United States Patent 9,487,797 (GENOMIC PLANT SEQUENCES AND USES THEREOF) - sequence listing, part 69

SEQ ID NO: 73809 - DNA, 29627 bp, Oryza sativa
acaaaaaaaatgtgaaacccgctcaattagttgaaatcttaagcataaagttttttttttcattaacaacaaacagcataacatttttttttcctgtcctaagaggaggtttcaagaaacagctgtctaactgttgtccttttttttttccttctctaacatgagatgcatgtatctattttgacaaaatccaacaatgtcagcaaggatataataatacgtcttcaacatatacatataaatgcataaactacattcctgctttcttctatcagtgaaatggcagagctccaacccattccctagaaaaaaataaactatattcctgatttgttcagatgaggagagacagacttgcaaatgctttattcatgctgcgatgggtcatggaacatgatatactgatgaaatactactgtgcaaataagaaaaatcatacactgttcatgactcgcatattggtagtcattccctcctcaatctttccaatctgggaaatataaggttatcagtatttgttgtaacatctaaggcagtgagcaagacctagtcaagcggttcaattttagctctgataagaaataagtagatcaatcatatgattgcaagcaactttccagtcccattatctccatttccgtccgctccaccaactccagcaacaagaatggacgaaggaaaatcagatgcctttatgattgtatcaatagtctcttgcaaatcagtcatcgcaccaccctggacaacaaagggaaaaacattgacaacatggaaacatgggttcagcgttatacatactgtgactattaacagaacgaagtatttctgctgattcatggcaagtgattggtttgctattgcagtagtagtgctaattactggacaaaatagtgttggccagccaatgatacattacgaagtgcactgatataaactgacataatcccttgtgttccttcaacctcaggaagtttaatatagtcaggcactcggccaataggcaaacagctaacatataatttcaagaagcattttaaaagcacaaaacactaagtacataatttcttacagaagaaaaggaaatgttctgtaaaccaaaataagatgggtgagaaaaggaagatttccacgtttgcttcccagatgtggtacttagaaattcttctacagaagatgtcatggtgattaaggtagcaaagagtaggatacctcaggttgatagatgctgccattcaggttgaaacagtggaaataggaaacaggacatcaataggtctagctccaaagcccccataaggggaatcgcttagcagggtcatagcattgtagtgcatctctgtttccagtactgcctgccaaccaacaaaaaaacagtggaagtacttaaatcaatgttgtcatatgaccatcagaacacaagaactaagagattgttacaaaccatttggccgaccagtgggttcgatgtaatgcaaggaatctggaagccatgggatttccatttgaagctacagagcacaaaacatccaagatttcaaggcaacgacttcaagacagtatgcgtttatcaactagagagctgacgatgaaatagtgggagggccagcaagaactagcacacctgtgaagtctatggctaccatgaaattcaattgacacccccctaatgagagagcacaagttagcattagattttgtccttaagaaaaaaagatagaaactcgccaccgctgcgcgcgcacacctaacctgcgccaaaaagcatgcgggtgctgtggatgccgcgcccgcgcggcgcggcggtggagctgagcgccgccgcatggctcgccgccccccgccgcgaggagcagcaggctcaattagccggctagccaacggcggccgcggcgcgaggcagggtgagccggtgaggccgcggcgcgaggcagcccgtggcagtggagcggagtggccgccggtgatcgccggcggcgtaccacccggccgccggcgagggttttgtggatggggtgcggcggtggctttggtcggtgggtttgccttgcctttgcctcgcctcggggagacttggaatgggagggagtgggccccactctctccctctctctctccaagagagtagtagtagtagtaggacaaaacaaatataatatttaaaaaaaaacacagagagagacgtacatcaccacccttggccttggccggcatctttcgcaacaccaactccgcctcgcctaaaacccttcctcaatctcttcttctccggcgccggcgacggcgttgcaacttcaacgatgggaagaagaagaagatcatcaagctagtttttctagatcatttccacggccctatccacagtttcgtcaccactctctctccaatccagtgcttgaacacagcaaaagctcctgctcgctatatctatctactccgattcaaaccccccaaaccccttccgatcgatcccttgctggtaggggtgaaatcgggtcgggttcggtcggatctcatccttcccatatcctaacccacattttataatcggaatcgggtcgggcacggatattatcggatacgaatagaagcacggataatatcgggcataaatacggaacgaatacgtaccaagacggatacgaactctatcggttacgaatatttattcaaatatcaagtcaaagcaacaaccaaatataccacatagacaatagccattcagccatttcctatatgtctattatgaatatattaggggcttatggcatcataatgcctatcagcaaaactgtaccaaagtagtagcaaaagtagacattcattgcttgatagcttcagactcaatgctgtactgatctgaactgtgaagtgaaggctagggtttgtgcttggcactttgtttggtgggccttttggatgtgggctggctgttgcctgttgtgttggcctgttgggcgcttgcctgttgggctgttgtccatctatccgagtaatatacggatagattatcgggtaatacccgcataatttcccggataatccgtatccgtcggataccgctctcccgaacccgatctcatatccgcaaaaaattacccgtattcgaaccctgtatccgtgtaagggtccgggtacccaaattcccgacccgaatttgacccgaaataatgtggccgggcgggcggtcgggaaatacccgccccgttttcagtcctacttgctggtacgcaaaaatgcctccaacgaagaaggacaagggaaaggaaaagattaaggaggtagaatgataatttttttaaaaaaagcttcatgatctttattttttttctgtttcttcgcgcggtagcttgatgtgtgtttggtttgtgcatttgaaattttgcgtgtttcttcaacagcccaagccatcggatgatttctacttggatctgggtgatcttcctaagagctatgccaatctaatgaaagatattcctcgtcgcttggaagaaattatcaaagctgaggcgccctccaccagtaaggggaagaagctcttcaagaaaatctcggggaagctatatactgcccagagtggcacatttttggttcatctcacgcctgataaggatactgcagattctggaagagtgtctctgctattccgctggaaagacttgtatttcgagggattttactccaagggtacgtattacggtatatctaatctactcgctttatcatgcattatattactaacttattaagaacactagccatactgcctcttgcttgctggatgtgccaattgttgttggttgatttggtatgtatagtgctaacacatggagaatcggagacgcacgattgcaatggcccttgtccaggagtgttcatgcatatgcaccgcttttgtctggaattgtttcgaattgggaggttaaatcgttgcaaagttggagtactacaagtatttgaggcctggaatagttttgagtttccaaattaagggttgtagttctatgaggcatgattaatgctgtagagacttgcattagcattctgacatgaaggatgcaattaatcatgtgacagtactatatatatactcttgcttgcatgcatgcatgcatatgtcaattgtggttggttgcatgcatatgactctcactgctgggctacttactagcacactgacacactggtgtggaggagcattgcattgcaccacacccccttttgtcaatttggagttaatttgtttaatttgggaggttaattaaattgttgtacattaatgtgtacaatattgtgttaattgccctatctgttgctttcgcagggatttggttcaggctacaggattttcaggcagaactccctcctcagtctcagttgccatatgctgccaagggtgggaaaggagtggtgattctctcaatcgaatctaactatgcagggataggaggaaataccatatacatgggctctgatgcattcgacaaatgtctgaaagcaatgctgagagcacctgacctggaaggtcataggctctactcggttctaaaatcaaacagagttctagctgtccctgttgtaggaatatctgaacctttaaggttccctcaattccaggaatgggttctctcaaccctctcaccacctcctaccgatgctgaccactcctcgtcgtctgatgatccttctcctggaactgatgctgctgaatcgtactctgctggaatgggtacgggcagggacaagaaggttcctgagaaattctccttctacttcacaaaatggggcacgctttctgaaggattgttgaacaatagtgttccagaagaatttagcacgatgtccattgatgagatggctgcacttcttggcattctccgatggatggaggggatgtcattacctgcaccaaggagtggaactcatgatagtgaggcctccagttccagaccaagcagggctaccaagggtaagcataataccagtaaatagatgatagctaggcacaagatgtcaatctggaaagagtttgaagctggttgcggacaactaaggttgatgtttcgatcaggcacaaacgtgcttttgtgattgagtgagaacatatgcatcacacgtactaagttttcaactcaaaatacatgcaaataagttgtaaaaaatattgttcgaacatggtaatttgcgtgtgttttttattctttttatgatgcattttgagacaaaattttaaatgactgtgcatatcatcattgcaatctcagattattttttcttacaacaaaagagaatggcggacgcgacagggggctgcatgacccacgttaatccgtcttatatattactctctccgttttaaattataaatcgtttttaattcgattagaatcaaactattataagtttaattaaatttatacataaatataataatatttacaacaccaaattaattttattaaatctgtaattaaatatattttcataatatatttattttgggttaaaaatgttattatttttttcaataaatttaattaaatttaaaataatttaactttaacaaagacaaaatgattatagtccaaaacgagggagtactagttaattatctgagtaattaagcctactaatccactgcgcgctgttcacgtacgtaagccatgaccaccagtccgagtcttgcaagcaggcactaggcctcacccatatacgacaagacgttagttagacagtttggtgaatttaactaaactaaatcatttctttgattacttacagtaataatggtaatttaatcaaccaataaaagccctgatataaagccctcatgaattttagtccccatggtataatggcgaaacatgcccaaaccatctactctagtcgatagtattgtgttactagtttatttcataagcacacctatatttaatcatgcatgtgtgttcagtgttcgccacttaaaaggatgaccatttaagcgcatgtttatacattaatataaacacttcctgatccttttcaagtaacgataattaacctttgtcgtaagtagcattttttttactactattagtttctataaatccatatagtgtaacattataagatttatatttctaaaattcactagaagaaatttttttataatgtataattaaacaacattgacctgatcgatttgccctattaatctttagttatttgagtggttttacgtgtaatttcaaggttgttttgaaaacacccgatccactttgaaatctaacaaaagcgatatagatacctatacaactcaccatatatatatatatatatatatatatatatatatatatatatatatatatatatatatcttaaactttaacatgcaaaacatgtaatatgacatcttaataaagcacatacgcattacatcatcatccacgtttaatttccttctagtagctagcttaatttcacatctagtactacgaccttccatttcaaatatacgtaatattggattagcatacgtacgtaaatattaggggtggttggatgacctactagctagtagttctaaaagctaagcgaataaatatgttttcttgaatttaacacaattttattataattgactggcataagagagaaaatatagaaactgatttgatttgatttgaatgtctaaaacaactttatatttgtataagacttagcaaatctatgaaatcttgatgaggggatcggagactaaagtacatgcaagtcacttgagtacgggcaagtgcaatgtaagaataacaattaattaaggaggaaattgataatattgccactcgatttgttgggcttttcaccctctgcgtaaggaggatttgagccctttttttcactgattagtcacatatgcatgaaaggaccaattaccaatgactaccgttattagttgcgttaaactggtgtcagttcaaaaaaccggcacctataggagctttggaaccggcatcaataaaaatttttctactagtgatgcctgttcgatcatccacctgctgccattagcaccagctaccgactaggagaagcggctaagtgctaccgtcttgaagcaccctgcccttcaagctcctcaatattccccccactcccttctaactgagctccacttattgtcagaagaacacaaggagaagaagcaggactattgtcgatcaccccaagttcccctcccctaaggatgttgagatgcgccaccaccgtcaagagaaacaccaaacctcacaggcaggggtggatctaggatttgcttggagggtggactcatcctcttcttctcctttcagcccccctactattattcccccttccctctcatcttctttccgtggggatccaacggggttgaggggactcaagccctccagtattcacgttggatccgtccctactcatacagaagtcctctagcatcgcttgctatgtctactatgctacttgtactgtagtgtaggcaggtaagttagggcaagagtccggcgggagtataccagaggaaggccggcattgagatgggggctgtcaaatcttggcgtgcggcacccgagtcactcaatttgttctcggctggtcctatggagacatagaagaagggagggggtgcgttatataggtatgtatactattgtataggcatcatcctctctatgccgaatatgtgcaaaatagtaaatcttcaaggtaacaacgaagtgtagcaaataattcattaatttgagcgtggagggtgttattttatcaaggccaagtggcaaaccgtcgattttctcttcattaagcagcctaaagatgcatttattattccgtttaattagctatcctggtgtttacatccaaatttggcacctatggacgaaatagaggaaaattgccaaagtttggagagtgccgggtttccttcatagggccggtcagaccagaggtatatgggcggtctgaccggctagtagggccggtctgaccacaggtatgtgggcggtcagaccggcagggtccgagtccgagtctgttttcgtcgggtctcgggtttccttgctcgggaaggcatgtttcgtgtttcctttggtttctatcccgagttggacgtagagaagggcctatagagggtaagaccaacccctatttaagggacaaggccggttcattgtaaaacccccaaatacaatctacttgaatcattcttttactatgttttctattttaccctagttttagtccatctttgtcggtttgcgccgtaaaccgtccgccgccgctgcgagagtgcgacacctctttgtaggtttgtcctgaaaaccttccgttttgcccacgagacgggtagttatcctcatatcgatctaaatcagcctagaggctgattttgatctctaaatcggctccgctagccggtttagcttttctttttgcaaaacccatcttgatttggccctttggttagatcgaggtggttggcgactccatatcaccgcaaggcgtttaggtgttgcgatcgtgcttgtcgacttgtcacaaaaagttgccaacacgatttttggcgactccgttggggaagagatccgttcatcgtcaactcaacttcgacttcgccatgatgaagccgccatccaagacggaggtggagccatccaatatgatcctggtcacattggatgacttcgaaggagaagatcgtaaagctatggaggagtacatcaacgagttcacgcaggaggcgttgatgagggcaagcactaggactcgtcaaggcgtgatcatcaagcccgggccacgtcctaagctcactcccgactcggtaagcaatgatgaggtatcacaatctatccaacaacaaattgcatctacaatagattcatctatgcttgtttttaaagatcaattagatgcaacttttgagggtaaatttgatgagtttttaagggttaaattcggccctcttttggccgatcacatggtaaaaaataaagcctcttccactactaatcaacctcctataggtcaaaccgaaggaacggcgcacacggccggtcagaccgcgacacagccgtcggtccgaccggccagacggccggtcagaccgggtattaccccggcggtcagaccgggactcaggccggtctgaccgcgcctctggacgccggtcagaccgggcattgggccggtcagaccagcgcaattataccaatacaggggatagatccaatgactaatgctaggtatttgtatcatcttagaacatctgatcctcctatatctactactacaagcaatccccaagttcccccacatgttcctaatgcctataatgatgttgctaggggatatcctcccgatactagacaaggccaatataatcatattgcgccacaaacacaacctattaggccaccaaatctaccgctaaatcaacaagggcctaataatatggaggatataattagtgatattatgaggaatagattcaggatcgaaactaggaatcgtgctagaacttacaaaaagccgtatcctgattattatgacattatcccatatcctcgtggttataaaattcctgaatttacaaagtttagtggtgaggatagtaggaccacatgggagcatgtagatcaatttttagcgcaatgtggtgaggctaattggaatacatgtaaattacgcttgttttctttatctttgtccggtactgcttttacatggtttacttctttaccggcaaattctatttctacttgggctcaattagaacaaaaattttatgattattttcacactaatgaaactgagcttaagttgtctgatttaacatcggttaggcataaatgcaatgaatctgttgctgattatatcaagagatttatgaatgttaaaaaccgatgttttaatttgaagataactgacaaagatttggccaacattgcatttgatggattacttgattctattaaagagaaattgaatggccagatatttcttgatgttgatcatgtgttgcatgaagttctggctcaggaaagccgagtgaatgacgatagcttacatgctagtttagatgaaagtgcaatatcatgtatagccgaaccaagcgatgtttcagattgtgttaatgatttgtgcaatgataccataacgattatagccgaaccaaatgttggttcggattatcttgctagcttgggtaatgatgcaacaatcattatagccgaaccaagcaacggttcggagtgtgttactagtttagacaatgatggaatagccgaaccaagtgatgattcggattgtgttgctagcttagagaataatgccattgaagatatagccgaactaaatgacggtttggattgtatcacaagcgaaagtgaaatagcattgtcacctaagaccgagtcacaaatcggtcgtgtggatgttgaaaagatgatgacaatgtcttgcggaatagtagtgaaatagaatccaaagtagccatgcatacatatcaaaggccgtatcctgaacacgtagattcggtcccatacccgcaaggatttgaggtgcccaacttcacgaaattcacaggtgagaatgctatgactacaatagagcatatcggccgctttattgatcaatgtggtaaggccggtagtgatgatttgcttaagttgaagttgtttcccctttctttgtcaaactttgcatctacatggtatagtttgcttgctcctagttcaatttctacatggtcacaaatggagcatgagtttcatggttatttcaaagatgcaagcttgatggagcaaagaccgattaatacttcatcggtcacttgtgaaactatttcggttacacctatgctaagaccggaattgttagtaattctctccctattaatcctattgatgttgataaaaagaaagggaaaaatgttattgttaaggatcctcggcccaagacacttaggatcaataatgcgaaggccgaagatcataaagttgcaaaggatgagtcatctagtatccaaaggaccaaaaagccgaagctcacttttgatatgcttatggctaaatacaagaaaggattagccggtcaatgatttgacaaccaaactagtgattcgaaaagaccaagatcatctcgtaggaagagatttggtcaaacatcaaagcaatcggagccatcaaccataccaactccatataaacctccaattgtgatgccatggtatccatatccaatgtcactatatggttatccttttatgtattacatgccatggatgcctcaattctctacgccgtttcatcaaggatgggaggaatcacctagggcagtaccaagtcattctaactcaagacaagaccgtttcccacaaaagaatcggtccggtggatcaaaggtgaaaaaggcgaagaaggtgtgggtgaggaaggaagccaaagctccggaggtcgttgctatcaaagaggagtctcaagatgttcatgtacctactggagatgcgatggaaattacgcaagcaaaggagatcgaagccgacgccgtgactgtcaacattggtggtctaaccgagatagctggccggtctaaccgccagactatggccggtctgaccaaccctcctggccggtttgaccgacggcttgtggccggtctgaccggacctagaggccggtctgaccgaggggcattagagaagagtgagaaaattgagagcaacacaggaggttccacttcgaccaaaaatatgaagaatcatcatttggctcctggaaaacaaccacagccgaagtggataccttccggcttatctcgctctcaaaacaggaggcttcagcgtcttcgggccatgggtaaaaaagaaaaggagaccaaagatgtggagaacaaaacatgtaacaatttagatcctcgaacgacatctaggcaagtgtggagacccaaagaggtaaaagttaagagaccggtgatttcccatagtagagataaatccaatttgatgagagaagaatcatcggtcattagagataagtctccttcgcatgatgctatggatgttggtgcggtgttcatcttgccttcgaaatcgtgcagtcgagaaagccgattttgcttgaggggcaagacattaatatgctcatgaagaaatcaagagaagatgaacggcgatggatacaacatcacatctttgagccgccgttcgtcggatgctaaggcaaggtatgggtttattgtgtttaccattatatgcctatgccatgttaaaacattgcttgtgtcagggttacgggttaggtataccccttacccttcgatatgcaccacatatcgacatggcatacccgcgcatacacgggcattatctgcatatactaaggaaatcttccacagtgtttaagtcctactcggacaagacagggtcgtcaatatatcgtgtagggtccgatgtctccgagttcgacttggagaccacttgatttgcgatataaaagggatcccctgggaggacctaaaggatggaatctgatagccaacacaacccccacagcctacgaagtcggagcctgcaggagccaaatcgccggggatctagtcgaatcaacttaattacgatctcgccgcttcatcgagttccattgttccctttgtaacatgtggttttccatcatataatcccatatcaactggattaggactattacctatcaaggggcctgaaccagtataatttttgtcttttattgcttgatgtcgtactacgtagatccttgtaccaacgtaccccaataccctctatatccggtctacgggtatcacccgtcgacagtggcgcgccaggtaggggggcttggtgctcaaggttttactactatgtcatccagcttcgtcgacaacagcgtcaacaccaacctcaaccacgggtttcctgcttcaacaacgttggtgtggactcaagtcggcgaaatcgtcttcccggtgtacaccacgatgccgatctcagccggtccatcaatgaccggaaacgagaacgcagtggctgcaacccaaggcgactccatgtcgaaggaccctcccgccgaagcagggaatggaacatcgacaacacccgagcttgagaaggattctaatgcggccgaaccttgtctttccgacaagaaccacgagccgacgagaacagcttccgaagcgacaaggtcctggtgtcctatccacaaaaccaggaaacatactttgcaagcctgctgggtcttcctcaatgcccacgccgaaattcgcgcctgtagagagcgtggaattcagcgcgtttctccaactcgtgatgtctattgtcctattcacaagacaaagaatcacgacctctcaagctgcaaggtttttctcagcgccataaagatgtcatctcctaaggtccagccatcaagcgtatcccttagagaggaagacaagagacagggaacgacgctgacctcagatcgattcgttggtgcgattgacatcgactcccacgaaccatcagttctacatctactcaaggactatggctcgtcatcaacgagtacaccatgcgaggtattggctatcgatgggaccagcacgtcagcacgcgctaatgccgaggcggagaatcaagtagttacaccggctcagcgcatcagtacccttaacacaatactgagggaggcaccttacgatcccgttctgaacgacgatcttgcgtggtggcaggaacggctacgagaatcagtaaccaacctcagccacacgttcgaaggggctgctgctgatgcacacccggaacagccaccaactggcggcgtcgatggcgaaaaccccgaacagcgggagtcaccctaccgagcaaccccttcaccccgcggcactggcgacctccgcgatcacctgaacggccgacgagaagcacgtcgcacacagggcaacgggagccgctctcgacatcacatcccttcacggcatcacgataatgaagaacgaggaggccgctcgaacgaagaccgagaccgtgatgatcgcgacaatcgtgagcggcgggcgccgggcaataccagtcgaggacgccgccataatggcgaagacgacagagatcggccccgggacaacgacggagggcgacgatgggattctcgagaacccggccgatgtcctcgtaatcctacaccagaaccaagcgattcttcgtcatcgtcatcctcttcttcatcctcatcgtcagatagacatccacgaaggacacacgatcgccgacaacccactgcccccagcgctgggtgtagagctttcggtcgttccctgcgtgatgtccgatggcctgagagattccgacccggaacaatagagaagtacgatgggagtactaacccagaagaatttcttcaagtctactccatagtactttacgctgccggagcagatgacaacgcattggcaaattatttgccgactgcgttaaaaggctctgcacgttcatggctgatgcatctaccgccctactcgatttcttcatgggcagacctgtggcagcaattcgtcgccaacttccaaggaacttacaagcgccatgcgatcgaagacgacctacatgcgttgacacagaactcgggtgaatccttgagggaatatgttcggcgcttcaacgagtgcagaaatacaatccccaagatcaccgacgcttctgtaatttgcgccttcaagtctggcgtcagagatcactatactacccaggagttagcgacaagacgcatcacaactactcggagattattcgagattgttgagcgatgcgcccacgtggacgatgcgctgaggcgcaagaacgataagccgaagaccgggggcgagaagaaaacagccacggacgcacctgagttaagcaagaagaaaaaccgcaagagtgcgaaaaggaaggctcaagcggaagttctcgcagcagaatacgctaacccatccaagcgcccagacccacagggtagcgacgcaaggaaagcatggtgccccatacacaagacggacagacattctttagaagattgcctcgtttttaaaaagtcgctcgagaagcacatggcattggaaaaaggcaagcgagtacgcgtggtcgagaaggacgcggaggcagctgctcaggaattggactcagcatatccagactctgacctccacgtttcacacatcttcggaggctccacatcgtactcttcatagcgagaatacaagaaagtggaacgtgaagtctgttcgacatggcagggggctgcacctaatatgaagtggtctgaacagaagatagaattttcggaagaagagcatcccaagactgccgttatcccaggacgctatccgatcgtggtcgagcccactattcggaacatcaaggtcgcgcgggttctcattgacggtggcagctcaatcaaccttctcttcgccagcactttggatgcgatgggggtcccacgaagcgagttgacgcctaccaatcaacccttccatggaattactccccagtcctcgtccaaaccattgggcaaaattacgttgcctgtgactttcggccaagcaaacaacttccgaaaggagcagatcacctttgatgtcgctgaattcgatacagcgtataacgccatcatcgggagaactgcacttgcgaagttcatggccgcatctcactacgcgtatcaagtgctcaagatgccgggaccgaagggaataatcaccattcaagggaacgcaaagctggcggtacaatgcgacaagcggagcctcgatatggtcgagcaaacgcccaacccacccgccacaactgagcctcccaagaaagtgagcaagacaaataagacgccgaaaccagacggcgccatcaagatcgttccactctccagtgccaaccccgacaagaccgtcaagatcggggcatcactaagcgaggaataggaaatcgcgctcatcaccttcctccgcgacaatgctgacgtgttcgcttggcagctgtccgacatgccgggggtccccagggaggtgattgagcacaaactcatggtgcgacccgatgccaagccagtaaagcaaaaactgcggagatttgcaccagaccgaaaacaagccatacgagaagagctcgacaaacttctcaaagctggctttatcagagaagttcttcatccagagtggctagccaatccagtcatggtgcggaaggccaacgggaaatggaggatgtgcgtcgatttcatcgacctcaacaaggcgtgtcccaaggatcacttccctcttcctcgaatagatcaactggtggactcgacagccggctgtgaactgttgagctttctcgacgcttactccggctatcaccaaattagcatggtgaaagagaacgaagagaagacagcattcatcacgccgttcggggtattttgctacgttaagatgcctttcggactgataacagcagggaatactttccagcgcacggtccagggcgcacttagtgaccagctcggcaacaatgtcgaggcatacgtcgacgacattgttgtcaagaccaagacaagcgactcattgattgacgatctgcgggagacattcgacaacctacgacgatatcgcctcatgcttaatccagagaagtgcacgttcggagtaccgtcgggcaaactgctcggtttcctcgtctctggcagaggaatagaagcaaatcccgagaagatcaaagcaatcgagaacatgaagtcgccacaagactcaaagaagtacaaaagctaaccggatgcatggcagcactaagcaggttcgtcgctaggatgggagaacgaggacaacccttcttcgctctgctgaagaagaaagacaaatttgtatggacacaggaagccgaagaggcattcgttgcactcaagcgctacctaacaaacccccctgtacttgttgctccccaacctaatgaagaattatttctttatattgtcaccacgccatattccgttagcaccgtcattgttgtcgagagagagaaaatacaacgaccagtctactacgtcagcgaagctctccatgacgcaaagacaagatatccgcagattcaaaagctgctctatgcagtaatcatgacatcaagaaagctacaccactactttcaagcccacagagtcacagttgtctcctccttccctctcggtgaagtcgtgagaaacaaagacgttgtcggccgcattgcgaaatgggtagtcgagctaagctagtttgatgtccactttgtgccacgaacaaccatcaagtcccagatactcgccgacttcgtagctgattggactatgcccgacaacaaatcagacaaccaaatcgacaacgaaacgtggacaatggcgttcgatggtgcactcaacagccaaggagcaggggcaggattcatcttgacatctccttctggagatcaattcaagcacgcaatccacctcaacttcagggcaaccaacaacacggccgagtaagaaggactactcgccaggataagagccgcaaccgcatttggggtcaaacgactgatcgtgaaaggggactccgaactagtcgcgaaccaggtacacaaagattataaatgctccaaccccgagttatccaagtatctcgcagaagttaggaagcaggagaaaaggttcgatgggatcaaggtccgacacgtataccgcaaagaaaacgtcgagccagacgagctagcacgacgcacgtccagacgagaaccactcgaacccggcacttttctggacatcctggcaaagccatcggtaaaagaggtcagcggcgaagttaacccagacacccccgacatcagctcggaggccacagaggcagaacgcgccgttgccgatatcaaaaccacagacgactggcgcaccccactgatcaaattcatcaacagcgacgagttgctcgaggacgatgcagaggccaagaaaataacccgtaaagcaaaaatctatggcacgatcggcaatgatctatacaagaaagcgccaaacggggtacttctcaaatgagttccgtccgacgacggcagacacctcctccacgatatacacgaaggcatctgtgggtcacacgccgtcggtcggacgttggtcgggaaagcttttcgacaaggattcttttggccaacctccctcaaagatgcatgcgacatggtccagcggtgcgaagcctgtcaatttcacagtaagcacacaaagctacccgcgcaagcgctccagactatccctctcacttggccgttctggtgctaggggctagatatactcgggcctttcccatgaggacagggcggctataggttcctattcgtggcgatagacaaattcacaaaatggatcgaggcgatgcccacgggagaaatcaaggccgacaacgccatcaaatttatcaaagggatattttgcagatacggactaccacatcgcatcatcactgacaacggctcccagttcatcagcgccgatttccaagattattacatcaggctgggagtcaagatatgcttcgcttcagtctctcatcctcaaagcaacgggcaagtcgagagggcaaatggcatagtgctacaagggatcaagacccgtgtctacgacaggctcatgtcacacgacaagaaatgggtcgaagaactcccatcagtactatgggccgtacgcaccacaccgacaacgtctaacaaggaaacacccttcttcctcatgtacggctctgaggccatgctccccagtgagctacgacatcaaagtacatgagtacagaagtactccgacgaggatcaggaggaacagcgaaacgacgatgtgaatctactcgaggaacatcgcgaacgagttgccgtccgagcagccggttaccaacaggccctccaccgttatcacgagaagcgcatccgagcacgcatactttcgacgggttcaaagccaagcagggcgaaacaagctctcacccaaatgggaaggaccttacatgatcacgcaagtcttgcggccaggcgcattcaagatagcagatggcgacggccgcgagttggcaaattcttggaacattgaccaactacgtaaattctacgtataggtcaatatcatccatacctgtaagacaccttacagtatcaataaagcctatgttcgggcacatattacaattacagtgttcatgcctgatgatcccttacccagatgatacctagcgttgaaacctatccttatgtccctttacaccgtcctgacaaggcctccgaggaacctaagggatcctcggctggggacgcccagagccgataaggtcttgtcggatcctgtagagacgaaagaccatgtaagacctggtcgtgtaagagttctcgccgtgcgtattaaccaagccgtgtaatcggaaaattaactttccaacttcacggctgggggctaggatcagtgctttctcaaccaaggcaggtcaaaggtctaagagccttgtcccccgagaagtatcctccgacgacaaggctgggggctagggagagtgtacgactcaaacgactgaccaaagtcgtgaactgaggaaacactcttacacactatatccagagtaagaaagattcaccaagatagatttcttccctacttcgcaaaatacttcttacaattatatacaaatccagaactttattacattctttccctaagatatctgtcacagggtacgaatactaccaagaaggccaacgccagtccatagactggaaaaccttctccgctaacggtgccatcgacttcgccaggtggtctatctccgcaggagtcctctgagaatgagtgaatccttcatggagaaactcgaggtgcagttgcggacgatgatctcgtacacaagccaatacatgccctcctgcatatcggctcgatcggcggcattcctgtttcagagcctcgtcaatccgcttgccaacgccctcaagctgagtacaagccccattcaaccacgggatatatccggctgctgactcctcgggatccccgcgaggtactcggagctctctgcaaacttgggccatggacgtgcagcaactcttcaggtatgagttgaaccacacctcacgacctcaaagtgtttccacggcctgctccttctttacttccaacatggctctctcgagttccaccacttcaaatttcgtcttccaatattggatacgacgatctcggtcagcaagtgcgttctcgaggtctgttcgacatggaaacgactacgttaggctgctcttctctctcgagaacacggttgatcaagtcggaggagcgaaaaggatgaaaaggccaccaaccaaaggaagtcgtcgccgtccccgctctcccgggtacaatgtcattcacatcgtccagcaacgcgtgtccctcaaacgcaagaatcggagggatcactggcgactcaggttgcccgcgctgctggacaccctcgtcatcagcatctctacaaaggacaaaaattcccgaggtcaacatacaagggcaaactagaatgataattgcacgtattctgaggcggtccaatttcaagttttacacagcatgtcttggaagtacaagaagacctactcttcaaatagggggagaacagattccccagatcaccgacttcttccatcacctccttacgcgtggtactagccgccccctgatccaagatctcgcgcagatcgagttcaggacgcgatagctttacgcacgcaaggacataacacgccccagtgtagatcccgttcgatgtctcctctgcgaccctggccgcatgcttggaggggatctccgtcatcgccgtcaatagtaccgcaagggaggaggtcagcgaaaattcgtcaggattcaccgggatggtagacttgatgccgcactccccggcaagctggtgcagcccagtgtaggtgacccgcaacgagccctgaatttccgacaggttgtgcccgagttccgacatgcggttctcgagcccctaccgttgtcgctcgttgccggccaccagttccctcatcttcgtgaggtcttcatgagcttccgccaactcgcgcaccaaccggtcagcacgcgcgttcgccaacgccgcttctgaccttgcctctgcaacctcgtggccaatgctgcgggcaccagcttctaggaggcgccccatttcgacttggagctcctcccaggcgaggatagcagtgggcggaccacgacctgccgcgggatcgctgactgggccactaggcgtcacctcccggctcccagctgcgagtacgacatccgtcgaggccgcggtaggcgaggcgctggaagcccctcctgacttgctctgcgcggcctttgcccacgcttccctatgggacgaccacggatcatacaacgcttgaacagaatcatgggaacttaaaaacccaactacttacttctcgccgatcgtcacaagacgttgtcgtcgcggaggcgggggagatgcgtccaaagcctgaaagacaaccaacgcgaagtaaggcaaaatccctctggctgcgcgatctggcgataggataacttaccgagggggtcggcgctttgcgacgatgtccgcttacagaggagaacttcctcccctttgtcggagcattgccaccactagtagtggccgcagcagcatcagacgcctccttgacaaccttctcttttagagacgccgccacctgatggtccgcgagcggcccgatgatgtcagtcagaggaagagcctacgcttaatcaagtcataagatgatctcaagaggaaaggcgggatgtccatcgagtatacttacgttaatagcggcatcacgctccgtcgcccccttttcacaaaggggcacggggacgtcactcgccgttgtcggtccactgatcattaactgcccgacttggcgctccacggccctactgctcaaacctgtgaatcgaggaccaagtttcgataaatcaagaggaatgcgaacgtgagtatgtcaagataaatacgagaaagataccccgaggagaaacctgggtcgcgtcctcaggcctggaatagttaaaggctagatgggcccgagcctggagcagctggatccgcctaccaacgaagtccgcaacgacttcataccccgacaagccccgcactcggagatcgttgatgaagtcgataaacgactgaagaaaggggtcaaaggaggcttggcggtccaagacgaaatcttgcccggttgttctgtgggaacgatgaagacagggttcgaatctttgacctcaagataaaaccatctattccgccatttgttgcgagaagaagggcactagaacgggatataacgcgacttcaggccatctcgaagtcggaacccaacggagccagataccctgttggactccatccaacgcagttcgtagtagaagcgaaaaagatcaagaaaagactctaccccaatgtaagcctcgcaaagatgagcaaagatgctaagaaaggcaatagaattggggttcaaatgaagaagagaaagaccatagaagttcaaaatcaggaggagaaattcggaaggcggagggagaaaaccgcagagaacatagtcttcgatcgcaaccatgcgacctaagacgggctggggattagtacctcctgcttccctctccatggctccacgaccaggaagggcgccgtcttcctgaagctccttcagcgatgcgctggtggaagatgacttgccgaggtccatcgctgatcgaagatcgccggtgaaaggacctaagttgctgaactagggtttttgcgggagtggagaagacgagaggcgcttgggggctggagaatttttccactacaggcggacttcaaatgaatccccaaaactcccttaaatagacgcacttccgacggtgcgaattccaaggaaagaagagagatggccgccggaaatttctgggtccgttacgcgcggcggtttttcagactttagtttaaactcactcgtgaccgttgggcttcacacggtgttctcgatcatgtcctgtctctacggttcccacaccgagaacgacatcagcctcgacatcagaagtcgttattggtcgcacgggttcatttaagcagaagttgggggctactgtcagggttacgggttaggtgtaccccttagcctttgatatgcgccacatatcgacatggcatacccgcgcatacatggacattatctgcatatactaaggaaatcttccacagtgtttaagtcctactcggacaagacagggtcgtcaatatatcgtgtagggtccgatgtctccgagttcgacttggagaccacctgatttgcgatataaaagggaccccctgggaggacctaaaggatggaatctgatagccaacacaacccccacagcctacgaagtcggagcctgcaggagccaaatcgccggggatctagtcgaatcaacttgattacgatctcgccggcttcatcgagttccattgttccctttgtaacctgtggttttccatcatataatcccatatcaactagattagggctattacctatcaaggggcctgaaccagtataatttttgtcttttattgcttgatgtcgtactacgtagatccttgtaccaacgtaccccaataccctctatatccggtctacgggtatcacccgtcgacagcttgatatttagcacatgtgtgttttgcttatcaaatccatattatacatacatgttgcaaatgccagttctaagtggtggaattggtaggttggcatataatatgtttgaagtatgatttggctcatcagtctttaatatttatttaaagccaaatcgtatgtgtttttatgggtcaccatataagatatagatttattgcaccatgaaagttttgcttattagtaattcggctaatatcaatggtcaatgtgatgatttgttttagagttattttatttaggaacattggcattgttaatattttgcatacacgctcaagccaattacttacatttgtagtttattggaatctatgcatgtgacacatatgactttggtgattcattattgattatacttcaattggctaagtgttttgatgccatgatgattattgttttaaaagccatttgaattagtattcatctagacatgttagttggatgttatagtttttcatatgtctatagagaagaaaatttggtccaatagtttgatacaccaagcatctggctattatgtgaagaaaaattatatactaaaggccgatgcttgatttcaaaggtttggacgaaattggcaaagtcatagaccaggggcggtctgaccagcattgcacggccggtctgaccggtggtaccggtggtctgaccggctctggatggccagtctgaccgggcagacagggtggtctgaccgacattgcgtggccggtctgaccgatcccagacagaaggctgggggcacattacagttgattaaaaggccgaattaattgtgaattcggacatttgtgcccatgagttagaaatagcttggagaattcctttgattagatatttgaaagatcctacacttaaggttgattggaagattcggcggcaagcattcaaatattatatcgccgaaaaatagatggagtattgttgaagtacttagataatgatcaatctaaagttgctaggagaatagtacatgaagggatttgtggaattcatcaatcggcccgtaagataaattggttgcttaggagagtggggtttcattggccgaaaataattgatgattgtttcaaatactatagagggagtgaagcttgttaacggatcagcaatgttcaattagcgcctaccgctgtgttgaatcctatcattaaactatggctgttccgaggttgggctttggatttcattggtcaaatttatccttcgtcatcaaaggggcatcggttcatgctagatgtaatggattacttcactaagtaggccgaagccgtgccgctcgagaatattacttacacggaggtaattgactttatttttgaagcatattgttcatagattcggtattccttaaactttgatcgaggagcttcttttatgtctaagaaggtgagaagttttgccgaaattttatgatattaagttgttgagttcttctctctactacgctcaggctgatggataagccgagtcgagtaataaaacattgttgaaattgccattttgccagttgaggtaaatcttggctttcttcggtattttaagaaagacgacttatcgattgaagattacaagaccttgatgggaagcaattttgaagacgtcatcgacaagcgtttgaagactttgaaggagatgaagacacttcaagacggtgttttcaaagagcaattaatgggaaatacttaaagaaatacttcccgagcatttggtaagatgcttaggaagtcctatggccggtaattggattatcgccctaagacaatatgttctatgcttttagattcacgatattcatcaaaaaggcaggggggcatgtgtttacaccaaaatttggcacctatggacgaaatagaggaaaattgccaaagtttggagagtgccgagtttccttcacatggccggtcagaccgtaggtatatgggcggtctgaccggctagtagggccgatctgaccgcaggtatgtgggcggtcagaccagcagattccgagtccgagtctgttttcgtcgggtctcgggtttccttgctcgggaaggcatgttttgtgtttcctttggtttctatcccgagtttgacgtagagaagggcctgtagagggcaagaccaacccctatttaaaggacaaggccggttcattgttaaacccccgaatacaatctacttgaatcgttcttttactatgttttctattttaccctagttttaatccatctttgtcggtttgcgccgtaaaccgtccgccaccactgcgagagtgcgacacctctttgtaggtttgtcctgaaaaccttccgttttgcccacgagacgggtagttatcctcatatcgatctaaatcggcctagagcctgattttgatctctaaatcagctccgctagccggtttagcttttctttttgcaaaacccatcttgatttggccctttggttagatcgaggtggttggcgactccatatcaccgcaaggcgtctaggtgttgcgatcgtgcttgtcgacttgtcacaaaaagttgccaacacctgggtccaagtttaactgattaattataaataatctttctaataatgagtattgtagtctctgtagatctacgtgagtacgtgcataccccctcgtcccaaaaaagacaaaccttgggtttccgtgtccaagtttgaccatccgttttatttgaaaaaaatatgaaaaaaattaaaaagataagtcacgcataaagtattaatcatgttttatcatctaataataataaaaatactaattataaaaaaaatttatataaaacgaacagtcaaaagttatacatgaaaactatggtttgtttttttaaggacgaagggagtatcatgcatggcagaacagattacgttatatgggctaagtacgtgtggcgcatgcacttaccattactccattctactcgtgtcccgatcgatcgagctggcaagtggcaaccacacgcaagcaatacgtacgtacggtacggacgtgtcgacgtgaccagagtgtcacggcaccacatgcttagtactgtttaaaacgttttgattttgatcaaagtttcaattttaaagtttaactaagtttataggtaaatatagttacattaataaaactaaattagtttcatcaaatcagtaattgaatatgacggagcgtggggctcctcaccgggagaccgcgcaggcccccctttgccggttcggccgggggccctgggtgagattctaagctcctagtctgtgtgtggaaggttcgcgagaatggaaaaagcacaagacacgggcgatgtatacaggttcgggccgctgaaaagcgtaataccctgctcctgtgttttggtggatctatgtatgaagaagctacaaaagagctggagaaccagaaagctcttactctctccctctctgatcgttctgtatccgaaaaaatcaatcccccttctaagtgggcaaggtcctccttttatacctcaaggggataccacatgcaccatctctctcttttttttttgtggggacttatcctctcttttcataaacagacggagacttgtatggttgtcgtccgagtgaccttctgatgggacggcccatacctacctccacttccgccggaagcaggcgcgacgtgggaacatggctgtctgctgacgacatgaccagtgtcagaccggtcacaaatcggtcattcttgtccaccacgcgtcagtttatcaatctgcatgttcgcccctcttcatacaatgtcttgcttgtaatggttaggatgaagcctggtatatatctgaccgggaccaacgtgccatctccaggagctaacacgccggctctggctagggacgagtgcttggaggctctcatcctgatgggatggggcgaggcgtgcgtcagaccgcctgtcgccacctaacccacgatctgatcggtctgtgactggtcacagaccggataaacgagcgcgctgcactgcgttacatgcggcgtgacgcgctcgtccaaaccgcaataaatgtggttaggtgagccctgctatgctcacctaccccgtatacgcggcgcaaaacccacaaggggtcggggcgcctcggccctcgaggccgagacgggagcggtccgacccctcggggagacaaagagaagggcggccgtatcaccctcgggcccgacccccccccccgagggggttaggccacgtgggtgatcgtgtctgcctcaagtctctaagtcatgatactcccggtcccatgtcaccgacagtagcccccggcgttatgccagggcgatcgccctcctcgagggaagcggtcgggcgtgacgccacttcctaaggcctggtgacaggtggggccggtctaaaaatcgggacaagccggttcgtttttcctggagatatggtgatggcgcttcggtcggcgagcgtaattaacgcgcgcacgagatgttccatctcgactgccacagccgcatatccacctcatgcaccgcaaacgggcgaatgggattagtggaagcgtgggcgcgagaaacgagggggcaagatagtgggcgcgagaaacgaggagccgggcacagcgttggtaagggtataaagtcgccgaggaagagatttgcttccttcctctcgccattattccccttgtcttcgccgcttgcgccctaactccttgtttcctgtgccctaccttcgccacacgcgctcgctctcaaacatctcttcttccagcgtcatggcacggggctccgctccgcttgacggtagcgtgctgccgccttcccgcatcgtgagcgagagacaggccgggctgccgcgccgcttcatgccggaatctgccaccggccgggagatagtctcgctgggcgagagatgcccggcgccacgctactcggggtggtccgtcttcttcctcccttttgctatggcagggctggttccgccattttcttctttcttcatggatgttatggagttttacgatctccagatggcgcacctcatccccaacgcggtaatgacattggccatcttcgcgcacctatgcgagatgttcatcggggtgcgcccatcccttcggctgttccggtggttcttcaccgtacagccggtgtcgccgccgtcggtggttggtggttgctacttccagccgcgggggccggtgctgaaccgctacattccctgcgtcctccgcaagaagtgggatgactggaagagcgactggttctacacccccctcgccgacgaagcgcgcctccgacttccgagccagcctccagcgcaggcctccagctggcgggcgccggtagatctgggagatggctatgtcacgtcccaaatcgaccctaaaattcatcctcgaaattgtgcaaagaataattaaaattcatgtgaaagcctccaacaattaaaatgtgcaaatctaaaagtcaaataaggcttggaggatttttgtatatttcctaaaagcctaaaatgcgtaaataaattttagtggaattttcagagcacaaataataattgaaaagaaataaacaaagtggaaaaggtttataaaaagaaaaaaaccctaaaagaagtcttctttccccccttcccttcttgggccggctcggcccaatcctctccttccctctctctctctcctttcccccgcggcccatcggctcctccccgcgcgcgcgccgctaacaggcgggcccgcccgccaccctcgctgacgggtggggcccacctgtcatcccccacctcgcgccgcgcccgccgctcgcccgtgccctagcgccgccgccgtcgcgaatctcgccgcctcccgccgtccccgcgcgcattaaagaggggggaattattccccacgattccctctctctttcccccggg

SEQ ID NO: 73810 - DNA, 53364 bp, Oryza sativa
  unsure (1)..(53364): unsure at all n locations
gaccgcctccgcgagtacttctacaagtacggcgaggtggtggacgccgtcatcatgcgccaccgcgccaccggccgcgcccggggattcggctacatcgtcttcgctgaccctgccgtcgccgagcgggtcattatggagaagcacatgatcgatggccgcatggtaattaaaatcaactttgtttgcttacatcaacatgtttgtgttaagattcatgatgatgatgatggtgtgctagatccatccatggtggtatgtaatggtggtttgtaggtgttactgattgttgtcgtttcgaggaattcagaatgttttttgggattttttgttttgttttgttttaggtggaggcgaagaaagctgttcccagggacgatcagcacgctcttagcaagagcggcgggagcgctcatggatcgccggggcccagccgcaccaagaagatattcgttggggggctagcgtccaccgtgacggaggcggacttcaggaagtactttgagcagttcgggacgatcaccgatgtcgtggtgatgtatgatcacaacacgcagcgtcccagaggttttgggttcattacgtacgattcggaggatgctgtggacaaggcattgttcaagaccttccatgaactgaacggtaagatggttgaggtcaagcgcgcggttcctaaggaactatcacctgggcctagcatgcgttctcctgtcggtggattcaactatgccgtgaacagagccaataacttcctcaatggatacacccagggttataatccgagcccagtcggtggctatggaatgaggatggatgcaaggtttgggcttctatcgggtggccgtagtagttatccttcttttggtggtggttatggagtcggtatgaattttgatccagggatgaaccctgctattgggggaagctcaagcttcaacaacagtctccagtatggaaggcagcttaatccatactacagtggaaattctggtagatacaatagcaatgttagctatggtggagtcaatgacagtactgggtcagtgttcaactcgctggctcgtaatttatggggtaattcaggtcttagttactcttccaactctgcaagctctaattccttcatgtcatctgccaatgggggccttggtggaattgggaacaacaatgtgaattggggaaaccctcctgtgcctgcacaaggtgctaatgctggcccaggctatggcagtgggaacttcggttatggatccagtgaaaccaactttggtctcggtaccaatgcttatggaaggaatgctggatctggtgttgttaatacattcaatcaatcaaccaatgggtatggaaggaactttggagattcatcaggaggaggtggcggtggtggcggtggctccatctatggagacacaacttggagatccggatcttctgagcttgatggaaccagcccatttggctatgggcttgggaatgcagcttcagatgttacagcaaagaactcagcaggttacatggggcattaacaaatagaggttagatatattcttaatgcttatgttctgtttatctaaagttccattttgttgctggctagtgtttcaaccattaccttcatgtggtgccgctatgatggtagcaatgtgaaaacagtgtctttaaatattgaatattcattctgctgaaacaatatcgctagatgaacccatgcatattcaatgcttatataggaaatgtttttaccattgcaaatataatgctagtgttagttgtcctaggaaaatactggatgacactgatcattcaagcgtggtaacaccacttggcagtttggccttttatagaaaaacaagtgtgtgttttttactgcttctggagtatgttagatatttactcaatgttgcaactgttacgttaaaatgcgtatgatgattctctgaatatttcattctttggttggttattgcattatttatgaactagacatcaatttgtttggatgattcacccatcaacgtttaggcatgctgtccaagtagtacaacaattaaatttgtagctgtgaaaacagaagctatgcgtccagttttgacctgtggttcgtaatagatagtaacacttgcttggtgtagaaactttattcccttctccaattattgaactttttgtcagtgcttaatgtgttatgtgtgtagcgtcccatcaagctggagattctagttaacatattcatgacggtgttatatttagacattaatatgcctgtgatatatccaatatatagttcaaaagtatacatttgttccatgtttggctaccacctaggtatactagggtcatgggttcagctagctgtttagtctttttggatgttcttagctttctagttgttaggttatgtcaccaactcaccaaacttaaagtatctgctaagaattataaggtacttaggaaaactgtgtccctttaataactagttttttcattgattccagtctcaaagctggaaatcattaactcgacaaactaatcttatttatgattagcttctgaaatatggtgcaaacatatattttagattcagaataattctgaagtgcttcaataacttgaaatttcgttgcaaatgatatgtttcagttcttatcagaaattcagtattctgaattcattgctcttaccacaactaaccatgacataacattttgcttgtttacgcaatgcaaatattaattgtggtagtccttggatgtttggtagcttgagtcttcagtcatacggtagacaactttgcatcttagataaatataaatggcctaataagattttggaaacttaagcctgacctgagtattttattttagagaatgaacttcttaggggcactggtgtaataatttttttgtcaaagcattcttcaagttgatttttgttaaaaaaaaagatcaattattacaacatgcttgtactcatcttattttgaatgtatgcttttcatcttcgttatattacactgctaaggacattactgaaactaaaccttattttttgtgctctttgtttttctgcatgcattgcacaacactatatatactctctaacttttatgttctcctgtgcagcaatgtcgccgcctaggaatctttttcacatacaacatttgtcaaaataggttgaggagagaaccacaggtgcatcaggtgcaaattttgaacctcacatgatttacagaaatgggttagttaatagagctaaccaccagggatttggtcaatgagatcagatatatatcctcagagaaccatttaaacgtatttccattttatgtaaggtttgagattgtggtttcggatttctacagcgagtttaggttttggcaaccttgtgttttttcttggttgagatgtgaagtaagattgcgggatatatatatctgaagagtgttcagttgtacggcggcgctgcccccatataggcccccctttttgggtttttgttcttatagtagaaactgctctagcgttttgcaaattgtgtgctagctgttgttatcaggatgataatttttttccccttcttggtttttatcttactgaagtgtatgtaccagagatcttgctggtctgtgtttttcctagtggaacttttaagggatgccccttctgggtctcaaagaataataatgctacattatattctaattcattttgaggctttctaaggctatatattatttgtatgtaccctgctggaacatctgtacattctgatgctctttgcaatttgcctttgtgctgcttttgcatcttctcttctgggtctgtctagtggtcagtgggtgatgcctggttcttctaccatgcataatttaccttgtataatgttgctattgtaccatctcttcatgtgccttttgatggctgggctacatggatgatggctctgcaggctgcagccatgcttgaggattgtgatgttaacatataataatatcttcatcttgtgatgtacagtaaattaccagctttttttttaaaaaccccaaatgcaagggattcggtaattgatatgtcaatcactattccttctgataagctccagaattttgtaggagagtcatagacagttgagtttgtgatttgtgaatagattagaaattaagtagttgaagttattaatagattagaaaatcagcaacctgtcatgagaattaggaactactcccctcgtctcaaaatataagcattttttactctaacacggtctccgagatgctactttgaccaacaatatctataaaactaagatgttttaaataaaaaaagttgcatattatgatattttgtttaatgataaatctagtaaaatcaattttacatgattgatcttttttataattttgttattaatagttaaaattaaaaatgtttgacttgtcactatgctaaaaatgcttatattttggaatagatggagtacctgtttactccgtatgtgataggtgcctgatcttttaactcttaattattgattttcatatgcagcccaacctaatttttcatgcttaatcaacggtttggtatcagctttcaattcttctagtgttaatgaagttgcttcaactgatgagcagttaaaaaaaattatgaacaatttcttacagcagaattctccatagatcgcttactgaatgtagcttgtcagaatgaaaacagtcacttagctcttgcatgatgtgaaacagcgtgctcgccaaagaagttttacaaattcagagtgaagcagttgaaaagaagttatgccccaatgcaagtttcctttttttttaaaaaaaaaaatcatggcccattagagaactacatcttttccataattccaaccaacttgaaaaggcattttgcaaattcaattgctccatttgaaaaggaagattaccccaagtttttttaaacaaaaatacatgacccaagacagaattgtgtcgtcataattcatttgcccatagaggtagagaattaggtggtagatttttttttttggggtgtagaaatcgatccatgcaagcaaaacaaaggtgctttcctaactggaccactgctattaatagacaattctttagaaattatatagcaatctgatttttaatagttgatgctattgatttttcgatatacattttgaccactcatcttattaaaaaaaattactacctccgtctcaaaacatattgtgccaaaacataacatggggcagaggcagcatgtaattgtcatttattttattgtgacttgatttatcattaaaactactttaaccataacttgcattttacatatttgtataaatttttaaataagataaataatcaaatgtatagataaccgtcaataacatcttctattaaagcaaaggaagtaattgttatgatgggaagaaactgtcacttagggtcctttgaatcaaacaatttatgaaggaatttgataagatttaaattttattaaaaaatatatttggtcctttgatataaaggattggagctttccaaatcctataaaatcctattgaatggctcatcacatctagattttggtgaaaaattagcaaaaactccaacatcttagaaaacttcctttgaggcttatctctttcatcctattctttttttccccttatccgatcaaacaattattcatgtattctctttttacagaatcatatgtcttttctacgttttttctattctgtttttccattcaggttagaaaagggccaagcaagtaatcattttcatgtctcgatcccaatgcctttatgattctactctggttccataattcgtgacgttttagacattgacacagtctccaaaatatatctgactatgtttttctattataatatatgcaataaataatttttcattttattataatacttagtaaaacgaatctatatacgttgttctagtgtctttaaattaaaaattagattaaattagaaattatttatagttaaagttataaaagtttggcctcaacgttatccgaagcatctagaattatagaaccgaccgaaccaaagaattgaattatgaatccaaagggagttcagttaaattgaaccacctaaccctttcatacttaaagggaactaactaaatctgtttaggtctgacagataaagtgctaaatttgtttagctctgacagataaaggaagacatgatcatggcattctttctaccgtgaatgatcatggttgtgactttttgagaaatcatgcaaatggtggagacaggatataagtttcactgatacataaatcactaaaggtcttctgaacaaatccagactgatgtagaagttccaataaatacaagtagtacaattcctgttctgccaaaaaaaaacattctctgaaaatacagcacaacagagctcagagttgctagttcaccaaatctcctagaatctctctattcaggcattcagttctgtaagaacccttttggtgcattatacaggaaagattaggccctcaattttgttgcctacatgaattcaatacccaattaattggtagctcccattgataagctgcagactctatcttcatctctttcaatctttcttgacacggttccgagccgccttggctgagctcgatcgctctgactgcgagaacatgatgaagacatgcatgaccgccgtcaccagtgcgagcccaaggcccgtaaacccgactcctttccatgtcgacaggagttgagtccataggaagagcttgacggcgccatataaaaggagacatgaccaaaacaaagtcacctgttacataagcagaattagaaagtcagtaactaaccaaacactagtagcatatacatacaagacgtcctatggaagttgctacagtaattgtattggaccaaacaaggaacagttctatgcaggcttgcagcaagtacttgagttttgcatttctatcaccaacagtgtgttcttacggtagtcccagcaaaacacctcccctgatcctctgacttggccctgacaaaggaaggggcttcgacccaagttttcagtttcagaccagacaaaccccaaacagcctgatttcgaattttaaaaaagatgttttctataaaattaaactgtttttttttattttgacttgttgagcatggaccaacagactttgagctaacccaaaaatattcacagttggtacagctgcaaatactgccactagctagccatgctcactgaaatttgtcttctgctcactccaaattgcccctcacactatgcatctccagttgtgagcaaatatatcacaaccatggtcaaaagggccatttctatgtttttatttgcctgttcacactcagaccgtactggtatgtctgcacactgccattagccctaggttctaacctagagactatcttttatgcaattaagtaaaatgctccggtattgagattttaccagcaatgattttactgggcggccaattggtctaatctcctcatcaaaagtgcctgtcgccaaatgcttatccagtaatgcatcctgtagttaagaataaaggaacatacaacatttacttcagaattaattgatcgaccaatgcatttggcattttaactgtaagatgtctaaataaaaaatatatatagctcagcacctttgctacaaagatgtctttgcaccattttgaaacatcgtcttctgactttggcatctcactcattgcatgacgtttcatgcgaacatgtacctagagaaacagtggagtggaaatttgtttcaaatcaaatcaatttattatgactatgtatctatatttatttgcaagacttcaacagtgaaaagaaacccatcaaatttcaatatttagttctgcaacactctcttgattggtctgccattagatatccaagaagttagcaaacataccactgaagattgccctttcaaaatccgcagcattgttggttgaggtgaatcttttggaataattactgttgtatcataaatagctggaacaaaatcccgcataatagttacagctgatacaaatccctggaaattttcatttttttcacaagaggtatcagtaaatagatttaatgctgcaatacgaaataactacatggccaaatgcatgacataaccatgtattcttaataactgtaaggagctgatcactcagccactccataaacagattaaagaagtaactgttgtactgaaagtattacagtcatatattataaaaaaatgctgtttcaaattgtcattttagaacttcaattaagctttaattttactggaagtattacagttatatctttcagttagttgcttttgtttatttctttaaaacaatttgtgaatgtccaattgaccagtaaaaatctttttcatataagttcaagaatttatcttgaaatttagcgtattaggtattctttttcaggaaggtaataaacaggcaggcatcatcatattactatgttgaaacacctgtacacatgtttatttcggaatagaaaccatcagccagtacaaaagaattttcagagttcccctatttctcttttgtactcttatccataatccatcaatattacgagtagtagtgtctgacatctcagtcttcaatgcatgattttggctatggtggttttcatcattatgaaattactcattgtctcgttctataaactacattttaactatcaaagtttgaaaaggttgacctcatgtcaatcaaaatctaaaaacataacactgcataccggatagcaactataggtacaaattaggcaggcaacagacattacatgtaaattttggcagtagagcacaggacccacattgttacacgaggcaagttgttacacatgtatcttacattcgagtgtttcgaccttctttgtattgttctaagagatttcaaacacaagtaacatttatctacgtttgaaggacagattctgcatcctaatcacctatgaagttgcgtatgtttaatagatacacactgtgaacatatgcaacagaaatactctaatttaaccgtagcacagaatatgcagttctcgatatgtgaagattattacatttagaattacccatctgaaatctgtagtttactagtgtctagtgtatataatatgatgttttcatttctttcatatcagaactattacaagggtaaaacttgggagaagagatttatatttgtgaattctgatgcaagaatacaggaataccagatacaagaaatcatttcagctagaaaaaataacatacctttgtacgtggaatcaatacatttctgggtgctggcaaaccctgtgaaacagcatactcctgagctgctagaagctttgctggagtaaagcgagtgccctcaacaaaaagggctagccaaaatggtctggggaagtccttcaacctttggaggccccactataagcatagcaagaccactaagttaaagaacaaacaatagaattatgtgtgtactgtgtagatgaggtaaaaaagttactttcaatgtcttttcatcctttgcccagctcctttccaaaaagaggtattctgcaaaccacatggaccagccaataacctgcaaaatgcaatcacaacattgagcatgtctgcatgcaatcaaaaccgctaagtactatatcagaagatagataactgaatgcttcgcatgtctgtgtgtctgcatcactgagatactagtgcacattacattaggttatggatctccagtaattacaaagaactgaacccgataggctgcttctccatcagatttctagcaaaagcagaacacatcttttctgatcttagttgatggacatcaaattttcttcaagattgcttcataccattccattccacattgtacagcttccataaaagttggttgcacgcatattttcatgtgtaacagagagtttgaacaactatagctatgttaccagaaacacaatgtatgttctactactagttcttagacattttgggtactgaacatttaactgccaacctactctgctacttattgctacaacctgaatgacatccacttgactgaatacaaagttcaagcatatcaattttagccacccttagattaatatacttagcggttggagtggtggaatctcaagtgtaacatatcatctaacggtattatatcaaatttgcttcaaacaaattcaccatcaacaatcatagagctctgatgagaaggaacatatgacataataatgcaatatgttatcttatcataattttagtcccaagagcaagtttaatattttattaccttctttacattttttttcaataatagctttatgcacataacttaaaagtcagcggcactagtctataagggactgaactgcaaaacaaatgttccagtaaaatgtacatgagctagctaactcactggaaggaatttcgatgatttcttcataacagcaagtgtacttccaaggcatcctgagcgctgaccacatgacaaaaaaaagttttggatgatttattatatattacagacaaatctgtatatactgaacttctaacaaaatattgcagtgtaactgatgtttcaacaactagagaatgagacctgtgccaaaatccacccaataagccaatcgatatcgctccgatgatttgatatgacaagtgcatgctcattccctacaaagattcttcagataagtttgtaacaaaataaatgacatggtgaacattgtaagcactatcaactgtgctataaaactgattcctcacccattgccttgtaagtttcgtcatcagcatgcagttgtatctgcagaacatgggttgaaattattttaggggaaaggcgaaatggcaaaaattaaaattgtttgcttcattaacatcaaatcaaacatttaatcttaagcagaatgctcaagtggcaagccggtaaattctattgtaatctgaattgctgtacacatggatcattcgcataatgtacagttagttaattagccaccagaatttgattgattatgctgtactctaattttactgccataatgaagagaaaaatgcagttggatttcaattttagctccacgggccaaattcaatcacaacagtggcagtattaacatggctgtttttccagactcacagcatatgcagctaaaccctataaaaaaaatgtccaggcatgaggcgtccagaaccatcaaaagagagagtccacattcaaacttttctcactgctcacaactcaaataatgagctctattaaattgtaacatgcacggcatacacataaatgcaataacagttaatttctgatctgaaggttctggttgccgattcggttatactgtcctaatgtgacaaaaggaagctatttcacacggatgatttgcattgcacaacggttccaaaataaactttagaacattgcgtgtacatcaaatgtgggtattttaacattttagcagaacaggtaaatcttgatacgaagtgcatatcagaaagatgctttgtcactgaccatatcaacataccttaactcctgcccaccaatccacaagccagaccagctgaagccacagcagctcggccaagaacctgttgatccgccggtacaagctcttcgagaacggccttatcgagagaaacaggacggcctgcagtttttcacgagcatacgagcagatcaggtaatgccgcatgctgatcttgctgcgtagttgcgcgcagattagcagatcaaatgaagcaaagtttgatgattctcgttacagtttcgcgcagtgacagacaatttttttttaaagtgaaaataatttagtaatcctaaatctttgcctaaaacagtacaaaattaacccagaaatcctagctacaataatttagtaatccaagaaagaggctacaaacaatcgacgaaatgatttgcgcaaacagaatacaaaaaaaagaaaaagaaaccaaatctcgcgccacggccgcatcagatcgcctgagatacacaagggaagaacagaaaagaaaagatttcgccaccaatctagctgaggattcgggcgcacctggatggcgttgatgatgaggccggagaggaggaagaggaggccgagcgggagcacgacgagcacgagtgggaccgccatggcccctgccgccctgccctgccctcacttccaatctcgcggggccgagatgcgaagaggaggcaacgggccgaggtggctggatgctcacccccgagggagcgccctctcctcgtcctcctcctccggcggcggcggcggaggcggcggcgaatccaccggcgacgagaagagacgagacgaggaggaagaggtgaggtggggtgttggatttggagattttatagggggttggatggaaaaagacgcagtgaagcgtgtgcgcccatggttccccctcaccaggagaagaagaggatggatggtgtgacacctcggataatgattgctttttttcttcccaattttttcgaagctactcttacaatggtgtttgagatagatttaacttaatatgatgattgatgatgaaataaaggtatgaaaaactagaaaccctattagtataattaattatgttttcgttattaaaaaaaattaaaattagatttatacggtattccctccatttcaggttataagacattttaagtttggtcaaaattaaattatttcaagtttgactaagtttatagataaatatagtaatatttagagtgaatttcagaaaccccgggttttggggcacctataacacaaaacctcaggtattacgatttgttttaaagaaccctaagttttgggtcaaaatgtttcaagaaaccacatgtttaagcttatatcatcgtttttggctaatatatttatgcataataattacaaaaataataatacgagatatttttgagtatatataaatgttagcctcattttaatgaatataggtcattggtagtatgtttgtttatacctgtaaataataggttaatgtgttattattaatgaggttatgttgcgtttttatcatttgtgcaactcaagagtgagaaaaagataaattacataggatgggatgtgtttttgaaacctactaatgtaaacatatactaaataatcatatataatatttaaattatgagtatttgagtaaatatggggtctcttgaaatattttgctccaaaacatggggtttcttgaaacaaatagtagaacttggggttttgtgttacgagcacctcaaaacctggggttttgtgaaattcactttaatatttatactactaaattagtttcatcaaattaataatagaatatattttcataacaaatttgtcttgggttgaaaatgttattacttttttctacaaacttatcaaacttaaaacagtttgactttaaccaaaatcaaaatgtcttataacctaaaacggagggagtattttaaattaacttctatataaaaagattttgcacgaaatacaccatttagcaattaaaaaatatgctaacggaaccgaggtataatttatatatgaatttatatcttaatcagaaacggatggggaaatatgcaccagtaaataaaatcatacatcttgtgtatattgtgcatcttcggttataaatcatatcgtgcatcttgtgtattcagaaaatattgcaattgtaaataatagagtgcatctcgtatatttaaataagggtttacaatatcgtttggccagtaaaattcgagacccggcaagacatcgatttttcttcagtaacccttgggcatagttcgatacattttgaaagaaaatcaacaaattttgaaccaatagcccgaaatgcactgcaagacctgaatttcgagcaatatctcgtgaaattgtgaacctgaatcaaaccaatttatttaattaaatactatccagaaaaagtgggcgagtggtatgagaacatgagaaactttgtggtagcaagtgtgagaaacatgttacgttacactcgttgtatggttggaaaaaggaaagcagcaaatggattagtgtttcccacaatttggtcaaacaattctcagatgagacgtctaaaactctcaaatttgcgggcatcgttcgtttaggggtgatgggggagattggctctcgtttttcgcgcgcacgcttttcaaactactaaacggtgtgttttttgcaaaaaatttctataggaaagttgctttaaaaaatcatattaatccatttttaaaatttaaaatagttaatactcaattaatcatgagctaatggctcacctcgttttacgtatcttcccaatctcctcaatccccttctcctcaaacactccgctgcgttctttcggggagatagggggattgtccctcgttttccgcgcgcacgcttttcaaactactatacggtgcgtttttcgcaaaaattttctataggaaagttactttaaaaaatcatattaatccatttttgaagtttaaaatagttaatactcaattaatcatgcgctaatggctcacctcgttttacgtatctttccaatcttctctatttccttctcctcaaacacagccttagtaatcaaagacaccgttacgtgttatgctaatcattgggtttccaagcaaacttacgtgtaagctgatctacgatgtgaaaacgacactaacagaaagcaaaatacaagcaacatatatactgcagtttctcaactttactagttcacctttttaaacgttatttgcatgatgtcagtatttttagttttgcctcgcaaaaaaaaagtttctttagttttgttttagttatacatatgttacatttagttgtgagtaagatataaaagtggcattacaatggacaagaagaccacatgatacgcttggatcataataaaaaacaatattaacttgagctcacatgaagaacacctctagaatgtgttccctgttgacagtgagtctttttctccgattcatatgcatatactccctccgtttatttaatatatgatgccttaacttttatcctaacatttgactattcgttttactaaaataaagtatataggtattatttattttgttatgacttatgttatcatcaaataaatttcaatatgactgtttttttatacatacacgtttaaataagataaatgatctaatgccatgctaaaaactaacgtcgtcgtctgtaaaaataataatagtatatatcattggttaaaacagttcatatgaagtacattttctcacatcagtaacatgctagaggatttcagattcttttttttaccaagataaaagaaaaacagttgtcaaagtacatgaatgcccaagggggaacaatgctattagtcatcacctatgtagaggacaaaaaggttgcttttagatgtgagtgaatttaatgtcgcttttatctctccataaattaggtgtaggtatttgttggtgagcccaaaaattgagctgctaggagtatctactttggcatctcacattaaaatcacacaaggtgaattaaacaaggttctttgtgcaaatgttccttgaatgtggcatttgcaaaagggctctcatgcacgtttgttgctatcaatcagtatcaggtggttcaactaagagcttactgattgtgtcaaccaaggtcatattccaagacatgacctaccaaagatgttccattaatcagtgaatcactatttgatggtgtcatagaactgaggtttaaccaccactttgacttttacgatatgtttgatggcaacggaaactagagaaatacaaagaatgttttgtaggtttggcttttattttcttttttttattggaggcttttttttctagaacatggtttcttttttttttaaggttgttcttttactttgaaaagtgcgatgatggaggaggataactgtacctttacattactactatttcagtatgtaccaatatattataatgggccaggtccatatgggctaagaaatggtgattaataaggatataaagtattcgatatgatggttatgttacacggagcgtagtgtacaaatgcgttgtgcgcggtgagaggagggttgaaaggagaacgaaggtctgacacagagataatcatcatttgatggtaccatacactatatcataattgtggatggatccataattaacccaaatctcaaaccaactgaaaagaattaatccctagtacatagtaaagaaaaaatattcatcctaatgagcctctggtcatatactttatgcaacgatccaaatagccttgaggttcgggtccacccctagtcatagcagcatagtttttgggttcaaagttcaaatgttggggccgtgtttagttgcaaaagttttcttcgaacttccatcttttccatcacatcaaaacttttctacacacaaaatttcaatttttccatcacattgtttcaatttcaacccaactttcaattttgatgtgaactaaacacacctccaatctcctaacttcaagcacatcaatcttgaaatgctgcatacttgcattgacaaatttgtttatctttaaacatgtgcgaaataatcaaacacaacggacctcatcttttcgcatatacttgtgtttatcaaccaaaatttaaatttttaaccttaaatttgaagctgattttatctttttatcaaggcttattttttagcttttatttttatatcgctaaggacgcgtaaataaaaattttattctctcacctgaccggtggggtcccacctgtcagcctcacatccctccaggccgttactacccccatcatcaccaccaccaccactccactcctctcccctccttatccccttcgtctcccgcctccgctcccccgcgcggccacggcggccatggccaccacctccacctcgtcgctgctgcctctcctcccctccaggaccccgaccccgacccctcgccgccgcctcccgttcgccgccgccgccgccgccgcagcggcgccacctcgccccttcctcgtctcctcccctccgcctccgcccgcgccccgcgcccgcctcgcccgccgcgccgcagcggggggcctgtacggtggtggtggtggggaggaagagggagacggggaggatggggagatggaggaggagtattatgatgatggggacgaggagggggattgggaggatgatgatgcggaggagggggaggagatggacgtcgaggcgatggaggaggaggccctcggcgccgtcgccgacctctccgagcggctcagccgcgagctccgcatcggtgagtggggggtttcagcttcgattcgctacctccgacatggccaggaaagtaggaaactagttagtgcttgtgaagagatagtagcatttagcctaaagtgcataatctagtgtagtagaacaatcctgtgtggaattttgagtcaatccgtagttccgtactctggtcgtggcggggatgttcgtataagatcagatggatatgctgcttgttgatgatgaactgattgttgtgccgagaatcatgatgatgcagatcaattgatactttgccttggagcatgatgtatgagtttgggaattgcagttccctgtatttctatatttgaaagtttagttgttagtgcctagcgtcgcaaagtttttcaagtacagtatttcttcggttttctcctttagaagcctgttacatacttacattgactttgtttagttcatgggctaaatgcgttgtgtcttcagatgacgatgttcgggataaaagaagaatcatcagggataagacatcagcatctaaacatgtaattatatcttcgtattcttgtaaattgtaaccctagttgacaggctggttaagaaagtgcaaatgtaaacaacttctattttctttactattgggtccgtgattcagataccggataatcttcttccaagggtggcaataattggaaggcccaatgttggtaaatctgcattattcaatcgtcttgttggggtaagctatttacagctacaaatattacttgagcgaagagtcagcattgtgtgtaatttttagctgaatgcagaggctgctatggtgtattgaattctggtgtctcacagggcaacagggctattgttgttgatgaacctggtgtgactagagatcgtttgtatggacgatcttactggggggatcgagagtttatggttattgacactgggggagtgattactctatcaaaatctcaagcaggtgtgatggaagagcttgctattacaactactgttggtatggatgggattcctcttgcctctagagaagctgctattgctaggatgccatcaatgattgaaaagcaagcagttgctgctgttgacgaagcagctgtgatactattcatcgtggatggtcaggcaggttcagacaattaccctttttttaatttgatcatttcattttctggattcttctgttatatttggtagttctgatttttagcaacactttctactgcaatagttttttcaggaatacacaaaagttttgcgtatcattgcctttctactgtaatatgaaggaatcaattttagcacctggtcctgccaagtgatggactgttgattacatactaaaatccaccacatttacaattgctccaataatgtcttgtagtatggtagtttttgtacatgtggtaaacaaaggcatctagagaaaaatattagatattcctgttagcatgtttcttgtctcattctctttgtgtgatttctgtctgaatcttctattgggtattgaagcattccttttccaacttctgcatgctgatctattaaactttttaagcttctggttattttctacctggaagcagacttacgtatatggattcttatttaacctagctcatacgtagaaagattgaatgtgtgtttatagttgctagatttgataaacctcctggtgctgaaatttttgttttgtctagtgcctttgttgcttcatgcccctgactaagttcattcttacatggatttgcattacttgtagctgtaattccctattgttgtttttcggtactgttgattgaattagtgttatgtagtgtcttatctaacggaatgggtatcaaaaatctttcaggatggccttgtggcagctgatatagaaattgctgattggttacgtcgcaactactctgacaagcatattatacttgctgtaaacaagtgcgagtctccacggaaagggcaaatgcaagctttagatttttggtcattagggtaagttcaacacgcagtgaccccttgctgtaattacacaacactcagttcatttgcaattaataaatattaaatgatgttctgttgatttttctttttttacattttacgtacagtttgtattaggtctgacatattcttgtgctgattaaatgtgagaggccacagacttgatgatattaggtaaaaacgttactaaagcccattgttagatgcgaaatataaataatggacaactagtttctgagcttttagtggttccacatgcaagatctctaaactcatttcactagcatcgctacaagttaaatgtgcttttagtatacataatctgcattctgcaatgctttacttgtgctctgactctgaaacaacccaatttgttaacgattacctcatttcttttattgttcaccactcaacttcataagaacagaatgcctattggctgctcaactcatcgttctgttgcttccttctagattttctcctctgccaatatctgccattactggcactggaactggagagctccttgatatggtgtgttcagagctaagtaattttgaggtactgaacttgcttagtttgcccagaggccagggaatgtttaattgtgtatgtctatatgcatgcttgatacccttttctgtttatggttggtaatggaatcattattataattttttgttgcaacactaaaatgttactcttggctgcggaaacaactcaagtattgcttctgacaaatggatatgctaacttagtggaatatttcactctctttcctccagtcctacaaacctagatgaatactgctagaaacacgtggtgtggtgacaccttgttatatccagcctacccattgagcttctagatccagaaccttgaatcataagttgtggtgtttgtcttttcagtagttctttaaaatagccttctcctttccaattttgattcatatatggaaatattttgtccattacctcacaaaatgttttacaggaactggatggagttgaagaagatggaaactatattcctgctattgccattgtcggaagacctaatgtcgggaaaagtagtattctcaatgctttagttggagaagatagaactattgtgagccctgttagtgggacaacccgtgatgccatagataccgagttcaccacagaagatgggcaggtttgttcagaatgcttatgaaagtttaagtgaccaagagcagcatcattatttcattattgaccctagctatgtccacttttcatgcatctttcatctttgtagcaaaacacaatttgaattggaagaaagaaatttacatctcataggaaagtaattctaatttgctgatattgcaatatgctgcagaagtacaaactcattgacaccgctggcatccgacgaagggcagcagttgcttctgctggcagcacaacggaaacactttcagtaaaacgtgcatttcgtgcaatccgccggtctgatgtggttgcccttgttgttgaagcaatggcctgcattacggagcaggtatctctaccccatcacatgcacatgtgcacccccaaacaattcaaagagatgttgtcttaccaatcttttctaacatggtgaatttctgtggtaccaaggactataaaatagcagaaagaattgagaaagaaggaaaagcatgtgtaattgttgtgaacaaatgggacacaatcccaaacaagaaccatcagagtacaacatattatgagcaagatgtaagagagaagcttcgcatactcgactgggctcctattgtttattgttctgcaacacatggcagcagcgttgacaagttaatcccttaactttattttttactccgcaataagcatttggtacttcactactatagcatttgatggtttaagctaggctatttgtagcttgtcggtgttattgtctattttcctgcataccagacctgaaatttaagctgatgtcattaaggcattaactaatgtttcatgctgaatcttcatgttcctctgttatctcccaatttcttgtaatccaactaattgcattgcatgtaggagattgttaacttcactagatatgtttttctgtattggcattgtaattattctttatacacaaatattcctcaggataatttctgctgctgcactagttgaaaaggaaaggtctagaagacttggtacgtctattcttaatcaagttgttagagaagctatagcattcaaaccaccaccacgaacaagaggtggtaaaagaggtcgtgtttattacacaacacaggtagcttctaacttcttattgaaccattctgtttattcctcttaagccaacaagtttatggtctcacctttcaagtaagtcgtaaaggtcactagcgttctcttgatctctactacaactaaattttcacttccttgtatgtcaagtgaagtccttaaatcaaatacagctccttaattcatttttaagtatctgaagatatatgattgattgaaactggatcccttaaagaagtatttcaaagtcagcaaaggatccactggttacccacttcaaagtatatttgatacactcactgtcctaagatagagtagtaatatgcattctgcaatattatcagggccctttgaaatccgtactgcttttagatttgtaaagttcaccttggggaaatgttttcatgctttccttttattttcgcaccaaaggaagcttattcttaacctgcaggctgccattcgtccgccaacgtttgttttctttgttaacgatgcaaaacttttccccgagacattccgtcgttacatggaaaagaagcttcgctctgatgctggattcccaggaacccctattcgtttattgtggcgtagcaggaagagaccagataaaaaaggtgagtcgatatcaaagtgcccacttgcataatctcaatgattttaactgaataatttttctactatcatacctgcatgcatagaattagaaaagattattttgtgattgaatcattgaaacagacagaacgacaatgctagataagtgaaaaaacacagaaggaacaaatattgtgctatcagcaagagagatttttgcagtcccattatatttgatttcaccaatttctatgatatatgtaggtgtaccgtgcacatgataggttaaggaccttggtccttgtattagaacaaatataatgctaatatctgctgaggcttgtagcatcaaggtagttgaccaaagtaataagaatacaaaatatcatgtgatgatagaacatatagaaaaactatttaattgatctgggtatatccaacaccgctatgaatttcatattaggagtaatgttttgtgctctaccatacctgctgttataagtcatatgatgatgaggttaaatagaattgtcatactaattactccatctgttcttggcaggtaaatctgcagacaacagcttgcagagctcagtaatcccaagcagaatggcgttagccacatgagttacacatgcttttcctttcttgagagcggaaaaagggagagaatacagaatgctttgcctgcattttttcccaagaggtcaagactgccggtaaaaaaagagtacaaattgtatatgtagtggacgagtactaggactggaggtcatctactaggtgttgtgactacatggtgctagtataagttctgtatccttggatgtctaggannnnnnnnnnnnnnnnnnnnnnnnnnntctgacatttgcttgtgccttggacgaatactgaatagtactctctccgtttcaatttcaggttataagaagttttgactttgatcaaaatcaaactacttgactaaatttatatacaaatatagtaatatttataataccaaattagttttattaaataataattgaatatattttcataataaatttttcttgggttgaaaatgttattatcttttactacaaaattagtcaaacgtaaagcagtttaactttgaccaaagtcaaaatgttttgtaacctaaaatggagatagtagtatattgcgtaccggaatttgccacatcggtgcctccacatttttttaacgtctcgcaacaatgcaaagttcatattcatattgatagagtaagaaaaaaagaaaaataacccacacccatgcaccgacagctccaacccaacaaacctaggagaaaaggctagcaccgaactggttgtcgctatgcatgaccagtcgctgctaggccaacaaaggaactatatccgagaatgtccaaaatctaaccctaacaactgacaccaagcccactctagccacctcttgagattgagggagagagggggtgagagagaatgttggaatgctttcccccctagcccttcgtcatgtccaccttgcataagctagagcgccgacacaaggggacatgcatctagagcaagcttacaccagttgtctggaaggattcggcaaggggctgcctagataatgtctccaaggagaggagcaaaggatacaccgctgtcgtcgtccattaaagtctcaaagagagccgagactgggttttcactcggcagccccactggaggtgaaggggcggcacgataacgccctcaaaaggtagagacgttagggtttagaaattcatttcaattgatttaatttacctttttatttggaaatatttaaatattcacctcgaatactccagtgaccgcttcgtgcaccataccgaccgcctcgacatctcgaacgatccagctcagctcaatctcccgaggtaacgcatggcgcctcgttctccccgaaattacgcctactcgtattagagcaaggtcaatagtgcagcccactactagctccaaatcgtctatagccaatgtaatagccaattcatataatagttgcttactgtactattaatatctggtcccacatgtcatacacacattacgtcttggagtccgtgctgcagctggctacaaatctgtagcccgctcctcttctctctcttcctttatctctttaaaatatgtttatagctggcttatagcctgctattgtacctgctcttactactcctacgattcttttgaccaaatattttccaccgtccgttggaattgcagtcactgacaccctgaccccacacgcacccttacccctcctgtatatataccccctctcgatttcaccatacgttcccctccccctccctttcactttccccatctcctaacaccacggcgaagatgcaccgtctccgccgccggccgaccggagagcacggcaccttctccgccgcgcttgcccgccggtggctgccgcggaagacctgttcctttctccggcggacggcgggcgggccttccgcgccgtcgacccgtccatagctccgcctccgtgatggcttgtcgtgtcgccggcggcggcggcggcggcgggggtggggtttcctccgccgcttcgtctcggtggcgaggccgacggcccattggggcccaatggggaaggcccatcccccgtggcggcttcccggccacgccaacgccttcttcttctgatgaactctccctggcaactggggcccgcaccgactcgcccaacggtctcccccaattttcgcctctcccgcctctcctctcttccaactccgacgagcggggccaacgccgatcgccgcgccggagcagggctagggttccggccaccgccaccgccagaacggtgcgtcgcgtcccgtccccatccttcttctgcttgctttccccccgttgtgttgcgctgtgtttttgattccgttgttcttgttgattttcttgcaggaatggggggttcgttcggatggttggagtttctcttatcgacctcgcacccgtgcgaggatgatgcggcggaggagcttcccgtcgagccgccggtggcggcgatggatgccgcccatgacggccgcgatgaggtgcggggagaagtcccctccgagccgtcggaagtactcgctggagaggaggaggcggcgatggatgccgcccatgacggccgaggcgaggtccggggagaggtcaccttcgagcgggcgatcggtgcctcctcccgtgcgggttacgaaggcatcaagctgggggaggagccctccctcaaaccggcgatggtgggcgcgcccgagattaagatgatcgagatagcagaggcctcctctgttgcccagtgggacttgttggcggggacggaggattgcagccctgagattaacccgaagattgtcgacctccagcagcagcagcaggaggcctctctccttcctgatgaggtcatctctgaggcagacgcgtcaatcttggcgcagtattcatcggtgacaaagaaagacgatgatgctgagttcttgatttgtcggccaaactttggttttgttacacgaccacagcaacacactcccaagaaacggcaccccaagaacaagcgggctatggggattaacttggtaagatgtttaaagccaacactatttgtatctgtctgccttctttttggacatggaatttatactgatttcattattgatgtttcaggctaagtcttcttgttcttactgttttcacttatatcttgtattccagataatttttcttgatggagattgttgtatttagtagatatatgttattctgtcttgatggagattgtcaactttcatagacatgttattctgttttgatggagattgtcaacattaatagacatgttattatgtctagatggttattattaactttaatatacatgttatttagtgtaggcattttttttaatatttatttttgttttctctgttttcttaggttactctacaatctacatgtctaacagccattgataatttatattgtcattgtgttttaattaaattgatattttgtggtattgtgttttgtagtggttaatctttaattgttaattcatttctttcttcatctctgatctagtatgaattatcaatggtgtaagcaagatttgtgctgtaagcctaattgattttttccttaacaccagacttaactaagatattagctttatatttttcaatgcgattcgtgtttttgctctatatcttaactaatatagatggtggctctgaaataaaactaacacaagacaatcttgtaacaaatatagttcgtgcatgctttgccatattattgtagggattaaattccatcagagcttttactggttgattaatactgtcaatagtattgtatataaacagtgaagattaaggcaagtaggcaactgattttgttgatttaaattcactgagctttgcttttctgatgtttatatgtgctgccttgtgcccatgtctttttgctagtcctggacactgcttgctttggcacaatgcattcatacggcccaatggtgcagtcatacctttcccttgttgttaggcttagttcttaatccctcaacgtttgttgtacaggtttcgagccaaataaatgtttgcttgttgaatatgccttgaataattttgtactattattaaataatgagtcatcttttggttaatctgcgtttgtttgtattagatgtgtttgtacatattattgatattcagttattgcgtccaaaaacatgatattcagttaatctgaatttatttggttcatctgttttactatgggattgattaccattcatcgtgaaactaatgtttgatcttttgtttttcagttggatcgagagggaaatatctgcagtgatgataagcttccaagtcagggttgcttggttggtgaatacaataatcttttgctgcagttgtatcagctgctgttcgatttaaaagagctaatggagctttgtggccaagctgataagatccagagtgaggtgttccttaaaaaggcaatgaaaaaagcttgcagagattctgatgatgctgttgcagacatagtgtttcaggccctaaaggtagatggtttcattctgaggctattaaggtatctgaagagccaattcaatttttgccggacccaggcatggaagataaggaatgagatattgagaattggtggtacacccatcaatgatccactttccaaagattctccttgaactttttgcttctgggcccttgaaccacctccaatatgggacgttgttctagaatcattgagacatatgctcctgattaccacatattttgcactttggcttgtggtggtcgtaattgttttgtgctaaatgtaatcctctaacaggctgaatgtgaaacggtcagctgtggtactgtatatagacatgtatccaatctgaaatgctttgtatggttgtatacctggatggacatatgcatcctatggatagctggtgcccagctgtggcaatatgctcgttgtatatgaattagcacagagagtggtgaatatgaaacttcctgttcttgttgatatttcactttatgttttaaattctcggcatcactgcttgtgaaattgttgaaattgtcctggttattcttggattataaatatctgatgacttttttgtttctgtttctatttttctataattttgaaatgtaataagccttcggatatttttttaagggccctcttaatttgtaaagtcttctgtattttgtgatcataacaaatttcttgttcgcggatcggacaagttgtccaatctttttcaactcgatgcattgatgtcagtatgtttggttgtggacagacaccgtttcggattggatatcatccgacaaccttggtcttcagtgcccgtgtctcgtttgctttatttgtttcggacgtccctgtcgcttcgactccgattctgttaacttcaagcgtgaaggccctatataatgaatgcacttgttcgcttctctctctccctctctgtcaaaccaagatcgacgctctggttgctttgttaagtctgcacagggaagagaaaattgtacgagttaactgatttgggcaatggaaacctcaggctctgacgagatgcagcagggcgtaaaggttgatacgactcgggtcatagagaacactgctagcaccgtcgacagcgagacgcccgtagagcaaaagaggagaaagaaggtggaaacggagtatgtcctcggtgggaaggatctagagtttatcttgtcatacgaggacgatgaacttgagacatttgatgaggatatgctcaaggaccaggcaatggtccggcaacagattgagaattttggctatggtttcctccatagctggagggaagttatctgcactgatagtgaagaagaagatgaccccgtgtccgatgatgatgatgatgatgaacaagatgacttcttcaccaatgatgatgatgatgaccagcaaaatgtcgaccaaatggataagaacatgtatgctgaggcctgaggggctaaaaagctaaaaacgatcacaatttgtacttttcttacaatatatattgcatgtcttaacttagttattcaattgattcatacctaaaaaaaataaattgatttattgtcgtatatataactagatctgatttatttctagatatattttgttcttcatattattaaaacttggtgattctttactttttctcctaatttataacaatattggatatttatctgttggataaattctcctgccatcttcccctgaaaaaaaatatatgttggataaattagtttatagcatctactaatcctaatttgctatagatagcatcgaaaggtttggctcactttaatagtaccaaaagttggaggcgcctataaatcgggcgcccgatttttttatcaaaagtttcgaaaccctagctccccgatagcgacggcggcgccgggcatgcctcctcgtcggttgcggctccacccacttcaggaggagaggagagagaagagagggggtgaaaataatattaggagagtagaggaggtgaaaaaaaattgaagtgctaagagggaaaagagagaggaaggaagaaaaaaatgtggataattggggtattttcgtaagtgaaaatatgctcatttttacatgtggcctcttaagaggtccgtttgcgaaaataaattttaaatacgggtctcttaaggagtcgtttatgaaaatagagatcattatttagacccgatcaattacggttcgcttgcaacttattagggtttatgtacggaaaaatcgtttctacaatagtgaatttttaattttaaaaataaagcatacttattttaaatctaaacggtaacagtacggtttgaaaattccagctcacgtcgactgtatatctgcgtttactcggtctcacatccgacggaattgattccgatcacaaatcaattgtttaatcctgttctattgagctaatcagattctggtttggttaggtatcctgattctgttaagttaagccaacctgattctgttttgtttagatctaaagatggtctaatatatactacctgcataatcagttcctgctaatctcaaaagcaagaaccgtgactactccagactccagcctagcgagaagagagaaagagagagacagactcagaacagtgacaatttcagatttgcaagaagagacagcaggagtaagccaaccgattaatcgatggaaacattcagctgctccgaaaaattgcagcttgatgcagacgttgatactttggttgtcgaaatcacagccaccgtcgtacacaacgggctagccacgaaggtgatcgagaaagaagaggagaacttgaaaaagaaaagaaaatgtgtgaagaagatgcatggtggagtttgtcattgatggtgatgacttggagtttaccttatcatatgaggaagatgaacttagcttccttttcgagaaaagcaatgagctcatgctaaaggatcaagaaatgttccagcggcagatcgagaattttggctatgcctttatccatggtgtgaaggaagtcatcctcaccgatgatcgatgaggacgaggaaggatgcgatatcttaagtgacgacgacgaagatatctccatcgccagacaccctaactaggacgatttaaacaccatggatgtgacaactgacaaatactcattgatgaatacaagttagttctgcatgagaatgcagctagtgatctgtttctaatatactactccgtttagttccactgatttggtattttgcatcggttcttcgtttaatgtgcttcctgctcccacctcatcgcctcaggatgcagctagtttaggctgtgcttagttcctcggtcaaaaattttttaagtacacaaacacacatttgaaatattaaacgtagactaataacaaaacaaattatagattccgtatgtaaactgcgagatgaatttattaagtctaattaatttatcattagcgaatgtttactatagcatcatattgtcaaatcatgacgtaattaggctcaaaagattaatctcgcaatttatatgcaaactgtgcaattggttttttttatccacatttaatgctctatccatgtatcaaacatttgatgtgacggagtttttggaagttttgaaataaactaaacactgccttagtatattttcttaatttgtaccactaaacctattagtattatttaatttggagataattaattaagacggacaaaaacaattcggggaacaattgttggtatataaaaatagtaaagcaaaaggtgttattaagccctactgattggtggggccgtaaaaaatgtgggggggggtccaaaaataacaattttttatacagatgcttatatcatccacacgtaaaaataaaaaaaaaattccctggaacagaagagccttatctggaaaaatagtgctatacggatattctgctcttttctgtttatggttgctgatgaaattgtttcaataaataggtattataaggatatcatgataatttaatttttttttgagaattacacagtataacgcagacactcacaacgcgcgcacttagatcacccctatgaacacacgcacgcaaaccctacccctatgagcatcttcgaagactgggccgggaaatcctggagagattaacgaagtcaccgcaggcgcctcgctgtcgacgggtacgtcgcctaccactgaaagcacaacgcctctttgaagactgggccggcaaatcctggagagattaacaaagtcaccacagacgcctcgctgtcgacgggtacgtcgcctaccactgaaagcacaacgccgatatatatatcctagaaaattcactcccatggtgagtcgaaaccaggacctcaggtgctactaagactcttgtaaccactaggctatttttttaggttaactggacacatgccattacaaattgcctatttagaaaaacaccattactatccatcgaatcagtcggatgccactctgctcttctacaattggaaccgtaccactccgtcatgggttgacagaaaccgtgacggaatgacttggttccaattttagaatagtagagtagcatctaaccgattagtaatagtaatgatttgattttgcttttctccaatcctacaaaactgggaagcattgttctgcttagataatctacactgatgtgacaatttaacgccgtttgtgtaagttattaaaactggtcttttttttttcagttgggaaaagatggaaaggactgtagtcctgtgaaattcaaaaacaggatgactttgttaccgagttaaacaatcatttgataactgtttaccagacagcactcaagattagagaaatgattgaattgtgtgagttttacgcaaatatgtcaaactccaagaggaatgccattcctgcaaagatgctgaagaatgctcactgtcaggaagattttggtgtccttgatttaattgaccaggcgcagaaaaatgacaagtttttttttgctaacattgctgtgaaattgaagtgtttgctgggacgtctttgtactgcaggttacaaactccggctgataataatcaaaaacaatggcaggcctatcaatgatccaatgtcattagattctgctagctaggtagctccttatgattggaagtagtcctgggaatgctcttcagctttgatttggaatagaaaacaatgatagatgctcagtctccttccttaaagacctgtgagatcttcatattttctatttccctcttgtgtgtacaatcttctctttgtgttggtacttctgtttttaggtgcaacagatgtttgatgaccagtgcaatttgtattcgattttgtgtaaagctgcttttaggtgtagtgccattgtctattgttgcttgcctggtaccttgtgaattcttggtacagtatgatgatgagaaaataccagtataatcatttctggccttgaagatatatttgtttctgagtacttgtagtagtagaactctatgttgtgctgggatgtttggtgttcctaacttcgttgtgtagagctcgtgttaaattggtgtattctcctggtcatgtgttcagatcagtttgtggattcatattcaatcggtgaattgatataggcttcagactatatattcaaatcggattatgcttcggacttcgttttttctgttccactgttcctccgaattatgtcgtactggtgagaaagatcgattaaattagttagtagtggattaatttaattccgattctgttcaacccagtctcaagttctttatactactactacttattgctttctggtcgctgccccctgaaagcaagatcgacgcgagcgtacgtcacaaacgacttgcgagaagataaactgcaggagcttagctgctcgatcgatcaatgggagcatcgttctcctacggacaaacgcaacgggtcaccgagaataataatgccgctgcctccaccgtcgtcgccgtcgtcgatgcgccgggtaggggcggatccgatgtgagttccccctcccaatcaattctagatccgccccagacaccaggtctggagcggggcaggggcggatccaacgtgagttctccctcccaatcaattctagatccgccccaggcaccagatctggagcggaacaagaggaagaaggtgaagaagatggtggagcgtgttatcgatggtggggatctagacttggtcttatcgtacgagaacgacgaagaatgtttgttaaatgagagcatgctcgaggatcaggaaacattccgtcaccaaatcgagaatttgggctatgcgttcatccatgtcatgagggaagtcatcctaaccgatgatgaggatcaagaggaaggcgaaattgtcacctatgctgaggaggaagatgatattgttaccgatgatgatgatgaggatgattagtaattaagcaacgaggaaggggctaacaacatgattgaaaagggttcagaaggctaaaaaataacaagtgatcgagtaaagcatctatgcattttagttacacacttacactacccgtttcatattataagtcgttttgatttttttttctcgttaaatttatttaagtttgatcaagtttataatttttttaacaatatctataatgttaaattagtttcattagatgtaacattgaatataatttgctaatatatttattttgtgttaaaaatattactatttttttacaaacttatttaaactttagtttaaatagggaaaaaattcaaaatgatttataatataaaaaaatggattagtatattttcagttagttcttcaattgatttgctatatggtggtgtcgagtgtgatagtgaaatcatgggtgcaagattacttcattcatttatcagcgttcaaatcccgatattcatccccaggtaaaccccatatataagattactgtaggcattcttgattggtccataggttaaagttatgtactccctctgtttcaaaatatttgacaccgttgactttttagcacgtgtttgactgttcgtcttattaaaaaaaatcatgaaatatgtaaaactatatgtgtacatgaaagtatatttaacaatgaatcaaatgatatgaaaagaataaataattacttaatttttttaaataagacgaatggtcaaacacgtactaaaaagtcaacggtgtcaaaacattttgaaacggagggagtatatatacttctattcattatcttaaaaaaatatatacttgtgaaaaaggaaagattcagttattacggtatgcaaaattccccaccttgtcatttggcgtgctttctgctcccgccttcgacgtcacatatcacgatgcgcttgcgagactgaacaaattaagctggagtactatattatcatgttgtttgctgcacgagatcagatagatgcaccgcttcatcgatctgtttcgatgaatcgcgcgccgatcgagacgttgcccgatctccctcgtgtgcaaatttcagctcaagcactgcaaatccagtttgcgaattgcctgaaaaatttgcaaattgagctcaaacactccgtgtatagttcttcaaattgatttgcgctggcacgtaagatgtttatattccccagcccgcttccgtcgttcatttgacgtattccttgctcccgcctccgacgccaccgtacatcgcacggttgttgatgtaccggatgcatgaatggcttggtcgctctccctctctccatttcaacccaactgcgtgaactaaacttaatttgagcgcgtcagatatcaagctcctacttgatatcgagccggttagcggcaaggcgttggcgtggtggccgcgcgttgaaggtgtacagttagtggtggccactgttttcagaatgcaacggcaacacgagaaggcagattacaggcacaagtccaaccttgttgggccagcaacggcgatgcctacatacactgctttcccattggggcgtttttacgtgaactttctcaaccatgccacctggatacaagaacttctccgaggaattacttgcatgtttcctcgtcgatcggctggatgactacttcgctagaaagaacaagatacatgacaagcgcgtgaaaccaatcctggagttggtaaaaaaaaccaatcctggagttggtaaaaaaaaccaatcctggagttggtaaaaaaaaccaatcctggaggagcagagaggatttgcaaggagtacaaggaggaaggctatgccgagtactggatcaccgacgacgaggacgaagcagccactcgagctccggcgccgggacggaggaggggtcgacgaggggtcatgaataagaagcataccggaggaactaagaatctttaagtgaataatagaacaaagtttagagatatctgtgcactcgatgcaggtttgagagcttcttatgtagtactcccttgcattttaatgtatgatgtcattgatttttttatcaacatttgaccattcatcttatttaaaaattttatgtaattatcatttattttattgtgatttgatttattatcaaatgttctttaagcatgacataaatatttttatatttgcacaaaattttgaataaaacgaatggtcaaacgttggtaaaaaaatcaatggtgtcatatatcaaaatacggagggagtaacaaacatctggtgatcatctagttaaaaggtagcccgcatctcccaagtgttgttttcgttgtgctatgttggatggttagctagtataactaagtgcagtagttaagtgcttttacggttcttgagagttccgatactttatagtgtaaaatttggtatctaccgagagatactaaatttgcgctcaaaattttggcacttcttaatatctcttaggaactataaatatttcgcagtagttaattcaatttgcgctcaaaattttggcacttcttaatatctcctagtaactataaaatctttcgagtagttaaatctctaatcattgagaaaatttaatttgtgcccttaaaaatttgctcaatcccttatgtgtccatcaaattttgcctcatatcttacacgccatcgagttttcatcttgatcttctctgtactcattttgctggttgaccagcaatttttttttcaaaatgtaacatgatctaagttgaaaaaagtcattgtaaaaagcaaaggggatagaattatttaaccacaaatttgaaaaaaaacacaaaattgttaaataaatttcagatcaaccttgatgaacttcgttgaacattttcaacaaaatttaaacctaaataataaatttaaacttcgctgaaacaatttggtaccgtgaggtacggtatctcgagatactttttgatgtactggggcatatctcttccctacactaactaatgccaacacatcatgattaatcatcatatctttctaacgcttcctcctcctgacaggttcttcttcacggcgactccattgcggaaccttctccggctaggggagcagcaactcgagcaggaactttattgtctttgtcgtcgtcgtcgtcgtcgatgtcgacctcgtactcggcatagcctttggtgaagtactgcctgaggatcccctcccgttcaccccggatttcgttctgcatctttatccagaaagccttgtcctcttctcggctgtcgtcgatcgccttgagttcatcgatgtagtcttgaggacaattcgcgaggtcgtcgccgaggatctcaatgatactcggcatgttgtcgtagtcgggcatctcctcttccttgtacgtgatgcagttgttgatctgcgcttgggtaaaccgcaccatcttcgtcttcgccttcttcttcttcttcttcttctccatcaccggcgccttgccttcatcggaggtaaccggcgccggcgccggaatttgtccgtcactttttttccccgagggagcttcatcggaaggatccatcgttgtcgatggaatttggctttgatcacatgttcccttggatgtgctcgccattgtatttcacatgttcccttggatataggctcttaatttttatggaagcaccgggtcgatcagaaataggtaggattcgggatcacctcgtagttcaggttcagcaggagtccatgagatgcgcgactcatgttcgactctgactcttcttctttcatggtggatttgccgtacgtagttcgtgcgtacggatccggccctatggcagccagcacgcgcggccgtcgtggttgacgccagcggcgccgggacgctcgagctcgctcctaacggagatgactaacccatctctctcgtttttcgtgcgcacgcttttcaaatttctaaacggcgtgatttatacaaaaagtttatatatgaaagttgttttagaaaaacatattaatccaatttttttaaaaaagttaatgcttaattaatcatacaataatataagcttcgttctgcgtgtcgggaggagtcccgaaggtaatttgacatgctgccatgcatatgcaccaactacaaatttagctagtagatccgggtcctcctgtgcacgcgcgcttgtctaccgcgtcgtgcggtggtgtggcggcggtgcgacgcgcgcagccggaagcgcggcgatgcacgcggcgcgaatgtcgtcggtgccgtggtcggtgccgagcgcgcccgcctgcgccgagggccacttcacccatatcctacgccgataattgctcggctatttatagtgtagtcttaaaactactcaaagtgataaaatatttttaaaaacaacctattaagtagcattttattcttgtcattttaatgggtggcgttttgtcgaaaccacgtgaaaaaagagtgccatattgtcctttttctccaatgtttggtatgccgggcagccgggcacactcacagtcacagacggcatcgaatccggaacctattcggttcggagtcggatacaaaacaaacgggtccgacgattcgcggaagcgattccgaaaccgagttattgttggagttgcgcttgcgctgcctatatatattccggcatctacccgaacccgataactctatcgcaatcgggtcttgggcctcaatcgagaggagactcaggggaacaattcatcaggggcgcagctggccttgccttcgtgggcttaggattagatgccgcaccttttttcattcagatgttgtgatctgatgcgatgttgtatcattattatcatacaaatgacttagctctttcggttcggtttcaatggtgacggaatttcaggcgtcggggtgatggatttctccaagatagaatttagtgaggcgaagcggattttggcggcggcgctactaacctccgacgacgaagatagcaagcctccgacgacgatggagaagaggaagacgaagatggtgcgctttacccaacagcagatcaagaactgcatggcgttcagtgcggacatatccgacgacgacgacgaggaatccctgcccaagctctcggaggtgctcagcaaggatatcctcgatcgggtgccgcccgaggttcttgacagcttgatagagttcgagaacacccggggagagcgcaaggctagatgggagaagctacgggacgatcttcatgaggaacgggatgctatcctcaaacaatactacacgaaaggctacgccgagtacgaggtctatgatgacgaagatgatgatgaagatgaagataataaagttcctgctcgagttgctccccctggccgccgcagaaggttccgcaatggggtagccgtgaagaagaatcggtcaggaggaaacattagaaagatataaactgaatgatcatgttcagtgttggtccatatccatcttagttgtagtgtagggggaattatagtttctccttcatttatcagtataataataacagctgtgctactctgtggtttgactatagttctcttttagattcctgctatggtttgattctagtcgtgctatgtttttatcttggtcagcattgatctatcatcatggttcagggaacctgaaagtgacctagactgaagtcacagatcagtagttttgttgactgctctccctgagataatttcagtagtagttctgttgactgcttttttttggacacctgaaaaatgttaggttataatttggaaccccttgcaaaaagctcgcctgaaatatgttaggcctaatttaaagaagctaagctgatctctgttgacatgttttctcctacattattcagagttgcatgataaggattccaatggactaaactttttgacattgtcatatgagaatggcaccctgttaccatctgtttctccaaatgccaatgcaactaggatcaacaccggaaatgaatgagtcaggcaggcagtgtgcttgagacaatcagacataatattttcagtttagcttcgcatacattgagttggttcccccataattaatataccaggtcttagttggtccccatagagtagttatcacttactggtatggtgcccgtgcgttgcgatgggacaataaaaatatatgcacacggggtaaaattatgttaaatagtttgagagtacgtatattgtacacgatccctatcacatatctcccctataaatacattgccattgtcataaatcatcaccaattcacgacaaacaggatcgcgattgccctttttctttcctgttcacttccttttgaaagcaaaacacaaggaaccatgatcagctccaagaagcaagctcagtttcctaataagtggcactgaatgggtgccatcaactccattgctgactacttatgttcacttgtaacaatcttctggacaccataaaaaatcatgacatagtcaacaatcttctgttcaccaattcacgacaaacaggactttatcttatcatacgaggacgatgaacttgagacatttgacgaggatatgctcatgtaccaggcaatgatccggcaacagattgagaattttggctatggtttcctccatagctggagggaagttatccacactgatagtgaagatcgaagaagatgaccccgtgtccgatgatgatgaggaggaggaagatgacttcttcaccaatgatgatgatgaccagcaaaatgacgaccaaatggctaagagtatatatcattggttacttctatactataagtaaacaggtgggtgctttcatttgaatacgaataattagacatagctacattatctgcttctatcgttcgtgtcctccaaagaactgatcagaatagtagtagcacacgctgagttgcaggtaatttcaggaaggaaaaaaaaaaaccttgggtcagaccaccgttgtcactgtggggtaaactccagaagacagagaaagctaaagatatgtcctaggtatgttttctctaggaaactagtactttaaacatgaggtagacgtaggagataataacatcaaaaccaatagcacttattatattatttagttgtatctggtagaagaataacaaactattgctagagttgacaacttttttcttccttaggaacggatttaaccgatttgcatcctattaaatctttaggcttatagaaatgatatagccaagctatatcatgacaaacggtgataatctacggcttgaggcgcctgataaaacgtgtattttatattgaaaaggatgttttcgttcagatattgtgttagtattttaacagtgttgctgctaatgctgatctgttatgctaaacaagaaatattaaaccaaaaactgataattgagattgagttccataatccaacacaggaagatactacgacaactagtaggtaaatcttaaaaaaaaaaaaaaagaacgactcgactgctaatcagcgaagtgtatcagcacatcgcttagtagctaattcagcttgttaacttttcctccattgatggaaacacccggtcgaaaccttctttgaccaggatgaggagcagggaaatcttcagcgcctgcaggagaggattcttggtcgccagcaggtaaggtttcttctccatcagcttcaccagaaggtaaggttttttctccatctttacctgcagatcgattcttcatcttcacctgcagcttcgtagcctttctgataagcgtctttctccacatagcctttctcatagtactgtttcagaacattgtctctcgctctcatatgccttgattcaatccggtttatatcacggatgatcttagcaaagtattcatccatatgatccccaaccttaaccatcctcctcacgaaactccacggtttggtaccggatgtggctatcaatctcggcttgagacatcaactccttcttcgtcgccgtcgtcttcttctttttcccttccgacgaactgcctgccatggtcgtcggctttttcccttccttctctgctgctgatgccgccgttgctttcttcttgccttgatcggaagagcttgacatgatcgctggctcgcaaatccagatgacaggaagcgcaccctgcgatcgattgtcgtgtgatttggttatgaaaaaacctgacctcgatacatctgctgcatatttattggttggtagctccagttcacaatcggagtcggaacctgcccctgccgatattcccaaccggaatcggcagagcttcagctgcccaaatctagtttagtttagggtctggattaggcatgactaatttttaggaccaagtttgggtatcggttggagacttgttttaaacttaaaattccaaaattagatttttaggaacatgtttggatatctcttggagatctctaggtgacatcatttattattgtaaattaattttctagaccctaaaagtactcaaaattgtgtctcatccagcctagattcgaagaataaatgtctcatctaatcctaagttggtatatactcctattttggaacggagggaatatatatttaatttttgggtgtaatttatgttatcctcctggtcctagttttgaaataatgttttgatcaccttaatctttcaatgttctatactgtattattgctcaattgattggagcatttgtaatagtacaatctcaggcagcacggaaacatcctaatatgcgtgcctttgaacaaggtctaagcacgtcatgagcaagaaaaaaaattgtgagctagcaccttatattactcagaagcatgccatagaatcaagctgcaaaaatattacacaactagaagatgagaagatgtcagtgagggctttttactgattatcatcgtccacagatgtgattgcaatctccatcttctctttcctcaagctgtctgcaagcttcaatggccgaagttcaatggtggctgctctcacgaaaccatcctctgcattgtccaagctgcgttcaatcaccatgcttgaggtactcatagctaaaacaagggacagacatttgcacaaactcatagctaaatagatttgaggccaccgagtgcttctgtgctaaagaaatacgagtaactttatatggtatgtttgctaatatcaagtgtttgttaataggaaaaagtaagctacattctgtctctagcacaactaggatccattttattggaaaacatcagaccaggctagataaagctacgaactgagcaacatagtactcatgcatgctaatgtgacagaagcagtatgcatggaatgaggtgatcatgactaatgacactgattgacaagtatgtacttaaattgaaaaggtagtaccttgcaatccaagcagaggtcgtttatcaggccttttacttgtgaaattaccccagcaatttgaagtctgacaactcccgaacagaaaaggcctcaaattttggaccaatcaagttcagagcacacataaggttgcaactcacaattgttaatccttgctctgcagaaagttaaccacaaaagatggtttgacacgatctgctcgatgaggtacaagaacattcatcacagccttcttgtttaattcaccaccaactgcaacatttgtaagcacaaacataccctgaagagaggaaacagaaaggccaatgactaactatgatttttgcattctttttttcagataataaatagtatcacagttaagaagcatgcatccgtatgaaaacaaaaaaaaaaatacactgttttattggaaatatttccctttttgccctccatagtttaaaaacacatatgaaaaaaaaaagtatagataaggtaagtcagtatactgtagtttaaggaatactgacctgtatgcacactcctaaggcatatgtgcattactcagctgtcttgaaatagcatttaaaatcatgccatcttcaccaataacataattaatggtgtccacatatccttcaacaaaattttgctgctgctgctgcacctcttcaccctactatttcaccattcgctcaaacgctcatgtgaatctatctgaaagtgccaagacaacatccttgacctcatgtattttgcgacaagggcagtgacggtaacaagctcaccgccactgctgagctgcttgacatgagaatctgtgctgcattgttccccacagcagcacagcatctgtgcccacacctggcagatcatctctagcgtgccagtgccatcagcaggcgagtcttgccggtcgatgaggaatgcaccaagcgagcatcctcccctcaacatcttgtccccaagtctattagtatttgtacaagttaatttaaacttcggtttagagctattcgtcctcaatgcatctgcgttaagttgtagcaagtggagcacatcctcagctgtgctgtacctcaggtgacgagtgatagcatagcacagcacaagataatcattgcggctggcatcgggaggcagcatgtggggacgtgatgcaagcaggaaaagcatgtgattggacagcgcctgagccgtttccataaggtcagcagctgaacctgaaccatcgactacctctggttgctcctctccagcagctgaacttgagccattggcaacctctccttgctccccttcagcagctgaaactgaaccaccgacggcctttgcttgatcctcttcagcagttgaacttgaaccactggcagcctctgcttgcccttcttcagcagctgaacctgaaccaccggtggccgctgcttgctcctcttcagcagctgaacctgaaccactggtggcctctgcttgcttcttctcctgatccttgtaccagcacaggtagatctcagtggcgatgtgccagatgaggatcctctgctccatcttggactcagcaacccaggctgggtccctgtacaatcctctgctttcaaattcctcctgaccccattgcttcgccttcatggtctccagcagcagctgcttggtacacgccgagatggggatgggcaggcccgagtaagccaacctgttccaccagtcctcgactcccatccacctcgcaatcttgctgcatcggctggccctgctgtgcacgcacaactgaatcaggttgagctgccccatggagcgtgaccagctgcgcctcctcctccaatatgccgcacggaccagccggcggagacaggcgggtatgtgagcaagaaaattacacacattacttccttccgatcccttctttaccaggagtgcacatgtccagctcgagaacatggccctcaaaagtgacatagtctccaggatgacggctccaacaaagaggacatatgtaacaatgacatctgctctgctgtaaccattcagcttatgctgatgatgatttccccagactagtagtatattaaacagaaagaatgcaacggtggtggccagagacgaaagcactcggatgcaaaggccataccaagtgtgtgtaatctcagacttggtgtagaagacgtcgtggaggagggagagttgcatctcagccaccttgtacaactcgtcctccccttgcaatcgtgatccttcattcatggggccacacaaaaacagacgaggtaatggccccttaaacctatccttggcaaaatccaacaataggtgagcatttaatagcaaggtttctgctggatccaagcgacgtatgaatgactcaggcaccatttgagaaaatcttcttctcgctatatcactctcgtactttccagttgggctactaccggcacatctgagcgcccagacacgctccccatacttggcaacacctaccattaacatgaggatggtggctgacaggagaagcaaggtccggctgtcgccaacaatgactatggaggacccatagatgacataggcagctgcggccacctgcacaacaagcgtctgcaggtggcgcagccacagccggttgtcctcgatggcgtaggcagtgattttgtcctgcccaccaaggtgcagcagcaggaacggtgcccagagtgccaacagctcatgctctggtgacctgctggtaacagagaggtggccaagcacgtagatcgctgtcccgtcggccagcatgtatgcggaccatataaaggcccttagcacgccagagtcaatgtaccggcggaattctgccaagatgaggagtgtgacttggaccatgaggctgagaagcaccagtgcttggagagcccattctttccatgcagcgctcacagcctctgctcctgccatcgatttctccaccttaacatctgaaatgtatacaccaatcgattgacataagtcaaaactacataatatttctttttagtttatcaacactatcaaacctaattctgatggcaatctcaagttctaaactcagcatccaagcccaagcagaataatgacagctgagggggtgtgcttccattctgttggactttcccttgttccgtatcacatgttccgggttgttgtttctttaattgtggttgtgtacatctttattatgcagagaggttgtgagtaaacttttgtgtggttgtacttgtattagctagctgtaataatgagagtaataaagctcccttttccacaaaaaaaaaaaactactatcattataattgttgtaaaagcagactcataccctatttcagcctaagcattcacattgccatgagaacttctattagaatcattgtaattaaggctattgtgtacatccaaagaagccactgagaatgcatcagactctttaggggttgtgtgcttaaagaatttgtgattgacttcccaaacacttttctcttatacgtcagttgtttcattgctattatttcagttttcatttgcttcattcttaccatcacctgaggccctgagctggctcatggcatatatggcaagccaaatacatactgtattcaggatatataaacataataagtgatattagagccaaggcaatgtcaatctgatttacaaaagaattagcaatgcatcaggtgccacaaattcaggaacagccttaaacaatgtggccaagcagaaaaacttgatagcaatgaagtcgtattaagtgagagctacaaaaatctcccagtttttttggctactgatgtgataaatgaatcttgtgttgcatgtacttatgtgaagttgtatgttgatctagttgggaagcgcatgcggaaatctccgtcttttaacagcatgattattatctatgcaccacaattaaaatttatcggacatgcatttttctaacaagggtaatttggatgaaatacctcctgcagtaaacacatattacacagaagctagctatgtgaatagagaaacttacacacgataactgaatgggtggagaagtgatcgatgataatcttcagtttgacagacaagttatatatggtcagggattagccagtttgatatgtttgaggggatgaatgcaattcatgcatagttaagtgccacacacaaatatatcaacatgcatgcaaaatctgatgcaatgcctcccagagggttaaggaatcaagaaaagatgtcattcatctgatacctgcccagcagcaagtaaaggataaaagtaaactattctcctttttttccccaaaaagaaagtggagtataagagtcaaatcactaacgctgtatcactttataacgatgcctcattttccttttcatctacaataatatatggttaacatcacatcacaacccctctaaaagaggacctagaactgaactcgtataatctcattattttcccatctaattctccctaacctccattgctccacttacacatgggcccacaagtttttttctcaccaaacaacaaagaaaatagttgcatagattccaggaaacttggtcctgacatctcccgcggtcctgcggcatatgctaggttcaaaactccaggaaaaaaaaaacagacctccagtacatgttttgaagttgccatgggtagccataagcattaagatcccatagactgtgatgttaattgaatcatcaatctacagatatttaagacctcgctggaacccatgattctcaaggcatatgaatagaaaaggattagagtgctccaactcctacggagcgttgaaaacatagaagaactgcacaacaaatagctgtttgaatagagcacatgaaaaacacaagaatcatataagagaggccatcaacttacttctttggtcagatgaatcgggctatcgagctttgtttcgttggtagaatgaataccgatgggatgatctagtcttttttgtttggttggtagtatgaatatcggattgtaccaccccttcccacagttgttgagcttatgattaattatccatccatttgacagtgacacaagcaaattgcggtcatatcagaaacgaaattatgcaccgaggttggtgatcttatgacttattatccatccatttgacagtgacacaagcttcacattccagtcaatgaacatattagaaacatgttaaataagaaatcatccatttaacacaaggttcacagtcacagacaccctttttttttttttaccaaccatcgattcgtctacaagactacagcaacaaatgcaaccaatccttctcccatctatccattataccatccatccacgaaccaagtcagggccgcaaagggataatcgattaccttgggcggtcgtggggagaattttcagaatataacacccaatacgcactgcttataggatttgtcacctaattcatactactttcagaatacaccactagagtacgaattttcttcgttccgtaacactccgtccatccaaagacgcccgtcgtcagttcatccatctctcgccgtttgcccgcacgaatctggccgccggcgagctcgtcctcccccacgccggcgagctcgtcctccccacactagcgagctcctcctcccgcacgcatctggcgagctagctcgtgtcgtccccgagctcagccgccgccgcaccgggctgccgccaccgcgccccgagccggcgccggtccaacctccgccgccggagctcgaagccctctgccctccaccgctgctcccctctcctccggccctccaccgcgtgcgccgatggcggcgacggacgagcgacggcggggccgacgcgggtgacgacggacgagcaacggcggggctgacgcgggcagcgacggaccggcgacgccggagctgacacgggcacgagcggcggtggactgacaacggtggcgccgggaggacggaggactgacgctaggggacggagtgtcacggaacgaagaaaattcgcactctagtggtgtattctgaaagtagtgtgaattgggtgacaaatcctggaagcagtgtgtattgggtgttatattctgaaaattctcggtcgtgggagagcgaaggagggttcgccggcggccggagatgcgtcctccgatgccggcgcgcggaggtgcggcgtcgggcaggcggtgagtgaggacgatggccgggcgcgcctattggatctatcatctacgccgccgttttttccgaccttctccggcgagccgacgagataatgacagctctgctccattggtcaacgagtcaacggatttcggttgtgacttgtgagtactactatggtccatccataaaaaaaaatttggtatattttgactttccaatttaagctttgactaataattaaccgcaagtataatggcatactagtataaattaactataagcacacatagatgagataagaaaagaataaaaaagaaagtgggctgcagatttctatccagctacaatttcaaaatgttgtgtgtataagaggtgagaccatatattaataatatagtatatatttatatgcaactattgtatgaatgcgctattaaattagctatagatgattctcttagttaacgctatcgaaatttaaaataatgttaggatcgttcgttttatttaaaaaatttatgtaattaaaatatattttattggtagttgtttaatcataaaaatagtttaagcatgatttatatttcatatatttaaaaaataattgaataaaatgaataggcaaacgtgtatttaaaagtcaacagcgttaattattaaaataaaaaacggagggagtatttaggttttatcattattattggattcatgttagaaattacgttcttgtgactgattttgtaaatgtaggcaaaattaaaatacatcaaagcttttttacggtcaaatctttttacatcagaatacaaactatattaatgataagctttgttttctaaaagtcaaaatatgccctatatctttgaacagaaggagtacctccctttacaatatttgcacaagtactgcctatttatgaaatttgaccactcatcttctttataaaatattttataatcaactaaaagcgcagcattagagaagtgtgtttatatcgtaagtattataggttgcaataccctacccgcaccacaaccaacaccccaaagccatcgtccacgacatcgtcgtcctcgccgccgccaccatcatcgacatgcaccacctcgtcgtcctcctcttcctctctgcactcgtttttgtcgtcgatgtcgaccacctccccatcgtcttcgtcgtcatcatatacctcaacctcttctctgtcgtcgttgtgcacatggttaaggcggccaacatcatcggggtcaaggagaagggattgtccctcctcgtcttcttcggcgatgacactattcctttgttcacctgcgtcatcatgtcactggaatcctgtactctgacaggtggccacatgtatagctttgtcgggagttttacttttacctgttggactcaataatagtaggtacaatagtaggctataagccagctataaacacatttcgaggagataaaagaggagggagaaagccagcaggctacagatttatagtcttatagctagctgcagcacggactccaaggtgcatgtgtgtatgacaggtgagaccagatattaattatgaagtactgcctccgtttcaggttataagactttctagcattgcccacattcatatatatgttaatgaatctagacacacattcatatatatgtctagattcattaacatatatatgaatgtgtgcaatgctagaaagtcttataatatgaaacggaggaactatatgtttataggtaactgttatatgagttggctattaagttgactatagatgatttggagcccgcagttggctatactattaaacttgctctaaccaatggcaatcggaacgtacaggatcatataactagcatacgcaaaaaaaaaaaagaaacccctggtatttactaaattattttttgtgtaagaaaattaaattttgacaatgccataaattaaatctttgggtaatgccactagatctctgaccaaatttgacttgacaaaatttggcttgacatggcacgttgtggctttagaatctttgggtcaagcatgcatgtcgtgagcaataagattttttttcgtcgacgtgcataaaataatttaccaaaaaagcgcgcgcgcatacgcatacatacatacatacatacatatatatatatatatatacatacatatatatatatatatatatatatatatatatatatatatatacatatatatatacatacatatatatatacatacatatatatatacatacatatatatatatatatatatgtatatatatatatatacacatacatacttcttcgtgttatattataagtctttttaattattttcctaatcaaacttctttacatttaactaagtttataaaaaatatagtagtatttttaacacaaaacaaacatatcatcgaaatatattcaatgctgattgctagaataataaaatatattcttaaaatgttacttatttttcattaaacttagtcaaacttaacaaagtttaatctctttgttaatcagaaaaagtcaaagcgacttataacatactcccttcatccacaaaaattacacatattacttttgacaccaagaccaaggagaaattaaattaccttggatgctacanaatcaagaagtaaataaaagcatgcaaccaatgagtatttagatgacttcttgagttctaataaaacatttaatttatctcttcatttaagtcttaaatgcataaaaactataaataggaacaacttatttggaaaaactcaaatgtgaaataggtgaaacttttgtggatggagggagtaaaataggagtatgtatattaggctaaggctgaaaaatataggtactactatcaactttcagaaactaaattttggttacttataaggccacacgacgagagcaagattgtgatcaggaatacccagaagcatgtcaagagtagtatctttattgagaagcaaaagcaagcggcaaaaccattacacactgcttgctgggcaccgtcccatggccgaacgtgaaaaacatagcccaagagagtagtacaatttacagcagcagtagcatatctccctcaattatacactcaccactcatcgtcacagcacaagcactaggtttttggtcatgctaaggaatgaaatttctccagagctagcacctaaaacctttttccgtttcggaggaaatcagctcaggttttctgacgtggcatggttacaacaaggtttcttgcttgtttctgcaagagaaaccagtcatggtcctcatggagttcaccaaatttacaatgacaggcttggaggcgacgagaagatgtcggtgaaggcttttttttactggatgatcattgttcacagttcatggcgcggattgctgatgcgaagagatcaatcttccatcttctctttgctcaagcagtgtttgattctgcaagcttcaatggcccgaggtgcaatggcggctgctcacatgaaaccatcgtcggcattgtccaagcagtgttcaagcaccatgcgtactgtaagctgcacaagggacaccttgggatgttagtttaagcccaaaccaaggtttgtaaggttcaagaacatatgccgacaaatgctaaccaactaccagacatgtttgtcatcttgcattatttttgttttttggttttaatcaacatctttatatataaacccatttgaggccatcgagtgcttgtgtgcttagaattttgcaggagtagattttaactatttgttttcctatagagtatttcaatatgtgtaaatttgctaatgtcaaatgcttgttcatagcaaaggtaaaatgacattttctttgcccaatcaagaatatacaatttagtgggcaacatcaggctaggctagataaagctacgacccgagcaacaaaagtactcatgcatgttaatgtgacaggagcagcaaggatgggtggaccataaatatctaacagcagcaatgaagtaatcatgacgctgatacccaatcgtgtgttttttcgagctcaataaataaaagaacaaagaggtaccttgcaatccaagcagggatc

SEQ ID NO: 73811 - DNA, 739 bp, Oryza sativa
catggcggagatgattgaagcactcggctttgaagtaatctagttcaagaaaagattatctttacgactgtgaaggtctcaggggctactgtgagattatgggtaccccatacccacacggcatggttatccgattagtcataggggatagcttatatctatggaatatgtaaccgatcatgacttgggtattacgtttccttttatattatggagcggcctaaagtcctgatttgataatattgtaaaatagatttaggaaaccgataccgtattggttaaggtttctatcttgtaatcccgcccccatcctatataaggtgggcaggaagccctctagggggcatgagacaactagatcgtcagatctatacatactcgacggattcaaatccccaaacaggagtagggtattacctctcattgagagggcctgaacctgtcttaatcctttgtctccgcatccatccacttttaggtctcgtgcgctacccctttttaagacttacggcttgcgtcttgttccctcacccgcatgagcctcaaatgctgacgggctaacctggatactcatcatatacaaaaagttaattatttcatggagtatgatagaagtaaattatatatcataaataagaaaggagcgcaccactcggttgcagtgattacagtagattctttgatccttgatatacccatcaactttcctctgtgatgaactactgcaggaacgcacacc

SEQ ID NO: 73812 - DNA, 1778 bp, Oryza sativa
atttattaaaaatacccacaagccaatttgacataaatcttggtgaattttagttgttggaggctcttttaggcttttaaaatttctagaaatgcattacagcacgatttaaatttagggcaatttttagggcgttacaatatccgtgtgcttgtagattttatctgtgatcgtaaaaaataccaacacccacctctcatccgccgcatataaccccaaataatgatatcccgtaatctagacaccacgcctaaactatcagatactactctaatatcatcgtcctgacatagagtaattgcatatgcaaacattatacccgcaccgaagcatctcccagataagctagcagtataatcagtataacatgaacataatgtaaagttggcattcatatactcggaaagtatttcaataccataaatgtataaagaagagtattctaaataaagtacatagcttacaaaagagaagagaagagttactatagccatacccgaactcttccgaaggcttccggactcctgatttctactctattcctattccactagcttaagaacattaaactaacttgagagaatataagagagctcttgcttgaggtgtgtgttgaagtgaagagagtgaagtccttatatagaggtagttatgacggttgtggaagcagaattatccgaagtgccctccaaccgtcattgggatgcaatcctggacgtccacgccgaaccctgcatccaacagcatcaggatgggttcggccaaaccatgggctgggccatcccggcccatcttcggctggtggcctcctctattgctcctttatgcagacttgtgaattttggcccaattcatcgtgtcaattctgagttcttagcccattcatgcataagtctgattctcgacatcgtccgaatgatttatcgtcttagttgatgccgattctcctccatttaatgatcattctctgcaaaaggttagtgaacctaatactggcggaatattattattctaacatgtatatgcattgatgcattgcaagcataattagttctcctctattttggtaatattgatggtcgaaactgatcgataacgaccgtcaaaaaacccccccaagcttgaacctttgctcatcccgagtgaaggacgaaaggaaacaaaaacttgattgttgatcaggagttgctactatgctgtatatcttaaaggtacaagtgcaaggtatatgtactctctctcagattaaaaaatctttggcacagtggcttatccttatctctgattcccacgagacaccggttctccttgccttgggcggttgaaagacaacatcaattatagcaccaatcacccaatctttattcgactcttatttcggaggttttcaaatgattttgcaaaagaaagccaagttcctcaaatgattcacttagtctctctaagtgtatcaatatgaatttcttaccatttttgcctttttgattcctactctaaggtttgatatgtttagctcggtagggatcaaacatggcatacttgcattcagatttattactaagttaaaaacgtagactaaaatagataactaaacatactcaatatcaagatcgtgcaaagtgtgtgatatattgtggaaatggtatataaagaaaaataaagaaaatgcttctcctttgtgcttactttcttctcccataaatcattcttttattaattaggagagggcatagctacacatttctcttttttttttctttttttttcatgctcatgct

SEQ ID NO: 73813 - DNA, 869 bp, Oryza sativa
  unsure (1)..(869): unsure at all n locations
tcgtctgtatgtagggagtattcagattattgggttgtttnctatcacctcctatcactccgacctttcttatattagtgagatttcgcggactcttatataaatccnntnttccnnnnnnnnnnaagagttagattttgcattgcagtaccacntctcactataccgcgaattcgagctcggtacccaaatagtacttgcggtaaataataccgcgctgcgtgcacataacacaaggttgttgttctgtctatattggctgattgcataaagaaacataaatctggctgaggtgaataattgatcattcggagccctctatatttattgatattgaagccacaaccatctaataactggctggtataggtgaagattatcgcctggaatgtatatttacatagggaatcacatatacccagataacaggttaggacctaatattggcataacatctaattgctttagtcttttatcctgaaaattgaacacttgttcttactgaaaacagaactttgatggatgtctttattgcagaacacttgctcgaccaagttcctccacgaagccagaagaagctctgcatggatgacaggctaagtgaccttcctgatacaattctacaccatattatgtctctcttatcagcacaggaggttgcacgtacgtgtatcctgtccaagagaaggaaagaaccttttgcctcagcaccatgccttgatatctgggtacataaacttggaatggacagggtgcggttcagggagtttgcagcacaattggctgctattccgggctcctaaatcacttaatacatttcgtcattactttttttaaaatcaaccatgcccactcttggatcaaccgtg

SEQ ID NO: 73814 - DNA, 725 bp, Oryza sativa
atcgaaccactttggtctattgtgacaacatcattgcagttcagcaccagcacatcaagcacgtcgagattgatctccattttgtccatggttgtgtgactactcgcactattcaagttctacatgtgtgaactacatcccagtatgctgatatattcacaaaagggttgccgactgatgtcttctttgagtttcggtctagtctcaatgtccagcctgttgacgttgcgattgccgggggtgttagcatatctcatgtatatcgcatgttttctttcttttggccagtcctcccaatatccctcccaggcatgtttctataaactggttgagtaggatactaggataaggatgattatgtgcctatatgtactcggcgttgtgatcaatcgatattgtgttgagtccatcaatctaagagtctgttgggccactcctctcaggctctcacgatgcctgcgcctgcacacgctcttgcacttgacgtggccgatctcacatcagtcatggaacaccaatctatggagcttgcatgattgtgacgacacctgatctctatctgcaactctgtgtctccattttctcatcctggatccaatgggtggcggtgagaacattggggatattatggaataagttcaccggaggtccctcaatttaacaccaagattttttgagatcccttaaccacaaaacaagaaatgtgcacccctaaacttatataa

SEQ ID NO: 73815 - DNA, 20196 bp, Oryza sativa
cctcatcttccagaagtggctcgggagattcgtgagggggaactgctgtaactgtaacacccaagaaaaccacataagcctgggatgccactaaacaaccacacataagtgccaaaacaagaaaattttggcaacaactaccttagacaagaaaacatcgcggaagcatcaacatatagattaaggttatgatacaacaatggactgacatgtagggataggcttgaaaaggtagctcattaatggtcaacacttctagtgtttaattaacccattatgtctaaacacaagtaatcctatcagcatattacaataatcatgactaagtgagatcatgtcgtgcaacagtgtagctaatcccatcccttcacgcaaacatatcaacagcaagtacctgaaaagactataaggggatgagaataaatctcagcaagcaaacggctttaacaagctacttaaaccacaggtggattatatagttaattaaatactaagttatgattcacataaagacaagttgaatatccatagactaaaaatatcatgacgtcaccaatcaaatccatatactcacaaatcccagagaagaaaacacttctcaaagatatcttcgatcgatatttcacgtaacatcctgcaatatgtacatatgcaatgcaatgatatgtactcctgctttcacacccaacagggtgaataaatgcatatgcaatgcaatgatatgtactcctgccttcacacccaacaaggtgtgaagctgcatcgtattacggcaatatacgatgttgtaccggtacggtcgcaaccataggttcacgacataacttcaaatgcaatgcaagtgatgcaaatgcagtatgaaatccagagtataacatcggaaccaaattccttcgatggagatcagtataagggtattataaccaagagcataaagtataaccatatacagtgtaaaatcaataagtgtgattcagataggtaaatcctctgggcaacaaataataatatatcggttgatgatatataattttcaaagtgaaggtagaataaaataacaggttaaagctgtagcaaaccaccgctacgttcacttgccttcactgatgatgagatgaactctagttgcattccgaagtggcatcacctgaataaacaccggctcagactcaaataacatgcataatcattcaagaatcacacatacgcttcctacgctgggatcccaccccaaacaacattaaacaaatcaccgataatcttcctataaaagcagcatagattaacaattcgatacctccaattctacatcacataacacagcaaaatatatcatttctgacatctacagaacaagagttacaactttcatttagataacaaaattgaattcttccatttagctggcctaaaacatggcacaaaacagagaagtgcatctgcccagaaaactgtgcaacaaccattcaaaagagcactgacaacaaactacaagataaaatctaacaatttttatgtaggaggtagatcacaacatatgctacaacttttgtaaaaacaagtttctctgattccatctttaaaatcctctaaaatccctctgaacctcgactacagaaaaatgcatcgatatttagacagccaacttcagaaattgatacctcctaaaccacttgatataaactcatgccatttggtcagaagatagatctacacgtttctacaacttttgtatagagacttttcgcaggaaatcccattatgttggccgaaaaggcagccaaggtagaactgtgcagggtggcagatcagaaaaaaaacccggttgaggaataaatcggtggatccccaaacttactcgcttccaacacttgatctaaaccctaatagaaaaccaaaacagagggacgaaatcatgcattgatacctaagcctccatgggcagcgggtaatcaaaccccacatttccatcttcacctcgatttcctccgcttccttctttccctttcttctccttcccttcttcttcccagatctgcagcagggcaggcatgggggaggtcgaccagaaggggaggtgggcgccccaaggtaccaaatgacggctagggggaggtggggagggggacctcctagggttttggggtgtggaggggcagctgggccttgggctggctgaaagctagcccagctagcgaataactattgtttttcttctaatttcaaacaccaaaaccttacggacttccaatatatcctctacggtattctatttttttctagggcattacagtaacctcctccgctaactcaatctctgagagagagtcggtcaaggcgaaccttgcccgcgagaatggaactgagaattcattccctcccaaagttatcttgaggctatctaatcggagcgtgtttatgaggagttgctcaatggaaagcccgattagaatgacaatatctcggatttcaaagacgtggaaatccaagaccgcctccctgtcttcaaagtagacaggcacatcttgcacaatcccaaatccttcgatgatatttccgttcgggtgtttgaagaatttgtttgtcagggttactggcttatcgctcagataagcgaatgcaaatgactcaaagatgagattaacctcgatagttggactgtaaagaataccaatgtcgttcccctccagatgacaaggaatgattcagggagcggtatttatccgaattacttcgtatgaaagctctgcctcccttagccattcgtcgctcattatggatgttagctcccgaacagtttcccgtaggaacccaagttccataagatcaggaggcggcaaagggacgagtggtttctttttactaaaatagtttagggtgttgccatagtcttcgtcaaaaccgtcccttaacagaattgcggcatggtccgaagtctgaatttcttcattcgcaacggatggctgcaaaggaactttctcatcaatcgagccagtggaagtggaaggttcagattgtgactcgattgttgaaggttcctctatcttggacacggatacctccggagggggttcatcagactgtgccatgaaggaggtactttctagaatgcggtctagaattatttttccttccaacggcgttttgtgcatgaatgatcctccggcggttatgttcagatagaatgtagattccttatccaaacccatatggaaatgttgcaagagcatatattcgggtaaggacaaggttggtccggactgcagtaaattagtgaatctagaccaagctgcaccgattgattcgtttttgatctgctggaaactgatgatctctactcgaagggtagtaatacgagtatctgggaagaaggaaagacataatctgtctcgcaactttttcccaactaacatttacacatccaacggtagaggtgtaccattgcttcgctctctcttgaagagagaacggaaacaattttcaccatatggtttcttatctcatgccacgaatattaaggcatgagcagacatgctcaaagtctcgtagatgatggtagggattttctagatcaaagccagaaaaagtattttccctaaccatgttgattagtttggagcgaatttcatagccagttgtataagttgggtccaatgaaggaggtggctcatagaattcgcccctaggagcagacagctcgaaaagaggttgctccatagttgagaagagtttgacaggaatacttctctgggtagcaggggtaaaggtagaataaaaagtgaaaaagagatacgatgatgaactgggttcggaaatgattagcaaccgttccccggcaacggcgccaaaaatgcttgttggtaattcttatggtcacagatagaaatccgcaagcgcacggatataccgatgtagcacttcccctatggagtattctaagggtatcgaatccaagggaacttgtggtttcagatcttcattcggttcatccaaggacaccaacaaaggatatgccaggatagacatgattttctgttgataaacagtgtctagggaaagcttaagttcaatcctaacgcaatacttcaggcactagcaacccgctgttcccagatgtcgctctactacatacctggatagggaggacttaagtaatcttgagggctgtcaccacctctacacctacctcaaacgtactgtgggatacgcagcaattactggataacaatcacctaaaaaccacgtctaagcaattaatatctactttagtgtttataactcaccaaagcaatcactatattttagttaattatagtgagcaataatcccgtatgctatttaggaactaaccaggagacaattctcataagataaatctaaattactcaagaaaaatattgtattgaaatcagagtaataaacagaataaaagaaataagagaagattactgacaactccggaattcttccgatttcttctactctactctcttcgtattctagtatacaatatagtgcaatagaacctcttataattcagctcaagcttggaagtgtgtgtgaagtgaaggagtgaagctacttttatagggcagttatgacggttgtgagaaggggaaatgtctgaactgccccgcaaccgtcattaggagagcatctggagcatccacgccaaaccccaggatcaatggcgatcagaggggttcggccgaactagggggttcagccgaacttgggctgggccctcccggcctggccttcggcctgtggactcccctgactctcctctgtccatttctcggagttttgggctgagtctttgatatttttatgactagtgagcgtgcacgtgcaaggcatgtcagtatactgaatagagaaaataaaagaaaaatacatccatcactgatgcacatcgacatatatcgatacattaaaacttacattcaccgaatgaaatagcataaagcatgtacgtcagaaaccggaataacctggtttagagtcatggatgctgatgttagcccaaatgaaatagcatcattgcgctctactgtattaagattttccattgaatcctggattttctaatttgttttgcttccctcaaacaaatgtttctgatatatcatagtttgaacgtgatacacagctatagataagatgcagtgccaaatttggacatcttcagctatatagttgggtgttctaagtagacaggtgtatcaatcaaagagctgcagtatgctccccatgtgatctcaaaagaaaaaataattggctacagtgtgaggtaccttgcaatgctacagaaataattaagaaacaaaatcaacctttagatgccacgaggagaaataatgtaatttcagtgttcaacaaaccaaatgctaagaatggcatcaaatcctggagacagagctgctcccccttggccacgcaagtatgtcgatgatatatgccactaactcctagggtccaaccattgctatagcattactgcattaggtttagaaaataaaattttcagaaaaagttcagtgcttgtatgaaaagtaggaagtggtatatttgaccaaaattcttcagaatttgaatgagatgcagagctcaacgatccattgatcgaaccacatgcagagttagtaactgaggcgaaacacaaaaacctcttcacatcaggtcagccttacgctaccatggtctgttgctttagagaacacatatagtaaatctacacgaatttcgtaagagagaacatataaagaaagcgctaaacgtttaaaagcatgacagttttcacagtgagaattagcatggctcttagactcttacaataagaaccattgtacctgagacttcggttgtaagaagattgtcacaagaggaaaacaatgcatcttagtaactatgtttctggcaaaaattcatcttgtgatagccaaagcagaaactgacagcaactcttagctctgagttgaatcaataaactactaataaaccattgctcagcagtttttttttcgccgggccggcgaatagccggccgatgtatattaagagaaagaaaaggaatgtacaaggttgcgcggtgcgtcagagcaccaccattaccgacacaaaagaaaagaaaaggctaaaatctcacagcaaaatttgctacagggtggcaaaaggggctaacaagacctgcagccatccaggtctcccattcatcccccatggccgagcagagctcgggaaccgttgccgcgattctatcgaacaccctcgcgtttcgctctttccaaatcaaccaagttacaagtataacccccgcatcgaatgttttgcagtcaaccttagcaacagatttctgtgctgtaagccaccaatcaatgaaatccgccaatggcgaagagcacgaaaggcccagacgcgtgtgcacccgaccccaaatctgctgggtgtaagcgcagtccatgaagatgtgctaacaggtttccccatcgttggagcacaaatggcacacccgggcaaggctcaatccgcggcgttgtagattgtcggcggtgaggcaagcgttgcgcattgcgagaaacataaagaacttgcatctcgccggtgcacgggatttccaaataatcttgccaagtgggcacttcatcctgcctgccgaaaacagggaataggttgagcgcacagagaacacaccatccggagctgccttccatatcatctcatcccgactagcagggtcaagagagattccagcgatcacatcccacagatctagatattcgcccaatgcttgaaccgagaggccgtctctgatatctgagacccaggaattattacggagagcagccgccacagtcattccactattcttaacgaaagataaagaggataggtcctctgttttccactgaaccaccatccggcaaccaattatctttccaaaatagagcatcttatccattccccaggaccaccttgcagccgataggaaaacaatgcagtctcttcttatccgccggcggcgcgaaacgcgcccacggtcgctccggctgcgttcggtggaactagatccacctagcacggagagcaatgcccatcagacgaagatttctgatcctcagtccaccatactcgaacggacgacggagtttatcccagactacaaggctacacgacccagccgcctcttcatcacctttccaaaggaatccccggcatttcttctctatttcgttgatcgccaagacagggacttccaaaactgacatgaagtaaagagagttccaaaactgacatgaagtaaagaggtagggccattaggacatgtttgatcagcgttaggcgggcatcaggggataaaagcttgggtttccagccagccaagctttttgcaagcctatccatcattggttgaatctgctcctttgttggttttctgacggagagtggcaacccaaggtaaacaattggcagcaacttgactgggcaggacaacacatctgttacttcatcaacttgcgcatcagagcagtgaattggtgttaacgaacttttaagcagattagagaccaaacccgatgcttcacccatcagcttgagcacaaaattgattgtcagcgcatcgtgtctggaggggtggaagaagatcaccgcgtcgttgtcacatcccaatttttattaattttaaaatttacctatttccaaaatttaaataaatatcgcctttcgcttttgttcctaaaacaagcttaattacttttattaaattaattaatgatgatgttaatttttattgtgtgtttattctaattggagttatttggatttaattagattttggtttgcgagctcaaattattctaactccctttatttcctaaaataaccactcaaaaaaaatatcatttgtgcagaaagccttccttttccttcctttttcgcttcctattgtttcttttcatttctccctctcttttttcacgtacggactgaaacaatattttctgtttcttcctctccaacacctggatccagctcctatcccaaatattgttgctttaatcccatgaaccagcagttataaaaaaagaagagatgaagagcaaatcaaccacccagactttacatcttcctatcaatgcaaacatttgacatttaatcctctgttgattgctctctccatccactatgagtttaatcacctatgggtcatcaatcaggatacgttagcaagccaagagccaaataattcccctgcattatcttcaattgaatcaccagataactcctccactcaacattgattccttctctcactgtataaacagacttccaccatttttctgcgttctcaaactctcaaaggctcatagagccaattcccacacttggtctgcaccgcttgctcacctagggccggcgtcgttgtggtaagacactctccttcctcctatctcagcgatggcgctgcatctccctcctcaacaacgttgacaatcggaggtcatgttcaccggcgacgatcaccggaggcattcgccagtgtcaccacattcttgtgtcggcaagtgctgttagcgaagctgctgtcttgctggtcaccatcattagttcatttgtgcctctgcacaagcacgtgatgtgtcctgtgaaatcacaggagctttttgttcttttctccttgccactaactggtagttctccttcaaaatgtcagaaaccacaaccaaatataaatccctgctttaattcctatactgatcgtccagtcccaaaataatcccagatcttttttttttgaccaagggcattaagcccccatttccattactagaaatgagaagactacaaaagttcaggttcagatacagagcaatcccagacaagctatcaagatagctggttttgtagatgacaccaaacataacagaatagcagcacatagctctaaaatttaaagccctgaaacataaccaactggtgattcagaaatacagcaatcaccacccaaaaccctaaattttgtagttgcagctgacatccagaccaatagagagagaacaatcttcagcatccaatccttcttgtagcggccctccatccatccttggagttgaaaatttcacttgccacctgtcttatgagtttggctcctaagagcaactttctttgatcttcctccagtctctgcaatggaatccaagattccaaccaatgacaaaccgaaaaaatcacatcagttgggtcattagggagtttattctcaaaacaggctttgtttctagatttccaaatggcccaaagcacagcagccacaccagtgacaacaagttttttaagtttctttccaaaagcagaaatccaggagctaaacagttgattgctatcaaaaacaggtttcaaatccaaagcacaggagataatgttctagatcagccttgccatagcacaatcaaaaaagagaagctgaatggattcttgttgatcacagaattgacacttagtgtcacctttcctccaccccctcttaaacaagttgtctttagtcaagattttaccctttagcatgagccagataaagattttgatcttcaggggtattttaaacttccaaattttcttgaaaggagtaggtgtctgttgaatacagagagcattgtaaaaagatttgacagaaaatgtcccttgcttattcagattccagctgagcctatccttacagcctagctgaaagtgtagatttgcaaagttttgtttaataagattccaatctgtcagtttttcatcaaccaaggtccttctaaatttgatcacactccaacctttttcttttatcttagctaaggaaataagttttgtcaaagtgatattataaagagcagggaactgagggacaagtgggcggccacccatccagctatcctcccaaaacattatagatctcccatctcccactttttttgaacatagactataaaattgttcttttacttccagcagcccctgccaaaagtaagagtctccaggttttgctttcagtacagacaagggtttcttcgtcaagtatttattcctaagaaaatcttgccaccatccctcttcattttcaagttgccaaatccatttccctagtagagccttgttcataagatcaagatctaacactcccaaccccccctgttccttaggagtgcagataactggccattgaacaaggtggtgcttcctaatgccctgatcctcttgccagaggagccttcttctaaagaaatccattctctccctcacccctttaggaattctataaaaggacggcatgtagagagggacattacttaaactggaattgatcaaaatcaaccttccaccaattgattgaaatctcccttgccaacaccccagcttgtgctccattttattttcagctgttttccaatcctttttcagaattctttttttatcaatagggaccccagatatctcataggcaaatcacctatgttacaagtaaagagttggctatataaattttgtctatcctctatcagccctatgcagaaaatttcacttttattgaagttaattttgaggcctgataattgttcaaacaaacacagaatatatttcaagtttctggcataatctagattgtcaggaatcagaagaatagtgtcatcagcatattgcaacacagcaactttgttttcatcattgacacctaatccttctagcagggaattgttttatgctctatgaatcaacaaagtaagggcttcagcagctaaattaaaaagcaaagttgacaggggatcaccctgtttgagacctttgtgggtttggaaataaggaccaacttcatcatttactttgacagctaccttccctcctctgatgactttcatcatccaatcacaccattgagttgagaaattctttgcaattagcattctataaataaaaaacccaatctattttaacataagctttttcgaaatcaatcttaaaaagaatgccactttgtttcttttggtgaatagaattcagaatttcatgaaggattaccaccccctccaggataaacctatttttgagaaaagctgtttggtttctggagataatgtaagacatcacacaatcaatcctgttcatcaacacttttgttagtattttgaaactcacattcaggagacaaataggtctaaacttttgaatttgagcagcatccttagttttaggaaccagagtgataatgccaaagttaagtctctctacatccacatccagagttcctttatgaaattcattcaaaagctttaagagatcaaactttatcaggtcccagaatttggcataaaactccccagggaacccatctggaaaataatcccagatctaatccacccattttattttctataaatctatttaatttgagctctctatttttctgttctgtttattacttgtttgcccatcgtttatttgcttctgttttttttatcgtgcacgagtagacgtcgctgccgaggaaggagcaggtgcagaagaagtttgggttggagattctactggtgaaggcaagtgtactcctttgatcaagttgatcccagtgtgtaaatattattgtcttcaaattatatgcatgttttatttaaaaattagcgctttgggtaattactgtcctaattgctataaataaattcctgccatgttatacattgctacctgtaaattctttgtcgccacgtattttgggaagtgagctactggaatgaaaagctctgataggtagttgagcttagccatgcgcataatggtttttaagcaaaaataatattaaacttgactaatcatatactcaacattgtttttataacgaccatgtggctgtgtgccgtcttttggtggcatgtgatgcatcgtatgataaacatatggtggaaaaattgttttagactggggtgatggtggatctgtctgaacctaggggggaagccttctgtgtgcgtgcttcccatcgacctgtgtggtccttgagctgtgtgctccttttgctgtgtgcttgaggtctttagtttaggcaagtcgccccggtcaattgaggactttacttcgtgcgccattgatctaagccctatcgtgcaaccacacgttctcgtgggaaggatctagcttagtacgcttcctagtccggacactggcgtcccaggtggttagatgctaggattttggatcgtatcgtgggacctttcacctgtgtggcaaagggaggactgcccatgagggaggccggtgttagggcgaggtaggggaaacgctttgttactctttagagtttggccgcaccgaagggtatcgtgtgagtaaagttgtacaacctctgcagagtgtaaatctattcgaatagccgtgtcctcggttatggacatgctcggtgatttcacatgaggggtagattttcgaaaattttactttggagcgagctgtgtgcaagataaattaatatgtttagttttgtgggattatatttgcatttcagcatttacattctgtacttattttcttttccggtatttaaattctgtttttactgccccctgtatacttttgtactaataaaatgccatttaagcaaaataacccctaacctttctttgttagccttgtaacatataatgcatgtttccgtacacttgttgagtacttgttgagtgctttatgtgctcacccctggtgctatctcaccagttgcagaggaggcttatcctttgtttccagaggaggttgtggcagtggatgatgactaggctcgcgtctcggtcgattgcctgtggcagtttgatgaatttcacttcgctgtttatcttttccgctgtgtttcccttcgcttttggggccctgcgcggccgaataaatatgtaaaccatgttacttatgcactggttatatattatatgcgtgatgcggttgtgatgttatttctgtatcctgtatatgctagcatgatcctggtctagcattttatacagagagatcctattcggggtctcgacagtcattggtgtagagcgaggcacgcagcggtagatgtacattggcaagaggagaaagctctcctcgctgcacagccgttgcgcatagggccgccagagcttccgtgacgatgacgaacaacagtggagagaggggatccctttgacgcaacccacgagcaagcctgatccgttgcgtatctctaccgttgatgatgacagaagtagaggcggtgaagagcaaggccgcgatgcaatccctccatcggaccccaaaacccaggtgccggagcagatccagaaggaattcccaggaaacagtatcaaacgcctttgcaatatcaatcttcaagagcatggctggcgttttagaacgatggaggtttttgaccaccccctgcacatacagaaaattctcctatatccttcggcgcctgatgaaagcagactgtgccggcccaattagctcatccatcctcgacgcaagtcgcaaagccaaaatcttgttgagaatcttggcgaagctgtgaatcaaactaatcggccgaaaatctgacagttgattcggttcctccttctttggcagcaggacaattgaggctgtgttaacaaggtgaagatgctgggcattggatctccatgctaagttaagagctgccaccagatcattcttgataatttcccaacatttcttgtagaaggtggcactaaagccatccggcccggtgccttgtcgctcgacatttccaagatcgccttcttcgcctcgtcttcagtaatgtcgcgctccaaatcagagaaatcatgcaccgccaagccgatcgcatcgaaggcaagggatgccgacggggggcaaggcatgccaagaattttgagaaaataatcatacgcagcctgaagcttgtcctcttcagttgttgcaatgatgctgtcctaacaaatagaggaaattgtcttcttccttcgacgagcattgattttgaggcagaagaattgagccgtggtgcctctatgtttcaggaaaagcaagcgggcatgctgtttgagccgaatgcgctccagggaggcgagcgcgaggcagcgacctttcagagatgcccgcaatgatctttcaccagccgacagaagacgatcatcctgggtctttgtccaattggaaaactacttcatgggcgatcgcgagttgctgacggagctcactgatacgcctggctccccaggaccgtaaggcagcagcagttgcacgcagcttgaaatgaaggctgctgagtgcattggagccagccggcgctgcctcccacgcctgacagaccacatcctcgaaatcctccaatttggcccaataggattcgaacttgaacttcctcggcctatgcatcatctgatcgcaggccagcaacaggggacagtgatcagaggcagaggagctgagcgcttgcaggtgagcatcacggaaaatttcctcccaatccccatttactagcaccttgtcgatttttgttagagtcggtcgttcttgctcattgctccatgtatagcgacgcccaaacagatacacctcgcgcagctcaagggcatcaatggtgtgcctaaacttgctgatcaaccgtcgatttacattcccattgtttttatcaccgtccgtggccaagaggttgaaatctccgaccacgcaccaggccccgaccactagctgcctaaccagcagcaattcctccaggaacaacaatttgtcgctgtccaattgggggccataaacattggtgagagtccaacttgccccaccttccaggttggagaaacaaagagaaagcgaccaccgtcccttgtgaagacaggaaacagagaagcgatcatgccgccaagccgtaaacagcccccccttgttccatcagcaggaatgaaatcaacaccatccagggcatgtccacacgactgaatcgacagggaccgatctagaacatctaatttagactcctaacaacaaaaaatagaagcactagaggttctaacaacttccgctacaagggacctcttgccagggtggtttagaccccttacattccagaccaaaagagtacaagacatgagaaacgaccagcttcaacattgcagcacatgcggcagttttaggctgccgctgacaccgccacactgcagagcgccgccagcgcctgtacatgagatggcgctaggggagccttgaacagctcgaggtaccggaggatatcccgctcgtccgccttgttctcatcctcgatgatgccgagtctcttcatcaccacccgctgtgctctggtgatcatgtggatatgtttcccactattctgggcggcaaggcgctcgctcctccttggagtgtacgaggacgggcggtgtcggtgccgaggctggtggggacgcttcccgaaaagtgacaaaggcggtggtcccaccagatcagccaaggcagggagcgatcgtgggtcagcccactcctctagccccggcctataaagaggaaaggcccgcgggccagtgagctccctgcggcggcggtagacagccaatgggccagggacgagcaaagccagcccaaaagagggagcgaggcgtggtcccggcaagttgaaaaaatctccatcccgctcagcgggcaccaggaccgacgaagcatcaacgtcagggcgcaccggtgatgacgaagtaggtgtcaacattaatggctcctcaggaaaaagctctctttggagacccatctccctggtagacggggccacaaccatgcatgccggggctgacgaggggtgagtaatgacgcgtggagacggtgggcccagagccgccaagcctagggaagaaagctgaggcagagccggtgacaacgggcagcgcaccggcgaaggcgttgaaggcgaggcatcccaggaggtgggggctgccagcactggagaagcaccccccggactcgacatccgcggcaggaaaggcgcagctgggggcggtggcgtcgtagccggaggcgatgccgtcgcagctaggagcggagtcgtcgacttagctggggatgaagcctcaagcgctagcacagagactccctccagaatgcaccgaggcatgctagctggcatcaccgccgcccgagcggggagctgcagatgggacgcaggcaaaacgggtacgcgctacaactgccgttgaaaaccccccgccgaaccagaacccatgtctgccaccaagcgccggccccagccccgttgcatcgatgcgaccgaggaaggtgttatgggtgcggcggtgaggaggtacgaagtcatcgtctgaagaagagccttcccgaggctcctggagcgggtcgaccacctccatgatgtgaaggagtaggtcgaacttgagacaatgcttctcagacggtggagccggcggcccttcggctaagagcacctcgaaatatccggatcgtcggtctctggctcgttccaccattcttgcgtcggctcaggaatgtcgagggcaaattccttgggaatggcggaagggttcaccgcccaaggcagcacttccgtcatgcaggcatcattcggcgggaatgattcgatgaactggcagtccaccttgttcaatagctgcttgagctcttctggctcggccgcatggggagggaggccctcaattgccagccgaacgatgtgtctcattttggtgcttcgggcatgaatggcacggtgccagcgacgaaaggtgatcctcgcgccagcaactgccaaacggcctgagagatcaagaaccgccatgcagtcttcctcgcgcgtgaaggatatgagaaaatcggagggtctagtcacttcgacgcgcacattgtcatagagcacaccacaggaacgacggagctcttccaccaccatggccggcgagacctcctgccgcccagaaagaacgacaacgagagcacggcccctcagattctgctccctcagattctgctcgatggccgacatccgctgggtctaggagaggaccccccctccccacgcccgggcggagaagagggtcgccagcgcctagctcatccatgacttttgccgacgaagcagaatcgggcgccgacactgtgacggggagcgcctgacgagggggaggggcaccgggacaggaaccgccgagagcgtaggcgcctggacgacggacgcagttgacggagcggtcacgtggataggagcagcagctgatgcttctttcacggtcggggtacgtgccgcatgggcggtgtgcgcaggagcggttgggcgccgcggacgagcgacggctggcggcgcctggataggtggctcgtcttcgtcttcttggtggaaggtatagtggcgctcaaggtggctcggataccagcagtggtagcaccttggcgtagccgtgcagccgtctttaaggtggcccagacctaggcagcggaagcacctcccatggagccaccgagggatggggcgagcagggcgagtaaagatggtggttggacggccggcggatggccctcctttactcctcctctggaccacacaccaacctgcatcaaatgtcttgctgcgatagggtagggggagcacgggagtcaacccgtggggcccggacgacgtcagcccaggaagcggcggaggacgagggcgtagaggcgacggctttgtctggacggtgaccgtcggagcggccagtcgccggaaggggtgggtgggaggacgacaacacggctctcactctctctctctcatggcgctggtcttcctcagcaggttaccaaatatatatatgatcaattaccaaatatatatatgatcaaatatagtgtatcaatagttagctgaacaagggcgtgtacctgtgcttcttctgaaactgaacgaatggatggctgcttccactgcttggagtggcggcggcgggctcgcacgaggcgagcggctccctcgtcgacgacgatggctccggcgggatgtccactacttggagtggcggcggcgggctcgcacctggcgagcggctccggcggaggcggtggtggcgggaagcagcgggcgcgtaggaggcggcggcggcgatactgcccgctccctcggcgacgacgacggctccggcgggaggcggtggccataggcaatccgaggcagcggcggggtaggggaatcgggagcgcagcccagcgagcggagtgaaggcggcgggctcgcacgagaggcggtggtaggggacgacgccggcgacgaatatggctccgacgggaggtccactgcttggagtggcggcggcgggctcgcacgaggcaagcggctctggcagaggcggggagcgacgggcgcgtaggaggcggcggcggcgatgtggcccgctccccggtgaggcggtgagtggagtggcggcggcggcgcccaggggggcgacgcgtgagggatttttttttctttttcttttgtcttgaccgatcgctaatttctgtaaccgctgctttcctcctcgaggtgggatcactaattgcaggggtgatccaacttttgatataagccgttggatgaatagatataagccgttggtcaggaaaaataggtgtttgatgaaatcgtgctttttatagtagtatagatgtttacgacccatccttgtatggatacttgtttctcctgactttattctagatttcctcccaacttcggggtttaacacctatacaccaacacttgtggaataagtgagattaaacacctatcactatgttggatgttttattatctgaacttttatgcagatgttggcggtatagaatcggcatttaataaccgccaacacctaccacctgggtaaaaccttaagcaacaagtctagctttatttctcacaatcaaaccatcctcattttgtttattttagaaaacccacttggttccaatagtattatgtccaaaaggtggttcaactaaagtccaaactttgtttctctcaaaattttcaagttcttcatgcatggcgttaaaccacgattcatcagttaatgcatgagtaacatctttgggttcaaaagaagcaacaaatgtagaatttgcacaaacatcatgagtcgttaccttagaccttgtagtctgctcacgtatattaccaataatttgttctggcagatgtcgtcgttgaatatgcaaaggagcaacgacttctgaagttgtttcacgttctgtaccctcactggtcgaagttgtagcctttggaggaccatctcgatcagcatcaacagaatcggaacccgacgaccatggccggtctgactgcacctcctgtgccagtctgaccggaggcgttccggcgatctgaccggcctggcgcccggtctgatcggccgagccgacctcatcatcgtcgttgtcgctgttgtcttcaaaaaatacgaccatcctccccctgaacctgtgacaaagtacctgcaatttcggatctagtacctggactagcctcatcaaaagaaacttcgcaagtctcaacaattttgttagtttccaaaacaagtacatgatagccacgtgaatgtgcggggtaaccaaaaaacattccatcggtaaagcgtgcctcaaacttatccaaatttccagatttcaagacaaagcatttgcaaccaaaaacacgcaaacgtgaaactttgggttgatgtccaaatcgaagctcataagaagtttttccaagttttgaccttaagaaaacataccactttcctccaacagattgcactctagctggaccaacagtgtccatgtgtaatagctatcccggtgcatccgtcatcacagaaacaataggggcatgtgaagaagaaaccatcttagcatgacgacacggtgtacaaaccaaatcaagatctttcttaagtttaggcaaaccacgaacaagatccaaaccacttaatctagtgagatgatcaaaaccaacatgtccaagtctacggtgccaaaacatcacatccttattaaacttagcaaccaaatatgttatcacatgtgaaaccggattttcaaaatcagctttaaacactcttccatagcgagaaatattcaacatagaatcaccacaagaatcaaatactttacttccagttttcttaaagtgaacctcaaaattttcatcaacaatttgtgaaactgaaagcaaacttatactgg

SEQ ID NO: 73816 - DNA, 8038 bp, Oryza sativa
tgtaccccttcaggttgataatccttatcgttttggacgagggcacattcttaaaaaaaaacgacagtgaccattatttttcattataatatgtataaaatgttaacaaatatatgatttttattaaattattttttaagactaatatatacatgtagtcaccatatttgaaagataaatattttaaaaatgattcataatcaaagattctaaagtttgacatcactcttgtctaaaacgataaatattatcagtccggggaagtatttaaagagtgacaacaataatattattttctagatctgctactgaaagtctcccgatcgaaggagtctggagtgtgatcggtccataaaggttggtctcatatatacattgcacaggaacttaagatcgtcctcaagatagaagctgctcataggcttatggtccggtcaaagaaaataacacaataaccaaatgaatctatacgtctgattacgatgctttgtacgtttatggataactcagttgcaagaacaggtcttagatgatctgtctagcactctcatgttttttttttctttttggaagtggcattgtgtgacttgtgtctcagtttactcgggttaatctaccactaacttgaaattgactagcaaaatactcactaggatattggataacaaatgtacctttgagcaattaacaactcataccacgtggaaagttcaagagttcttttgctctggatgcatcacttggaaagtgacatgatggtcatcagttgtcaaaattactattgcatttataatttcgtgattatgcaaatttttctatctcaatcaactgatcctgatcgggaaaatggggccagaaattagttcggtcacatcatattctaacgagaccaatgtattaattaaattcacgctggcacaaattgaacgacaattttttttctgcggtgcatgacaaagacgtaaaaattggccaactaaaggaaaaaaaaagtaaaaaaaggaacagcggaaatatatacgtggctaaaatacgcacctttggagaatttttcagggtttatgtcaactccgatgattcgagatgctcctctcaatctggcaccttcggcaacctaaaagaattttaaaataatcaaaatttattttcttttgtttgccttttcgcatcctaattattacaaacatatattttgttgccaaatgaaatgtacgttataaaaacgctagaaaacacatatttgtagaaaaaatattttattgcctgagtatttctcagtaactaatttacttaccgcaagaccaatggcaccaagcccaaatattgccactgtggaccccttggagacgtttgcagtgttccatgcagctcccactcctaattaacagcaaaatcataaacaatttttaattcattatctaaatgaacgattgctaattaaattcaaaacattaaactctcacattaaactttcaagaaatctacacttccatatatatgcagtatcaatcaaactttaaggctttcattttcacacatcgatatcacaatgatagaagcaaatgcccaccattatcatctaaattaataaacagggataagtacccaaaaaaatcaaatggagggccatgctgcagagaccaatctctgtagcattgtgggctggacatggagcttggttttgttcagtttcagagttggacagagtaaccaatctactggcatccgtatccaaggtgtcccatgctggactgttggatttcaaataaaatcaaaggaaacatcgatatctagtcggcacttgacaagtccatgagtgtccagatgcatgctagccagtttgtccatgtgtcatgttaatccagctagctgaatttccatgtattgacagacagcatctcaacaaattttctgttcaagatcatgggtgcccctgcctgtttctcctttatggtttatatatacttttatgttggcttgttaactactacctccgtcccaaaatatagcaatttttagctatgaatctagacacacatgtgtccgtagctaaaatggttacattttgggacgaagggagtagtgtatagtttataaaacagtggttgtaacttctaggttataagttcaaggagatatagtcgtaactcctgtctcaaaaaattaacttggctcatcagtgtaagagcaattcatgtcattttaaaaaaaaaatcctaatacaaaactaaaatgcctattattgagtatatactatctccatcctagaataattacatttttagagaaataaagacatattagcaaccaacacaatttaccactattaataatcacactatatgtacacattccatacatacacttgattaaaaagaaagttaaaaaccatttttaaatttgattaaaaggaaggttgatcagtcccaccacagcataaatacatttttttaacaaaatttgaatggtagaaatacaattattctggaacggagataggacaatattttcttcactatataggaccaagtcacggttgcttacctgtggagaccccacagctgaggagactcatcttctccaagggagccttagggttgatcttgacagcgcaagcggagtcaatcacagtgtactcagcaaaggtggaagtgttgagaaaatggtagaccgggttgcgtgcaccggaggagcggtcgatcatggtgaacctcgtgccaccatcggtgaccatggtgctcttgaatgggttgacacggtaggttttgcataggttgctcttgctggactcgcagtaggtgcacgcaccacactcgccggtgaagatggggacaacatgatctccaggggcaagatcctccacaccctctcccacgctctccaccaccctgtttttttagttgcatattgctatcaggtgttgtataaaaatggtaacgtctttaatgtgccaaaaatatactctttaggatgagtgcttttactatgacaagatgtattcagttttgtgaaaacatgcaaatattcattccattaaacatgagaaatggagagtaaagttgattctagcgcaaccatgtaaaaacattgttaaaattaatgatgagctcatttgcgctaaataaaaaaaaggataaaggttttacatttcccataaacatcacttgtatgtagactagatttatatgccaaagtgatccgaaattttttattaaaatgaaatggaacacaattgatgaaaatatgtgaggctggtacaaagaataatcaagcatatgaggtatcgtctaatcccatgtgagctaagctggattgttggacctatgcttttggggagccggcgttctatatatcgtcttcatctgccaactaacaataattaattgtatttgtatttattaacaactggttatctgtcacatgatcgatctaatcgccatacatcgatcctactttatgtcagacaaaaaagatatctctagcttgttggcatgcaccaattgtaattaagatcgaaagcacgaccagtttctgatcaagcaactctaataaatccacttattagcacgtgtctggtgtaaccctggttatgtagacatcatatcggatttttttttatttgcttaataattcttggtttcttaaaaaccatcttttggagtatcttgacggtgatctctaatgtagtaccattaggacgtccaagatgacttttcttaagatgaagttgaccatcatttcaccattagcttttttgcaagcaaagtcaaaaatgcaacatcactttatacaaaagaaaaaaattcaattgcaacagaaatttcagactagccttttggtctttcctatatatattaattctctactgaactaaagctaaaaatcctatttcaaccacttttatctttcagccagtttaattaattgttacatatatacttacatagtacctaattaattttcctcaagaaccttttttttgcatttgcttgttcaaaacgaacatgcatgtaaattaaagcaacagatgaattttcaagagcttagttattataaagagaggaaaaaacacagagaaaaataacttttaactagagaaaaaaggaggataaaaattaaaagagggtgaaagatcaaaggtgtagtactcaccctgctgcctcatgacccaatatgcgaggaaactttcgctgaagctcgttctatcatcatcatcatcatcacgccagccaaaacagcagcatcacatgaacagacagattgaaggacaaggcaagaatcaatcaattaacaatgctcgagaaataattcaattgtgtacatctttgatatagaagacagaattgtgtatgctttccttcatacaaaagaagttaagtaacttaattagcaaaatttcatgaacacgattactgcatattcgtctatctttttatatacatctctctatatatgtatttgtatgtgtatatatatgtgtagaaagatatatacctctcctttccaggcgctgaggtcggtatggcagatagaggtgaagagcaccttgaggcgcacctccatcctcgccggcggcgccacctccacctcctccatcaccagcgcctcgccggggccgtgcgccaccgccgctgcacacgcatgatcgtcgtcgtcgatcgtcatctcatcatcatcgatcacaccggccggccggcaagaaaagcttgccggccgacgatggccggagaggaggacgaagctagatatagaaggcgatcgatgtcgttttaattctcacctttgcatttgatcggcttccctttggtgtcggcgccggcgccattggagtgcagggcgccgttgccgatggcagtggcatccatggtgtttcttgcctttgactttccgaggagaaatgtggatttcttgattgtagcttcaagtgaggcaagttgatgggtttatatagagatggcatgaggagagagattagctggatatatatatatatatatatatatatatatatatatatatatatatatatatatatatatatatatatatatatatatatatatatatatatatatatatatatatatcttgtagatatgatagggaggagaccaacaagggattaaatattttgttttcttgaagctataggttgagattttaatttggtttctcttttattttctcaaaagaggtgcatcaatccaaccagccaccgctttaactcctggcacacacaattatgcatagctggaagtatatctgtttcaaattacttgtggttctagcaaatctcatacaaatcaaaaggatatcgaagattacatagttgccccattaaatacatctcaattttttttgttttcaaagcatataaaccaatgggagttattgggagtttatgactgtattaatgcatgactatattgatgaaaaggtggagataagatcacctctaaaaaggctttgaattgtgagaaccatataagtaatttgataaaaaaaatgaaatgctagaatggtaagtaatatatatgaaactgagggagtactgatttttttgaagaagttaggatttatacttagctaacgactattaagcgtgttcaaacacggtgtactagagagtttgtgattaaggtgatgtgtttgtcggtatatcttgctgtgaaaaaacaaggtatggttcatgttcgccaaacacaattttactataaaaattaatttctaattgtataaaggtaaagctccaagtaactccatttttcactcaaacaattaaacaacgcccgcacccaactaaaatcagcttttttaaaaaaaaaaaccatatccaacaagataacctatgtaaaagaaaatttattttttcatggtaatttgtatatgattttaaatattggtgttctaaaccaatcttacgtcctatgcaaataataattaaattaaacatcctgaaaaactcgaagtataatgttactatcattcactccacaaatttcaccttaaaaaaacgccttttcactaaaaaaaattcaccttaaaataagactcgtgtaatgcgaagcgagaaaattattgaaaaataatattatacagaaaagcgaacaatttcatgcatggtgttgatataataattagtactgtggcaaaatagtttaaactaggaaagtggtatttttccaataaatcctaccatttaacctacataaagttggattaattgacaggggttaagcatgctattataccgatcgacacatacacgctccaccattgacttttgaaagaaaaaaatggaaaaattaggccaagaccactaacattaattaggtgtaaagaagaggtatgaacacccgaagctcatgagtggaggatgctgtaaattatatatactcacagagttgtaaatttacaggtttgatcttttgattacgacatgaactgtagtttaattgcaattgatggcatcgtattaaagagacagcaaactcttctatttgtattgagtgttttagcaggagactaaatcgatctacttattatcagtccatttgtgaatagcaagtaagcacatgaacaagcactgcaatcaatgatcaatttaacatgtggcgtaagaaataaatgtgaaaataaatcgtgggtagatactagggatgaaaactgaacggatagttttcatctgctccagagaaattaaaacgaatatagatacctttcgaaacggataatatagatacctttcgaaacagatagttcggatacgaatacggatatagtatcggggtttccgatatatatggataataatacggatatccggtgaacaccctatttcttaataactctataaccttcaatctacctttttagattttaatagtaacacatatcttaacactagtccacattattattattagacttttacataatttttataaattatactatattttatataaaatgagctaattatgtacgatgatatttgtttctattagaaattgaggtggtttccgtgttccgagaaaaaaatgtttccatattcatgtccgatcatatttgatccttattcatattcaagataatttgtatttgtttccatatccgtgctattcgtatttgttttcgtatccggcaaaaaaatatgaaaacggatatcgtatgagcattacacattcgtatccgctccgttttcatcccaatagatacatcttgccactggaccagtttctctttaaaaaatttaatgatatatatgtatgtatgtatgtatgtatgtatgtatgtatgtatgtatgtatgtatgtatgtatgtatgtatgtatgtgtgtgtgtgtatatatatatatagtgaatctattctacacccctcccctagaataactattctacacccccccctcccatgggtcaaacccacctcccccaccctccctagggcccaaaacccctcctcctacctcggtcaaagcgtcctcccaccggtcaaacccgcccaccactttgctgctctcgtattgtaggaatcgtgcagtaacaggacggtcatcctgcagtaacaagacagcattatcgcagtaacaacgtcaaaaagtagccatgatggatctagtttcgttaagtgtttttttatgaactttatggtgcaaacggattggaaatacaagatatgatgtgagagatattgctctctaaagattgtgatttacctcttttttagttctcgtctcactggaacagcgtagtaacacgatggccaatatgcagtaacacgtttgcttttcgcagtaacaacgttaaaaaatagttatgatggtttcagtttcgttaagcacttttttttttacgaacaccatgatgcaaatgggttagaaaaataagacatgatgtgtacgttagtactctctaaagattgagatttaaaatactctagatctaaaaaaacattactactatagggccactgttacgatgcatgttctctgttactgcaaatttcgtcatattgttactgccaaaagtgcagtaa

SEQ ID NO: 73817 - DNA, 21637 bp, Oryza sativa
  unsure (1)..(21637): unsure at all n locations
atccagaagtgaccgagttcaatgaggatgcggcatggcaaattatcatggcaaattatccctataagaactttatgttttccttttatctttaggaaagtttcttttttgtcctaaaagaactagtatctccccatgggtataaatatgtacacccggggtcattataatttagctctcgatcaataatactctcggcgcatcgccaccctcttttctgaggtttttacttatcaaccgacgaaatttggcacctgacgcggggctgcatctgttcagttcgatctccggcgaatgggtaactcctacgttccgccggtgcaggcaattgtcttgtttacgttggtgtcgtttaaggctgcatcagtacattcgacctcttggattgctccggtttggatgatatatttgtctgcctatttatcatatgtcttagttagtctaggcttagtatctcaatttagctctatcgattgtctctcgctttagggtttctgtcggtatcggctaaattgttttacaagattagattagctaaggcatctaccaccctaaaaatcagtcaagggcttaattttctagatatgatgtttcttttcatacttagtgttgcatcagttaagtttgatctactaagtcgtgtttagaaccataatccctagcctgctttttgactgccaataagggtttcatcgggatttcagccgatgagttatctggatgttgcatcggcttacaaggattacatacaagttggatttagctgatggcaacaaaaatttcactgtttaatctaatattgtggatttatgacattggacctccagccgatgtatgctttaaccttcggatcagtgcttattctatcatgtcattgttagccgattggtttctactagattatattattgatatattatattatcatcagtcgattgtctttatatcattatccacattgggtatatagcagattgctcaaaaccatatcgctagcggctggtatcggcatcggctggaattattcctttggtttgacaaccgatcggctcattggtctactatttgtatatcttgtcagttgcagcaacaaactgactggcacgcccgcatctcatcaacctttggacctgcactggagctaagcacatctcccaggccagtgtgtgtttttcgcatcaacacctcccctccctaggaggtcttctatttatacccatagatgtccccttgtccaagtagaagtagagagacaagtatggatataatccgagtagtccatatagtttccatgtagaactctgcttgtccttccttatccggaactccttctatatacgaggtatgattccgtataaggcttcgtacaaggtgggccccgctgaccttaatcgactaatattgggtatgtgttatccataaccatgacaatattgatccttcgtttcacaattggtggtgtgctttcagaaatgatattcttctacatatgtgtaggacaaataaaattcttaaacaactagtttttgattggttgcacagcatttaatttcttttctggaggtgtttacctcttgtaacattcgctgtaaatatagttttttctcttttacaaaattacactactggggaaatgtctggtagcattcaatttcaaaaaaaaaagaaatacataacatctgatccatttgatatagacccaaccaacatgattctatgtaagccacataatcatctatccaccaatttcactcgtttaatgggcgccaaattctggtacttttggggtcatgatgctaagaagtatactcattggtctacttctattttgttgtgaaggtagatagcaaagttattaaatttgtcaattcccctttgaacattatgtatagtacatagctagttatcaaatgtagatcacttcaaaattgtttgtggagaacaaaagcaaattcggccacactacatacagtcaaatacctcgatacaaattcagccattgggaagttaattcagccaccggaatctaagtctccatagactacatagaacagaacttaacacaacagaaatcaaatgaagggtgttgtgtccctgatgttgcagagcaagatgcagggtgccgagagcccgagacgcgatgggggaggagactgcggcagcagcgacacagtcacgcgcatcatgggaaatggcgtggggcttggggggtggacaggttcggtagtgttggtcgcaacaccgtagccacagagcaagtacgcacagcagggaggataggctgcggtggtggctataggtgcaggcggcgacaatgacacatgcgaggtgaggaaaccacattgccgcaagggaaggagggtgcccctatcatacccccgatgattgaacggtcagatttcatttgatacatgcttgtacaaagtacctggaggtactaactgctggaccggaacaaaacacattttagatggaggtagtaaatttcaagcacccaagtttaatcccaaaattagtgcacttttaaattactactctctccatcctaaaattagcaacatagtatgcaatgagacatcctagtattatagatgtggacatagcagtatctcatcttatctcatctcatacaaagttgctatattttgagatggaaggagtatatgccccatcagttgaagcatgggtactggtcggcgttgctctcagtccgcacgggtggcaatgccactcaccatgccgtgcctcccttcctcccctccgtcgctgtccaagctagcaatcggatatctgtgcagcggcaaggtcaaaggcggtgggggctgcttaccagctccgcaatggttgaaggcaagcagtagctatcagatctgggtctccgctcctaggtctagatgtgtggtggagtggtgacagggatcctctccggttcatcaacaatgatgcccctggcttgcggatggtgccgatatgggggctttccccagttcgtggatggcggtgcaattagggcttctccccggtttgctgatggtgatggtggggctccattcctgagggtggtgacagggtgcttgaccatgggactaggcgaggaggtgatagggtggtatggcaacggtcacgattgtgggaggcgacgatagtagttgaggccagtcagccaggcggttcacctggatctggcgggggtggcacgcaagtggtggtggactagcggctctaattgctggttagcttggtgttctccggtgaagcggtcttggacatggccaactaatgttggttgctaagaagactgggctaagcaggggagcatcgaggtagcgagcggccgggtgagcgagccgggtgagcgcctagatccggtcgcgtggtgccaagggcagcggtcatggtggttgtgcttttggtgtggatggcaaagatggccctagggcagtggctaccagaattgttctttcttgtccagattggtcgagtggattgaaggcaagtgttgacagtccttaaatcataatatctaaccgtcaatgcctacatataatgaaataaaatatggtatccaaactagtgttagggatattactaatcatttccgctagtgttggtgaaatatatgtatgcatgtattttaaggagaaaacacatctgtcctgtgacaaaatacacctccggataatcaggacacgtttacatggattggacggcggaaatgctactgggcgggcgagcgccctcgctcgcccagagcgatcggttccccctcccccctccccctccctctctccacctggtttccttttttggcaccgcattactttcctattttagtaaatttatgcacctaaagtttatacacctcaagtttacacatttaaagtttagagaccaaaagtttataaatcaaaaagtttatatatccgattcaaatttgaatttgaattcaaataatttttatatatatagtatttctatacatctaaagtttatacacctaaagtttatatatccgattcaaatttgaatttgaattatgtccgattcaaatttgaatttgaattcaaatatttttcatatatagtatttctatacatctaaagtttatacacctaaagtttatacacctaaagtttatagacctaaagtttatatacccgattcaaatttgaatttgaattcaaataattcaaatattttctatatatagtatttctatacatctaaagtttatacacctaaagtttatagatccaaagtttataaatcaaaagtttacgtacccgattcaaatttgaatttgaattcaaattttttatacataaatttttctaactttttgttttttttaaatttttttgtggtgtactgtaataggaaaagaaggggaggaggaaggggagaaaggagggggggccgatcgctggatcgctcgcttagcgagcgatcgcccatcaagcgcccccattggagggcccatatgtcaatcaaaaccacttagaattgggccaaatcatagcataggatgttgggggcccattaagcaacctcccggccgaaagagaggtcgggacgagggtttttgggtatgtccgaaccaccaatttggccgaacccatcctgaggccgttgattgccatatttcacgtgtacgctcctgatctctttccaatgacggttggagggcatttaggacatttcccatagctataaccgtcatttggagcctataaaaggaggagctcacttcatttcaacacacacaactttgagctgaattacaagaggcacagggtgagggaaagctctggaggagtgcccggaagtttggcgctctctccgatttctacctcaacgagtgtagctttttaggaggaattctggaagagtatcggagttgtcggtacactgctttgggttcggagaaacttcttttataaagtaagcattcgggatcatttcttatgttatttaattatttattctaagtaagatttccatctttgtgggttcattgtttagtattcgtactaagtgcaccagttctagtactctggataaaaaagaaagttcctgcgcaagtattagagtagtaattaataacttagacgtggtgtctagattagagcactacaataatctatgacgaaaaaaattcgtcatggatcactgaaaattcgtcatagtaatttgactgtgacgattctacgtatcgtcatctattgagcatcacagattaaatctgccgacgttttctccgaaattgtcacggatcagcacaatctatgacgttttttaaccgccataaaacgcttttgggctcgtgtagtccagccagtcccaacctttgtgatgaaattaaacgtcacggatggttgccacgtggcggccaaaatggccagtggcgtggtcgttgacacatgtgtgatgacgtgtcactgatgatgtggtagttaatgtcagcaaatatttttaaatgacccattatttttttaacggcccattatttttttatggcccattatttttttaacagcccattaattttctactgcagcccattattttgttgagaactgacccattttaaaataggcccattttagaactaggcccatttcagaactagcccattttatcaaccaactatcatatcaaagcccactaaacaggcccattaaatttgagaccaccaaattcaatccaatttctcataccatctcagatacaaacataatggcagataccatctcagattcaactaaaaacagatacaatccaaatacaacaacattcaaacaatagttcatctcagattcaacctaataacaaatagtctcagatactctgcttgcagaatcaaacaatagttccacagcaagcaacaaaaatttgtgtagcagaaccaagctaccaacttgtccaagttcaagaatcacacaacattcaagcatacacagttttggttcaacaaacacctgaaaacactttcagcacaaaaaaaattgaaggtccaggttcaggttccctccacaccagcaggacggcaccaaaaatgaaccttagtaaattgcagccatgttgatctgtgcacatactagtactaggtgttggggttatattactgaatatgcatccttagttcaataagcaagacataattttcatgagtgattggccaagatagtatcatctaaaatttaatggactcttaataggataattcaagtatagatcagccatctcagtgcatagttgatagcaagaattatcttggatgatctacaagtgcatttgagttaagcattatatctgtatatagttcagtaaagccatcatagaatgaattttgaatgcatgcatagttagaaataatcattgttctatttaacctcaagaggttaagataactagataatatcactattgtgctactatttctagttaaataggcagagcctaaatgggtagacagtaatctatttctcagtatagacactaaataaagcatctaggatccattggcagaatcataggtatcaatattaggtcagctagaagagcagagcatatttagagaaaagaatgacatctattaggtcttgttcagttactagggattaaatccccaaggggaagcaaaccagggagggattgagtgaatcccaccatgtcacttaaaccctgtggggatataaattcctttctcctaatccctctattaatggaaaccctgtgttcggttatcaatttttttttttttgctactgatcaataggaacagccgaacaaccaccctacaatgcttatgtgcattaaaatgtgacagacatgtgtgacgaatgatcttgaaccaaaacaaaatgtaattttttaatggccgatgatcaagagcatcaatgcatatatcaactacatttgaatgctcatttcaactgcacgtttcgatatccgtaaaatcttttgctgatgagcaactgcggaatacatacaaatcttcatccaaaaattcgacacaaactggctgtcaacacgaactggctgtccaggttgtactgaaattctaaacaaatgagcatagaaacaaatgagcattgtactaatacccaaccaacagtgacccctccttccctgtgctgtgcacactgctcaaagaaaattaatgatcctactagtatctcacagatcattcgaaatgcaaatgcatgcatacatgttaatttaacctgtccttttcgttttcttgatcaatgctggggcaaaacatatttacaggtgcaggcttgcagctagcatgcatggggcaaaacagatttacagtgcaacactgtgatgagtcgcgattaaacagtcagatcagatgacaaactatgccaatttatgaaacaccaacttatattacctttttttagataattaacaccaacttttatattacttgtaacaatgaaagcaaagaatgccatgaaatataactgaagaaatcaagaaatccaccaatgtgcagcaatcaatcgatcactagagattagctagctaagctcagtaattaagagaaaggaattcatataagagccttcgcggagaactctatcagtttctatttggttaccgaagctaaatggacccgagctgttgatgaccgaatagaaaggtttattttcaatggcatgtcctagatgatgtaggctttgcttcctcagcattaaaccaatcttcaggattctcaagcgtttcagctatttctagatcaaccaaaagctcataacttggtttattcttcggttaccatatctttgaatgacaaagtgcccgggaagaaagatctagatctctatcatcatctatctctatatctaaatatggaagaaccctcgaagcctgtccccgacgacgatgccccctgggtgaaaggaaaggggccgccattctctttctttcctcaatcgttccgatcatttctctcattcccttttgtttgtttggtggggccccgggttggttcgtttattcttttccatgtattagattatccgtccgagccatatcaaattaaaaatatctaaaatcaaattcaatatagaaattggaatagattctattagaaaacatatatatatcgatcaaggatgctgaagacatcccagcgtattgaagtacctaattatctactggcccatccaagaaccaagggaggaggaaatctaggtgacacatcaatgggaaagaagacaaattcaagaatgccgctgtttacacccaaatttggcacctagggataaaataggaaaaattgccaaagtttggaaatctgccggtttcctccgagtgggccggtttgaccgccatgtgttggccggtcagaccgccggtcgaaggccagtcagaccggcggtatgtggccggtctgaccggtagagcccgagttcgggtctgtttcgccgggtctcgaggtttccttgctcgggaaggcatgtttcgggtttcctttgaattctatcctgagttggacgtggaggaggcctgtagagggcaagaccaactcctatataagggacatggccggttcaattataactaaccaatctacaatcaatcaatcgaatcgttttttatattgcttttagttttctcttagtttgtccatctttgtcgatttgtgccgtaaatcgtccgccgccgctgcgagagtgcgacacctctttgtaggtttgtcctgaaaaccttccgttttgcccacgagacgggtagttatctagaatcggctctgctagccggttttgttatcaaaacccatcttggtttagcttttgctagatcgaggtggttggtgactctaggatcaccgcaaggcatttaggtgctgcgatcgtgcttgtcaacttgtcacaaaaagttgccaacacgatttttggcgactccactggggacatctgctcaacgtcaactcaacttcgacctcaccatgacgaagccgccgtcatccaaggcggaggtggagctggccaatgtgataccaatcatatttgatgatttcgaaggggaagatcgcaagtccatggaggagtacattaaggagatcacacaggaggcgctgatgagggcgtgcaccaggactcgtcaaggcgtgatcatcaagcctaagccacgtcctaagcctacttacgatgtggtaagtaatgaggaggtaacacaatttatccaacaacacattgcatctacaatagattcatctatgattactttgaataataagttaaatgcatctattcagaatcatgttgaaggatttttgaggactagattcggccctctcgtggccgattttatgttcaaagacaaagcctctaccagtgctagccaagccactatagatcagataagtagtataaccaacggggcgaaaacacaacagcacggcgaggggtgggcggcgcacacagccagtctaaccgggcctggtggccggttagatcgcgatgtcgctgtcggtcagaccggccagacggccggtcagaccgggtattaccccggcggtcagaccggaactcaggccggtctgaccgcgccactggacgtcggtcaaaccgggtcttgggccggtcagaccggcacaatcatcccaattcagggggtagatccaatgacaaataatgcttatttgtatcatcttagaacatttgattcccctgtatctactgccactacttgtccccaaattctcctacatgttcctaatgcttataatgatgtttctagggggtatcctcccgatactaggcaaggccaatataattatattgcgccgcaaccacaacctattaggccaccaaacccaccaccaaaccaacataggcctgataatatggaggaattgattagtggaatcattagggataaattcaggattgaagctaggaatcgtgctaaggtttaccaaaagccgtatcctgactattatgacaacataccatatcctcgtggttatagggttcccgaatttaccaagtttaatggtgaggatagtaggaccacatgggagcatgtaggtcaattcttagcacaatgtggagaggctagtagttccgatacttttaaattgcgcttgttttctttatctttgtatggtactgcttttacatggtttacttctttaccggcaaattctatacatacttgggctcaattagaacaaaggtttcaagattatttccatactggtgaaactgagtttaggttatctgatttaacatcagttaagcaaaagtataatgaatctgtcataggtttagggatgttaaaagctgatattatagtttaaacataactgatagagatttgtctgatcttgcttttaatggtttaattgctcctattaaagaaagattagatgttggccaacaatttcttgatgttagtcaactcgtgcaaaaggcactagctcaggaaagccgggttaaggatagcaaaaaatttgttagaccatatgagaagaagcctaatgttaattcaattgattaccatgaggctagtgatagtgaaggtgagggtgatcatgatatgtatgttgcctgccgccgagccgtgtgcgccgctgccgattcctccacccgattcgctcgattctctgagccgtttcttgaattagttgaggggatttgtttcccttatcctcctctatctcttcccccaaaaaaccgactttatccctttgaattcgacgcgaatttggattcgttttcgagtttatgtctccaccaaaccctaggttttcccggcgcgattccttgcgttccaagcctgatctctctctcccgtcgctataaatagagtcccctccctctcctctttcggccgccacctctccctctctatgccatcgcttgtagcgccgtccccgtgttcgccttctctctccgccaccggcagctgctccagccgccgtttgccgccgcctcagctgatgccctcctgtgccgccacctctctcggctctgcaaggtcaagagcaagcccggcagccgattcccttgcaccgaagacccagggaagcccgtcgtcgccatcaacccgaagctcgccgtcgtgttttgatctccggcgaggctctgctgctcctcccgtcatcgccaagcttcgccgccgcctccattggattcgcagctgcgaagtgaagcctggccacccctgcattgtcgccgaaggtcgccgaaacactgtcgccgccgtggacagtacctcgccgccatcccgttctcgtcgccggccatcttccatcgctgtccgtcatcacgtaagtgttggtaagaatttccatcgccttctctacctcccggtgccctccgtttgcattattgtgtcgtggttcgccggcaaccgccgctcctatgtcgttcaccggtgtagtttatccctagggtcttaatccaatataatccaatccgtggttggtctagcattgtcatctccgtgtgttgctgccggaacgttgtcatcatcccttcctctccgatcgctttggttcggtgagacttctattcgttctctcttttcaatggcatattatttctttttaatatatgtcatctaccaaatataatctaatattttccgaaggttgttttaatcttttctctcagttataaatcatttataaatggtttaattaatttggaatagtcttttctttaataggtttaattggaattaaatcttgtaaaattcgtaattaatttatatgaaatcggaatgagaccgttcaagtctcataattcatctaaaatcatgatctacatatttgtttacttttatgtactgtttatttggtttttattagtctttttctttgttttgcgtgttagcttgtcgtttccgtcgttgcgaaggcaagtcacacagatcctaaacacaattcctttgagcttgttgatcctatatttaaattctctatttatttcaactgtgcatttattttcgaatgtcatcgggtggtgtgaacctattcctttgttatggccaatttgcattgaataccctattccttcataccttgggtaacaaattaattagcttgaaccttatatattggtttggttcagctaatagctatatatatatatgtatgtatatatatatatgtatatatatataaatgtatatatatatatatgtatatatatatatgtatatatatatatgtatatatatatatgtatatatatgtatatatgtatgtatatgtatatatgtatgtatgtgtatgtatatgtatgttgtgtgtgtgtgtatgtatgtatgtatgtatataataattgcttagccatgcttagaaacattagctcattaatgggatgaatcacactacattattacttatggttatatttaattgtagctcatgatggttaatcgtgttatgataattaactgataattaaaatttgattaatggtgggttgtgagcacatggttttgaaggtcgtgctcatgacaattaaggaccggtttgcgagctactgttgtgagacattaaccgtaccaactacaagccagcgtgggcaacggctttaccttttgtatagcatggttctttacggggtgctagactgagaagcggtgagaagtccgtgggggtcgctggggagtccatgcctctggttatatttatagagggggtgattatgatccaggaatggtgcattgtggtgagttgtgttgtgcagagggtattgtcacaacctctattcgggtactttccagtatcgcgacgcatggtagacatgatgttgaggctgtgtcttgtgggtatagtggtacacctctggccagagtaaaactattcgaatagctgtgcccgtggtcatgggcgggttgagcaatgtttttcgtgattagtctcacacctctcacaataattattgatgctataactggtaataatttgtttagctcctggtttggagttagatctgtacagccgggtatggttgttcagaatggttgggcctgagcagcatgggcgtgttgttcagtgttgattaaaattaatgattaaattagtttattgttttactactcttaaatgtttattaaatgctgcttttgcaaatgagcctatattatgccattctttggtatccttgtgcacttgcatatttgctatgtggcttgttgagttgtcatatgctcactttgcaataattaatcaacctcagttgaagaaaatgatccagaaggagaagacgtttggcttataccccagttgagctgcctatgggagtggagccggagcttcgctagaccattaattttgctgttgttttcttttcttttgtaagtatgtaacgatgttattatgatggatttgtatattaaattgtcagtttgtgtgcctcggctgattccgggacgagggttttatgcacaaataagttcggaaattgctagtgagtttccgggcgtgacaccaagtggtcatgggactaacaaaaacaagccttttgtttgttctaatttaatgccgactcctcgtaaagatcggcaaagtaggattaagtatagttttgatgtggccaaatatgataagatctttgattatcttttgcaagaaaaacaaattagattacctaaaggtcatattatatcatcttaagaagaattgaaacgtcaagcttattgtaaatggcatgattctcactctcattctactattgattgcaatgtgtttcgacaacaggttcaatcggctataaatgaaggacgattgaagtttaccgatggttccaagatgaagcttgatcatgatccttttccggtgaacataattaattttgatgataagaaggtattgattcggccggagcaagccgaatctacaaaggggaaaggaatggtcattggagagcctaggccaaaaatgatggtgccaaagaatccggaggttggtgtttgcaaggaaaataggagtgaagcttcaacttctagagttcctaagaagactaaggtgaccttcaatatgcttttggagaagtatgagaagcaaggcggtgagagagatcgcaacaaaggaaaaagaccaagatcacctcctagggagcgatttggtcattgaccaagacggtcggaatcacctccatatcatcattctcaagacatgtcatgggggccttacccaatgccgccgccgggttatccttatccttactacatgccatggggggcaacaacgccaatgttcaatcatatgcctccaatgcaattcaaccaagggtagggaggaccaaggaggccaattcatgagcatttgtcttcatcaaacaatggttggttttatggtaagaaccgggccaatggagaaaagcgggaaggaaagcgcgtcaaggtgaagactaggacttcggaggtgattaccatcaaagtggggtctcatgatgtgccaataccttctggagatgaagttggggagtcctcaagcaacaaatctgaagccggtaccagctcatcgaagtcggccgatctgaccaggccctctggccggtctaaccgcagccatacgggcggtctgatcgccaatccaacaacggtctgtccgacgcctcaggccggtctgaccgctgacctaatgtcggtctgaccggcacctccggccggtctcaccggtggtctaagtccggtctgaccgggctccagcgccagtttgacaggaggtttgcaggaagcaatgtaggggcttcctcgtcttcaaatagacttaacagggggcactatttacctcctggaacaaagcagaaacctaggtggatgcctgaggatttgacggctactccaaggagaaggttgcaacgtcttcgggctcaagagataagagagaaaaaggccgaagaacaaagagataggaggttcaatgagttgtgaccaccaccggtatggaggagtaaattcgtagagaaggaagaaccagttgttttgcaagaggaaaaggaagaacaatcagttactaaagatgaagcatctccaaaggaagacatggaggtcaacatggcgtgtatgttgcctatggagttttgtgctatggatgaagctgaggttgctcaattttcactaggtcctaaagatgcggtttttgagaagccgatgagtcaaaccgtcatatgaagcctctctatctcaaaggtcatatagatgggaagtcggtctctaggatgctagtggatggaggtgccgccgtgaatttgatgccgtactcgttgttcaagaagttgggcgtggagatgatgagttgaagaagaccaacatgattctcaatggcttcaatggtgaaccaacggaggcggagggtatcttttcggcagaacttaccgtggggaacaagacctaccaaccgctttcttcatcgtcgatgtgcaaggtaactacaatgtcattttgggtcgttgttggatccatgccaattgttgtgtgccttctaccttgcatcaatgtttaattcaataggacggcgatgatgttgagattgttcaagcggatacatcggccgaggttgcaatggctgatgctacttttgagtggcgccatgggaatattcaatgcttatcggggatggatctctttagttatgattttattagtatctccaatggcaaatttgtacccatctctgtaaagccggctagtttagcacggctaggccatattaatttatgcaatgactagagaagctaatttagggtggtagcaaaagagtgtgcaagaatattggtctacaaataacgatattggtgaaacttttgaagattttgatgaggtagagaagcttggacaagggtttacattggccgatccattggaaaaagtagacataggtgatggaactaagccaaggccgacttttgtaaacaaaaaatatgagatccggttataaggttaaagtaatcgagctacttatggagtatgtggattggttcgcatgggagtatcatgagatgccgggacttagccgtgatcttgttgagcatcggcttccaatcaaaccgagttttaggccttataaacaactacctcgtcgttttaatcctttgctatatgaccgagtcaaagaggagattgatcggttgttgaaggcggggtttattaggccatgtcgttatgcggagtgggtttctagcatagtcccggtggacaagaaggggagtggtaagattagagtttgcataaactttagagatttgaataaagcttctcccaaagatgaatatcctatgcctatagccgacatgatgatgaatgatgcctcgggtcataaggtgatttgctttttagatgataatgccggctacaatcaaatctttatggcggaggaggatatgtacaggacggcttttacgtgcccaggatttgttgggttgtttgagtgggttgtcatgacttttagattgaagaacgccggtgcaacatatcaaagggcaatgaatttaatcttccatgatttgctaggtattatcttagaaatctatattaatgatattgttgtcaaatcggatggtatggagggacatatagccgatttgaggttggcttttgagaggatgcgccggtatggtttgaagatgaacccacataaatgtgctttaggtgtgtcggtggggaggttcttaggattcatggtgcatgagagaggagttgagattgatcctaagaagattgaaaagattcgttatttcaaagcgccaacatgcaagaatgaagttcaaaagttgctaggtaaggtgaattatttgagaagatttatttctaacctagcgggtaaaatcgatgcttttgtccctatactgcgcttgaaaaaagaagccgattttacttgggggagggggcaaaacaacaagaggtgtttgaagagttgaagaaatatttgtctactccacttgtggtgcgggcgcctaaagccggaaagccttttcggttatatattgcctccgaagacaaagtcattggtgccgttttgacgcaagcggaagatggcaagggatatatcattacatatttgagccaacgtcttttggatgccgaaacgaggtatatctttatagagagactttatctatgcttatactatgcttgtaccaaattgaggcattatttgttatctagtacatgcatagttgcttgtcaagccgatgctattaaacacatgttgcaaaggccaattctaagtgggagaattggcaagtgggcatatgctttgattgaatatgatttggcttatgaaccgttgaaatctatgagaggccaaattatatgtgattttatagtagaccatcatgtagatattgcttatgaggaagaggtttgcttagtcgaagttataccttggaagatttattttgatggttcttcttgcaaagagggtcaagttataagggtagttttgttttcacctaatggcatgtgttatgaggcatcggttcgtttaatcaagccgaatacaatgctttattattcggcttacaagtgatggagttggttggagctaagcatgtggaagcttttggcatgaggcccaacaacgatattattgccaattttgataattttgctattagacatattgctaggcatgataattctagagcaaatgatttggcacaacaagcatctggctataatgtgaagaagggattatttctggtattagaagagccggtgcttgattttaagtctttgtgcgaaattggcaaaacttcagaccaggggcggtctgaccggcattgcacggccggtctgactggccacatgccaccggtctgacagtccaccccgagcggtctgaccagccttgcacggccggtctgactggttctggacagagcgctgggggcacgctgtaattgattcaaaggccgaattaattgtaaattcggacatttatgcccaggaaacagaggaagattggagaattcctttgattagatatatgaacgatcctacacgtaaggttaatcggaaaattcggcggcaggcgttcaaatacacattgcttgatgaagtcttattgaagtgtttagatgaagatcaatctaaagtggctatgggagaagtgcatgaaggaatttgtggaactcatcaatcggcccacaagatgaattggttgcttaggagagcggggttctattggtcgaggatgattgaagattgtttctaatactataggggatgcgaagcttgtcaatggttcggcaatgttcagttggcgctcgccgccgtgttgaatcctatcatcaaaccatgtccgttccgaggttgggttttggatttcattggtcaaatttatccttcgtcatcaaaggggcataggttcgtgctagttgctacggattacttcaccaagtgggccaaagccgtgccgctcaagaacatgactcatacggaggtaattgactttattttgaagcatattatccattgattcagtattccgcaaacattgactacggatcaaggagcttcttttatgtctaaggaagtgaagagctttgccgaatcttatggtgttaaattgttgagttcatctccttactacgctcaggctaatggacaagtcgagtcgagtaataagacattgttgaagctagtaaagaagaagattgaggaacacccaaagaagtggcatgaggtgcttttccgaagcattgtgggtgcataggatatctaaacatggtgccaccaaagtcactccttttgagttggtttatggtcaagaagccgttttaccgattgagataaatcttggttctctttgctatatcaagcaaaatgatttatcaagtgaagattacaagacgttgatgggagacaactttgatgagatcatcgacaagcgcttgaaggctttggaagaaatatagaaagagaagaagagcgtggccaaggcgtacaacaaaagggtgaaagcaaagttgttttaagttgaagacttggtttggaagacaattttgcctttgggtactcgatctagggagttcggtaagtggtctcctagttgggaaggtccttatcgagtatgcggcattgttcgaggaaacgcgtattttttggagacacttcaaggagagcgtttcagcgagcaagcaacgggaaatacatgaagaaatacttcctgagcgtttggtaggtactatggccggtaattggattatcgccctaagaccaaaaacatgttctatgcttttagattcacgttgatcatcaaaaaggcaggggggcatgtgtttataaccaaatttggcacctagtgataaaataggaaaaattgccaaagtttggaagtccgccggtttcctccgagtgggccggtttggccgccatgtgttggccggtcagaccgccagttgaaggccggtcaaacccgcggtatgtggccagtctgaccggcagagtccgagtcctggtctgtttcgccgggtctcgaggtttccttgctcgagaaggcatgtttcaggtttcctttggattctatcccgagttagacgtggaggagggcctgtagagggcaagaccaacccctatataagggacatggccggttcaattgtaactaaccaatctacaatcaatcaatcaaatcgtttttcatattgcttttagttttctcttagtttgtccatctttgtcgatttgcgccataaatcgtccgctgccgctgcgagagtgcgacacctctttgtaggtttgtcctgaaaaccttccgttttacccacgaaacgggtagttatttagaatcggctctgctagccggtttagttatcaaaacccatcttggtttagctttttctagattgaggtggttggcgactctaggatcactgcaaggcgtttaggtgctgcgatcgtgcttgtcaacttgtcacaaaaagttgccaacagccacctcaccagttcgtcgcctaccgccgccgccgtagcatagcgcgagcgagaaaccctaaccctataagaggaggggagaggggaagggaaagatctcaccaggcaaaaggtgaccaccggaagacagctgccggaggaaagagcgcccatcatcggacttggacgggacgaggcccgccgccgctggatctgggcgggacgaggcccacatcgccgcccactcgtcgtcgtcgtcgtcgaggtcggcgcctccttgtcgttgtcgcggtcggcgccgctgcggaggggcagcccgcggaggaggcagcccgagcgtcagggtcagcgcccactcgtcgtcgtcgtcggggccgcgtcaccggcggaggaggagaaggaggaggagtgggtggatgttatttatatggcggcgagccaacgacgaaggggacgggtggaggcttatctgaattggatcggctagggttagggaactagtggtgttgaagcaatcgctgatgcaattttacaaaagtacccatggtgtatctggagttagcactaaaattatgtggaaaaaatggtcatttcatgttgaaatttaggtcttcctcccgccgcactgaaagaaggggaaaatattaggggagggagaggtggaggaaagatgaaatattttgaagtggtgaggaggcaaaatttttattgcaaattttgaatcgaattttatggcactaaatcagctcgtatgaaaaagttgtaaaaaacaaagttgtagaactcatttagatctaccattttttttggtcatttcttcatccgagtttgattgaactatataaaatttgaatttcaaattatgacaacttcaaacaatatttttaaatactaaatgatttcaaatgaaaaagtcatcaacaacaaagttgtataaatcatcaatatctacaacttttgtttttgtcatttcaccatatgactttgtttcaataatttgaatttgaatttcaaatttagacaacttcaaacaacattttcaaatactaaatgatttcaactgaaaaagtcatcaataacaaagttgtataacttatcaagatttacaacttttgttttggtcacttttctatatgtatttgtttgaatagtatgaatttgaaattcaaattatgacaacttcaaacaacatttacaagtactaaatgatttcaactcaaaaagtcatcaacaacaaagtggtataactcatcaagatctacaacttttgttttggtcattttggtatatgactatgtgacaatgatgagaagtccaaattcaaattattacatcttgaagagacattccacaatgctgaaggagagctactgattaagtcatcaacagcactatgtgacgaaccatgaagatgtactaatttgaaattggtcattttggtatatgaccatagtccaatagttagaagtcgaattccaaagtattacatctggaagcgacattcttcaatgctgaatgagtccaactgagtaagncatcaacatcaaaggtgtatgtaactcgtcgatatctatagtgcttattttcgtcatttctgtgtccgataaagtgatagtgacatcgttccataaatttacatgtctcttatatgattttgaagtatttaaatcacgacgaaattgctataacgtcacaggttttgggccggtttaattagcaaaattagagactgtcacggttt

SEQ ID NO: 73818 - DNA, 10800 bp, Oryza sativa
atccatttttatgtcattgttgttaaattaatttgattattgattgttgagagcctcaccaggtaaaaaggagccataaaaagatgcttgcttcacttaaatttatggatagaaataaatccaaggtcccatagacaatacaagattttatggaccaaaagcaacttttcttagcagtatgttccattaacaatggggcatgtagagtcagactcttcggggcttgatagcatcatattgaactatgacataatatctatgatataatatctgttatatgtaaacggattggatagcctactaaaattatatatttatttcttatgtttgatctatgaattgtgttcagtttcaggaagaattcaatgcaaagtttaaactgaaggccccaaattgtataataaatttaaggtggtcttgatgaaggatcaacttcattttcgagatatatggaatgcatgcagatttataatacattctcattagttcgaaactcagtactatcagattttgtatttcttcgatatttcaaaatcccctgtgctttggttgcactatgagaatttctaatttctttcattgtcatttgtatagatattcaaatgatgatagatttcttccatttttccaatgatttatttctttcttacatggatccttgtgcaatgtactctgttcgcatacagtatagttttgttttcccccttttcagcctgaatataattttcaggaagttttgattcttcattcttctatggatcgaaatgaatcggtttggctatatattgagtctgcaaaatattagattgatggaatatatattgtgaaaaacgtgcattgcacgtgcacgattactagtatatatatgtgtgtgtatgtatatatacatgtatatatgtatatgtgtgtatatatatacatgtatacatgtatatatatgtgtgtgtgtaaatttttagtgtaaatttcgatatctctcaaaaccattttacactttaaaaatatgttaattgggaagctactttaaaaaataaacatggaagcactagggatgcaagtgggtagttccgctatcttcataaaaatccgcttgctagtttattttctatatggtagtataaaatttagaagaaaaaataaatcagaagtgagataagcgggcaatcgttcttccgttttagcagataaattgcgccacgatgcattttggacatgtcgatgtccataccgctcaatgttctagaggacgacaaacatagtatttttcaaggtacagttgcacgggagcttcaccagatgaattacgacactgaacaatttgcactggtttcacgcgatcttggggggacagatcagttaattacgcctcttaataatgatttaatcaagaccacttgcattaaacataagaaagagaaaaaaaatgtatcgaacggtccaatcgagttgtagcacgtcacaccctgtttgacccgccaaaccactcttacgcatgcacacgttctgtttacggtccaatctattggttattggttattgatgattcacgttgtattccatccatactcataaaaaaagtcattaaagacaatgtgtaagttaaaccttatgaatataaattataaataattctcaagttgttgagtttgaaaatgtaaaaaatatatgtatagatttatcttgaaaaatacttttataaaagtatacatatatcacttttcaataaatatttttatagaaataagaaatcaaagttgtgttttagagaccgtgttgctattctaaacgattagtatgagtatggagggagtaattaagaaccgtttactgtatattgaactgctagtaatcaggctttgggtagcaatggactggtttcggacgtcccacggtgacattcttgatattgtgacacatgtcgcattggaggttttctgttggttgcagtgtccttgtaataatgtcttcgtcggatcggattctctgcagagtgatgacatgatatgaccaaatgacttattatatatcaattgctctccgacaatatctttcattttggttcgacgttagtcgccagatgtaataggagcgaaatttgatcgatacaggaatgagccgttgattttgaagatttttttttctggtttgagaaagattaggattgtaaaatcgtttgattcttattctgtgatgaataattggcatctgagtttattggttttaatatttggagattattagtgaagtggttttggagatgattggagttacaggtgttaaacaaggagtgctggagatttggtccagtcagaccgggcatgggttgctggtcagaccggtgtgtatctagtagccagaccgggcagcccgcggtctgaccggccgactctgtgtcggttgcggtttcgggttgtttcattggatatcattagataatttgtgtttatggcttctagatggatactatgaatatgtaatactgttgtttgctaataataagtcaagttggaaatagcttggtgtcggaatatggtttctttgtttgattcatgtgtaggtgtcttagtgcctcaggagagtattgtcgatgatggatcgggagtcaatttggagataaggtgatatccggacggtcagatatcatacgagatacttaggctaaagatcaatgcgcgtggttggtgaagattccatatggcatatgatggagatattgtgtgcgtatgggatacagagtcgaatttggtacaattggaatttgtaaagttggtttactgtataggaagatttcctaaagggattaggacttcttgtatgagtttggttcgctacctacctcatatataaatagtgagggagggtggcctcccggtatcgctttagatagcattgagttgacagaatagttagggtttcgagtttagtcgagatttttgtgaggagtgatgttgttgcactttctaaacacagagagaagtaataaagttgtcatttactttgacagatcttcaatttttgtttgctcgggttcggcggtcgtacctgcgatcagatcagcggtggtgcggcggtcagaccggtgggtcagtggcggttagaccggcgacggcgacaggaggcagaagcaattttcgggtggttagaccgggcaatctacatcggtcagaccgacggctttggcttggtcagaccggctaatctacttcggtcagaccgtaattcatcgatttgagggtaacttttagttccactaaaagttttggttttggggtactacaaccattcacccatctatggttggcttagttatcgtcgttcgatcctacaaggattacatataactattaaaactgttgtaaaaaacaacagctatgcatactctagcccaaccacttatagaaatatgtctttaagtgatattttttgtttttaattaagctgtaatttttaatttttaattcagagatatttgcccttcaaattttataataatatgccaaaataaatttcatgatgtaaaatactcgtccagattcgtaatcatcctagttacaatatttagagccggagggagtaaaagagtttggagtaagaagagaacatataattacatttgaccaatcatcatattaaaaatacaactaattattttattgtgacttatttttatatatttttaaaaaataactaattattttttatatatttttaaaagttattaaggcgtgatcgtaaacgtaaaattaaagtcaactgcgttattggaaaaccgcaagaagtattgggcaaaagtataagatcgtacattaatactgcaaattaaattaataagtacccatccatatgttagttaatatatggggccgtgcagacgtggacgaatttcgcacgctactttcttttcttgcccccaatcacacgtggtaactacaatacgtgtagatacagacaaacagtcatagagagtgatgcaatcaggcaagcgacttctccatgtgtccgaacgtcgtcacggcagatatttccatgtgttacagtagcccacctgacaatgaccagaccatagagacatgacagcatgtagtacaagagagactttctttttatatgttgaatatatttttaagataaaaacagtataactcatcgaaaactattttccaaaagtaaacctattggtcatgttacaccaccgtaataattttcggcgaacaatatgttgcctggctacaatagtcgcgtggcagccaaaagatttaattttaagtcaacatagtaccacagattacaagcctaaacaaaagcttagccaaacagttttagctttaccctaaaataggagtggagctgggtagaacgctattgcaaaataaactagagaggtggagctaagtttaggctgctacacaactccactccagatccaactcctaaaactaaatttagaagttggaactctaccaaatagcccatatgtatctaaagttttctttaaacaaagttttggaaaacaaagaaattaaacctacaggagacagattgcaattaagatacatatataacatagcagacatgtgcaattctttttatccacttggttttgtcaaggaactacgtacatgttgactggagcaagtgtactggttggagttggcgtcggctttttttttttaacatagtgggaaatgttgtctgctaattagttcactttagcttaattttgcccaataatttggggctactccatgtgggagttgctcagatgtgtgctggatttcactatatttataagaaattcattcaattggactcgatccgggtcaagtcggcatgtgactacttgtacatatacaaatggcgcgtgcacgaaacacctttgtttaatgatatcattaatttcaatttgttatttatcagtgtctggcattttccgtgctacttaattaagtagaataaattactggaccacagcatgactcaaattttaactaatcacatctgcatttttttcgcgtatattgaaaatagccagtactcttttctagaaaagagaatgatatactgtcgttagaaaaatatagaatggagttccctttgaacgatttacctctcccaagattcttgctggatcgtcacgaagaccaaggtagacttgaaaaatgtagtcgcagttttagtcaatctaaaaacaatgactagatcacgacctggaatgcagtgcagaaaatacatgaattacccatactttttcttgactttttttgttttttttcctcttatcacatgcccccatgcctcacaaatggagttacctaagagcatctttagcagaagccctcattttaaagccccaaaaaaccaaatgagggctgcccccaatttcctaggaccctacaaatgccttcaactccaccagcagcccccattttttagaccatatttattattctcttttatattaatatagactataggtttacgtctaatttaacatctcaataattaaaagataaatattttacaagatcatctcgatgtaaaagttaattatcaggtgcattatacacgaacagcacaaactatagagtatatatttaaccaaactactgaaatattatcctatatgctgtttcaaagaaaaaaattgaatatataccactgtctctctccttaatcctgtatgtctcgacccaaagaaaaaaatattgtctttccactggaatcctctatgcctctgtaaaaaaaatgcaaagaaaaatctactccctgcattctgcgtgcagggacattgcaggggcaagcagacaggcagaagagggacaggcggatgaaaaagcaaggggatgggctggtgggcaggcgctagccctccggccggcagcgccgccagcgcgagcaggaggtgcgcgcgggttggcaggcaaaagagctaaaatcagtgcggtgattcaccggcgtgcgagcggatggcggacctatctggggtgatcttgccagcggtgaggggtcaacgactgaaatttttacaatttggtcctttttaaaaacttattttacaaatagactcctaggaaaacttaaaccagaaatggtcctttttgggacgccagagtggctggtacagtaccctaacatgcgggcgccagccacactggcgccgtgcccgtgccaccgtggcactagggctgtcgtggaggtgctgactaggcagaatgggggcgccagccacactggcgccgcccctcataccacggcgccagcatggctggcgcgccctcctctgtgggccgacccttaaaccccgtgggccccaccacctttctcctccccactcccattttcgccaagtcccagcccgagcagcagcgcaggagttcttcccctctctctccccctcacctctccacctcaaatccaatcaatttgaagccgtttttcacgggattttttgtggaaatcgaagagaaaggtagactccttcattcccccttttttttcgtttttattggttgaatttgtagatcggtgggtaaccctagaaccccttttttacccaaatttatgatttttagcatttgttcttaggattggcttgttgtagtgctatatgtttgcaatgtactcattggtgtcatgatttttttaaccatatatgtggtaatgttaatttttggatggtttggttggatggatggatgaaaaattatggttgaggcatgacggaggtttgggttgtatgacggagtatttgtaatatttcgatgtgtaatgcactagtaaacttgttgatagttgtaggtggattaaatatttttttggagtagtagctttgggacaatttaagttatgcattggttataatatgtcggtttggactacgtttaggaatgaagatttaatttttgttgcaaagttacatttgattttttggtgtagatggatagacttgttcgtgtttactacggtggtagagtggtggaaccttatgttggtgcacatgttgagtttgaggatatgtcattgaagaccattttgtttcccacccacccaactctagatgaactaaggtcacgagtgaaagaagttcttggatggaccgaggataatgtggagattcgtttttatgggagatacgatgttggtcaagggcataagtatatattaaatgtgataggtcagttggaatgggaagtttactttgatttggtaaaagagtctcagtttagatctctagaggtgtttgcatcaaagttagttcgtaccgtagaaaatttggatctaaacaaatctccttcttatcattacgtttagaagaattttgtgacatattattctcgtcgtggagggggtgcaagtaagagtgagttggtacgagaagacttggagggtgaaggagagaagaagagacctttgcttggaaatgatttatgggaggcaggaccatcaaagagatattgcggtactgatgatgtggatgcagcgagggtgatgaaaagggagttagtacaagaggggcttgatctaagtgaacatttgtcggcgagtgttcattggtcgtcgtacggagtcaaccctgaatacccgacagaagtagcaggccaatatgtgaatccagatgattacttttatgtcgaattgagtggtggtcacgattctgtctctgtagaagtcaatagagatgatgttgacgaggaggcaagtgttgagcaatatgatgttgaacttgctgaagactctgatgatgaccgtccattccctccacttactaataatgacaagttagcattagaggaatgtcgtgcgtttgagaaggtgtttgggaggaagccggacattcctgagtttagggacctaacacatgcccatggtgcactactagatggcggcatcaacctagatcagttgctagaaccattccaggtggatggtctcagaaagggtttagagttcccatccatggtcgcattgaagctatggctccaggagtacgccatcgtgcaccatcgtccataccgtgttgtcaattctgccgcaaataggaggtacactattaaatgtgaaaacccacggtgcaaatggaaggtccatgcaactaagaggtctagtggcacgtggaggatatcacgggtaggtaagaaacatagttgtgctactgccgaaggttcagggagccaccggcagctgacatcaaagttcatagcaaataggttattcaatgccataaaactgcaacctacactctctgcttctgcgttagctttgtatatatttgaggttttccagtatagggtgaagtatggcaaggcttggagggcacgagaggaggctatgaagctcatttacggtgaatggggtgaagcgtatgttcgtttgcccactttgctgcaagccattaagcagaggaatcccagtatgatctaccacatcgatactcatcctgacagggttgtcaacgttgatgttgtgaccaagaaaatttttatgcgtgcattctggtgctttggtccttccattgaggcttttaagcattgtaggccagtactagctatagatgcaaccttcctaactgggaaatacggtggtgccttgatgactgcattatcagctgatgcggaggaccaacttgtacctttagcttttgccttggtggaaaaagagaattcacgagactggtgctagtttatcgatcttgtccgacgggttgtggttgggccgcatagggaggtttgtattatctcagatcgacatgctggtataatgaatgccatgacgactcctattccaggattgccaccggttcaccaccggtggtgcatgaggcacttcagtgctaatttccacaaggccggtgcggacaagtatcagacaaaagagctcctaaggatatgtcagattgacgagaagtggatatttgagagggatgttgaggcactaaggcagcgtattcccgaaggtcctcgtaaatggcttgaagatgagttgttggataaagataagtggtctcgtgcatacgatagaaatggccgccggtggggttacatgacaaccaacatggccgaacagttcaatagcgtgctagttggtgttcataagcttccagtgacggccatagtatcatttacgttcatgaagtgcaatgactactttgtgaacagacatgatgaagctttgaagcgagtccagttagggcagcgttggtccaccaaggttgatagtaagatgaaggtgcaaaaaagtaaggcgaacaaacacactgcaaggtgttttgataagcagaaaaagacatacgaggtcacagagaggggtggtataacgcgtggcggtgttagattcggcgcaagagccttcaaagttgaaggtgaggggaactcatgttcttgccaaaggccattgctctaccatatgccttgctcacatcttatacacgtttatatgattcatgcaattgatgaggaatctcccaaccgaatgccgtatcagttctcttcaagagccgttgtgaacacatgggcaagtcgctttgagccatacctcgaccccacacagtggccaccgtacgatggtgaagaatttgttgctgacccaaatttgaagattaaaacaagagggaagaggagatcgaaacgattcaagaacgaaatggactcgggtctgggtggttctggaaggaaaccaccttcatgcgttcaacttgatgctgcgccggtgcaaaatgatgctcgttgtgtcaccaggagggtcacaagaaaactaagtgtcctacgcgtccaaaaaagaagaagtccaaaaaaaatataagtgttagggaggtaaatattttgttttcctactcatgctctcgcattcattttcttttaatatatgtcacattggtaactaacggtgaatttattactttttcatgtaggatggccaaggagggacaaccgccgacttacccagccttggaggcgtactacgaggcccgtcatcgcggggctgtgatcgaggcggggagggtatgaatcggcattgattcacttgtgcataagtatcggtagcgtgtatttgacattatattaactaattgatttacaattgctaatgcaggtacttcaaccgctccgagtcagagctcatgcccccccagtgttcgacgataggtagatcccgtacctaagggctgccgggttgctcggggtggccttggtcgtgagcagaggaatgccagtgttcaacgctcctgcgttgacagcacttgtggacagatggaggcctgagacacacagcttccacctccccagtggtgagatgaccatcactctacaggatgtggctatgatcttggccctcccattacaggggcatgccgtgacgggcaggacagagactcctggatggcatgcacaagtgcagcagctgtttggcattccactgaacattgagcaggggcaaggggggaagaagaagcagaatggaatacccttgtcttggctgagtcagaacttctcacatcttgacgacgatgctgagccatagcgtgttgagtgttatgcccgtgcatacatcttgcacttgttgggaggggttctgtttcctgatgctgggggtgacattgcttcggcgatatggattcctttggttgccaaccttggtgatctgggccgtttcagttggggctcagcagtgttggcgtggacatatagacagctctgtgaggcctgttgtcgtcaggcaccatcatccaacatgagtggttgtgtgctattgactcagatgtggatgtggttaagactaccggttggaaggcctaagtggagg

SEQ ID NO: 73819 - DNA, 19313 bp, Oryza sativa
  unsure (1)..(19313): unsure at all n locations
cgatatcgtgctcgggtcaccggtcaagatgtggaaatacgaaatcggattctttgaaccggatgtcataagccaagagacccaaaacaaaagtggtagatatggatgaaaaaaacaattttgttgtagangactttttcagttgaaatcatttattacataaaaatgttatttgaagttgtcataatttgaaaatttaaattttatataggttaatcaaactcaaatggaaaaataaccaaaataagataggtatatctcaataagttatacaactttgtttttgacaattgtttcaaaaaagttcatttattatgataaaattcgattcgaaggttactggccagcccttttgctcatccctctccgagaagtccatttttcctccctcctttcaattaatttcaaaatgttaaaccttcgaatcaaattttatcttactaaatgaacttatgtgaaaaggttgtcagaaacaaagttgtataacttattgagatctaccaattttattttggttatttctccatctgagtttagttgacctatataaaattttaatttcaaattaggacaacttcaaacaacattttcaaataataaacgatttcaactgaaaaagtcatcaacaacaaaattgtataaatcatcaatatctacaacttttgttttggtcattttgctatatgactctgtttcaatgattcgaatttgaatttcaaattatgacaagtgcaaacaacattttcaaatactaaataatttcaactgaaaaagtcatcaacaacaaagttatataaatcatcaatatttacaacttttgttttggtcattttgctatatgactctatttcaataatttgaatttgaatttcaaattataacaacttcaaacaacattttcaaatactaaatgatttcaactgaaaaagtcatcaacaacaaagttgtacaaaccatcaatatctacaacttttattttggtcattttggtatatgactatgtttcaataatttgaatttgaatttcaaattataacaactgcaaacaacattttcaaatactaaatgatttcaactgaataagtcatcaacatcaaagttgtatataactcatcaatatctataatttttattttggtcatttcttcatccgataaagtgatagtaacattgttcataaaatttacatctctcttatatgattttgaagtatttaaatcacgacgaaattgctataacgtcacaggttttgggccggtttaattagcaaaattagagactgtcacggattatgggccttgtatccatagttgcatatccgtgatgatctctaaaaacatcacgaaaattttgtcacggattaaatatattcttgtagtggagattacctttgtttgttgtgtatcccactaatttgttagaggtagacggtagctggtgacaaccctgaatcccgtcctagtaatcctccacgtttgggtacatcatagagctatagcaggaaccatgctggcagaccagtaggggtctgtgcccgaagcaatagataggaaattacctttaacttagcttagataattaaaacatatagaaaatcctttctagcctagccagcctaccaacagttgttatccttggactgccttagccttagatagattagacatgttccctgagttcgatatccttttggggtcaccgaaggtgatgtgctacagcagtattccgtgcgcttgtggatttatctatggtcataagaaataccaacgacaagttcattggcgatgcttttacagtggcggtgcatgctacaactgggatggctcaattggaccttatggccagatttcagtgtcctagtgagcaaggtgaagagcatatgaagtgatcgttggagaggtgctagtaatagcgatggttggagcgcaacactggatttggggcctgagtgtcattggatcaaatgtgtgtgtgctgggagttgttcgtgcaaagacaaatgacgttggtttttctatgcttcctttggacggtgtcggcgagcaaaggaactaaggtcgagagataccgcatctgttgaattggggtggcgaaggattcaattgtaagtggatggaattctaatgaagggtttcaagaattcgggctgctctcaggatcgtcatagtgcggttttgtgaagctaaagcaagatgaaaatacttttgaagcttaatcttctagttttgtgtattcgtgtattcacttcgttgttcctcaatcatgagggttggattctaagtatttctataacttttggttgtgtatatccacttatggatacatatgctagatttcgatctattatctaaaaaatgtctcatcaatcacttctaattcaaatttctccctatcttacccccaaccgtcctcctactattaaccatcccttatttaatttgggggggcatttatgtcatttatttttcatagtattttatcttgtatatattgtagaaatgcacttatttagaaatggatgtagtaaatacatttaatttgcatggaaagtttaaaacgcacacacacttgaggtaacctagtcgaaatgtctaacgactagcaatgtcccctttattttaccataagattgcccatgctttcgatcgttttaattcacaaaacagcattttccttgctccatgaagggacccagactatgctgcttttggggaggaaatggcacgcctccacgtccccaggcttggcatgctgctcctgcaagaacgggtgttttgggctccactgcgtcatgtccaggtggcacacggacaccacctccatagtcgctggttccgcactgccactgacctagctgaccagcaccaccatgtaggccctggtggccgggccagccatgtggcagtagaatactacgtacgggtatgtcatatcatggcaggtcaccatctctgatgactcaccgtcgccactggatccggtggggacgatcctatgcagggctgttatggcatacctcctacgtggctcctcggagacggcagcagcctctaccggcatgttggcagagaaagcctgtacgtgacgtgtcccgaggagggaggaggggagcttgaccaggtcctccatggaggtggcgcatccggctgtattcctgttcttctcaccggtgagcggtagccatgggttgctgtagcatttctctagcacccaccgtatctcatcggcgatggcgagggagactggcacgaacatgttgagaatgttaccaagtcgatcgatggagaacggttaaccatggctaggattagacttttattgggcaagagtaaaattgatgccccatggccaccgccgactcaagtaagttacttggcatccttattgtgtgatattggaaaaacacccacagtaaggtattgggctgagtggaaaccttggcctccacctcaagaaattggcactacacatattcgagtgaatcaatgggcaagtgcaaaattatggaccttcctcacttggacatcccctgttgcagagaaatgggcagctgaactgaaagaaaaaggcataagattggaagatgttgaatttgattggaaaactcttgatccagatgtgcaagaggtcgattacattacatgggtttgcagttaggattcttcgtaggatcgaaacacaaaaactaagccaaccagagggggggtgaatggttggtatacccaaaaaccgaaaacttttagcgaaaataaaagttaccctcgaaatcgatggatcgtggtctgaccgaagtggatgcgccggtctgaccgcctgattaacgtcggtctgacagatgtagatcgatcggtcgaaccgtcgaaatcgcctgccgccgcctgactgcgccgtcggtctgaccgccttagctctgccggtctgaccactgcctattgccggtctgaccgccggtgcgccaccggttggacagccgaaccccggtgaaacacaaatcgaagaactctcaaagtagatgacaacattattgcttctctctctgtttacaaagtgcaccaacagcactccttataaaaatctcgactaaactcgaaaccctaactaaactagcaactcaattgctctcaaaagcgataccggaaaacctcacgctccccccctatttatacatgaggtaggcatcctaaagccacgaaccaaactcatactaagagtcctaaacaccttaggaaacccctctagtacaagacacaaactttacataaccaatcgtaccaaatttggactccttccaaattcgactccgcatcccatacgcacacaatacctccatcgtatgccatatggaatcttcaccaaccacgtgcatcaactctagccttagtatcccgcataatatctgaccaccacggacatcgtcttacctccaagccgactcccggtccatcaccgaaaatactgtctcaaggcatcaagtcacctacacatgaaacaaacaaagaaaccatattccgagaccaagctatccccaacttgactcattgttagcaaacaatagtattacatacgtatagtatccatctagaagccataaccatgaaacaatcacggatatccaaagaaacaacccaaaaccgaaaccgacacagcgtcggccggtcagaccgtgggccggccggtctgaccgcacacatagcaccggtctgaccggcaacatccgctcggtcggaccggacacataaaataacagtgaatccgatcatcacctgaaaattgattatctgcaaaaccacttcgacgataatctccaaatatcaaaaccaataatcacatatgccaattgttcatcacaaattaagaatcaaaacacacattgatcttacaatctcccccttgatgaacacattggcaaacccatcaaaaatgttttggtgtttggaaaaataaaaaaaagcgataaaaagcacacttcgtataaatgtacacattggtctcaaaaatccaaaagaaaacttctccccctttttaaaataaagaaattctcaattgaaccaaaaacattgctcttctcaaaaactcttctcagctcccaaaagtccaattttttttatattccttctcccccttttgacaatgatttcatcaagcataggaattatgttcactaatgtataagagcttagcatacatatagcatatcatgtcatgtgttgcaacaaaaagaagataaacccatctataatataacaagcatgcattaaagtataaccatgaatcaaagattttacaattaagcttgaatcaacaatcgaaattcatgatttcatacaatttataatggaacatcttaacaagcacataggttaaagaataaacactaaacacatatacctattgcatttatcactctttctcaaataaactttagcacaaaataaccaagagaattttttgaactttttcttttcctgagcctgtttgctcatatttttctcttttatttcgggtacgcccctgtcgtcaagactgtttccagggattcggcacctattattttgctcacatcgaatacgtccttgtcgtcaagactgttttcgaggattcggtattcatttttttcatatttttattctctttttcacaatgagcaattaaatctatttgaggaataacaagtcaataaagcatatatatagagcatttataaatcaaaccatatgctagcatcaatattgcacattttcttaattcaagtgaaatttaagtgtcatgcatcatctcccttaaaaacaaaatctaaatctcatgaaaagactagaacacatacaagctatgctagagacaaataaaccttcaaagtattgctagcatgcacaagaaaataccatatgtatagaacaaagctctcttttctcaattttttctcattgtcatattattgcttgataaaaccatgaggtaaaaactcctcctcaaaacatgccaaaaggatttacgaataagcactaactccccctcaaaataacctccaattctctccgaacaaaaatcaagaagaaatcaaagattttgaaaaagacatccaattgccaatgatatcacaaagattctcatgaattgacatgtatacaatagtattaaccaaaactacaacctcaaacactagcatatgaaaagctaataattaagaatgtagaaccaaatatctgtcaatccaaaagtaaattgatgttaccttgaaaagcaatcgtcatcttaaaattgaatactcatggggagtatgacgccaaaatacctatgaacgagaagatatcgaggcctccgtgttggggttagaaataagaaattttggaatccaacactgagtcacacgaccagtagaaccagtgggtacatatgtactgaaaaaatcagaatcagacttaccagaaaacttacctttttgcttcagaaaagtccgatttgaatttcgcacaaatttgccccgaggccggtctgaccgccgcagtgcctgcggtctgaccgggcctggcaaccggtctgaccgccagttcaactgcggtctgaccgctggccggtctgaccgactggtcagtgtcggtctaaccgtggtcctcgaattaaaacccgatttttgccaacgttgtattacaaaagcaatttctctttcctttttctgtttatgggcaagtctaaaacaaaaaccaaccaaatgtccatcttttccaaaaaagaacaagtgtacttctcacgacaagtttgtgaagtaaatggttttgaaattgatggttttgcaacaacataaggttttgcattcacaacatttgatttcgaagaagatccattcaaagaagacatgatgccagcagatttaaacacagtgttcttaggctcagtttcaatcaaaatttcacctctcctagcaacacccaaaacagtaggaggatgtctagtatgatgagcataaggatcaaaacctaaaccatgattgtgtgtgctaaccttagattgatcaagaatcatgttgaggttctttttaccatcagacaatctttgcaacgaacttttcaaataagaaacctcctgagtaagaatagcacaatttttgcaagcatccaaaagacctttttattttctacaagttgagcaagaaagcacctcatcttgtttaacaacctcttccatgtgtttaacacgctctagagcatctttcaactttaactcattcaaaacacactttgaacaatcttgtgaaatcacaacaccattgttttgttttgccttatttgcacatgaagcattgaccaaagaacttgcacaaaaagcaactttgtatttttttcaaaacgttctttgtcaaaatcaactcatcaacaacacgagcatgtaaagcaaatccaagagcaaaagatgattccaactttttagatttttcaatctcaaattccaattttttgcaattaacagaattgacatctcgcaaagcattaatttcagaaaacaaaacttcacaagatttacattcatcatcattaggaatcaagattttaatctagcaatttcagcatttagaatctcaatagtatgatccttctcatcaagcgcagcatattctaattgatcataactaagcttttcttcattattatcatcagattcatcaacatcagaacatgcattacaagcaataaaagctagatcaataacttgcttacctttgccctcatcttcatcttccggttcatcaaaaacttttatgagttcttggattaaccactgcatgcaatgcttcttcttctccttctccttcatgttcttcttcttgttcacgtcatcatctttgactctctcatcatctaccttcttgcctctcccaagcttagaaaaatgcgagcgaagatgatcaagtgcaccacactcaaaacaacgattcggttctccttttttactgttcctaacatttttcatagctcgagaaaatttgttagataacaaaaccaagtcgtcgtcctcgaactgttcgagttgttcatcggaaatggcattaaataaagcaaaaacagaagacttcgatgaagaagcaccaacatccaaagaagtcgaggaagaaatcaaagcactagacttataatcaactttacgagcaagaatattcatctcatgagtttttagttttgtgtaaagcgaatccaaagtcaaagtagacatatcaacagactcctgaattaatgtaactttcatctcccaaatagacatgtcaagaccattcaaaaagtgaagagaaatctcatattgtgaataattagcatcataagaagaatcaacagatctaagatcactcaaaattttattaaaccgagaaagatagtcatccaaagcttctccaggtttcatctcaaatttaatgtactcctttttgaaaagatcacgatgaagttctttaatattatttgttccttgatgaaaattactcaaagcagtccaaatctcatgagcagtttgaagatgagcaacacgatcataatccgaatgagaaatcccactcaaaagaatattacgagctttgcaattttgttcaaactcagtttttgtagcagcagtattaataacttcaggaattacataaggatgagaaacttttctccaaatatcataatcttcagccataacataagattgcatcctactacaccaatgagaaaaatccattccatcgaaaacatgaggcttagttgaaaacctaacaggagtagccatggcaaaaactctagatcgattaaaatccaaagaagcaaacaaggctctgaaactacttgtaggatcgaaacacaagaactaagccaaccagagggggggtgaatggttgatatacccaaaaaccgaaaacttttagcggaaataaaagttaccctcgaaatcgatggatcgcggtctgaccgaagtagatgcgctggtctgaccgcctgatgaacgtcggtctgaccgatgtagatcgatcggtcgaaccgtcgaaatcgcctgccgctgcctgactgcatcgccggtctaaccgccttagctctgccggtctgaccgccgccttttgccagtctgaccgctggtgcgccgccggttggaccgccgaaccctggtgaaacacaaatcgaagaactctcaaagtagataaaaactttattgcttctctctgtgtttacaaagtgcaccaacagcactccttacaaaaatcttgactaaacttgaaaccctatctaaactatcaactcaattgctctcaaaagcgataccgaaaagcgataccgggaagcctcacgctccccctctatttatacatgaggtaggcagcctaaagccacgaaccaaactcatactaagagtcctaaacaccttaggaaaccctctagtacaagatacaaactttacataaccaatcgtaccaaatttggactccttccaaattcgactccgcatcccatacgtacacaatacctccatcgtatgccatatggaatcttcaccaaccacgtgcatcaactctagccttagtatatatcccgcatgatatctgaccaccacggacatcgtcttatctccaagccgactcccggtctatcaccgcatatactgtctcgaggcatcgagtcacttacacatgaaacaaacaaagaaaccatattccgagaccaagctatccccaacttgactcattattagcaaacaacagtattacatacgtatagtatccatctagaagccataaccatgaaacaatcacggatatccaaagaaacaacccgaaaccgaaaccgacacagcatcggccggtcaaaccacgggccggccggtctgaccgcacacatagcaccggtctgaccggcaacctctgctcggtcggaccggatacataaaataacagtgaatccgatcatcacctgaaaattgattatctccaaaaccacttcaacgataatctccaaatatcaaaaccaataatcacagatgccaattgttcatcacagaataagaatcaatacacacattgatcttacattcttatgcttgcattggtcagaagtgctatgttcagcacatcctatttatgcacaataattggttttctagtggtatgcttgatttgaactctaaacaatacatgtgtagaatgctacttactttacatggcaccaagtcaatgattcactttgcaaataggaaatattttcttcaaggcaaggcattcacaattatggacccaatggaactcatgcaagcccaattagtgcagttagtgtgggatctagatgctcagatggttcagattatcaatttaatacctagatgagggaagaatgcactaaatcatgtgattgtgagatcgtcactgccaaagaacaccatgttgttgatgctacttttctgctgtttggcacggttcaacatcctaaagagaagagctcacaagttctcaatcatgtactacatctgcatggtgatttgttggcttgttggttctctcaaatgggctgatgaagcaatggattttgataaagtgcttcttctcttgcttactgctacatggaaggttaatagttatgcaattccaactagagggactaccgagatggttgtttcttctgtgcaaaattcgtaaggtgttatattcaagctcagtcaaacaggggctgagcatgataacaagctgaacacatttctagctcatgggagtttggcctactcagtaaccaacaattatctaatggaaagtatcaatttatgtactcaagctgcctttttgatttccaaagttcatctcagcaactgcaagctagaggaacaatggtgaatgtttttttgtattttggacatcccgaagaattctcagaactaaaggtgccatgggatctaggagtttattgcattggcttggagacaagccaaaaattaagggaacgggttgttaggagccgatgggcttcctaaggtgcagccgccccacactattgatgcagcccaagaccatgttccatgtaaagcctaagggcctgttcggctgctttgtaccgccgctgtgttgccacagccgaaagaaacaacacactgtgctggttggctgcagcacagtaaaaataatggcagccgaacagagcctaagaagaagagaatataaaagcagcagtactacgggaaggaggagagggagagaatcccaaaacggaagcttggcctggacggtgcgggcgaatggcggcagtggcggcgacttaggtctaggcttggattctcgtcgagtacctgttttcttcttccacctctccatttcctagctactagaacttttctatccacttgtatccttgccatctccatctccaccctccattgttgcagtggatattgtcgtttggaaatattgtgaattgggttgttgacaaaaatttattacaatctaaccagaaagatcaaaaccgtggatttattccctgccaattctttttcatagaactacagcttgaagatgaattagaagtctccttttgctaagcctaagcttacctttgagcttctttcgactttacagaggtaagaggcaaacaatagcacaaatataaagtaagttttgtatttttatcgtagtttaccaaacccaaacgtaagcatgccacagcttactggtaaaagaccacttttccgatcggtcagatccttctccagggtttcaactatcgatataaaaaaaatatcaaaggtaccgataaacaggattatcggaaatatcggaattttatcagcgatacgagaaaaattttggacaaaatttattaaaatttggctgaatttgtgcatgaaatcaagtagattgtatctagatcatttggtataaaaaataacatatgttggcgtagccaggaatttttttctggtagtactatttcagaagttcatattacatataaaaatttttgaacaccgtaaatcatatatagatgtaaaaatttagtaaaaaggcgatacaaacatagaaataatatcatttaacatcaataattggctaatttataacaagcaagttcaaaacgtgcgaatactatcatatagatatttaaaataaaaaagatcttagacatggaaagaaaattacttgccgataccttaatctacgcttattcatagccatgaaagtttttattatgtcttcctcgcctatattgctcaatatatgtgactaagccattttaaaatcacctgatcaacttactaattattttgtgcaagccatttcaaaagctgaaggaaattccctctatttgctagatttatcactttcattatgcccacgaaatgccaatccttgttttcaaagaaatcttacatctaagtataaacctagccttagaactaattttgttctcgtattaaaccttcacaatgacattatcaaggtgcgtctttaaagaaaaatatatttctcttgaacttttgtgtgcacttcatgttttgcaaatccaatatacaaactacaatatagcaaatcagcagaacgttctgatattcacattcactattcactgattcgcaaatcacatattcacattgactgattacaaatcgttaatttacttcacctgagcacaagatttgaagaggggctagtaggaaggcagggatatcaacaagggccagggtactaggggacccgggctcttagcgtggctgcccgacaccatgggggggacacgaattgggtggggagccgcacttgcccacgccgaggcgccgctcagctctacccaccgtgaatcgatgcatgcagagagtggcggtgtctagacggcgacgtgacgagaaaaggaaccacagcggcggaggcggcgcggcggaagcggcgcggcgaggcgagaaacggtagctacggcacggcgaggcgagaaacggcagcgacggcgtggctgaggtgaggaacggcggcacaacgaaaagaggagacggggagtggacagaagggaagaacggcggcgtcacgggttgtttctctcacgcgtgcaaagaaccacgtagcaatggtcaaacattggtacggaaagatagggtttgtcttttttttgggacggaggggagggagtatgtagtctgtaaataaccagtactctctgagtgcaaagcatcatataagcaatcgaagagcacaatatcaagcatgcatggcgacgggagggaggagaggccgcgctgtgccgctgtccaagagcttctcgaggaggctaaggcacggccgcacgggttttggaggaagcggacacgcgagggggatgatgcagctccatgtggcgtccgcgccatccagatgtatggcgacggcggcggcagttctcgcctctcaactctcgaacaacaggacaaggcggcgcactggggctcaatgaatggcgacggcggcggcagatagatgcatggcgacggcgccggccggcggcatatcgatgtatggccacgtcggcggcagctctcgtctcgcctctttctcgactctcgaacaggaggaggcggcgcacggggttgggagtggatggggtcacgggattggaacttggaagtgggctctaggactttgactgggctagggcgcgtccgcgcgtgggccaaaattttgggaggctgtggaccgggaaaagaaaaagtacaccaaaggtccctcaacttgccatcgggatacaaaagcgtcctcgaatcgcaaaaccagatatatggggtcccttaattatacaaaactggtcaaaatagatccctcggcggccctcggcggttttgatgcaggttttgccctacgtgtctgcttagacccacgtgggccccacatgtcagcctatccagtcagcctctctttctttcccctcttctctcccttccccttctctctctcactcttctctctgggggctctgggcaggccggcgctgctggccgacaggtggggaagagaccgatggtgcgaggtgggagaggaggtccggcggccggcgatatggcggcagtgatgacggagacgacgcgggagcaggggagcaaggcggcggcggcggcggcgagatgtccatggtgaggtactggaggcggagctccgtcggggcggggagcgggtcgacggcggtggatggcgggcacgggatagcgtcgcggcccaacgccggcgccagcgccggcatcgcccgcccgcgcgcgatctcccccaccgccgtcatgaactgcaacgcgccgagggccgagggccaatgcggcggcgacggcgtcaccgatggctgccatcgaggcggttcgggagaggcagcagaggaaggggagatcgaggatgacggcgccgtatcggcgggcgtggcacagcagtcggtgtgctacgacggcgacaagcagtggacggtgtcagtgttgtgggggttcgcggtggtggtgacgcgcggggtgctgtcgccgcggagatggagatgcccatgcgcacgttcctcaattggtaccgctgtgccgactacacggcgtacgtcttcaacacgcggcccctggcgtgccaaccatgccaaatgccgcaggtgtactacatgcggcagtcccgcctcgaccgccgccgcaacaccaccgtcaccgagtacgagcgccaccgcgtcgcgcccgtcaattgcggctggcgcatccctgaccttgccactctgctcgaccgcgtcatcgtcctcaagaagcccgaccctgacctctggaaaagggtaatcaaacacacaccgtagttaaaaaactgaattgatttgtacaacaaaaaaccttgatttttttaatgttgctcttaaaccgacgcgcgtgcagtctccaaggaggaattgctgcagggtgatgtcgtcacccaagcaagggaaggaccggaagatgaccaacgatgttggcgtctgcagagcgggaggtcaaagtgagtgtgtgagccgggaggccgctgggcgccggccggacgcgccgaagcgggacggagagggcgtggccgcgcgggcgccggcatggcgcgcgaaggcagcaggaggcgcgcgctgccgccacctgcacgcccgcaccgttcccgcctcgctaccgcctccccgggcccatctttggccgccgaggagctccgccgggccgccgccggggtctccgtcctcgacctcgcccacgtggcgacgccctcccctcccttatcaccggcgacgccgacgccctccctttttccccgtcgcggcccccgccactgccgccgctgccagccatcgccgtggacgtgctaaccccgcctcgccgtggtgccatggacgcgctaccgccgccgctgccgacgcgctaccgcctgggtgtgtgactgtgtgtagaagagaggaagagaggaggaagggggaggctgacatggattgcctgacatgtggggtctacgtgggtcccacgctgactcagccgccacatcggacaaaaccggggtcaaaaccaccgagggacctaaagcgaatggttttattagttgagggatgtctggtatctggttttgcgattgggggacgattttgtatctcgatgacaagttgagggaccttgggtgtactttttccgccggaaaaatgccgcggcaaattcaaaaggggccgaaatttttggccaatactgttttcttgggtgcccaccgataaacccgattttcagaaattctggaccctgtttcggcgaaattttgaaccctgtccttctccaccttccccaagctgcaacgcaccccgaccacctcctccacgaagcccgtggccgccggagcgccatcctcgccatcgtcccatgtcagccgccaccatctcgtcgccatcgcaagcttccgccgccgcctctcccgtcacccacgcttgatgagcaccagaatccttttcctctttccctctgtcacatgtcgtgcatgctgctgcatcgaacagtcaccgccggaccgtgcgctgccactccccagccggttggctagtgagccctcgcccctttgttgtggtcgtccgatcaccgtcacatcggtgctgcatgggttccgcgtcggcgccacatgtgcaccatgtggtgcgctcgcccggccacgtgtgtccgtccctcttagacagcgatgcgtgggacgcgcctgtcggcgccacgtgcgcaccatgtggtgcgcccgcccggccacatgtgcccgtccctcttagacaacgatgcgtcggacgcgcctgtcggtgtaaggttttccccccccccccttggctggcatcataaatcaagtttattgcgcaataaatcatatttaacttagttaaatatgatttaatgaagtataactacagtgtaactgcactgtaactaattacagtataatttctatataagttaggtataaagttgcatatattattttaataattatatacaaattatattttagttatagtggattatattacaattatagggggtgtttagatctaggggtgtaaagttttgacgtgccacatcaaatattatatagggtgtcgcatagagtgttcgggcactataaaaaaaaactaattacagaatccatcagtaaaccgcgagatgaatttattaagcctaattaatttgttattaacaaatatttactgtagcaccaaattatcaaatcatagagtaattaggcttaaaagatccgtctcgcaaattagtcctaatacgtgcaattagttatttttttaagcctatatttaatacttcatgcaggtgttcaaacgttcgatatgacaaggtaaaaaattttagggtgagatctaaacagggccatagttagatttgaaatttttttattaaaaacttactacagttttttagatagtctgttaaataaaagcacttgtgtatgtacccatattgaagacacaatatccatattaattatgaacatgcacacgcacaaatatgcagcacacatgtggttcacacgatgacaaactgaattattcactttttacatactatataagtagatagctcgatcgaccgttgctgcaaattacgcacaaaccacgccaaattgttcactttaggttgtagagcttgtttacatcatcgatgatgattaagctgctgcgcgtgggcccccctgctcgtggcgtgggacccagacgatgctgagcttggtgaggaagtggcacacggacacctcccccggcttgacgccgtgcgccacgaagaacgggttgtccgccctccaccgcgacgtgtccaggtggcacacggcgagcgcctccatcttcgccggcgaggccgcctcgccttcgccgtcgccgtccccggtggtcgccgccaccagcgtcaccgcgtacgcggcggtcggcttggtactgtggcagtagaacacggcgtacgggtacgtcaggtcgtggcacgccacgacggcagccggcgccggctccgacgacgacgacgaaccggaaccagccatcgccgagagctcccgcacggacgtcacgttgtacctcccgcgccgcgccggcgtggtcgcggcgtcggtgggaaggtcggcggcggagaacgcgcggacgtcgcgcgtcccgaggagcgacgcggcgaggtcggcgagcgactcgagggaggtggcgcagccggccttctcgcccgggagcagcgccgccgcccgctggccgcaggtgtcgagcgcccaccgtatctcgcgcgccatggcgagggacgccggcgcgaacatggcgaggacgtcggcaaagcggtcggcggagaacgggatggcgtcggcgacgtggcgagggaggaaggccggcagcgaggtcgtcggcgggatggtcggcgtgatgacggagcccggccgaagggcgtcgcgaaagaagaagacgtcggccagttgctgcatcttgttgccgtgtgcgtgaacatggcgtccatgatccattcctgcgaatgaaccaacaacgtagaatagctagaggtatgtatatcgcctcaaagagtttgagaaagaactggcagtacaacttgtgagataaattttggtagttccgttaaggaaatgcatttcttaagtggttaagaggtaaaaatttgaaattcaaagatagctacattttaacatggaaagagtatgtattaagatctgccaatgcttgaaatttctagaccggtgaaccatgtttattttagggtgaatatgatccctatagtttcgcttcgagctcagtttagtccttgaggtttcaaatcgttcaaataagtctttcaaattaatcatttgggttaatatagtccttggacccacaaaaggtgctacgtgagcatgccaagtcatcctcgcatgcagcgaacagcggtatgaataaaataatcattctatccttatataccatatagaaaagaaagaaaaaaaaagaaaattaatgtttcacacatgtatgtatatgtctcagagagtttgaaaaagaattgaaagtataacttgtgagataaattttggtagctcccttaggccttgattggttaatccctgtgagggacggattgggggagatttattccacacatattgtggtgtggaattattcctcctcaatcccctccaatcctctttaatcccctctaaaccgaataagatcttaaggaaatgcatttcttaagtggttaagaggtaaaaatttgaaatacaaagatagatatatattttgacaaggaaagagtatatattaagatccgccaatggttgaaatttctagattggtgaaccatgtttattttattattattacaattatccactttgtatctttgagttacaagcatagtgaactatatatatatatatatatatatatatatatatatatatatatatatatatatatatatcatatatcgataggctatacaagattaagaaagtcatcaaaatgagaaattttacactcctggatgatggagagaggtgacaaatatatttttaacataaaatttagtgtctcttggtaaccgagatatgtgatagcatcgctctatcaaaatgtgcgtgcttagacaattttaagggaaacacaaaaggttgaaaggaaaacaacttacagtatgaataccctaattgcttttctagacgcattcataagttatatgaaagtataacagacaaacttgctattttcaaatattctcaccttcgaatgtgtgttgataattcttatgtgcgaatctcgtagggaacatattgcttagatttacttcatgggcatatgacacttgaaactttttgagttcctctatacgtgacagctatgtacaga

SEQ ID NO: 73820 - DNA, 20236 bp, Oryza sativa
cttagatctcatagttattgctgacgttgcatataataaataattctgaatttctaatgtcaatggttgataatcgtaatatggatgacatcgtgaatgagaaaaatcttgtcagtctgatatttcgcatgctccagaagatgctaaataatccaacttttcatgaaaacgccacgagttgaaaattattttaggcgtgcacgccttccttttgttcactgtcagaagcaacaagtgacaaataagttcatacaagatctgtccatttttcttgttgaaaataggagaaaggacgtaccatgtctcgttcattgctgcggaatttggcgtgttcgttttccaatagtttttcagtcaaagtatgtcccatggaggcattatttatctttgacaaaattcaagttcatttctctatcaaccgaaaggacagaaaaaaagttgctccagctgggagttctctgtttacaaggtcttcacaaatcttcaacaaaattctctgcttaaatttatcaacaaaatagcaatctctgttttgaaaaagttgcactagatgcaatagtaggagttagaagtcccattttgcagtaaaaaaaatcatgaatttcttaggttgcatctaagcatgggcggcctgaaatgtttgtgcaggcaaagagatgggcatcactgacttcatcaactcgaaggcatctggcaagcctgtccacgaggtacaaataatttggccgcttacataaccacactgaacttcgttttcctatgttggcaatttaaacatttttcaaaacattgtcctgatattttatatttaggttatcatggagatgacagatggcggtgtcgactacagcttcgagtgcaccggcatcaccgatgttctacgggaggccttcgtttccacacatgatgtaagcggtgaaaatatccggtgtttttaccgctctttgaaaaactatacaaatagttatgaaaaaatttgcgttgtttcattaaaactaaacctgtattctgaatgaaatggaattcagggatggggcctgaccgttgtgctggggatccatgcaacgcccaggatgctgccgctgcatccaatggagttatttgacggccgtcggatcactggctgcgtttttggtgacttcaagggaaagtcccagctgcctgaaatcgtggagaagtgcatgcagggtgtaagtaccgaaattgttttgaccaatttcattgagtcagattaatgcaaatgtttaatggatggtaattttgattctgtaacaggagattaacataaattttgatgggttcataacacaagagttgcccttcgccgacatcaacaaagctttccagctgctggaagaggggaagtcactcagatgtctgctccatgtctgatgaaacttgtggattgtaaatttgaatacacaataaatgaatcataaatgttttcgcggtttcaaggtgtataattttcatatgcatgtatgttttgtacataaaatgggttgaacttcgttaaagaaaagacaaattgttaattagtagaatgcagtattaatatttgtaacaggtgagtgtgggtgtgcagtcgcgagaattgagcacacgattggttacatacatgctcgagttgctagtcagtagggccacacaccatttttatctattacatacgagttacagtctaattttattatagttacatataaatgttctctaccaaaaaaactgtctgaatgttgatatttgtaatagagttagcacaggtttcttctgtatactattatcatggtttcctacacaataattgtaaaatgttcttttgaatttagggatctccattgcttgtgtccgttttacatttgcaaagatctcaaatatggatgagaactttcaaaccgaacaacaatttcagtttgaaagaaataaaacatgtagtagtagaaattacaatacagcgtccaattgcagaaacgattccaaagtgcacagagcgtctgtgcacataggccggtttaggccgctagcgctacactgtcaactgcagcttgggcctcctagggctgggccttcgtacttttctgatcttagactgttggaagaagtccactttaagtccctcaaataagggtatggtttaaatctcatcctccaaccgtaaaatcaaatatatttcataccttcaatttttaaaactagtataaataaattgagtcattattcgatagttttgaatggcagtattgatcgacatggtgcttacatgatgtattgatccgaacatcattgtaagtggcacttattttgggatgagtctataggtcgggcgtccgatcggtttggagaaaaatcggacactgacgtcagcataacgtcaacgcccgatttatatgcaaaactattttaaactgatttttctcttaaattacttatccaaatcatgatccgattgcaccattaaattcgttgcaattaaatcttcaaaacaggaccacatatggatatattccgatgaaatttttttagcttattattgagttatttttaaatattgcatgatgttccaccaggtatatcggaattgtttcactaagtagatcgaaaatgtttcacttgtttaaatcgggtgttgtttcaccttatataaaaacaatgttttagcaaataggaaaaaaatgtttcagttcaatgcaacatttgatccatacatagtgaaatattttttggtggaacaaaaaataaaacgaattcccttaatagggggtttccaaaatatgtgggttttttttgttgcaatggaatatttcagttcattgcaacattagatctatacatagtgaaacattatgagtacactaggtgaaacatttttagtggaacaaaaaataaaccaaattatcttaatagagggtttctaaaatatgtgggttatttgttgcaatggaatatctggtggagacacgtggcaggtgggaacagagatcttggtggggcctaggatactgcatgcacgtgcgtgggaggcggggccatggggggagcgcccaattttttgcaacccccgtcggtcgaccgacgaagagcattatcgcttattttgtgcaaaaataaaattgagaccgacgtgtcattagtatttccttctttgtcccccataagtggtgaagcaggatctagacatgggggactaacttatgaggtactacctccatatgttaatgtatgacgctgttgttttttttttaacgtttgaccattcgttttattcaaaaaaaattatatgattgttagttattttattgtgacttgattcattatcaaatgttctttaaacttgacataaatatttttatatttatataaattttttaaataaaacgaatggtcaaacgttggtcacaaagtcaactgcgtcatgcattaaaatacgaagggagtattacttaaataaatatatcaagacaatccacaaaaatttaggactgattgtgtattagagtaatttttttcttgtgcaactttcacgatgttggcatgatatttttagaataaggtagcaatatttctatacgtatctcttctttcttctttctatatatagttggtacccactagctataaagctgctctgaggatgagccacgtcaccctaattagctgagaccgttagatcttaaatcaacgcttcaagactgcacatggcaccaccatctacaccaattaggcccatgtaagcaggttcacctaaacagccttccactttcccgtcgttggcccactgttattaaaatccagcacgtttgaatctctactttgcatcatcaaaaccacttgaaagagcaattacaacaaaaaaaaacccgtcatcactgacatgaagatcaaaggtcgtccttaattccatttattgatccccaatctcctcctaagcttctctcaattcatcattaccgtccacctcgacggatgcaatacgtagattaccaatctattaagtctgtcctaaaataattttagtgggcctcatactaactcctatgataattatgttcatgcacatatcgttgctttaatttgccttcctaacattcgtcttaatcaagtttatgccttaattagcactaccaataaaatgaaccgttacacatattcatcgattgaaattttttccgtgacttctcctttcatcttcccttttgatgtccccatttatatttctgtccataacatataaaatgtcttagccatcccagaacaattcatcgtgaaaccttttgctagccagcaatgcaatagctggtgaccttttctactttgttttcgcgatgtattgttctttctactaaattaagttaccatcacaggcttcaaatgtattgttctttctactaaagttaccatcacaggcttcaaatcactgatggttttgttgatatcattcgctcactgccaattaatgccaggctaccgtgtttgctcctcatatggtgcgtaaattatggttacaactccattcaaatactcatgctactgttttgtcccctcctcatgtgttctttgtttctttcctctcaccatgatatgacacacttaaatttttctaatgcattactctttctagcattcttcatatgcttattcactactaccaataaaatgaattttttagttatttatcgagtattaattataattcctattttttctaaaaggcttgaaaggcctaagtttataagcattgaagtgatgaatttcatcaatcttcctttctaatgatctggcccaaaccaacagcacttggaaacatgaatttttctaagttttttgaaaaagttgaaagatgtatttaaatcaagttgcatctaacgctgaagtgatgcacaaattttagaacaatatatatttacgtatatatataagcagtcaaatgcatcttgcacctaacattttctatttatcatagagaaagtcccgcagcaacgcgcgcggagtctctcactagtatagcagatgagctaggcataaaacaacaatccgttttcccctcttcatcatagtctattatattggcaggcaaaagttctagaatttccatggtttttctttcacacatttaatttagaaattcgtaaaaaacgtagtaactactacctccgtttaggttataagactttgcccacattcatatagatgttaatgaatctagatacacatatatatatttctagattcattgacatatatataaataaatatgggtaatgctagaaattaagtcctataatataaaatataaaatagaggaagtatatacgtctcaatctcatcatcactaacgctgcatgataatcatcgttggagggggccgggccgcttcgcccctgctgtctcccatctcctatctctgtcggtgacggtggcagaggttgcggaggagaagcgcgcggacatgctgaggcagatgaccaccccgggcagaatctcctcgttgctcgatcgcctccggccgctgcatcagccagcccccgcacccgtatctttaccgaggccatcaagtgctctctaacatcatgctcttcatcaattatacagtatatatcgctgcatcacctgaagctagaaaacgaagctgaagcagcagtcagcagagatgaagtactcgctcacctgaagctgaggctgagcccgtaggacagagagcgaattgaagaagcgagcacgagaatggaggaaaggaaaagaaaggaaaggaagaagtaggaattgcacgagaagcccaagcaacaagaattgaaattgaagtgcctagtaaataggaattgcatttgctcaaaaggaatgcatatttatgcatttagattgaaccaatccatttccatataagacagcctagtgctatgctaaagtagtacaaataaataaataaagggaatatatccatacatacacaaaaaaaagggattaagtgctgacctagttgtgttgcttaactaaacacaataaatttgaatctttaaaatctggcctccttatttgttcgacctacacaaaggggaccaaccgattagctcaccaacatactatcacaaaaatgttcaggataagtaagaacttaactgggtttgcaagataaacactggtcattgattcatggcgtaagtcaagaagtaattaacatattttttatttagaacccacaatcgataaactgtgaaatggaagagaaaaaattatgcattccctgtaaaatcaaaggtgtttttgattattattctgtgatgaactaaaatcaaatgtgtttttgattattattctgtgatgaacaattggtgtcggagattattggttttgttatttggaatttattcacgaagtggtttcggagatgattggatttacaagtgaattacaggtactgttattttatgtgaccggtcagaccgggcatgtgctgccggtcagaccggcgtgtattgcgcggtcagaccggtgcaacctgtggtctgaccggccgactctgtgtcggtttcggtttcgggttgtttgtttggatgtccgtaattatttcatgattatggcttctagatggatactatacgtatgtaatactgttgtttgctactaatgagtcaagttggagataggttggtctcggaatatggtttctttgtttatttcatgtgtaggtgactcaatgcctcgggagagtatttgcggtgatggaccgggagtcagcttggggataagacgacgtccgtggtggtcagagatcatgtgggatacttaggctagagttgatgcacgtggttgatggagattccatatggcacacgatggaggtattgtgtgcgtatgggatgcggagtcgaatttggaaggagtccaaatttggtatgattggttatgcaaagtttgtgtcttgtactagagagtttcctaaggtgtttaggactcctagtatgagtttggttcgtggctttaagctgcctacctttgtataaatagagggggagcgtgaggcttcccggtatcgctttagagagcaattgagttgagttttgagtttagtcgaaattttttgtaaggagtgctgttggtgcactttgtaaacatagagagaatcaataaagtcgtcatctactttaagagttcttcgatttgtgtttaccgggtttcggcggtctaaccggcgatctaccggcggtcagaccggcgggaacacggcagtcagacctgcggcggcgacaggcgcggcaggtgacatcgatggtcagaccggagattcaacaccggtcagaccggcggctacgcttcggtcagaccggctaatctactccggtcagactgatctccatcgatttcgagggtaacttttatttccgctaaaagtttttggtttttgggtataccaaccattcatcctccttctggttggcttagttcttgtgtttcgattctacgctccccatactcttggcctcttcggatcaaatggcgttggctctgttcagctacatgcatatgattagtgaaaaatctggaagaattaagagagattttggaggagaataaatggcattaaccatggcccatggcctctcatctccttattcttagcgacggtttcttaggctgctaccatcgtatatttctacagagggaggtttttgcactgttcgatatctcacccggagatcttctcatccaatgttcatatgcgatctcatccactgatcaaacagctgataattaatgatgacgtggaacactgaggtttcagctttgggtcccaactttacagaaagaagggattggcatattacaaacttcatgtctaaatacttggactgcacactaagaatatgaactgtgcataaagcagtggtgataactaatacggctgaattatgcattctttgtcctcatgtttcctgatgctgcatgcacttcgtgatcaccgatcaactgctttcctgagcaattgaaccccagattctagactgaccaaatgggggtagtactataaacatgtgtacatcgcctggtcttattccttcccctgccttgcagcaacaagattggaataatcttaaccagctgctgctgcaaattcctttacaaaagcaactaactcacaaacctctttaattattccaagtggtgcatggcccaagcaaaggtgatcacctcctcctcacacagtttaacattctgcagtccgtaagacctataaaaaggccccttctataacacagctaagcccacacaagatcaagagctggtagtagtactcttaccctcttgcattagccttttccttcatcatacaatttatcttgagaaatcaagctgtacctccacaagttgacatgtcgacggtgacctcgtgcaccttcctgagcatccgccccacggtgagctctgctggcagtctcttatccaagaaaccggcagcgtttgtttcccttgcgtcggagaggaaatctaggcctctttcgccgtgcttcgcaattagctccaacaaaccaggggacccaaaaatagatgtgtcgccattcagcatttcacccgttggtgagttatttgtcacattgtcattgcaccatgaatggcacacttttatttatttatgcctttcgaaagaattacgtttacacactatataccattacttcctatgtctgcaaatataatatatgtttagtttttgtgttatgaggtttataaagttattggaatgcatggtattttctcaccctgaaaaaacttaatgccgttatgacatggaatgatcttcaaggacaatattcaaatagttatttctgataaatcggcagaaaacatttagtaagaattatcactagtttatttatttgaagtgatatctgtagtcttattacaacaaaaaaaatgtgttataagtttccctcaatagtttaccttgttgggttgaatatgattttttaaattaaagaaaatatgtattttagactatgttttaagatacttaaaacaaaaaaagctaagatatggaggcataaaaatacaaatatctaataagaactgcaactaagaacccataaaaattggaactgctgttttaggctaggatgcatggcactattgtgtaagtttggattcatggccaactcatagatgtattaattagaaagtccattaaccagttcacaaatcaattaatgacaaaactatatatatttgctgtaaacaacacatacgcaacacatgaagggaaaaaagggaatgaattatccattaatttggttatttgatttccaaatgcatgtgaagttctggtgaacccggtgccggtggacggcgagcggtggcaggtggcggagaacaaagatgaagtgagcctgtggttcgacgtgccggggctttctccggcagatctgatcgtcgagatcgacgaggacgtgctcgtcatcaagaagaagaagaaggcgagcccaaagagcaactacaatactcctacttccggtgccattgcagatcatcaggaggccaccgccgacgagttcagcggcggcgggatctacgcgcggctgctcctcccggcggggtacagtagagagggtgtccaggcaaagctcacctccggcgagctgaagctcaccattggcaaggtcaaggagagtgtccgcaggaagatcaatgtcgatatctctgtcaagtagaattcagtgagcttccatggaattcatatatggtcatctgtgatgaaggatcggagcaacggtgcaagttatatcttgcctaagattctagctcatatatatcaataactggtccatgatctgatctctctctctctatgtatacatcctttgctgttttcctaaggttgagtatgcttatgtatgcaagctttattccggctgcatccaaataaataaaatgatcatctttgttgtgctttcacttgtgcctgcatgcatgtgtgatgtattccctggtagatattctaaaaaaaaaattctatgaacatctctggtatacatctccttagaataactactctacacccccctctcccataggtcaatcccatcgcccccacccttcctagggtccaaatccccccttccacctcagtcaaagaatagtcaaagcctcctcccgctggtcaaacccgagacaaacccgcccattgactccctcccccgcctaccactttgtgttacgtctcgcaggaattccgcagtaacataacggtcatcgtttagtaacaggacaactttctcgtagtaacaacatcgaaaaatagtcatgatagatctagttttgttaagcactttttttcaaacatcatggtgcagatggattagaaaaattatatataacatgagagatattgctctctaaagattgaggtttactttttttaagttctcgtctcgctggaacggcgtagtaacgcgacggccaatgtgtagtaacacgactactttctacagtaacagcgttataaaatagtcatggtggatctagtttcgttaagtattttttgtctcaatcattgtgtagtaacaggactattgtctcgttgtaatgtcgttttaaagcattatggtgaaagcgattctaaaaataatatgcgatgtgagagatattattggttaaagattagaattccaaaagtatacttatactaagcttgctattatgtatctttgtatggacaaagagaagtactttttaacacttgtatttttcataagattgagatttaaaaatttagctatacacaagtagtggtactatagtattaccgttaatatcatatgttctctgttactacaatttcatctcaatgctactgcaaaacgtacagtaacgacctataaatttcacagtaatgacctatacatttcacagtaacatatcgtgttactgcacttctgcgataatgttactaccgaatcatagtaaaaaagtatgattcctacagtaacataacgggtttgtgttcacaaaatttgaacaaatatataaagaaagcaaacaatgatctcaaatcacatagtgtcatagaggtgaataggttagtagagtttgttatgaaccatgagatcatgggttctagtcttgaattcatcaatttatttttaatttttctataaaatagaagggaaaatggttctagtcttgaattcatcaatttatttttaatttttctataaaatagaaggaaaaatggcagatgggagagaaaaaacgaataaaagaaaaaagaaagtagaggagtgcgctaggagaagaaaaagcgaataaaagaaaaaaaagtagaggagtgcgccaggagaagaaaaggcgaaaaaaaaagagggaggaggggggcaatggagagagagagatcggggaggaggaggaggagtaggggaaggcggggccgtgcccgggagggcgggatgggcttagtagttgggctgggaaggaggggtgggggtgtagaatatatatatccgtggagccccccccccccccccgcgccccagctccatgcccttttgctgcggccgccgcaggtaacgccatccaacgagctccatgcctctcccctacagcccagtcaggtgcttgagactgatccctcataccataagcttcatgaggagagctgcggtggagctccgctgtctaagctcgagctccactggcctccgcatttgcctcagcctaattctagactggaaaaggcagcagacaatggcaaccaagcggtgaagatggtgcagctttgagcaagctcgagttggatgcggagatgacacggacaatgacaaactcgaagtggtggaggcccagcggcctcggctcttccatcgagcttgtcgtgggctcgaggcctcgccaccggcactcatcttcttcgaccttggcaagggggcggcaggtgctgggtctagggtggtggcggagctagggacagtagaggccttgtggaggagagaatcgaagagccgcaccttggtctcgtactctcgtagatgttggggaggagagactcccaaatttcaaccagccgccactagacccagatgcagtggggtttgtccacgtccatcaatccttgatagagcttgttggtgaaccttcttttctgtgctcgatgacccctcttctctaacctcgccactcatcgctagtccccctcttctctgacctcagccaatggggcaggctctgcgtcgagctagccgccaacctcgtgcttctcccgagcacgacaaagggggtgagctccgcatcaatctcgacgccgaccttgtcatggccgccgccccctcttctctcaagcatgcgagatctccatggccgcctcaagctcggcgagggtgaaggaggaagaaaacaccatgacaggcagggaccgctgacatggcatcctggggtgtaccaaaaccagggtaaaaaccactctggggtgtaaagtgaatgttattgaaagtcatagtatgtgaaatatccaattttagagttttgggtgtattttagacaaaacgaagaattgaagggtgtaaaatggacttatccctatttataacaaggtgcaatttctttcgcacttattgtggcacattgcatatatggacattacattgatgagtttacgagttagcctaatatcaaaagattattccaagtcatctaaggacaatcatattttggtttattgtgaactactaaatgccttttcttttgttcgccctttctttttcagcatatcatttcaaaaccgtaatctgtgtaataccatcctgcagtaagacgtgggaccggcatcatctagttagatacatataacacttccacctagacattactcaggtatctaaatagaaattctagtgttggctactttagatatgttgaaacttgatttatttttgcacaacttaatttcaactatatataaagatagaacttaattaattaacttggtcaagacaacttcgtgctagttaattaagttaacttggtcaagacaacttcgtggcaactataattaaggaataagccaaacggacatatttgctaacgaaaaataatttgtgaataaaacttttatatacgtatttttagagatctaaaagaaaatgctggaaaataaacttcaatgaaaaaaccccaaaatcaacttgaaatttaagattgaaaatttaaattttagctggtaagcataagcatatgtgaagagatgaggctagtagtttctctgtggggccgattgcattatattgccattagggcgcttgtgttatttgtcagtttaccatctcagttttcttattttcacagattccactggttttcttctagtgttgtcagttgtcaaaatgccactacgattccagtttcaacgccattaacaagggaacaatcttcgactgtatccgtgaccaaaaatacccctcaacaaaatattataaaagttttaaaaaaacattatcctatttgagttgtgaaacttgaagccggataagaggaaaacaaacagaaataagtattttgggagcccatgaattgtggaatcatcgagatgcactctcgagatctgataaacattaatttggttttggattaattggttcatcatgaccattacgacaattagtacctcagttttttaatcgagttacaatttcgactactaacgcagcatgatgatgagtagcatctcctcctcgtgaagaaaggaaaaagagtaaaagaaaaaaggagaaaaaaagaaacactcatggccgacactgatagaacacgtcaaactgttgctcgtacgtactacaaggcacagataatgcagcatccactgatccaccggagaataatgctttacgtaccaaagcagcttcccggcctggtatctacagcccttcgatctgaatttttcctctctttaattataccctgctaacccgaccaagcaaagtgcccaaaatgaccaacacttcagtcctagctgcttttcctttctctctatatataaactctcgcttattagcttccctgtactcagtattaatcagcaacaaatggcttcagatcactagaccagagtgaagagagaaggcatgtactacagctaacccattatacatttcgatctcctcctatacatatgatgatatatatatttgattcttgacttgttaattacttttctttctatgctatagcgcgtgtgtgttgattgtcgtaatgtcgatggttgtggcctcttacgctccggcgagccggtcgccggtgacgcgggcgtcctccggcgcacggcgggttagccatacacagtcatggaggccgccgccgccgccgttcttcccggcttccgccgccgtcaagtgcaggcggcctactcttccggtggcacgttctgttggcccgccggagaaacatcgccctgtgctcaacattcctcccaccggtagtgactctccttcaattcacttctctgtttttttttgttcttctcagctttgattttctcttttctaactgtggctaatatacctagaaatcaaaatgaattcaacaaattaattgcaataaaacttaaggcccctttgattcaaagaaaatttataggaattttagaggattttatttctataagaacttttcctacatagccctttagccctttgaatcaaagaaattgatcctatggaatcctatgaaattcctatgtaatgtgtcttcttattcaaattttggagaaaatttaacatgaggtagaacctcatggaaaaaaatatttgagtctttatctctcctcaagttctcatattttcatgcagttcaatcaaacggttattcctaattaagtttttcgtgtgttttgtatttctctgttttacactattcctgtcagaattctatatttttcctattacttcgtttttttcattccagtgattcaaaggggtttttaatgtgataatatgtgatccaattcagctctactgtaccaagtcccgccaccggaggggaaagaacggtgggaaatcaaggatgacgagggcaacgtccagctgtggttgcaggtgcccggcctgacggaggacgacctggagatcaccaccaccgacgaattgctcgagatcaagcgtaaggccggtcgcggcgacccgcggcggctcgacgacgtccaaggcgttggctccttccatctccggttgctcctgaccaaggagtttgtcagcagccaggtgacagccgagctgaaggccggcatgctggaggtgaccatccccaagaacacaaacctgcgtcgcaccgtagtcaggatagggcagcaatcacagtctccagctgcagttagaactgcgcagccgaaggtcgtcgatcctcctcctgccaattcgccaccgaagaataataatcttgtgagaaacacaagtgtgcagtcgaggattgatcctcctgcgagagagtcgccgaagaatgatcttggagtaggtatcagtgttcaaccgaatgattctcctgcgagagagccacccaagaacaatcttgccggaggtagaaatgtgccaacgaaggatgatcctcctgcaagggagctaccgaagaataatttggccggaggtagaaatgtgccaccgaaggatgatcctcctgcgagagaaccaccaaagaataatcttgccggaggtagaaatgtggcacccaaggatgatcctcctgccaatgaggcaccaaggaataatcttgcaggaggtacaggtgtgccgacgaaggatcctcctagaaatgccaatgagccgccaaagaatcctcctggtacccgtgaagccaacctaggatgagcaaattaaccgtggtgggcatgtgagaataaagattagaatagattaaaccccatgagaggagagaagatatgtttatgtacatggttgtcatgctcagaggggcaattttcactgcacgcagttggttcactttaatttttatgaaataaagttatttgatcgatatgatttgctatggtcgaccatttaccgtttcagtgatggtgtaatgtcccagatatccacataataaccgttagagtgcgcaacctggcccaccaccgtgggccacccaagtcacattgggtctgctgctccactatatgcccaaccggagccataactttaggtcctgggcctacacaacccaaaagactagtctgataggtgagaaccgcccccaccttttaagtcgtgctcctccatcatcaattaccgatgtgggactaaacccaacaataactatagtgcaagaatatcaaaattcaaacatgaaaaccctgctaagatgaagaagagaaaatgacatagggcaaatgagtaggggtcccggagacaatccagatttacggaatcgaagagtggctcattgagtcatacgatctccatcgtgtaaaatcaaagtgtttttcattctttattttgtgatgaacaattggcatctgtgattattggttttgatattggagattattggcgaagtggttttggagatgattgatttttcaggtgatgaacagggttactgtttttgttgggtccggttaaactgggcaggtgctgccagtcagaccggcatgtatcgcgcggtcagaccggctcagcccgcggtctgactggccgactctgtgtcggtttcggtttcgggttgtttgtttggatatccgtgattgtttcatgtttatggcttctagatggatactatgcatatgtaatactgttctttgctagtaatgagtcaagttggagatagcttggcctcggaatatggtttctttgtttgattcatgtgtaggtgacttagatgcctcgggagagtattgtcggtgatggatcgggagttgacttggggataaggcaatgttcgtgacagtcagatatcatgtaagatacttaggctagaggtcaatgcatgtggttggtgaagattccatatggcatacgatggaggtattgtgtgcgtatgggatgcggagtcgaatttacaaggagtccaaatttggtatgattggagtttgtaaagtttgtttcttgtacgggaaggtttcctaggtggattaggacttctagtatgagtttggttcgtggcattaggctgcctacatcatgtataaatagagagagagcatgaggtttcccggtatcgcttttgagagcattgagttgaaagtttagttagggtttcgagtttaatcgagattttcatgaggagtgctgttgttacactttgtaaacataaagagaagtaataaagttgtcatctactttgagagttcttcgatttgtgttttctcgggttcggcggtctaaccggcgaaacaccggcggtcagaccggcggcattgtggtggtcagaccggcggcgtacttacggtctgaccgtcgacgacatcaggcgacttcaggaggcagggtttgatctcagcggttcgactgatattactacctcggttagaccgacgatctccaggcggtcagaccagtgcgactacttcggtcagaccgcgatgcgttgaatttgagggtaacatttaattccgcaaaaagtttgggtttttgggtataccaaccatttaaccccctctggttggcttagttcttgtgtttcgatcctacaagtgatatcagagccttgttttcttctttagattttaaccgatctagagtttttgccatggctaataagtttataactaagccccatgttttcgatggaacggattttccttattggtgtagtaagatgcaatcttacattatggctaaggatcttgatatttggaaaaaagtttctaatccttatgtgattcctgatcaaattaatactgctgctttaaaactgaatttgaaaataattgcaaagctcacaatattcttttgagtgggatttctcgttcggattttgatcgtgtttctcatcttcaaaccgccaatgagatttcgattgctttgagaaattttcatcaaggaactaccaatattaaagaacttcatcgagatcttttcaaaaaggagtacataaaatttgagatgaaacatgagaagctttggatgactatctttctaggttcaacaaaattttgagtgatcttagatctgttgattcttcttatgatataaattacacacaatctaaggtttctcgtcattttttgaatggtcttgacatgtctatttgggagatgaaagttacatcaattcaagagtctgttgatatgtctacgttgactttggattcgctttacacaaaactcaaaacacatgagatgaatattctttctcgtaaagttgattctaattctagtgctttggtttcttcttcgaattctttgaatgttggtgcttcttcgttgaattatactattctttctttaattaatgctatgttcgatgagcaactcaaatagttcaaggaggaggacttggctttggtcactaacaagtttgctcgagctatgaacaatgttaggtacaggagaagaggtggtccaaatcgttgctttgaatgtggtgctcttaatgaccttcgctcgcattgtcctaagctttgaataaaggcaagaagaaagacaatgatggtgagaagaccaaggagaacaagccaaagagcacgttcaaaggggagaagactaaggagaatctcaagaagatgtttgagaaagtctatgccgcttttgagcctttaagcaatatagatggagaaagtgaagatgaagataagggaaagaacatctccggtgtttgcttcatggcacgtggtgaatcggattcagagtgtgaagacaatgaggtgagttcttttgaagaagctattcttattttaagtgctaaaaataagaagtgtgagaagatgtataggaaacaggaatttattattaaatctcttaattctgaaattgctagattaaaatctcttattcccaatgatgatgattgtaaaaattgtgaggttttaatgaatgagatttcaaaaattagagatgtcaatgctgcacatgatttgaaaaatagatcttctcttgctcttggatttgccttgcatacacgcactttggatgagttgttttttactaaaaatttgttgaaaaaaatatcaaattgcttttcatgctagtttgatgtttaacatgatttgtgccaaaaagtttaaacaacaacatgatgttttggatagctcaacatgcacattaaataagatgaaactaaaagatgctttaggacgtgttgagtacatggaggatattgtgaaaaacaatgaagtgctttcttgccccaaattttgtaaaagcaaaggtgtcatggtagattgtgaaaattatgctaatttggaaaaggagctttcttatttgaaaagttctttgcaaagattttctgatggtaagaaacaacttaacatgattttggatcaatctaaagtgactagttacaatagaggagttggttttgatgttcatgaatatttcaccaaaaatcaaccaaacgttttgagtgtgactaaatatggtgaaattttgacaaaaccaagtgctaagaaaacagtttttaagtctgctggaatttggccttctctttctacaacactaagagaaacaaaaacaaatctttcaaaaccatcttctaaaaaaaagtgtacttgttctttttgtggtaaagatggacatattgttagattttgtttcagattagctcgtaaacagaaaaaggagagagaaattgcaattgcaaaatcaaagtggcaaaaatctggttttcccttgaggaaatcggttagaccgcagtgggtcccgccgtcataccggcgactggtcagaccggtggctgtgcatcggtcagaccagctactatacttcggtcagaccggccttggagagatttttctaaaaattctcaaactgtttttgcacgtgggtacatgcctattggatctactggtcgtgtgtctcagtactggatttctaaattcttattatctaaccccagtactgaggcttcgacatcttcttgtgtgtaggctttggtggtgaggaaggagaacatgtggatcgtggattccggttgttcgcgacacatgaccggtgataaaaattggttctcctccctcaaacagacatctaagactgaatcgatgatctttggtgatgtttctactagtgccgttctcgctacaggttagttcaaggtaaatgacaagtttgaattgaaaa

SEQ ID NO: 73821 - DNA, 4254 bp, Oryza sativa
aagctataattaattaattattacccgagatcagcataatagcaacaaagtcccgcgactttggaatagatggcattatattacctgtctatcagttggaagaccttgtcaaaaaccttctcctctttattcattgagtcgtatacagtgactctgcatgcgtccaagtcaaaaaagaactggacccagtggaatatggaatatgcgtgagatgagataaatatcagaatgtacatgttatatgtatgggaatgaaatttgttcgaacgacaataaaaactcactctgtgttgtacggcaatagtatgaacgtcttgaaatgctgttgcgttaggagatggacgagattgtcctctgtgtctttctcgtacttgtcgagcatttcggtgttgattttccgagggtcaatgaacccagtatcgtaaaccccccgccgtcaggccctttgaatctccattctacaacaatgaaaggaaattattattgcttacatatatgccaggagctaattattgaacgaaacaaatcgaactcaaagatacttacaaaatccatgcgctcagaagagagacgtcgagggcgtccagatgataccgatcgaagacatccttgaaatggatccttagaacatcttctccttccaagaagtcggggtttctgatcctcgctccgaacatctctctacccttggcgctcatttccatgtaccgttcatggaatttgtacatttgtgttggtagggactgcagctgctcaggcctgacaagcggtttaccgagttcaaacttgtatgccacttccgccttcgggattggtgcgcctccaaccaactgagcaacagttagaccggtgtccgaaatgaaatacgttatgccaaagtcttcgccggtcgccaacggctcgaccacttggtttggttgttctccaagctgaggaactggtttggacttcttgtaataggctttcctaagtgttcggtcatagtccgttagctttaaggcctccttgtttgtggtggacattcccttgaagaaattcttcacgctcgggtcaataggtatcttcttttcaggactccgaggcttgagttgcctcttcacttctcctgccacataagcgtcaagctcctcttaactgcaatcgtacggcggctccttgtttttggtggtgtcaactttggccttcttcgttgcccttgtgctggcaggaggtggagcttggcgagaccttgtcttgggaggtgcaggcggacacggtggaggtggaggtggaggaggcggaggagccggaggagatggtgcatgaggaggtggcggaggagccagaggagatggtgtaggaggacatggcggaggaaccggaggagatggtgcaggaggagacggcgaagccggaggagatggtgcacgagacgccgcttgtcgcccagggaggatgatgtaccgcttgcgctatagtataatggcgtgccttgtgtctcgtagatgcgtctcaccatctcctcctaggtagtccaactcgaggtcctcgtacacggcttccaccagctcaacttcgaccctcgagtatcctgctggaatcggcctgcagtggtaagtccctgaaatgtccgttgggatggccattcccgacgccaccttcacgtgatgagaggttatctattagtaatcaacctaagcagcaacttgcggaacgtacaagtcaaaaatcatatattacatcgaggataccttgattgataagttcttgaagggaatatgcagctcacatggtgtccgttgcgtgatctcatcaacggggcaggtggtttcatcatgggtttgcatggcgtccatgctatgtgatcctacctgccccgttgaggcgcagctgctacgattacctgattggctgaccattggaggaggtatgtacggctagggatcatgtgaccgatgtgctgccatgcgttcatccaccttccgggccacctaatcttgcatgctgagctcgtagctcgataccctgtactcaagatctgcaatcttcgcctcggtatctctcttgctcctcatccgactcctgtacgtgtggatgtcctccttgaatcaaatcttccagggaatcacgccttttactcgtgttcgtcttggatgctcgggaatctgtagggcgagtgacagctcgtccttctctctgtcgggtcggaacgtgcactgagaagaggcttccactatgtccgttagtcgactggcagcctcacgtatctgatcgctgaagaccagggagccatcaactgggttaagcgttccaccgtgagcatagtaccagaacttcgatcgatccggccatttagcggtggccggttcgatacccctctcaatcattcttgcctccatctcctcccacttcagtattgcgacgctatagccacctaaccccaagtggtgatggtacttcttcttggcagcgttttccttgtttttgaccatcatcgcttgcccttgttgccctgtcttgtcagcaacgaactcgtcctaatgatcccttagctttgggaatacgtcgaagttcggtgttagtaccttcaggatgtatttcttgtacagatgtcccttgaagctcttgaactgttctgccattttcttaagagtccactgtttcactatgttctccgtacccgcagggagcgtgaacgtctcgagcattgtggtccacagcttctctttctctgattccgggacaaagctgtcattatccccgcgtgcccttgttctgcgctagtacaccttcctgacaggcacgttatccctcacaacccaaccgctgtgtcgtacaaaattcttggctacttctgccgggacactaggtcggccgtctgcgtccacctcagttatgatgtgccgaccctctatcttcttcgcagcacctcgttgtccgcgtgccctcttctgtccagtggagggatgacttccactagccgcctcctcgttcccctccgcatccctctccacgttgccctcctcgttcccctccgcatccctctccacgttcccctcctcgttcccctctgcatccctctccacgttcccctccttgttcaagtactggttggatcctcgttcccctcttcttcgttccagtactggctgcttccctctgcgattgtatcgtacagtatctatttctcatcacgatcagccatctgttcatagaagaaatatttgctaagcgtaatattaaaactctactaatcttgtattaaaactcaaataatcatatatgctaagtctaagtgtcgtgtattagaaccctagataatcatatatgctaagtctaattaagtttcgaatattacatctctaataatcttatattaaatctctaacaatctctaacaatcaaatatgctaagtctaattaagttccgtatattaaacctctaataatcttatattaaatctctaacaatctctaacactcacatatgctaagtctaattaagttccgtatattaaacatctaataatcttatattaaatctctaacaatctctaacactcacatatgctaagtctaattaagtttcgtatattaaacctctaataatcttatattaaatctctaactatctctaacactcaaatatgctaagtctaataatctaataatcactaacactcacatatgctaactctaataatctaataatcttatattagaaatctaacaatcttatattatatctctaacaatcacatctttacatcacttgcctgcacgaattccttcgagggctagctaccacttcggcttgagggacgacgacgatgacgtcttctctgcaacatgcaaaaaaaatgtattagtctaaacgcaaaggaacatataatgtatttcacgttttcaagtatatataatcatatatatatatatatatatatatatatatatatatatgctaagttcaacaatagtttaattatctcgttcgtacacgtttcgctcgcgttcgttcgcgttcgttcacgttcgttcgcgtttcgttcacgttcgttcgtgttcgttcacgtttcgttcatgttcgttcacgtttcgttcgcgtttcaatcacgttcgtttacgtcgttcgcattcgttcacgtttcgttcgcgttcgttcgcgttcgttcaagttcgtttgcgttcgttcgcgttcgttcacgtttcattcacgttcccctccacatccctctccacgttcccctcctcgttcacgttcgggcggctgtgcgg

SEQ ID NO: 73822 - DNA, 1267 bp, Oryza sativa
ttgattgacacatttttaaatatacattgatacaaggcacatatgttaacgaaccaaatttggtaatatcagcatcggagaaggagattagatcgaagctatcggtgaagtgggcccgggggtatgtggaatgaggggaatttacctttcccatcctggcgcatgacctacagcatggccctacccccgtaccccgcggatcgcaggagcggccagggggcctcggggtgccacgtcgtgcccctcgggccctcgcccgttttgccccgaggcctcggggtgtcacgtcgtgcccctcgggccctcgcctatccgccatctggcggggggagcaagcggggagggggcccaagccgaacctcctttaatgaacgcagcgccccaactgccccctgccgcattcaatgcggtaggggcagacgtgcggcatgcccaactggcgcgcgatggtcaggaatgactagtctgtgaccggcctgtcaccggtcacatatgactggacggacagctgtgcccccacgtcacatctgcctccggcagagtggaggtaggtatgacccgtcccatcggaagggtcattcgaggtcctccccatgagaggatggccaccacaattcttcatccattaatgggggattgacaggggtgtcccccgtgtcaggcaagggacggcgctgaaccccactcaaggacaatccgtggcttagcttccaggcgaaggcacgggtcgagatccggtcaaggtagggtgggccccccccacccgagagaagagtagtagagtcggtgcatgtggtatcccttgaggtataaaaggaggaccttgcccaccgaaaagggggggaccaagagaaaaaacctgagctcaaggagaaaggaagtaagggcaatctccagggcttagggacctttgtaacttgtgcctaaatcccatacacagcagtagggtattacgctcctttgcggcccgaacctgtataatcttgttgtgtgcacactacctggtagtctagtgggcggatacgtgattttcagaggcgggccttttcccccggtcgaactcacgaaagggggatcccacgatctcccgctagagaggatcactcctcgacagaagcggaatcgaagataagggctgtcgcgaaaacagagtaagaatcgggtagagtctggatcggctacggtcaggatcggcagagttcgagtcagacagggctagccgatacaaccgattccaagaatacgactcggtgtacatcagcgggtg

SEQ ID NO: 73823 - DNA, 16174 bp, Oryza sativa
ctaaatgctgtacgatgcaccaactagcaaccttgctgtactgggggactggacgaatcatgccacattaggtcgcgccatgcaactcctaccatgcgccatagttgcatcggctgcataacccgtggtcactctggtcgcacataccatcgaacatcggatgcatgtcaaacatcgaccaccacataaatttcgacataccttgaaaggtataccggaatgaattcgcgcatgccacatgaattcacatacatatttagcccattaatggatcatccgatacatactgcacttatgaaaagcttcaattgtgtctaattgacactacgctcttgccaaatcgatcctgcaagatcatgcatgttggcatcagcacattaagaaaagcactaagtaccggacgtccacaagaataggactaaaaatgtccaccgcaccattattgaaattcctgccacttcaatggactcttagctccaaagacaacgaaatatcaataaccggactattcgaaatgtgttgtccacttaaaagaatactagtgttgactcgacacacgtgcatgtcccacaaccataagggctcccaccgaaaaaaaatggaaatttttaacagaggtacgaacttatcctaaattccttgacaataagaaggattattttcagtcgtttagggggagagaaataacccttaaaatgataaatgtcaggaaaaatggtcaaagaaaggatggatgcacatttaatcaagaaccagcgaatgaaagtatggaaagcacacataagaattggataactacctatcacttttgtgatctggagagcatgactaagttgcattacccgaatgtaatgcaccggaggagggtgaaataccgaagaatgcaaaggtatacctcatcttgtccagatgcctcaaaaaataaataggacaagaactccggctccttaaatctctaaagtaactggagacgtatggtgaaaatgggacgaaaggaactttcaagctcatagtcactaaaagtaaccccagaatttgagggggagcctgttcagagctggcaaatggtatggaacctcagaacatgtataccacatcttcctatcaaggaagaaaaccagcagttggagtgcacaccaatgccggtaaaatgaaaggatcatgcccatgtcaaagaatagaagcataagaaaattgcatatccccatatatcgatggatactcacataagtgtcacatacaaccaataggaattggtaatgagacctgctatgggaaatattctcttcatacagcaaatcattggcagtcaacctggagtttaaaatcaactaaaagatcaacccgcaaagctgacctgtagttgacaatgaatggttaaagaaattttggattgggcactcgcatacaagcattaaaagtcccaaaccaagttgatgatcttaatatcatcgcataaagaaagaaagctcactctttccgaacaagtttgagataaaataggtagaaacctacgtttctttggctcataaacctacaacacatgaagaagtgaaccatagaatatcagaatgtgagaatacataggttccttggatatagttcaccatttctagcaagtaacatggttcgagctttgcccaaaccccaaaatcattatcaagaagataatgatatgtgcgtcacaccaacactaatagattgtatgatctctacaagttatggaaaaatcatgcaagatttgaccattgaagcatcactcggactatcttttgaaaacataagagcaacgagttttgatggttcacacttaaaagagatgcaaaattcaaggggggaattctgccagtctattaacaaaagcatgaactaaagaatcaagtacccaaaaacgattaagaaaatcgatacaagaatttgggtaaattgtactctttttcccttagataagttttcttgcagtttcttatcaaggtttttaataaggcaatctatgtgacatacatgcgtatgctatgtactctttctgcaatttttcccactgggtttttatggagttttaacgaggcatagacatcacgcggtgagtgcccaagggggagtgttaagaaactttaggcttggccgatgaaggcctggcccaaatacacttaatgggcccatcaacgaacctttcatatattggaatgcactatataaagagaggagggggctaatcatttgtacagttgattggaggattgaatagtaaagagagtctcacccctaaactttgtgtctccaatattttctgtagaattacgggaccctcttgaactgctttgtgtagcaggagggttgcgtaatacccttgaccctaaaggttccacaaccctgaccagggtatcattattaagaagtagagaagaagatgaggcactggaaggctgttatatgtccaagaaacattagctgccaccatcactttgggatggagagaaaaaagattgaaacaactaccatgtcaaaggaactctgaccatggttgcattcacatgggattataggctatagtgtcaagagtcaaaacctcgagaaggagataggccacgacgagcgcaagaatgtggatgtgcgctgtagtgaagcgcttgcttgagttcaaccatgtttagtcacatgtttttcttccttttatactgagggattgtttggtttagggtgtattcgtttgggaggaatttcaaaggatttggatttctaaggatcctatgaatgtcattcggttcgtaggaatgtagatatagaaaatcaaagaaaattttctttttctacaagttgcagagagaagaaaggaaactttccatccacataaacctcatggaaaaattcttacggattgaagtatgcatgcttttctattcctccacttttcctaatcctatgagaagtttctactcacagaaataggaaaagtgaaggagtggaaatgtatgcacacaccaatccataggaaattttttcaagagtttagagtaaattaaatgaaaatttttctagttttctctctacaacttggaggaaaacaaaaaaatttctttggtttttctatacctcattcctacaaaccgaatggcacttgtagtagttaatcattaggaatctaaattctttgtttttcttcaaaccgaattggtttagatagatccttaatttgcagcccttagaggatgcaatttttctttttgctatattcaatgaatgaaatagcaccgtctttgtgtctattcatttaaaaaaaatgattacttttgactggatctctacacgatatgcattggtgcagtacaataatagagatcatcttgcttcttattatattcagcttgattgacacatttttaaatatacattgatacaaggcacatatgttaacgaaccaaatttggtaatatcagcatcggagaaggagattagatcgaagctatcggtgaagtgggcccgggggtatgtggaatgaggggaatttacctttcccatcctggcgcatgacctacagcatggccctacccccgtaccccgcggatcgcaggagcggccagggggcctcggggtgccacgtcgtgcccctcgggccctcgcccgttttgccccgaggcctcggggtgtcacgtcgtgcccctcgggccctcgcctatccgccatctggcggggggagcaagcggggagggggcccaagccgaacctcctttaatgaacgcagcgccccaactgccccctgccgcattcaatgcggtaggggcagacgtgcggcatgcccaactggcgcgcgatggtcaggaatgactagtctgtgaccggcctgtcaccggtcacatatgactggacggacagctgtgcccccacgtcacatctgcctccggcagagtggaggtaggtatgacccgtcccatcggaagggtcattcgaggtcctccccatgagaggatggccaccacaattcttcatccattaatgggggattgacaggggtgtcccccgtgttagtcaacgcttggcgctaactaccaatcaacgacagaccgtggtttagtttgcagatgatggcatgggtctaggtccggtcaaggaagggtgggctcctccccatcccagagaagaatagtagagtcaggtgcatgtggtttcccttgaggtataataaggaggaccttgcccaccgaaaagggggggaccaagagaaaaaacctgagctcaaggagaaaggaagtaagggcactctctggggcttaaggacctttgtaacttgagcctaaatcccatacacagcagtagggtattacgctccttagcagcacgaacctgtataatcttgttgtgtgcacattagctggtagtctaggggacggatacgtgatttccagaggcgggccttttcccccggccgaactcacgaaagggggatcccacgatctcccgctagagaggatcattcctcgacagctggcgcgccaggtagggggatttcgcgcgcttcgaagagaagtcgtttccttccgctccaagccttcctccggccccaacgatcatggtggaggttttagaggaagaggtggaggtgcagacccttactccttccaggagtgaaggtgccagcgggagtcgcaacccgcgtcaccgccgacgcggctcgcggactccgcccctctccgaccccctgcggagggaggttcacgcctgatcgggtggctcggccctctccccgcctctggatggggggaggccatggcacgtccgagcgcgccgctgcctgacctaccgcgacggcagctcgccccagggcgcgctttaggcagggggagccctcctgcggcaccccccggtgaacgtggagccggaggcccccgtccaacgatggttggacgacgtcgccaacttggtcaccactgcccagcggcggttggccgtaagtggccgttccaccgccacaggtacatcacgtacctccaccaccctctcctcgtcagcaaggaggagggcccgtcggatagccacagcctcaaggcgatctacggccccaacgtcgtcaggggcctcggaaagtcggaggcgtcacgatagcctatacggggagcaggacgctcgagtcaacattgagcgtcgacgagacgagcgccgcgctacccgcatgggagaaggcgcctcctcgtctggagtgccgcgtttctcctcgcgcggcggcccgcccctcacgtccaccccagggggaactggttacaaggccttcgtggcgagtctccggaacgtccggtggcccccaaagttttgcctcaacctcacagagaaatataatggcagcatcaatccctccgagttcctccagatctataccacaatcattgtggcggcgggaggggatgaccgggtcatggcgaattatttccccatggctcttaagggtcaggcgcgtggatggcttatgacctagccccccgactccatccactcctgggaggacctgtgccagcagtttatcacaaacttccagggcacatacccccgtctgggggaggaggcggacctacacgctgtgcagcaaaagtacgacgagtccctccgctcatacatacagcgcttctgctaggtccgcaacattattccatgcatcccagcccacgcggtcgtttatgcattttggaacggcgtgcggcacaaccgcaagctggagaagatcgcctccaaggagcctaagaccaccgctgagctcttcgagctagcggacaaggtggctcagaaggaggaggcgtgggcttggaactcccccagcaccggtgcggcggcagcggccgcccccgagactgccccccgctccaagcggcgggacagaaggggcaagcggaagccagcccgctctgatgacgagggccacgtccttgcggctgatgggccctcgcgggccccgcgcagggaaagggccaccgacggcaagacgagctataccgccccttctggtaagggtcggtccgcggacaagtggtgctcggtgcacaatacttatcggcacagtcttgccgactgccgctcggtcaagaacttggccgagcggtttcgaaaagccgatgaggagaagcggcagagtcgacgggagggcaaagccctcacgaccccagccaatgatcagcgagaggagtctaagaagaaggcccccgccgacgatggcgatgacagcgagggtctggagttccaggtacctcagggaactgtcgccactctcgatgggggggcttgcgctcacacatcccgtcgtcggtcacatctgatctgtgaccggcctgtcaccggtcacatttgactggacggacagatgtgcccccacgtcacatctacctccggcagagtggaggtaggtatgacccgtcccatcggaagggtcattcgaggtcctccccatgagaggacggccaccacaattcttcatccattaatgggggattgacaggggtgtcccccgtgttaggcaagggacggcgctgaaccccactcaaggacaaaccgtggcttagcttccaggcgaaggcacgggtcaagatccggtcaaggaagggtgggctcccccccacccgagagaagaatagtagagtcggtgcatgtggtttccccttgaggtataaaaggaggaccttcccaccgaaaagggggggaccaagggaaaaaacctgagctcaatgagaaaggaagtaagggcaatctccagggcttagggacctttgtaacttgtgcctaaatcccatacacagcagtagggtattacgctcctttgcggcccgaacctgtataatcttgttgtgtgcacactacctggtagtctagtgggcggatacgtgattttcagaggcgggccttttcccccggtcgaactcacgaaagggggatcccacgatctcccgctagagaggatcactcctcgacagaagcggaatcgaagataagggctgtcgcgaaaacagagtaagaatcgggtagagtctggatcggctacggtcaggatcggcagagttcgagtcagacagggctagccgatacaaccgattccaagaatacgactcggtgtacatcagcgggtggagttgatatgcttcaagatgattgccacgcatggataaagtcctgaaaaggcaattgtatctattaattaggatattttatgcaaagtccttagagataaatgtgggcaaaagtctgtcgcaaagacttgtggtatcttagagtttgttagagataatagtcgtgtccggtatggacatatcttgtaatactcgggtataaatagacccctagctccatgtaattaatctaacacacacattcaatacaattttggcgcatcgccacccttttactttcattttgtttcaacgagttcttgctttcgggttgagctgcatcggtttcaatcttcaacaagaggtaaaacttgttatggctgcttgtgttctcgggattagtgcttccatctctatgatactctaatcttgtttatgtaattcatcaagttatcatatatcttgtatattcttcggtaatatagtcatctaacctacaatcagctaacatctgttagtagaaggcagccgattaggttaaatagcggtgttagcttggattgtacaagatacttaccactctatgaaacatccagtggcttgattgtctagatattgttcttcttttcatacttaatgctgcatcagttaagtttgatctatcaagtcgtgcttagaatatcaatctctagcctgcttcctggttgccgattagtatagcatcggagtttcagccgatcttacctgatttaactatagttatcctatatgcttgattgacatgttaaatctgccctttatgttaagatcttgttgcatttaagtatattatgcttctgtctgatatattctatttgctttaatatcttaatatagagtggtatcggagtattagccgatatatgctagatctatctaatcggctacgctattaacgtatatagttttgttgttgatttatatttcgatctaagtgatttatactgtctcggcatggcgaccgatctatcccaatcacttgatttaagtatatatcgacataagaattatatattgttaatgtctacagccaatcgagtaggtttagttcttccttaattattcatgactgctgatcgatgcacacatgacatcggtctaaaataaatgatgtcatcagtacccagccgatcggctatcatttatagatttaattacggtttctttgtcttcattttttgttgattgtaggatcaaatcgactggcacgctcatatatccgaaggcgagttttggacctgcactggagttaagcagatcttccaggcctcgtgttttctgtcaacaccatataaattgttgatgcgtgcatgatacatttaaatttttctgtagataattaaatatcacaaattgaagaagggatataatcataataacagtagtaggggtttgaccaattttattcatttagggaaatgcttcgcatagtttattaatcaggcggtggcgttgagctttgcgatttcgtcatggaatgcatcgacgtggtgagctgtaacacacgctgacatcaccctagccccttgctctgttgccttgagcatgacgcagatcggcatagcctttaccatcatcgacatggagagcaccaccctctgcgggtaggtcatcaccctcgccgtcttcccgctgccgaagtcaacatcttcgaatccgatgtttcgccatgatgtcaagtagagcaggctctcatatccatccagacgatggtcatcggcgagctcccgtagcatcgtcatgtcgctgccgccggtcatcttgagctgctccggtatccgctccttggcgcgccgtatgatgtctacaatgtcgttgatgtcggcgttcgccaccgcgccgctcttcgccacggccacgtgcatcgtgctgcagtttccgtagtacccgtccttggctccgagatactttcgcgcattcaccgcgaagagcagtacggcgggggcctccggatttttcatcaccgcccgggtacggcactgccaaagcacggcggcgacagcctcgaacacggtgacgtcgtcgttggttcgtcgtcctcggaatcggatgtggtcgatcaagctcgacgggacggtgatgttgttgaaggtgtggtcgatggatgccttgtggctggagctggacataaactgataaacggccatggcgaagggaggtatggcctgggtggcgttgttgtcgtcgtctaacctgaccgggacgacggacggcgatggcaggccacgggtgagctcgccgacggcttgtatgaactgtgccatgccgaagccgtcagccaggccatggttccatgtcaccccgactacgaagcctccacaggagagtgtggtgacctgcatccacagcagacggtgatgaaggtcgtcgggcgtgcagttgaaggcgagctgctgcaccaccgccgtctcggcgtcgggaggctggtcgtcgacgcaacacatgagctcctccatggtgcagttggcggacgccgccacgaacgtgactccgagctcctcgccggtgcagtcgatgtagaaatcgccgtcgtcgtcgcaggaaaggcggccggcgataggatagtaggggacgagcgcttgagcgagacctctcttgatggtctccgccgtgcactctgattggatggtgggatggtcgaacgcaagtagcactgtggttggcatcatggaactaggcttgtccataggcgacagaacgatcttgctgccggaggtagtcttcaccggcggctgcgatggccggacgaccaccggcgccgacttgctcaccacaatgctcatactttctctatgtctaggctctagctcgctctgagaataagttaggacaagcaattacagatcatgtatacaaccatacaatccttaaacaaaagcatcatagcactggttacctctatggaattgacgagacaaaagtgatcgaagcaatgtcaagactgatgagctatgagcccttttaaggtcttcatatccatcctaaccgttaacatacaattatttcttaatttaaaatatgtttgcatatctgtcaatcaataaatgaatggctttaatggaaaagagtaatacacgtaagagcaagtttaatagtagagctaaatactagctataagctcatctgaaaataatattagtcaacttgtaaaatggcttagctataaggttttctttatttttatcatagtcctttcttttcttctcacttatctagtataggtagaggtaactcttacataagagttagtacctattatctctctcctccacatatgcacgccacgagccaaagaagactgtcaccggttcaccgagagatggatatccatatataagtacatgtgacacagaatgagtttgacgatatacacatagggtagggggcatatcgattttgttagaagataatggatgacaaatttagaatgtcattctaagtgggtagctgagttaacataggtcaaataagatagtgttagaaataatcttgttattagtgcataatcatgtttgcttaatttggtcgcatgtagcaaataaatgtataggtagcaggataggataaggtacccgaagaagctatagtagtagtacgcgagatccgtatacgagtaggcccaagagccgtgcgagacggccgggtatgtgagatgctgcaggagcacacaaatagtggctggttagtagagtcattagcataatagccgggccattaggatcttagttaattactaggtgtgcatatggatgatctagtcgtgtggctaagagtagcatgcggctgctagtggcgcacgttttggcctctaactttgtctatttaagcatgtacttagcatctttgttaattgagtaaaaaagagaaaaacgctgcgtttgtgcagcaccaaactccactgttctttgcctctaaatgtgtgtgtgtttatcaggagtgtgtgcgagtctatctagctaggaagtgattcccaacagatagcaaatcaggttggaagagacggaagtgacttggaagtatagctgagggaaagtacgttagatgctattatatggtgaattgtaaacttttgatgcaataaaactaaaatcgagaactttccttactatagattcaattttacatttaagtagaagcaccaagtttcttataacttcctctctacaaagtttctttagtaatcaaataatgcatgactagagactgtcccatcaaatattaattggtagtatgggctaggagagtgaccgtgcctgcaaggaataaacatcattcgttatatattggtttatgcttgagctctctaataagaaaacatgcacgttcttcacgcagacttgctatagctaactttcaaatagtttaattcttatctactagcgctccaatattaaatatggttttattataggtatacatattaacaccataacggtattacgtccaaattaattaataccctctctactgttgatgttaatcatcacgtacgtcgccacactatgagcatattatgtgcaacctgcaatggcaatcagagacgagtcgtcacaaggaaggtggatgccaccaaaggaacaaaagcatcatagcaatattaacccgccgtggctgtccgcagagagaacgtgaagcaacgtaaagacgaatgagccatgagcccttttatggtgctattttataactctaagggcttcaaaccgatcccaagagtaggtacaatagcaggctcttagccagctgtaaatatgttttaatgagataaacgatgagagagaagagtagcgggctacagatctatagccagctgcagcacagactccaagacacactgtgtgtacgataggtgagatcatatattaatagtatagtaagcaactattgtataaattgactattagattagctatagatgaattggagctattagtgggctatactattatactagctctaagggcatccacaatgtagcatttcagcaggtaataagcattaaatgccctcttcttacccggtagcaaccattgtgagactagtaagtagatgcagcccggtaacacgactacaaccgggtaacaggaattaaactatgcccagttttcctaacaaaagttatagaaagaagtcacggctagagactgccatccatgattttttctgaagctggccctaccttgtttcccactgatatgctgatacattgtagagtgcatgattgcttactgctgcctgtagccctggcccacactactgacacactactaccaagttgggcaagtaacattgctgttgccctaacggttgatatgtaattgttttttgtaacttaaaatatatttgtgtgtgttaattaatgaatggataacttgaatggaaaggagtaagaggctgacaacgaggtcggtgagaggatttcttgagcacttcgagtgtgacagcgaggtcggcgaaaaatcacgtcaggcccaatgccgtagtcaatgtgtgtatccatcgccgccagctcgatcagagagaggaatggtggtggaagaagatgactaaataagagtaacttgcatgtaggtcccacatcaatcttttaatttcgttgatgacctagttgccatgtggatgccatctacaaataccaccatcaatattgtcttgtgagttaaattacatgggttataacagttttttttttggggcgggggtgttccagatatccggtattgcagttgagggatacgaatcagataggacctatatttaaaggagtcaaattggcaggattatatataaggcatatctcctatatgtgggtttttgttgtatgttaataccaaacctaatattatacgggaagatgcccttggaaacagtaataaaattgatgattctggacggaaactgtcttcgctgggtggaaggctctaaagtcctattcaaaaaacacaaggttcccatggttaattttctatttagggtctccgagttctacttgtagaaaaattaaaagtcaatcatcggttctaattggaggaaaatcaattatcgatacaaatataaagcccttatgaggatagagatcattgaattacgagccataaccaccaaccacatcagtagacaatccagaggaaaccgaagccctatttgctgataagctctcgctaagtcatactcggcgagttctaatcgacggattgccttagctagtctattctcctcatttgtaatcattgtagtcttttcctagatatacgtataaactgtgttagagctattactctttttagagggtctgaaccagtataaacccttgtccttgtctagatacaatctcacatatatcctagtatcaacgtcctccgtactttataaataccgtaggtagataaagcccataaaaaagtggtcttatttcttttgtttggcatagctttgatcggtttgcccattaattttgcctggttgagtaggctattatatggtactccctactccctcggtttaatataactgtcaccattgatccatactattgtaaccgtaattttaaaatggttagagtcttcgcaaaaaaatgattagagcataatgataaaaaaattaatacttaagcatgtagtaatattcttggataatatgatatctacatatttatggatttagaatttctttcagaaaagacaaacgaacacaatttaaatatgaatagtgctcggtttaataaatataaacaaatggatagagtggctttcctatgaatttttttgttctggaaacacgttacgagcgttcatatacacacgcacgtactctcctttataaacgcacaaatacacatcctagtcctatagaaaccaccaacagactatgccacataggcatatctcaagagtggtcttgggaccaactaaaaaatacatagctaaaggttgatgtattcatgggttttctctactggtaatgggatacagggtctatgagggtcaagatctgaagagggaggtagacaatgaagagagctagaacatggtcgctcgctagagagaagcgcttgcttgagtttaaaccatatgaagatgtaaacttttttgtgctatattcaatgaatgggcaccgcctcgtgccgatttgttaaaagaataatagattacttgactggatcggatctctacacaatgtatcgatggaagtacaataatagaaaccatgtgccttcgtattattcagttatatgctttcttcacgattaatatttcttcatctttgtttgtactgctatggcatgtattaaaaaactagaaaagtgcccgtgcgttgcaacgggatgaaaatataataaattgaggaaatattgagaaatatttacattatgtaattaattaaaattcaaattcaccatcttctttatacgaagaaactatatgtgtgtgtgtctctgtaattgcattttcatccctgctaaataagaaaatcgcaattacagatatatatgatgttgaagaaaataattaaaaatgaattctaaactgacctggctatatgttaggtctagcgatgtgtttggtctaacatcactgtactatctagttttggagtggcttgataaagcagtcgtgcttggaacgttgggactgccatggaaggaaacacagaaacacagaaaacgtaggtctagcatcactgtactagcttgttttgtcgtgagactgccatggaaggacacacatgaacacacggtcaacagatagacgctgaatcaaaaacgcccggacgaacgattggagttgcatgtaatgttgcgtcttagttgcacatctcctttgaaaagagatgacatcattgagttcacagatctcaagaacgtattttcatcaagtcattttcattaaattgatctcattgacctctattttgaagagcagcgacaacagaaattttgaatgatgcatgattcttgtggggtataggatatatgtatgtatcgtcctaatccaaattgagaacgggatggactgtccaccttgatttttgtttaagagatttataaatcattttataaattatttgtagaatttatcctaaagttcaattaattttccggtgatgtaaatgtgggaaataaaatttcccaaataaaatatagctggatttaatttttattaaattctccataattaattacactatctgaaattctttcagaattttcagagttcaattgttaattttaataatacaaatatcatttcagcatttatttaaataaaaatctaaataaaaacccttctttttctctgggccacttttagcccatttcttctgtcaaactgcagttgagccggcacgctttcttcccttctcctcccctccgcctctggcccttaagcgcaccaagcctatcaagcaaccacaagtctaatagtcctcgcttcgctcctctcactgtcgcgtgggtcctagtgctacaggtttgtctcctacctccagctagactcccgcagcttcaagacgatgtctaaaatcgtctccaccatgaaatctggtggcatccttggagataatccaaaactgagattgaggggtttcgatttttatctcatactctttccattttctgaagaatcaaagcaaaacctcatcgtatcgtgcttggaatcgaggcctatcctaaataagcgaactctagaatttctcatctcagagtccgtttcactagaatttcccatcacgtatacgtatgataacgacgatggacgaaagtagtcgcgaaatccttatgtatttttttgagtaaagtgtacgggtggtctttaaacatgtaggggtatgtcatctaggtccctaaactctcaaaatgaatattcaagtcctagaacttatcatagtgtgtcatctaggtcccaaatcgccacaaccccttcaggatcctacgtggcgttgatgtggcatgccacacggacatgatatggctggcattattttgactgacaaatgggtcccatttaatttttttttcctttttcttttttcttctttttttccctttcttctccttt

SEQ ID NO: 73824 - DNA, 3374 bp, Oryza sativa
tttggacttcttgtaataggctttcctaagtgttcggtcatagtccgttagctttaaggcctccttgtttgtggtggacattcccttgaagaaattcttcacgctcgggtcaataggtatcttcttttcaggactccgaggcttgagttgcctcttcacttctcctgccacataagcgtcaagctcctcttgactgcaactgtacggcggctccttgtttttggtggtgtcaactttgtccttcttcgttgcccttgtgctggcaggaggtggagcttggcgagaccgtgtcttgggaggtgcaggcggacacggtggaggtggaggcggaggaggcggaggagccggaggagatggtgcaggaggaggcggaggaggcggaggagccggaggagatggtgcaggaggtggtggcggaggagctggaggagatggtgcaggaggagacggtggagccggaggagatggtgcacgagacgccgcttgtcgcccagggaggatgatgtaccgtttgcgccatagtataatggcgtggcttgtgtctcgtagatgcgtctcaccgtctcctcctgggtagtccaactcgaggtcctcgtacacggcttccaccagctcaacttcgaccctcgagtatcctgctggaatcggcctgcagtggtaagtccctgaaatgtctgttgggatggccattcccgacgccaccttcacgtgatgagaggttatctattagtaatcaaactaaccagcaacttgcagaacgtacgagtcaaaaatcatatattacatcgagcataccttgattgataagttcttgaagggaatatgcagctcacatggtgtccgttgcgtgatctcatcaacggggcaggtggtgtcgtcatgggtttgcatggcgtccatgctatgtgatactacctgccccgttgaggcgcagctactacgattgcctgatgggctgaccattggaggaggtatgtacggctggggatcgtgtgaccgatgtgctgccatgcgttcatccactttccgggccacctcctcttgcatgctgagttcgtagctcgataccctgtactcaagatctgcaatcttcgcctcagtatctctcttgctcctcatccgactcctgtacgtgtggatgtcctccttgattcccatcttctagggaatcacgcctttccctcgtgttcgtcctagatgctcgagagtctgtagggcgagtgacagctcgtccttctctctgtcgggtcggaacgtgccctgagaagaggcttccactgcgtccgttagtcgattcgtagcctcgcgtatctgatcgctgaagaccaaggagccattaactgggttgagcgttccaccatgagaatagtaccagaacttcgatcgatcaggccatttagcggtggacggttcgatacccctctcaagcaagcttgcctccatctcctcccacttcggcatcgcgacgctatagccgcctgaccccaagtggtgatggtacttcttcttagcggcattttctttgtttctttccatcatcgcctgcccttgttgacctgtcttgtaagcaacgaactcgtcccagtgatcccttagcttcgggaatacatcgaagttcggtgtctgcccccttcaagatgtatttccggtacaaatctcccttgaaggtctagaactgttctgccattttcttaagagtccactgtttcactatgttctctgtacccgcagggagcgtgaacgtctcgagcattgtggtccacagcatctctttctctgattccgggacaaagctgtcatcatccccgcgtgcccttgttctgcgccagtacaccttgctaacaggcacgttatccctcacaacccaaccgctgtggcgtacaaaattcttggctacttgtgccggggcactaggtcggccgtctgcatccacctcagttatgatgtgccgaccctctatcttcttcgcagcacctcgttgtccgcgtgccctcttctgtccagcgtagggatgacttccactagcctcctcctcgttcccctccgcatccctctccacgttcccctcctcgttcccctctgcatccctctccgcgttcccctcctcgttcaagtactggtttggatcctcgttcccctcttcttcgttccagtactggctacttcccgatgcgattgtatcgtacagtatctgttcctcatcgcgatcagccatctgttcatagaagaaatatttgctaagcataatattaacactctactaatcttgtattaaaactcaaataatcatatatgctaagtctaagtgtcatgtatttgtatggtagataatcttatatgctaagtctaattaagtttcgaatattacatctctaataatcttatattaaatctctaacaatcaaatatgttttgaatattacatctctaataatcttatattaaatctctaacactcacatatgctaagtctaattaagtttcgtatattaaacctctaataatcttatattaaatctctaactatctctaacactcaaatatgctaagtctaagtgtcgtgtatttgtacgatagataatcatatatgctaagtctaactaagtttcgaatattacatctctaataatcttatattaaatctctaacactcacatatgctaagtctaattaagttttgtatattaaacctctaataatcttgtattaaatctctaactatctctaacactcaaatatgctagtctaataatctaataatatctaacactcacatatgctaactctaataatctaataatcttatattagaaatctaacaatcttatattatatctctaacaatcacatctttacatcacttgcctgcgcgaattccttcgagggctagctaccacttcggcttgagggacgacgacgacgacgtcttctctgcaacatgcaaaaaaaatgtattagtctaaacgcaaaggaacatataatgtatttcacgttttcaagtatatataatcatatatatatgctaagttcaacaatagtttaattatctcgttcgtacatgtttcgctcgcattcgttctaacacttttagttcaagtgcattcacgttcgttaacgtttcaatcacgtttgttcgcgtttcattcacgttcgtttacgttcgttcacgttcgttcactaacactcacgttcgttcacgtttcagtcacgttcgttcgcgttcgttcacgttcgttcatgtttcattcgcgttcacggcggtgggggcgcggtccggcgccgtgggccggcccggcagtgtgggggcgcggcggcggtgtggcggcagcggcgttgtctcgcgggggcggcgtctcccagcagtgggggcgcgg

SEQ ID NO: 73825 - DNA, 15702 bp, Oryza sativa
gtggaagagagaaaaaatcaaatggcgcatggataccaaggatcgaaccagcgatcgacgtgcaaaacgctagagcatgtgttcactaccaagatttgtaaatttttctattttacaataataattacatctttcttgtactgcagttatatacgagttacgaatgtaattacactgctattatactataattacatttgccagaaattttagggggattttctatcgaatgttagatagacagtctctattttttaatctaaatgacaacgatatgccgttagaaatatatgcaatgcctttttatcattagaaatatacacaatgcctttctgccaaatgtcccaccacccctctcctcacctcgtctcatatcccctttactccttatttttaagtagttgagatattatttttaatttatcataataaatctcaaaaaagcaacttttaggtacccaaacaattattattcgctcacaccgttatatttcttacaattaaatgccgtaggctctctggaccttccattatatttgagagatgaagtgaataattaaagtcatcaaacaaatataatgaaatatctgacgccttgagagaagaatattggagacattgctaggcctttagcctgtcagtcaactttgattaaatttatggtgtgagaaaaatctacttcgtaagtattcttgaaaacgaaatattttgtgttggttcatgttctaaaattttaccggtcgctcaaataatcataaatatgtaaaataaaaataggaaagaaattagtcctgctactatgaaatcatgctatgttaaaataattttactatatgatttaactaagtatatttatatttatgaagtaatatattttgtctttatttcgtaaaaagtcatactatgaatgcacacacacacatacctacgactatttccgaaagactgggccggcatattttgagattaaagaaatcaccacggatgcctcactattgatgggtacgtcacctacaactgaatgcacacacacatacctacgactatttccgaaagactgggcctgcatattttgagattaaagaaatcaccacggatgcctcactattgatgggtacgtcacctacaactgaaagaacaattaatcgtaaatgcaagcacccatatcaagtataggacttgaacccaggtggcaagttccagaacaagaaacctaaccagttgagctacgcttgctttgcaataatgttggatactaaaacaactataattttttagatctatcttattaaaaaaacaagtgtgtattcatggtacatcacatttcaaaaatgttactgcgcaattatatttcatcgttatcgtattcatgttaagctgcgtggaggttctgacccactctacatgaaatgttcatagatggatcacctctcaaactacatcaattataagagtctatataaacctatacatttagtggagtttcatgtctaacacaattcatcctctaataaaccatgataatatatgcaactaagaaaagaaaaacaccttaattttactttacacttacttttactttcgttaacatgttttcttaagaaaagaagtctaccttcttttcaattgcttatagatgttacttaattatgatataatataaagctaataggttagaaaattataaaagcaattaatgccgacgtaaacaatttatggagaaatcgtggcagatgttatccgtttaatatttcactcttataagtgtcttgaactaagcgtaagacacatgtccgcgtgaaagcgtgggctaccttcctagtttcttttaaaggcagatcgagttggtgcaggtatgacgtattgtacgcggtagcttgcagaggtaaatttggactagaaaacttagttaaccgagatcgatcgatcgagctgagtcgctagctagctagggaactcatctatatattacactaccaactaaatatcaccatatataatactccctccgtattttaatgtatgacgccgttgactattcgaccaacgtttgaccatttgttttattcaaaatttttatgcaaatatgaaaatatttatgttatgcttaaagaacatttgatgacgaatcaagttataataaaataaatgataattacataaattttttgaataagacgaatggtcaaacattgaacaaaaagtcaacagcgtcatagattaaaatatggaggtttctttctgtggagattatgggtgccccatacccacacggcgtggttatccgactggttatagcggataacttatatctatggaatatgtaacggatcatgacttgggtattacgtttcctttatattatggaatagcctaaagttctggtttgattatgttgtaaagtagatttaggaaaccgataccgtattggttaaggtttctatcttgtaatcctgccccccatcctatataaggtgggcaggaggccctctagggggcatgagcacatatgatcgtcatatctataatacactcggcggattcaaatcttcaaacatgagtagcgtattacatctcattgagagggcctgaacctgtctaaatccttgtctccgcatccatccacttttaggtctcgtgccctaccccttttattattgccgaattcatgtttcgacagttggcgcgccaggtaggggtgcgccgagttatctatcaagaagtgagatggaaccaattagaagtccccgaatcagattcaatctagcaaggaaaatcaacctcagcaagttagatcgctccaatctccgacgtcaccaatggtggtgaatccttaagattcaactcgccaagatgccggctggagctgctatacagtccgtagccaaaagaatcgtttgtatccaagagatcatcggccacgtctccaactaccagcctgcacaaccctgctcgatcgtgctgctctgcatggaggtcggccacgggaggcaccactgctatctggacaggtgccgatccagttgtcgtcgtcgtcgccgttttctgttatgctcggtgagattgattccgctgagaacagattggacgcttcgagttagacgcggactcggcgcctcgccggaggcgtgtagcagcgcgtcatccaccgcagccatctatcagccgtgtgaagacagctactcgccgggataacaatcacccgtcagcacatgcacttggacatgcaaggatcggctttgcatctacacgcataaacacatgcatgcatggataaaaactgctttccggcatcggcagatttatcgttccaatctattattatgattatgatattatttttaatcatagattgatctgccttttgattcttctttttctctcgcgtgcatatactggcgtttgatggatccatgattacctccgatgacggcatcatgctgaaggactgtcggttacaggggcagatacacgcacagtggcatgcaatactttcagacgcatggacatgcaaattagcatgcgtatatgctgcatgcatacatcaatatatatagcatataatatctatacgttattgctaattgctattcctaatcagtctgattaatatattgggtattttttgcatgtgagatcatcgttggcctatccatccggctgacgtcgccctgatctggctggagcgagctgctcacacgcataatttgcactctgccgtatgcacatatatacacgcgtgcgagcagattgggagcaaacatgtgtgaggaaatatcctagcgttttccaaccatcactgggcctcttcatcttcaccgactagccgcctcgtcagccgccgactagtgtttccgcctgcacagctggcctattatgccgccgtttgttgggcttatatgtctccactgccggcttgccttcgccaccgccaactgatgtctctgcctgcacggctggcctattatgccgccgttgttgggggtctacatcttcaccgccggctcgcctccgtcgccgccgactagtgtttccgcctacacggtcacaccatagttgttgggcgtctacgtcttcacagccggcttgccttcgccgccgctgactggtgcctccgcctacatggctagtctattatgccgccgttgatgggcgtctacgttgtcaccgaccggccgtctcgtccgctgccgactggtgtttccgcctacacggctgacctattataccgctgttgttgggcgtccacatcttcaccaaccggcttgccttcgctgccgccgattggtgtctctgcctacacggctggcctattatgtcaccgttattgggcgtctacgacttcatcgctggcttgcctctgtcgccaccgactgatgtttccgcctatacggatggtggactccgtcaccgttgatgggcctagtcatctacaccaccggcttgcttccgccgccgccgactggtgttttcattgccattgatggacgactttgttcccacatcagccacctctgccatcatcaagaggaatattacaaagctaagtcattattttttcttatatgatattttccttttcctctgcctcactacatcaactggttaaccgttgactagtgagtcgggagctacagatattatatcatatttttcaacaattttcataatatttatcttgattgcttgcgaaataatacgagtaacaataaagtgcctatcgagttatggagttgtatcttcctatgctttccgtttggtttgtcaatggatagtttgcctttgggctgattcctagcacccgggggctcgttggatggaccaagtaacgcaaggtgctaagtattactcggaagaaatcaaaagcatagagataagataatttattttctactcttaataattgcaaaagtacctgagtagtaaacgccaatccgtgaaactttgtcccattaatggcgaactcatgtcacttatatgcatctttgggaagtgcctaggttgactcccgatgcttggggtctatgactagtcgggcagagtgtttaaacgtacggagtcatctgctcagggaaatcaaaattgacaagaggagaaatacatatttataaatattttaaaatacttgaatttttctcgagtattatatttacaccagatactacttatcctatatgtttgttctgtaggatccagatccagatatgcataaaagggattcatggctttaagcttatctcttacgctccaggaatggatcagtcagaacatcaccaacggcttgccttcgccgcggccgactagtgtcaccgcctgcatggctggcctattgtgccgccgttgttgggcgtttacgtcttcaccgccggcttgccttcgccgcacgcgactggtgtcactgcctgcacggctggcctattctgccgccgttgtcgggcgtctacgtcttcaccgaccggcttgccttcgccgccgccgactggtgtcttcgcctacacggctggcctattatgccgccgttgttgggcgtctacgtcttcaccgccggcttgccttcgccgcacgcgactggtgtcactgcctgcacggctggcctattctgccgccgttgtcgggcgtctacatcttcaccgaccggcttgcctttgccgccgccgactggtgtctttgcctacacggctggcctattatgccgccgttgttgggcatctacgtcttcaccgccgccgactggtgtcgccgactgcacggctagcctattatgccgccgttgttgggcgtctacgtcttcaccgaccggcttgccttcgccgccgccgactggtgtcttcgcctacacggctggcctattatgccgccgttgttgggcgtctacgtcttcaccgccggcttgccttcgccgccgccgaatggtgtcttcgcctacacggctggcctattatgccgccgttgttgggtgtctatgtcttcaccgactggccgcctcgtatgacgccaactggagttatcgtcttcacggttggccacctcgtcgtcatcattctacttcttccatcgccgactggttatgccgccgcaggttggtgtttttatcttcacaactacgcgtcttcgctaccgatttgcttctgttgctgcagactcatcttcacttcatcacggctatgcaactttatcaccattatggggtgacttcatcttcattatcttcggcacaggcaaattctattgcctctactttgcaagatttgctacttcaccaaccaagacgtctacaagagctccgacatctcggcatgcatcaccaaatatgatgccatgttattttactacaacaagtggtgttccaatattcaatatttctactcggacatcttcaacacgtatcttcactcaagcaatgactactcgacgacaagaagctacagttctcgactgtatatttagttgttttccaactaaccaaagagtcgggggctacacaaatacaagacgaatacaagactcaaaattcgacaagttttttttgtcaagctgaagcaatcaattaatcagcctacgagtcaactccagaagtcattatcttcatctttgcttcggagcagacattctacttcagcaactcttattatttcactggcaattttggcttctggatgacgacagatctgccagggtagtgtgtgtttttcacgtcaatacttagcctacttgggtagattacaacttgataggtagattccaaggatgaagcaggaggcaaggagtgttcaaactttcaagatgaagaaggcggaccaaaacggaaaagtcactcttcctaaaagctcgaggaagtacaccattcgagtgggggaagatgccaagaaaagattccgtggggaccaccttcaaccactcttgctagctggcgcccaaaagagtataatgacctccaaaatataccaaaatgcccctatgtttgcaaatgtggcaaaggcattatagtaaactcacaaaggcccgtaggggcatagatgtaatctcacatgtatgaccgtggattacaaaagctggtcaaaatcccgtagcagataagacatttttaatacaaaagtaatcagcaaaaagttgtgtgtactgttcgagctcatttctaagtataggcgggagagttcacttttcccgcctatccccaaacttgtccgtaacccaaggtcacgacaaaattctttcctagtgaccatcttattaggtcattacttgactttggtttttggttcatcctttattttactcgatcggatgtcaggtaagattcttaaggtgctatcaaacatatttctcgcatggtacatgacatcggtagcctaacgaatcttgaagtctttttcagtaagtacttattgagtagttcttgaacggcacatttggcacgttcgtatttttcttcctctttctttccttcttctttcaaaaagaaaactttgcatttgcaagaccaattatatgagtcttggcttatcgactaatgttaattgtttaacttttagctaggctgtgttcatttgtgtgtgttggaaacaaatctccgatgcacgacgaaaaatagagtggtccattagcgcgtgattattcaagtatttgctatttttttggatcaatataatttttaagcaacttttgaatagaaactttttgtaaaaaaaccatcatttagcagtttgaaaagcgtacgcgtggaacacgagagagagagagagttgaaaacacaggctgcctaacataaccttaatgttatattctagagtaaattgcgtctacggtacataaacatgataggtgggtgtgatctagtgcaaaaacttgaaaaatgagcatataggtgcaacaacttgactagcgcgttcattactttttattccatataaaaaaagccaccactcagactatctcgaaaaggatctacatgtattacatattgctttcaattagttagttataataataaaataatatgtcaatttaaaaccgaaagatatatggttatcaaaaataagtgcatgactaatcaacatatttattatctcaggttatgaacatggtgaaacacggaaatgaatcatgagccaacgatctagcaaagcgtataattccaggattaatcaacgtatgcattagtgttttggcataaaatatacatgattgtaaagtttactagagcgggagcgcgctttgcgcgctgcaccagcttatctggatcaaaatgcgtttgttcttttttgggaaattatctgtgtttttccttttttggaaaattggttgtgttttttttcctgttttaggtggtgaaaaagaatgaattagtttgaagcattgaattgtgagcatttgtgaaaagggtatcaagatggatagcttattactgtaacggcaggcattttactcgaactacttagatagtataaaggcatgtcattcagctagactgcatgcatatacatactatattctacagcattggtagtagatgcagtagcatcttagatcatacaatgctaaggaaggtagataaggcaacacttatatacaatgataatcatgacaaaaagccatgaacaaaagatcttggttccttagtcctgggtaatttcacaactgccatctgtcttctagctgggacatagctttgtacatatatataagaaaaagtcttgagatggattgcacgtcgacaactcattcactgtgtagatgaattaagagctgagattaggaatgcctttaaattgctaatttgttatgtgtagataggtgagtttgtgtttgaggagtaacctgtcattgcctttttgctgggcatcatccttgaacaatttcttagcaaccggaggtgttgctgtaggtgtaggccttcctctgtttattgaaatgatgtgttagttacaatggaagaaatctttattattggaatgcacctaggagtgatcaaagcacctttttttggctagggtatctgtagggaaggatggggttgcttgtttggcttcttcagcagtttctggtagtccctttcccttgtaaaagaagtggcggttaggtcttaatgaatgagatgaaaggaaagagatgtagtagtaccttattttcagcagtatcaggcagtacaacaattgaagatttatcatgtgaggtgttttctttagcttttgtgtcagttttgggcttgcaaaattaggaaagaagtgagagtggatgtaattcagtatgagtgacaacaagtttaagggtggctataaagtggttaccttatcatcagttttaggtttggtcttgctagactgcatgtgagacactgagacaacaatgcttttcttggtaggtgctgaagaacttgatttgctagttggggtgtcctgtgttccctgagcgatgatgaacttggttggtgttgagatggtttgtcttggttaaatgggctgctgtgattcattgcttgtttcatttggtgttggtgctgtttggacagagctgcttgagcttgctgagacaatagctgatgtcacttgtgaagcatctggggacataaggagtagtggctggtttgaagcaccagcggatataatgctattaacttgtaggcactcttgacttctcataacagtatcccgcgtaaagctaacattccatgcaaaattgctaccaataagtgacgtgatttcacttggaatgtattcactgtttggtggtttttcttcaatgagagattctacgggcctgcgtagtagccgttgtgcgatccttccgaaaaggataaatgtagcattagcatcatcatcgctggcaattaatactactttgtacctgcatgaaaaatggatatggctatagcaatgtgtggatgataattgctaaagatgtaagaggacagagcgtgttctgttatgaaccttggatctgttattccgatgctagaacagctggagtatctgtagctagagccatatggttttgaagttttgtagcatattcgacatgaattgtaccaccaagaatattcattacatatccttctgacagtcacatttactataaaacgtgttccctgcataagaagacaatgaaaatatcatattggtaattatatcatcaaaaagtggatagatgtagttaagatgtgttctagagatagtgtcaaccttgtgtttgtgagggttgatattaaggatttctgcaatactcttttcttctggtacatcctggttgtatcctgtagcaggctcatcaacccacttgattggttgaaagtttgtgctaaagctacatagaagaattgtatcttagattaatggatactgtgaaaaccttgaagaatacagtgatgcacatagattgtaagaataacgttaaataaattaaattacctctcatttagttctgctacttcaggaatatttagatggtaagcttccagttagtgtaaggcctatatatgtggaggaaattattagatattattagttgcatgtagtcaatactacagtaattgaaagtttagaaagaaatgtacctaatcctctataatctttcacaagtgttccaacaaacacagcaacttgagcttgagtttgaccagcattgtatatgtcatcagcatcaaaagaggttgctctttctccccagagtgtgacaggaagagttgaattgctagttttgtagatttggaggggaaaaagtgatttaattttaattggaagagatgacttagtgttaagaatatgtgagatagtttgtgtgaatgctagcgaaaaagattaagtaaataataaatatgtaaatatttagttgtactaaactagccttgcatcgcggatctgtaatgtcctttttaagctcttagcgtttctggacttaggacgtatagtagtgactgcaccaacttcagtgatcacacccataatgtctgtttgcattgcatataaatttaataaaatgatatggcattgcaaaagatgtatataacaataattgcaacacaataaaagtatgttattaccaacgtagaatgattttttctcgacaagggaaggaacatcttcgaatggtgtcagtgaaaatgtaataccagggaaatgaggagggacattaatgtgttcttcaagtgttgtccatttactgaagaggatcattaggttgtttgcaactagcctgtatgttctgtttgcagccctaacagtgaatgagtcaatgtagtaaaccttttcttccttaaggagaggtttcatcttttctgttataggggggtaaatttgggcatgtatgctagtcccctgcagattataaatacaaatcatgttatcaagagaattatcggtatagaaaggaaaatatagaaaatggatttggcacgtaaattattaccatttcatcgagtaagacaagatcagtgtggaaaatttttgtatcatcgttgagatcagtaaagttccatagcctggagacccttgcaaggattcttttgtttgaatctccaaacgatagctgtgaaatcagtacatgcgccatatggaatctgcaataagcacaaaatacttttagtatagacaaaacaacactactatatatgtacaaggaaatgttactaagaagaacagtacatataactgcagcggacaaatcatatactatgtatatagtatatggtacatgtgaaggaggtatatttattccaaaatatatgtacaaaattgcttcttttttagggtaaaagaggttaagcatggagcggcaaagcctgcaacagaaaggtatttcaattattattgataatttaagagaacacataaacatgatatatggaacagtgtgttgaaaagcaccgctggcaatgtagcgctaagcacttcggtgtaaacaatatttcttgtttgtgtaccacatgatccatcgtcattctcaattaatatttttaaacctgatcggcttgttgctcttgaaatagcaacgtataattgcccatgtgtgaaaacaggttttctaagatatacacctactcgttgaagtgtttgaccttggtttttattgatagtcattgaataacaaacacgaacagggaattgtcttctttgtaatgtaaaaggccatttcattttggtagtactcagtgttatccgaggtatgtaaacagtttcaccgatgtttgatccagttaatatgatacattgaagaattctttcacccaaacctgtaactaataatcttgttccattacatagcccaattgattgattcagatttcgaagtagcatgaccacagcagcttctttaagaataagtctatatgtagggaagttagtggcgtctattgagttaagaaactcaggtggatatagcaagtcaaaatctggtatttgttcagagcattttgatattgtatcacaacttgagtatatttttgcatctccaggaagcaaaccaataatatagtcatttatttcatcaactgttgtattattagggcaaacaattgcacgtgaagctaggtattcaggatttttgtatgatgcaaggaaatcagggtatacttcgctgacaatggcatttattttatcaccatcagttataatgagtaaatcatcaggaattgtgatccatgtaggatagctttcaccttcctttgctatcattggtaaagtgccatcaccaacagccaaaacccactggctaaaatcatccatgtcctttttttcatttttaggtagcattgtattaagtaatctcatttttatattcatagttaatattgtcacatgtttccataagtctgagtttgtgaccgatgcattgattatagcacgacgggagcctttaggaacaactggcaatatttgtctgaagtcaccacctaggacaacaggttttcctccaaaaggtataatagaattcaaagggcatgtctcagaaagtatatcacataatgtgcggtctagtgcttcaaagcatcgcctatgtgtcattggagcttcatcccatatgattaatgcagtctcaattaaaagctcagcaagcatagttcctcgttttacattgcaaatacctatttcatcaatgtcaattggtattttaaatcgagaatgagctgttctgcctctaggtaatagcagtgacgctacgcccgatgaagcgacggcaagaacaattttattatgtgatctaagttttgcaataatagcattccacaggaatatttttccagttccaccatggccacacacaaagaaaaaaccaggttgattcgcagcaatacgagaagttatgatgtcgaaaatgttttttttgatcattgttcaattggtgtatcaaagaatttgcatgcatgcttaacataagtggatcaagtgcaagttcttcaatcaatctattattaccaggaatatgcggtacagacgatggatgtggcaggttaaaatcctttatattaccaccactattcgcaaacacattagcaagttcgtggagaagaagattaagcaaatggtcaggtggaatgatacaattcgggttatccaatgctttttttagtttgctatgtatatcatctatcatatataaccaatacttgttaaacaatgatcgcacatcactaacagagcagtaaagaagtatagtcacaaaaagttgtctaaggtgctgtgaagatgcagagactattgcttcatcgaaaagtagataccattcattgtccccctcaaggagccctcgtgcctcacatgcttctctaaatgtggcatagacaatattattaaatgtacgcacatcaacataactttgagcacctttaacaatcattaacaacatgcgtaggtagtaaagttcactagcagttggatgcacataatatattctaccaatttttgcagcaggtgttcgctggcaccatactctagatgacgactcccatgaccactctttcggaaattcacagtatgttaatgaacgggctttagaatattttttgttagcttcaaaccattcagttaacattgaacgcttcgtagcaggactttcaagcactgctcgtaagtccgatcctttctcatatctaacatagtttttcccaggtaagtggacaaccaatcgttcaacaggaggtactctatagtgtatatcaaattcaaacaatcgatgaagtgcctcacaggtcgaaacaaatcttgcatccatgtattctaatatttcatcacgtggagcaaggtcatgattcggtgatgcatttgttgtcttagctattgtttcgaagtagattttagctcggtcttggcctttcatgatatatttaaataaatatttatcaaatttgatttgttacaccactcaacatttatgtgtgcctcgtattttttaagtaatttcatgttataggggacaacagatctattatccaagggaattccattttttataatacatcgtccatcatttcttcgtctataaattgtaaaaccagcttcatcaataatggtttcatcttgaaaatctttagggtagtttttttttagcatttatcgttttttatgcaaggacaacttttgtttgcatcaccacagggaccatgcatcatgaactcgctaaccaattcatatcctagtcgatcagtgtcataatcgggtatttcagcacatatgaagccatctatgatagatgctgacacgtcagcagtgggagctgcgagccaaaccaagcaatgtatgtgcggaagcccacgtttctggaactcaacagtgtagaggactgtaataacttaagagagaatactatgagtgtgctatccttaattcaatatattctatggaccaagagggtataagaatacctgcaagaactttaccaaaagttctgccctctctaatatcagctatgaattcattaaccttcatattaaatacacgaacaatgatatcggctctatcagatggttgttgactaggctcaaatcgaatcgcttcagcaatttcttgccattttgaattacatgtatatgtcacaaagaggtcaagtgatccataaacacggcatattgtcattgcatcttgatagttcatcaccatataccttctccctccagtgaaactggcaggaagtatgacacgctttccaattgaatcaccatcagtgacacctttatcaatcgcatctacgatcccatctacagactcaccacgtaactctttttgatggttgtcacgtcccaaaacgaccctaaaatatatcctctaaattatgcctagaataattaaaatccgtgtgaaagcctccaacaattaaaatgtgcaaagttaaaagtcaaataatgcttagaggatttttgtatatttcctaaaagcctaaaatacgtaaataaattttagtggaattttcagagcacaaataataattgttaagaaataaacaaagttaaaaaagttttataaaaagaaaaaccctaaaaagtcccccttccctcccttgggccggcccggtccatctctccccccctctccctctctcctctccccgcggcccatccggcctctccccgcgcgcgcgccgctgacgggcgggcccgcccgccaccctcgctgacgggtggggcccacccgtcatccccttaatcccgccgctcccgccgcctcccccgcgccctagcgccgccgccgccgcgaatcccgccgcctcccgccgtcc

SEQ ID NO: 73826 - DNA, 54958 bp, Oryza sativa
cataccactacttcgccttctcgctaccgcatcgttgcgccaacgcttggtctccgcgaggaccgcgactccgcacgccgtcttgcactctcgctcgttaccgccgtcccgcactgccacaccggccaccggtgcacgcgacggtgacgcctagccaccgcccggcgcctagcgacgaccaacgactggcccgatgccgcttgcagccggcgcccagcaactcgcttctcctcgtctcctcctcgcctccagcctcctcctgctctgtgccaacgcaacgccgtcgctgtcagcccgtcaccgtcgtcgccttacgtttggtccggccgtcccgctccctggcctggccggtagtccgcagcacaggcacaacagcagctagcaggctgcaggctagcgcctagacgcctggcgccaacgagtcagcgacctcaggggtaagccggtaggggcagcagtagcagttggaccattttaatcaaatcatcctcttccttggaccattttattgtagtcaagtaacaagcaaatttgtttgttcctcttgcaaatgatctgttcttgctgtctagatcagttaatcatctgtttaggttaatggaaatagtaggtactcctagttaacactgttctactgtgaaaatggaaagcatgcgcagttacttgcatattatttatttgtcctactgcattttttggtgtatgatgaatttatatatgatgcaaatattatttctttgttataaaatggtttttttgcctcaaatatatttttatgcgattacggcataaatacggtctttataaagcgaacattttcgccccatcttatttttaatcctgcgtccgccattgatataacccttccttcgatgtatatttaaactaagtgattacgatagatcggtcgccatgccgagacagtataaatcacttaaatcgaaatatacattaaagcaggggttatatagacgatcagacagatctagcatgtatcggttaatactccgatactactttagactaagatattaaaataagcaaaatatattaaacaagaagcctaatataccttaatgcgacaagatcttaatataaatgacagatctagcatatcaattaaacatataaaacataaagtagctaaatcaggtaagatcggctgaaaacccgatgctatctctctcgataatcataaaacaagccagatatcacaattatggatattactcaacagatcgaacccaactgatgtaacattaagcataaagataaatataaaatctaggcaagatgatgaaaacctctaagagatgatagatacacgatataatctagattaataacgaaacataactctatcgactactttctaatagtacaaaccagccgatgacaagttatatagcgcaactaatagagattacaaaacgcatatgataactcgacgaattatataaacaagattagagtgtcataaagatggaagcactaatcctgagaacgcaagccgtcatgataagtttacctctagttgaagatcgtaatcgatgcagcttaacccgaaaagcaagaactcgtcgaaatagaacgaaagtgaaaagggtggtgatgcgccgaaagttttattgaactgttgttgtaaattgcatgggttcgggtgatatttatacccaagatacatgatatgtccttgccggacacgactcttatctctaacaaactctaagatacacataaggctttgcggctgactcttgcctaaacatatctctaaggaaactattcaaaatatcctaactaatagatacaattgactatctgagagcttatctccatcatgacaatccttgtgtagcacgttaaagcagtttcataactgcctctagcaaaatcggccttatcggctgtatcggccatatcggctgtcctctgtctgatccatctcagccgatgcagtatccagccgatgcacattccgttcttcgaatctaactctttgccgaatccactttgattccaatgccgaacctggttcatatcttaccaaatttggtcgttaacacatacgcgataatgatatgtttcaatgcatgtcttgagcgtgtttcacaaaattcctaaaactactgccactactctctctcctctctcttcacctcgtccatgcatacatgcatgtattttaacgagcttcaaaatgatttttctcttaaattaattatccgatcacaccgttgtattcattgtaattaaatctttacaacaagatatcgcatgactatattgcgatgaaagaaaaatatatgtttcaaaccattaacactagtttcatatgtgatagcggcatgtttcaacgtgtattcaccatgtttcataggatttttaaagatttcaattgctaattttttgtttcaccatatataacttgatgtttcactcgttggttaattgaaacatttgaccgaccgaattatttttttggcatctggcgcccgatgggaagattcttcctttaattacagtaaatcatgaattagggattgattacaatcatgcatgtttccgccgtgaccatgtttgcgcgacgacgacagacgacagctaggagcattgggtcggacatgattctgctctaccggtgtccaactaaacccattaccatccctaattaggatatcatttgtgttatataaaacgtaaaatctaaatcgagaacgctctcaatttagtcacagtgagcgaccctatcatccaatcagccgttgtccagatatgtctcgaagaatcttactttactatagtactaattgatcaagcaagtagaacaaatattcctatcatctatgcttcaaataaaattttcttttaaattactcattcgatttacaatccgattacaccgttgtgttcgtaacaattaaatctttacaacaagatctcacatgattatattttaataaaaaaccacaaattacttttataatatatctaaattacttttagatttcactaagttacttcttaaatatataaaagtaaattgaataaagttttaaagtaattaacatatattatatttttgttataagttacttttatattatatttttgttataagttttaaagtaattatttttaggttatattgaattacttttatatgtctaagaagtaacttagtgaaatctaaaagtaatttagatatattacaaaagtaatttatattttttcatcaaaatataatcatgtgagatcttgttataaagattaaattgttacgaacacaacggtgtaatcggattgtagatcggatgagtagtttaagagaaaattgtatttgaagtgtaagtggatagtgtttattatagatggagtggtagccagctaccactagcgctaaacaatagcgctaaacaacacgatgcacgctaaaaaacagagggagtatgcaaatagcagctgtgtagcgtagggcctgttttggggaggttatagcaggtgcagcttctcacgaaatcttcagctttcccaaacagtttagattatcacctagattctaagaatttgtaattgtagaatcttcagcttcaccaaatagtttagatagaattcagaaaataaaagttagaagcaaaaaaaaatccagccttttagattctcatagtctggctaccgaccaacaaattctcgtaaccttaaactttctaaacaagacggtaaactagtttcaaagcaaggctttgcttttttctaaagaaaaaaaaaggaaagaaaattgagaaacaattaaacaacacaaagttattacgattatttgatacaaatgatatcccatggtaagtgaaagtacaagcaagaaataacatacgcgacaacttgacgatcgaccgaatgtctgcaaataacaaaccagtaaacagtcgacgatcgaccgaatgtctgcaaataacaaaccagtaaaagtttatataggctcgtagcaatagaatccgtgctagctcctgccttcttgatgatgtgacaagctgttcatagacatgtagagttcgtaaggaacaattcacagtttgcaagtacatatataggtacaaagatacagcaatcgataggtaggcatatgaatacagaatacataagattttatttataccttgtgtaatgcttatgcctgtgaactgtgatatcatggcctcatggggcgtccagctggctgctactagctggcatttcgtttctctctggatagccataactgtggaaagtataggtccctgacggatatgattctctcctggtcatggatactgttcagctgacttatttttaccacatggagaacttgaagacttcccaacgaaccatttggaatctcaagttcatccactccatcaatttcatgtagtaaaagtgtcctcaagttggcaaaactgttaattgcttgaaataccagcttggagatgccactgatattatggaggcggagcgattcaaggttacacaaatttgtagatagtaggacgagcgaatcatcccttagcttgcacaagcttaactccagaactttaatctgtttagatttgaaaataggatattggaatgtctgctcagccaacccgcccctgataacaagtttttcaagactagtaggattcagggtttcaaagtcaagagactcctcgtccacacgacttgcactgacatgcaaactagaaagacaggaaagcttcgacaatgaagaaaacaatgttttgctggatcggccttctccaataacaacagatagagtagttaactgggtcagcttctccacatgcttctcaaaggtatcacttgcctgcactgtctcgagagtccgcaattctttcaggtagttcacagttttcggggctttcacagctcggtatatgtctgggccttggccatccaatgtgtcagcagaaagatgcctcaatcttatgagtttgcctatccaacttggcagttcatttattctgctccccctgaggtccaaagtttgcaggttgtagagattggccatggaagatggaaggcatcgtatttgtgattttcgcaagccaagatatcgcaaattaaacagctggtagccaatacctctgggcaattcttcaagtggagattcttgcagtttcagaacagtaagatacttaagtttggctgtcagtgatgccggtaaggacttcaaatttgcagcagcatttctgctggccataagagtccgaaggtacggaaaatctactaatgcaccaatatcttcagggttttccgagataaataggcagcggacattggtatccatctctgctagtttaccaccatggcagatagctccaaattcttccttttgagagatagatacagccagctcatgcaccacaataggcatcctgcaacttgctactctaccttgttcgtccacatctacaacctgcagaaatccccagtggattagctcctttatatagcgctcaccaatttcctccacttgcaatgatccctggttctcgatgaaaccctctgcagcccataaccggacaagactctcaggcaacaggagaaaaccagccggaaaagtactacaatacaaaaggcagttcttgagatgcattggaaggttcttgtaactgagatatagtactttttgcacattgttcaggcttgacttgcttttttgaatatcttcaatttgttgagccatttcactccagactgactctgttttttgctttgagctgagcaatgctccaatagaaacaattgcttggggaagaaaattgcacaagccaataatcttcaaagttacttcacggagttctatagggcagtcacttggtcttccaaaagcctttgtacagaagatatcaaaactgtcattaggatgtaaacaagtaagcttcatgaattccttggggactctcgccgagggtcttacaggttccagcgaactagatggtgtttgggactgtgactccactgaagattcacttcttacaaaagcaacctctggcatccgagcgattatgattatccggctgcccattttattatcagaagctgcacggtgtaccttgtgaaccatgtctggcacccatacatcgtcaaatacaaacaggaacttgctatcctgattttccgtcattactctcagtgaggtactctcagtggaagtgccaacttgccttcctagttcttccatcatcattcttttcaaagcatcagtgtcagcattgggacattgagcaatggaaatccacgcagaagtactgaaatacttcttctcactagcataaacatccttaacaagatgggttttccctgacccaggctgaccatacactgcaatcacagaaagagctccatctttcgtcatatctttactctttagcgattcaatcagttcttcctttctttcggcatatcgcttagtatctatgttgttgacatgaggaccaaacattgatgatgaagaagctaatgaggtttccttgtccacttgaacccatcgttttttcattttggaaagatgctccagctccacctcaatttctttcagctgagcagtgaagcgatgtgaggccagtataacctgtactctcttggtaagtcgatattgtttgctctgtacaatatagacaatatattcgtccattatttgttcaacaaggcatcctagtttccgtgcttccccaatccaactttgaagtacttgcttgttatcatatcttgtttctatttgagccaggaagcaaaggatcatgcgaagttcactttctattcgcctcaatctaccttgaagttctgcttgcctaagaactaatatatcattactattaataatctcagatattactctggtaagagatctaattagaaaggatcctccttcaaggccatgttccaaagctgatcttccttcaaggtcatgttccaaagcagtagcacttctctctcgtcctagggcaattcctatttttctgagagctaggtatattgcagtttctgccatttgccttctatcccttaatcttttgacattaaatggttcgtgaaaccaaaaaggatgcttccactacagtttggagtacaatacactgagtgtcacatttcctccctccctttttatcctgcatgcaacacatagtttggggtacatgttcttttcagtttcaaaaaaagaagaaaaaaattcagtaggagataatctaaagtaatgaaagaaacaacctttcttgaaaggacattgggctacgcaatgtgaaaaacaatgaccataagatgaatgtttcgatgaaagatggacatctgatcattaacatacatgcggtaaaaaaaaaaatgcactagacacttccctcccgatccttcgagtgtctcccctcagacatgtggcaagcaagaaaaagattactccatgaaaaatagataatgggctattggtttgcatggcaattaattggcatactttaatgggctgcactaattaagatcaattttgagatgtcaaataagtaaaataaacatgaacggttgttgtgaagaaaaataggaatacatattacggtagtactgtatgtaacttacgggctacttcagttgtaacaatcaggaaaaaataccactataactacaaggaaaaaaaacaatcttaagatctttcaacaaagatggcatctcatagtcgcgcgaacacgcgactccgagaggctaatctctatgtgaaatctaaaagtaagttataaaacaattatcaactagccaacagaagggcagtctttttatgactgatacaatagacttacaaagaatgacatcagaattctcacttgggaaaaaaatgataaaagtacgctgtttaaaatgtggtagctattagatgatccatctattacattatagggatttgctattcataactcaactgaaatttttttgcaagaaaaatcagattcctaacctttggatccggcagagattcgtgctccggcgagattcttgactctggcggccgtgcaacaacggcaagagcgccggattaggtttcaggtggggttggggttagggaagggggattttggggagagggtggatccccgggtttagcgggaggccagcgaggcggctgaccggcggtgcgtggaggcgccgccggagccgcgggctggaagcaggcggtgggcggagtaggcagcgggggcaacgagaagtcgagtggttaggaggcggcggccggatccggcggcgctatgctgcggagacaggggagggtcggcggcgcggaggcatcttgccggaactgtaggagacgacgaccggcttcgagcgataagaaaatcaatagggaggacggaggaggtagccagtggcggcggcggcgtcttcgaggcagctgctgcggcgcgtgtggcgacttgctactcgcgagcgaacagacgagggtgacgagagtgttgcagttgcctaaatatgtactccgtcgtatttttacattttgcttacatggtttaatcatttatttattttattaaaaatatttagaattattatttatttttttattcacttttttatccaacgtactttaaacacaattttttgttttttgtgttttatatttgagcaaattttttaataagacgagtgtttgttttttaaattttatatttgaacaatttttttctagtaagacgagtggtcaaacggtgtaaataaaatattaaaaaaatctcttatattttggagtagagagagtatgtactacctccctatcagaatataataatatgggatgggatgagactcatctcagaataatttatctggatatgtttagaataggcctcattttatcctacgtggttatattttgggacggagggagtaagctcgtttttcttgctgcttcttttagtgtgctctaactgctctctctttttcgtcgtcgtgacttttttaagtcaattagtttataggaaaatataggccgagtatatttccaatttttttaaaaaaaactttctacttttttatcacatcaaaactttcctacacacgtaaacgtctaacttttccatcacatcgttccaattttaactaaactttcaatttttgcgtaaactaaacacacccatagtagcttttttaacacaaaacaaatatattatcaaaatatattcaatagcatattagatgttagtaaatttatttacaaatttaatcaaacctaacaaagtttaaatagaaaaaaattaaaataacttataatatgaaacataggaagtagcttatagtctatattgtacttgttgtaattatgcctcgttcttttcagcaaattcaacatgcaactttctttttttaagcacgcttctcaaactattaaatatttgagtagaatttttctacatagaagttccttaaaatcaaataaaacaatttttcaaatctttagtaattaatactcacttaatcatgtgttaataacatgtctcatttcgtaagaaaaaaactaacaggatcaaatttataatggaggtgactaatatttatgtagtctatcaataaattaagaggggtctcgtatgtataataggttgtttctaatacataaccgttaactgctctaacactttcatatttttattgaaacttacgtagagattttcctttgtatgaggggtgtttttttctcttctccatcttaccgttcaggccacgttctaaactctaactattcaacttcctcgttttccataagcgcggttctcagaacgttaaacggtgtatttttttgaaaagaatttatataaaagtttctttaaaatatcaaatgaatctaattttcaaatatttaataattaataattaattaatcatgtgttaattgtttgctctggtttccgtgccggttaaaatctcaattcctatgcagaaacgaacgaagcctagtcctaaatgatacttcctccgtcccaaaatataaacatttttaacacagtgacaagtcaaacatttttaactttgactattaatagcaaaaagataaaaaacatcaatcattttatcattaaacaaactatcataatatacaactttttatttaaaacatattactatatatatatatatatatattgtatattgtattgatcaaagtagtatatcggaaactatgtcagggtctaaaactgcttatattttaggatgaaagaagcatcccgtatcttgtgtttacatgtatcactttatccagcatccacctcatgaactgccaggggcggagccaccgcctggctagcccaggcagcctgcctgagctcgctggcaaaaacttcattaaattttaatattgttgaataaattaatgatgtaatttttattaaaaatgatagttatagtgaagtttgctcgggctaaaaaatatttctacttgcgccactgcgacgcggcaaatttactgtcgtcagcgctgtaagtctgtaacacaactaaccatgtgttctagtagttttgaagtttcaactccctcgttttccagaaatttcaaaatttgccatcgaatacgcacggttttcaggacatgccatctaattcgcactactttcagaatacatcattgggacgcgaatcttcttcattctacgccactccgtccgccgacgtcagtcctcctcgtcgtccgtccgtctgccgccacctgcgccccgtccatccgccggcgccgccgcgttcttgttcgtccgccggcgccacccacgcgccaccgccctcctcatgctcggcgtcctctgccactcgctgtcgctcatgcagtcatgctcaggtacgcgtcacctccggcgagcacgccatcgtctccggcgacgccgccctcgacctgtcgtgtgcctgcagcatcgtcatgctcatcgcctacctcttcttccaactcaagacgcatcgccagctgtttgagccccaacaggttcgtgattgatcgatccgatgcatgtcctgtacgttcgatccatccaaccaaatggtaatcaggttgaggatgatttagtgatcgctcaagatgatgagccagtactgggatgatgacgatgatgcgcgcgggggcatacgaattggatgccggtgtcgttgaggatgctgacaccggcggaggcgaagttggcgcagacaagcaggttctcgcctcggaggtcggggctcaggtaaggcagcgcgggcatgtgagtcaggaagtcgatcccgtacggcggcgccgctcgcatccgtccgccggcgccgcccgcgtccccgtccgcccgccccgccatcgcccactacccctcttcaccgaatctcgcgcgtctcgccgaggagcaccatcgcgcctccacggggaagatggctgtgtcggcctcctcgacctactcgacgacgacctccaccacgagctcctcaactagggcgattttgtccaggcggcgtgtcgggtgttcgctcgcagtggccgcgttgagcaggccgtcgccgcggcggcggatggacggggactgacgcagctgtcgtcagaggtgccggcggacggacggggacgtgggtgcgcggcgctggcggatggacaggaacgcggcggcaccggcggatggacggggacgcgggcggcggcaaacggacggacgacgacgaggaccgacgtcggcggacggagtggcgtagaatgaagaaaattcgcgtcccaatggcgtattctgaaagtattgcgaattagatggcatatcctaaaaaccgtgcgtattcgatggcaaattctgaaaattctcctcgttttctatcaagcttccaaaactgctaataaaacgttttgttttcaaaaacctttcatataggcctggtttaattccccaaatttttttccccaaaatatcacatcgaatatttggacacatacatatagggcaaaaaaatatagattaaaaaactaattacaacgttaggggagaaatcacgaaacaaatcttttaagtctaattagtccatgattaggctcaaaagattcgtctcgtcgtttccaagcgagttatgaaattggtttttccattcgtgtccgaaatactctttcaacattcggtcaaacatccgatgtgacactcaaaagttttctttttacgaactaaacagggccatagaaatttcttaaaaatcaaataaacatatttttcaaatagcatccctacaaacactcatagatcgtcacatggtgttctaataaatcttagaaattctaagaaaaatttaagacatttagccatcggttatcatttaatttggtggatccattgttttcaactattagacctattaaaaagttgtgaattcaatttatctctaaacaacaagtacggtatgtatgtcgtcgctgatgtgatgcacgcacttggtattggaataattaactatttaccactcttacaagtggtaattaaatatttgccattagactcacatatcataaaactgcgagtagcaaatttttaattaccacattttaaaagtggaaaaaagttaaattaatgaccacttggtatcgtccccgacacgagcgtaagccacccaagtgactcaaaactgcaagcctagtctaatttgcaaatggatggtaaagatacatgttgcaaactgaaaatatatgcttaggttgggaacccttctcttcgacatgcaaaacgaaactcgtattattacatgattaactgttttttaacaatggattaatataattttttaaaacaacttacatatagaaagttttttataaatcacacaatttagtagtttgaaaagcgtgtgcgcggaaaacgaaagaggtgggttgagaaaagggggaagaacacagccttagtcttggggtctgtttggttggggactaatattgccacacattttttactaaggtagctaagcttagtcttgccacacttttgtggcaaataaaatgacaaattaagcttaggcaatgtttggcaagaaaatatagtgtatgatatgtgggccaggtggctaagagttaggcaaaatagacttgtgacaagaaccaaacactatctattaaaactttggcttgcctaaggttaggtgtagtaaatttagttgccaaccaaacaggcccttagtcttagttcaatgtatcactttggtcactttaaatgctcaaaaagtgaatgttactctaaagagtcttaaaaaaaatttgtccccaaaggagggccgtgctggggccaccccgtgtcagagcaggtacaatagcgggctattagccagctataaacatattttaatgagataaaagatgagagagaagagcagcgggctacagatctgtagccaactacagcacagactccaagacgcaatgtgtatatgacaggtgggaccatatgttaatagtatagtaagcaactattgtatgaattggctattagatcggctatagataatttggagctagtagtgggctatactattaaacttgttctcacgggagcatgacctcgccaaaagcaacttgctagacgtgcctccacggcgtaagagcaggtacaatagcaggctattagccagctgtaaacatattttagtgagataaaagatgagagagatgcgcaacggactacaaatctgtagccagctgcagcgcggactccaaaacgcaatatgtgtatgacaggtggggaaccatatattaatagtatagtaagcaactattatatgaattggctattagattaactataaatgaattagagctaatagtgggctatactattaaacttgctctaaggacatggccaacggtggccataccccatcttggaagtgggcccaaccacacgaggccctcaatcccctaagagcaggtacaatagcaggctataagccagctataaatacattttaagaagataaaagataagagagaaggacagcgagctatagatttgtagccagctatagtatggactccaaagtgcatatgtgtatgacagatgttatcagatattaactatgtagtatatgtttataggtaactattgtatgaattggctattaagttgactatagatgatttagagccggtggttggctacactattaaacttcactggtggagaaatgatctttgctgggtcgacccaaaaccacaataatcccagttccaaaaagaaccgggactaaaaatgatctttagtcccggttgaaaaccccagaggcattgtatgatctttagtcccggttagtaacaccaaccgggactaaaaattatctttagtcccggttcatcccctgtcagattgatgtcagggggccgagcatctttagttccggttggtaacaccaaccggaactaaagatcaccactttagttccggttgggaacaccaaccggacaaaagatcaaaccgatctttactcccggttgaaaacaccaaccggaactaaaattcgaagcgtggtatataatccatatcccttatcctctcctcaacagatcgaatctctcccttctttccctccctcctccgcttcctccatcctcatcccgatccatcccctccacctcctccccttcctcatccgaccccctcccctctcctccacctcctcctctccccttcctgcccatcctccccttcccctccacctcatcccctcccctctcctctacctcctcatctcccctttcctgcccatccacctccccttcccatccggcagccggcggggccgtggccggcggcgggtcggggcagcggggccgcgccgggcggcggcaacggctttattttctcttttttttaatttgtgattcacatgtataattttatgatttattggatgaatctgagatgacctgtgatgtatttgatttgtgtgtaattttttaggatttgtgatgtatttgacctatgatgtatttgatttgtgtataattttttaggatttgtgatatatttgatttgtgtgtatatgtaaatttaagatttgtgatgttactttatttttgatgtggatttgggatgttactttcatttggggatatgcttctcacttgatttgggagaaaatagatatgcttcctacttgatttgggagaaaattaaaaaaaaaaagaaaaaggaccgtctggaattgccgctattctctctttactcccggttggtgttaccaaccgggactaaaaagagggatctttagtcccggttggtaaagatccatctttagtcccggtaaaaatagcgatctttagtcccggattcgtagtcccggttgaaaaaccgggactatagggggttatgattcgggagtaaaaagtacttctctaccagtgcttgctctaacggggaagtaccctcagatgagccatactcaatccaaaacttgcactcccgaacaagttgaaggaaccacagccatcaagtcgaaggcccgatctctccaatgcatgccttgacttaggctatgtgtagttccccaaaaaaaatttacaccatatcacagaatatttgaacatctacatgaagtattatataaagactaaaaaaattactaattatacagattataagatgaatgttttgagcctaattacttcataatttgacaatatggtgctacagtaaacatttgctaatgatagattaattatgcttaataaattcgtctcgcggtttattggcggattctgtaattaattttattattattatccgaacaacctatgtaacaccttatataatacccgatatgacatgctaacattttacatgcgtgaataaacacccccttacaccctcgcctcgaagcagctcgtttcataggggtgagccgtgagcgattgttgcagaagaatcgcgccttcttgcatcttgcaaagtccgtccttgttcgctttttctgccggggttcgtatcctctgcctttgctacgtaatggcagggagtaacattctctctatcctagccctctatccaatatcaacggctgataatataggatgtactagttggcacaccacataatagtgattgtagttagcaaaacctcacgctggttggtttctatcctgggaaaaatattttatagataaaattttgatatggatgttcgtatagatttaaaatataaatgatgaaaaatataagtatagtaaaaaaaattaaaattagttgccagtcccatctttaagatacccaacccgtcgtatactgcaatattttacacttcatctttaggttgtgttcgtcccaggagattgagagaagatttatcttgtttttcgtatactttcgtatacttcatctttaggttatttatcttgtttattttttaagtttgaaatgattaatacccaattaattatatagtcataacttacctcattttgcgtattatctcaatattctcttttcccctctgattaaacactccctcagccttaagcttataagagtaagcgaaaatttaaattttaaatgctttacacttcatcgtttagtctacaccttatatgagtaggtgacattttaaattttttattatactttttttcatcatttatattttaaatcgttatgaatatctatataaaaaatttatctataaaatattttttccccggctagaaacctacaagcgtgaggttttgctaactgcaatcactattacgtggcataccaagtattacgtgagtatgttatcagccgttgatattggatagagggctagaatggagagaatgttactccctgccattatgtagcaatggcagaggatacgaacccggcctggagagggtacgtacgtgtggccaacattaactgatgtggtgttgcggctcccacatttcgagccgagactatatgcggtagttatgtaagtgggtagtctcgctatccgtatagtaacctacttgctagtttatttttcgtatgttagtacaaaacttaaaagaaaaaataataaaaaataaactagaagagagataagtgggaaaaaacccgcttacacgtcccgcttgcatgtctacttgcggcgttctgtgttgtgcatggtcttattttttctaatgcagtgaggagaaatatcatctactctaaaatataaagataaaaaaattatgttgtttagcaaataatatctcaggtcattacttttacttatttcagttatcaggttttaaactttgaatggcttagattctctttctaacttctaataattggctttcaaatcatggaaataatgggcatcatgtgaatcagtaaaaaaaatgcttatactattgtataaaattcaaatattgaaaatacttttattttaaaaggaaggaaaccgtctatcgagtacaatgagcatgggtagtagtgtatacccatacctaccagataattttatgtgcacagacatacccattgcacatgtgacgaccagagatgaccttgcccatgcccattagccgcaggcgtcacgtgccctagatctgcacatttacccattaattatacttacataacataaacaaagaaaaattatatagctaataaattcactcatgtattaactatataattgtgtttaagaggataggaggagaaaaggagaagaagatacgagaaacgagatgagcaactagctcataatatttgagtattgattatttcaaacttaaaaaacaaactaatataatttctaaaataactttcgtattttttctaaaaaacatatatagtttagcaattcgagcaatgtgctcacaaaaagacaaccttttctttttctgtcattcaaatgaccctaacaaactaaggctgtgttctccggcacgcaaaacgaagctcatattatcacatgattaattaagtatcaactaattttttttgaaaaatagattaatataattttttaaaacaactttcatatagaattttttttataaaacacaccatttagtagtttaaaaagcgtgcgtgtgaaaaatgaaagaggtgggttgggaaaatggaggaagaacgcagcctaagggtaagttgttctagtttaatagtagagctaactactactgcctctgttttcaaaataagtttatttttcattcatcttacacataccaatacaaatacaaaaatacctctactttatcagatactaatgcaactattactcactttatttacttccaacacaattattcgctactttcacaaactacgatacaatgattactttaaaatgaacttattttgagacaatgtaaggaactaaaaaataacttactatgggactagtgaagtagctattaaagcaagttttataatataaccaactactacctaaaaaaattaacatatcatctacacttgctaaggccattcccaactcaagatactatggcccgtttggcacagctctagctcccaactccaacttactagagccggagctgtgacaaatagtccagatcctccatttttgagagcggagttggcagagctgttccacaaaattgtactatgggggtggagctgggtttttctgctccacagctccactccaccccaaaagacacactaccctttaatttttttagtgtattttcaccaaaattccactgaactaccccttcctatccgatctcctcctgttctctctcctcctccgtcttcttggatagcccggcggccagcggcggcgtcgtcggcgtcggcagtggccggcggatggcgtggcgatgagggccacgggcggcggcggcggaggtaggcgcgcgggtggtggcgcggggtggcggtggcggcggcggccggcgagcagactgccagcagcggagcgggcggcgacgcgcgggcttagcagcggtagtggcggctgcgcacgggcggtggcgcgggttgacggcgcacggccggcgcgcgtgcggtggcggcggcggcccatgggatgagcggtggcagcgacgcctaccaggtgtttgacaaaatgccaacaagggacgtggtggagtagagctaaccaatctagccaaacactttctattccacttcagctcttataggaaccagctctaactggacttggagtttagagttgggagttggagtttggagccctaccaaacggggtctacacatagtttctataaactttacatcatcaagaaactaatagtagacactactctttcaatgcaaacaccacttttccatatttaaatttaatgctacttatcttacatgatgtcttggatgttgtgtagaaaccatgtctcatgcaagacctggtttccttctctttcctcatttattctcttgccacatcatctttcattctaagtgttatgtataccatcctagtaattgggtcgggaatggtctaactaaatagtccatcatacaatagttaactatcgatacatattacactattaatgcataccttacatttctctctcacataggttatcggatctcgtgctgtaacttgctacaaatatgtaccccctatttcctctctcatctcttttttccttcacgtacgcacaaatataacgtgacaacctatatagtccgcttccatcattttattatgtccattttctcctcctctctttttctcttaccatgaatcaaatacatatatattataaaaatgtgtagagttaactttgcacgagagtgaacactttacagatgtctattattattctagtcatttgcttaatgcagtcatacgtaagtttgtggagaagaaaagcacctcaacattattttgtccagatttattgtactaggaggtcgtattctcttaggttggcttttttttaatggatggagtaggttagatggttggaaccctggaaagctcctcgataccagtgatgtcacatggaacctcatgttggagtagatctgctttatagggagagatgcttcacatagggagagataatagtccggtgggttaggatgaaatagttttttactaccgtcctactatttcctccaacttaaaatataaaaagctaaaattagatcagatattctttttagtattataaatctagaaagattgtctgtcagtccaaattcgtactactgaaaatctgtccagattcgtagtactagaaaaatgtcatatcttataatacgaattcaatgccaaaaatcagaaggagaatggtgccacgtggcaacaccggttttgcaggctcgacgaaacgtgcgtccgcgcgtgcagggatcgatgaaatgctcttgcctgcgtgcgtgcgtgtgcaccggtcgtccagaaatttctccccaatccggcgcctttacgtggatgagacgagatactatgcatacagtgcaaacacgttaatttctcacattcccaccgtagggctggcaaagctcagtcaggcaggccgctatttcttgtggatcaaagaagtaataatacctactttagttagagattaaaatagggttagcaggatataattaaatcatccactaaaaattcctacgttccaaagatccatctttttaagttttctatggtttttattcatctgttttacacacgtatttatgtgttttatattccaaatattttctttcgtgtattttgtttttctgagttccaaacataccttagcctatgtttaagaggagagaaagatattaaggagataagtaaaactaggtgagccattatcgcataattaattgactaataattattttaaacatgaaaaatatagaaatatgattttttttataaaagggtaacttttctaaagattttttaatgtaaaaacacgccgacatgtgggtgaaaaatgatggacgtttcctttatttgtccctttgtcgaatgcaaccttagaacaagtacaatataaagcaataagctagctattgaacaaagaaggagagagaagaaaagtggactacatataaatatttaggtgcagtatgagctccaagatagtatgtgagaagtaaccacccctcatgcaagtggtaatttcttcacaaactctaagaaaagaatggtgtggtttggatgcaaattgaaaccaatatgctacatcttaattaattagttgatgatgtgaataaatttgaggtcgtaatcacccctgctataaaacttgcttataaaatttgctcttagagcaaagataatagactaatagtgggctataaacttatgtggagaatagagatttaaaaaaaacagtgttggctttcaagtaaaatctagctctacacatgcttcaaggtaaagaaatagagagacaatcttatagtcaacttataagctctaatataagcagctttagttatctctactattaatctctggctcttttatatatgtgtattaatttgttacaggcccaattggccaggctcagtataccatgcgtggcaaagccgcgcgctttttctagtccaatcttaagtttttatattttgggaaaaatgtactatatgaaataagaatggtctaaatatcttttatttaatggggtggactaaaagcataagtaggaaaaagattgaaagaaattctgaatggtgaatgattgtggagagaataataatactagtagtctacaaaatgtaattattctcagataagtttgagtgctaaataatacttatagtgagatgaaggtagtattaacgtggactcatgtttagagctctttaaatctaggattttatttatttattgagtggttgcacgtaggatacgaattattaaatttcaatcatatttttcatcaatccagtggttctcagtactcctatttttatttcttattatgggaattgctaactgtctgttgttgacagaaaattgatggttaaatcttgcacttgttaaaccgttggatgtgttcgggatcgtgctagccgttcgatacaccgtgatttctgagaaaaagagaaaagcaacgcacaaggagggatcgatcctgtgatctcatcctatttatacaagttacagtatatgctaggtacatatgtaattataatacaattatacaattatagtgtaattatgaaaattatattgtaattgtattgcagtaacatttgatagatttttaggatacttttcagtcccttttcttatataaaaggttgacagatattacaagaaataaacttactatttatacattacaaaattatatgaaaaaaatattcaaaccatgataaaaataaagaaaaaaggtatataccaacaaaattacatgtaaaataccacttcaattttaggtatatgaatatgcaatcttatgtgaataaaaatttacaaactttcgagcacataaagatttagcattgccccgagaagaaaagcacctctattcatgtgcagtcatatgggagctcgtgatcacatcgatacatgagctcgtgatcacatcgatacatgtgctgtgacatgtaagctcttgatctctgctttgcacaaaagggagaatattgtactattggttgatattgtacttctattcatgtgcagtcatgtgggagctcgtgatcacatcgatacatgtgctgtgacatgtgatctcttgacctgctttgcacgaaagggagtatattgtactatttgttgatattgtacctctattcatgtgcagtcacgtgggagctcgtgatcacatcgatatatgtgctgtgacatgtgagctcttgaactactttgcacggaagggagaatattgtactattggtttatattccatgctttgatggggaatgcatgagagcaagtataatagagggctataagagcaagtgccacattggattgagtaataagatggaggagagaagtgaggagagagatgatgaaccatccctaagtcaagaatcaacctccacacaaatttcaagaagagtgtgagagtattagtgacattgatatttatgtactagaggtgacatattgtatgtgttgcctcttaatttacgagtgaatgatatggataaatttggatatggtaatcacatttaccataacacttgccctaagaaggctgaatactgaggtgtaggctgaatactggctcggctcggcttgcagtggctcacaacaagctaggcttggcttggctcggctcagttagggaaacaagctaaaacttgagctcggctcgtttcctagctcgagccagctggagctggcttgcaagccttcctgttaaaacatctcttcatatatattttgtaattattaacaaaaaagcaagagcaaatcatcgacatgtaaaattaaataagtttatatattcaattcttcaaaatcttaatgataaatttaaagttgataaataataactccatgaaaagcaaaataatcgatataaacacatgatggtctaggttcgcgagccaaaataagcggctcgcgagccagctcgggctcggctcatttcaacaacgagctaaataagaggcttggacttggctcgtctggcttacgagccgagccaagccaaccaagctcgagccaagcccaagctgagctcatgaatccgagcttttttttccacccctattgaggtggccgaaatctgtgagacagacaggtggaccatatatttatactgaaaagttaaccactatatgagtaagcttagagataggctataaaaatctatacagtaagcagttggctgtattattggccttgctctgaataaacataggttagggcaagtactataagcctctacatgttgctcctaaagatgtcacataggattaggtgatgatatgaaggagagaagttagaagagagagaatgtgccagcctcatacaagaggcaacctccacacaatctttaagaaaatataagacgatgtgagaattaataaaccaatattgaagtttgtgtattagatgtgatatgttgtatttgttacctattaattaatagaacttgcccttaagtagtagtgctactatcaaaatgatagaaacatgcatgttaaaaatattgtacaaatgatgtgcagttgttgacgtaaaatctaaaagaacagacggaagcgtgtgagttctgcttagctttagtataggtcctatggatttcagaatgtgttagttagtttgatcatacaactaacaagataaaatacagatagattagattaaaatgacccgttggctatttcggtctatatggaattgtgggcctaaccgaaaccaataagattcaggtcaacggctatataactgatagagtttgttattcatactatatattttcctcatttctcttactcgttcaaaaatcgtacacacaactaaagaaaattttaatcatatatacaatttttcacacggttttatatattaataaaatttatgcatgtcttatgtataatgaaacataatactaaaaccattttatatttctactacattcatactataatatttcttgagtcctaacatacatagtacctaaaaattctaaacttctcacataactaaactatttatatgtaatatatgcacactacattaattattacttatccaacacttaatattttcatctaatacataaatcatcgctaaatctatacttcataataattaaagtactaaaatttacctctattttcttcgacttatatccctcttggcttggaccattacctcttcatttcttctctcttcctcaagctcttctcttctcttttttatggcatgagcacctcgtctggtgcaaactctcttctccttatatggcgtgaggtgagcaagaaagaggaacgaaaagagtgacgttttcaccgtgcttgattgctcaaagtttgagagcattgtattgacagcgcggattcctactctgtgcagcgcaactgtgctgcggtacgggcctagctcaattcaagagtattcagatgaatacccaagatttttagataaaaaatacaatatgaggtatatatttcgtatctgttttagatgaaactatcatcagaatggccagttttcagttagatcaatgtacttagctttaattaacaatggttacattgacagaaataagttaatttggaaacttaagatgccgcttaagatcaagatctttatgtggtatttgcttaagggagttgtgttaaccaaggataatttagcaagacgaaatttgaatggtaatttaagatgttgcttttgtacgaaaaatgagtatatccaacatttgttcattgaatgtcattttgcaaagtttatttggagagcagttcagttttcttttggtttatatattcctactagcatatctcatatttttgatgatcggctttagggagttgtaaacaaaaagagtaaactgatacttgttggagcttctgtcttgtgttgggctttgtggttgagtagaaatgatagggtttttgacaaatcacctacaattacttatatgcaggttattttcaaggcaatatattggcttcgtctgtgggcacagttacaaaagtatgatgaagatgaagaattcctaattgttgtgtgtcgtatgcttgaaacgacggttatacaactgtttgtcaatcatggatggagatttaccaatacactgaaataatgttattttatctttattggtttccttttaattttaattttggttggtgtgtttgctttcatttggactgcactcttacagagtgctagtttgtaataattggctgtaactcttttgagtaaaggtcgggatgttatttcattccattattaaaaaaatatattttgtatctgtgcagagaaataaagaaaataaatactattgatcaaaagaagcctaacaagaaagcctagcacactggctccctcatcccacctgtcttatcttctcattatgtaggcccaatagcccaaaagaaggggcaaagtcaacctagaccaccactggtcgctgttggttgttccaacttccaagtcgcaacatgtccctccgtcttgctcatcaacgcaacgccgcgctgccgtcgtgcacgcgcagatgtggagtagcccgcggcgtgccgacgcctatcgaggcctcaccctcaacaggtcgcggacgcccttccctcgctcggtcaaaccctctctctctctctctcgtcatatggcccgccccacgcctccggcaccgttggtcgcgctgccgcggccgcttccgcacaacgcgcggtgcaccactgcaccccctactgcccctaccaaatcgcctcgccgaacagttccgattcgattcaataggtaacccgttcaatctacattctcccaatgtgtttaatgtgaatatctgaacccaatttattttttagattgtactacatatgttttttcataaagtatatcccaataaatcaagaaaattgctgaaaatcttgacgcaagttctaattcaataagcagtactaaaatatcatactgttgatcatacataccaaatattatgcttgtgttgtaaaacttttttttttacccctttccatttcgaatacctaatttcaaaatcctaggtccgcccctggcggtaccgcatggatgccacgggaccgacatggtcccgccctccaccacgttgccgcacacccaggccgcagcattgacgcggtgccgcaattctggcctacgggaccaaagcggtgccgcacgctcatcttacgtgaacgacccagccgactgtctcgcgtggctacgccgcaattacgtagcgctcccgcgtgcccatcatgccgtaaagagatatatttgtgcaaatctttcccatacatatatataaatgcaaaatcttaaaaaaagttatattttcaatctattatattattaaacagctttaaaatgaggcaccacgttcgctgtgggggactaaaatttcccatattaaccagagaaaaagaaaatgagagttcaagtaaaaatacaatttaaaaatagctgaaattcagaattaaaaataagcaatattgagagaagagtcaatataaaaacccgatacgagattaatcaaaatttagaataaaaataaaataaaatccaaaattagaaaagaaaaggagagtccatgtaggaatacaatttaaaaataactgaaattcggaattaaaaatcaggaatattaagagaagagtcgatataagaacctaatacgagattaattaatattcagaatctctatctctatctctactacttaaaataagaggttcttccgtcgtccgtaaaaaaaaaggggcgaaaaaaatcagtctaatccaaaacaaaaataagaggtgcttccgtcgtccgtaaaaaaacgggcgaaaaaaatctgtctgatccaaaacaaaacgggcgaaaaaaacggacgaaaaaaaccgggtgaaaaaaaaagaaaaaccaaatctgtccgatcaaaaaagggaaaaaaaaggaaaagaaaaacgaacccgattccaaggtaaaaaaagggcgaaaagaaataaaaaaggaatctgtccaattcctaaaaaagggcgaaaaaaaccaggtgaaaaaaagaccagcaaaaaaaaatgaatctgcgtggacgcggtaaaaaaagagcgaaagaaataaaaaacaaatatgtctgattccaaaaaaaaaaagaattatatgtgacgcggtaaaaaaaattgaatcctattatatttgacacggtactatatatctctatcttatctatatctactacttaaaaatttaaaatgtttctgttgtccgtaataatgaaaaaagggcgaaaaaacattagaacaaataaaagaaagttcgattcaatttacttccgtcgtccgtgaaaatcttatcttatcttaatctcaatctttccgaggggacgagcggtgccctccgtcctcacccgcgggatgaaacgccagccaaagcaaaaaaaaaacgaaattgagcaaagggataaactagattgaagtttccaaaattaaaagagggtaaacgatattgaaactcccctaactcgtaaagagggaataaaatagattgaaatttcccgacaaaattctctaaattcgaagaactctaatttcgggtaagaaccataagagtcaaatccaaatcaattaagttaagggttcgggttacttaccggatttgaagccccagagctcaccggagctttccaggaagcggcaccgccgcaccttcacctcctcgcagtcgtgtcgggttccctgcgcgcacgctgtcctggagcacccctccaccatcctttgctgaagacgggaagcgtcagcttggcgtcacccctaccgtcgacgaggtccaggctgctcggtgctcgtcgccgtttgcacgcccacctagccggaccgccgacgtcgtggcacggttttgcgtcccccagccggcgaagcaggagccgctcggcggtcgtcgctgcacgcgcgcaccagcttgccggaccaccgtcattccactcgctcgtcgccggagagaaatgggatcatgagagggatttgggagctagggttttgcccctctccccggtcggtgcttcattcggcgcggggacgattggagccgtccattagatcggacggcttagattcgcccagcgtcgggccgtcgccgccattgattatgctacgcccaatgggccgcggaagtgcatcggaccgtccccgcatatgtaggtcgcgcttagctgctcagcttgtgggccgtcgaattgactcaactcgccaaagatgggcaagcccaagtttgggccggcttgggaaggcttgggccgaaagcaaatttgatcaaacaatgtggctcacatttttcaaattaaagtccgtcggataaactgctaagtaggctcaaaaaataaatctaaaactaaatcctaaatcctatgctaattgatcaaattagactcggttctacctatttgttaatatatcaaattatacttgatttttacagatttgaggttttcaaggtgtcacaccatcaaacggtgtttttcccgttgcaacacacgggcactattgctagtaaaaataaaaataaaatccaaaattagcaacaaaaaaaaaagaagagttcaagtaggaatacaatttaaaattaaccgaaattcggaattaaaaataagcaatattgaaagaagaatccatataagaacccaacacaagattaattaaaattcagaatgaaaaataaaataatatccaaaattagaaaaactaaaagagagttcaagtaggaatacaatttttaaacaacttaaattcaaaaataaaaaaaataaattatgaaattagaaaaataaaaaagatttcaattaggaatacaataaataactaaaaattggtgataaaaaataaagactattgaaaaaaaaagatcatctaaaacacatgacgagataaattaagtaacaggtctataaagaagtagagtggtggcggttgatacgacatacaaaaactattaataaaacacaaaatagaatcctaatgacgattaaaaggaggaacgacaggcagaccgtgaagctaacgggcaaggcggttgctgggacttctagaaattaaaaataaataaatcccattgataataatattcgatatttaaaatctcaatggcaatcaaaaggagaagcagcagacggggtgtataggagtgtagttgcagagccgctgacggttggcgagacttctagaaaataaaaaataaaaaatgaattctaatgataattatgttcgacttttagaatcccaatgacaataaagagtaggcggcggatgggtcgtggaggagtatagtggcatcgtttgacgggacttataaaaattataaaaaataaaacccaacaagacaataaactctaaaaactataaggaccaatttttaaaggttcggaactttcaaaaaataaaaaaacccaatgataatcatgttcgattttaaaatcttggtgacaataaagaaggaaggcagcaggtgagccacaaaggagtacaatggcaaagccgctgacggtttggcgggacttctataaagtaaaaaatgaacccgaacgataattatgttttatttttaaaatcccaatgacaataaagagaaaagacagtggacgggccatagaggagtataatggcagcgtttgacgggacttctagaaattataaaaatgaaacccaacaaaacattaaactctaaaaactacaaaattcaatttttaaaggtttcagggagaataaatagaaatagtggtagattgagcaagcaaataaagaagcatatgacagaagtaaagggtagcaactggtgtgacttttaaaaactatataattagaaatatagggatgataagatttggattttcaaaatcttaagacaacgacatagatatttaataaattttaagtaaaatcatactaaaaaaatatatgattttgtttgggtgctagccgcagaattgcgcggaccacccagctagttttttaaaagtcaccttgcatggcttaacttacacaccggcagttctctctaaaaaaacacaccggcttaactatgtttttgcttttatccctcttccacaatttcaggacaaacatcaggcgcagttggttcttcagactgtgcagaagcagcattactggtttcagcatccttcgtccatactttattgttgtctagcggccaattagctactcctgagcagtgctgagcttcgacaaactccagcattggatacagttcacgcaattcctcccaacaaaactgcagatccttgaggcatctcaagcgcagcacctctactttgcactccccattctgaatttccagactatgcaacttcccaccagtaaaatacagtttctttaaactgtcagaactaatcgtcccaaattgtctcgacgggaagcagtagagatccagctttgaaagattagagggaagaacaaggttaaattttgcagcatctgattcgtcggcagcatctcgtggagataccattccccatgtaatcttcagtgatgcgagactggcaaaattggcaagcactttcagctcatcttctgcacgcttcagtttcttgctaacactgatgctaagtttgcgaaggttgctcaagcttaccaactcgcccagattgcaggtgtttcttttgttagagtttactaccaaaaaccctttgaggacttggagctgagacatcttgttgaatccctcgggcatatcaacgagcaggtagcactcggagacatccagatactggagcttctgcagcttggtgatctcctttgccagcacctgcagatcgtggcacgccctgagatccaacacgaccagctcggccagttctccaatggcagccgggatggccataattctcgatatgcctctcaagctgaggtacctcaggttcttgcacgccccgatccccttgaggtggtggtcgtcgatcagctcgatgtggctcttccttggataggcaatctggtcgactgggtcagccacccgccactgcccgagctgcaccgtgccgagttgcgatctgtaggtgaaccacgcggtgctcagcttgacatagctctggccaacgttgtagatcgtggagagctgcgggtggaacctggagccctggagcagcccgccatcgtgcaggcatgcgcggtgcgtcctagagaaatcgttgtttgaggcggaggcgccattgccatccggatcaatctccaagaacgcgctgctccttgcaacggccacgagcatcctgcggatccacgggtgcacggtgcacgcgtgggcggtgtcgcagtgcccccggcggcggactgtgcgcacgaaccgcaagtcgacgagctgctggaacaactcattgccgtcctccaaggatgacacgaacttttcgccgatccaccagtggatgaggagccgcttttttatgacggcgccctcggggaaggctgcaaggcagaggaggcaatgcctcaactgctcatccataccgtgcacggctcgccgcaggtgcgccatctgctcgccgtcacggacacatctccttatccctgccatcgtcggcgcagaagccgaatcctccacatcccttcctctgtccggagatggttcctcttgtatctttatcttataggatcctgagattgcctccctgatgatgccaatctgtactccgacaccggcgagcttcggctggagcgtggagatctcgccgccggcggcgagggaattgagtacgtcgtcgacgagctcctcgatggggtcgaagaggtggacgatgcgcctctcattctcgcccatcttgacaaagatagcttggagttctctcatcatgtcacggatgctgtcgagctgagcgaggtcggagctgctctcagcgccgcggaagctcttggcgtcgccgatgacctgcaggctggagaggagaggggtgaggatgccgtcgtcgatgtacttggagaagaggatgcatccaccttcaccttcagcttcagcttcaggagtggacatggtggatgcctctacaactactctacttgtgttgctcttctctttcctcgtaccattaccagagtactagactttccccgatcggtagagatctccgggaggggtaagattgtaatttgcacaaaaaaactagaaaccctaacaatgcgtcgtgcttaattgggccgcggctattgggccgacagtcgtgggagactgcgagtggagggaggccctggcgcgggaaaagtacacgcaaggtccctcaacttgttagccagatacaaaatcgttcctcaaccgcaaaactggacatccggcgtcccccaacttacaaaaccggtcacaataggtcccttggcggttttgaccccggttttatcccacgtggtggctgactcagcgtgggatccacgtggccccacatgtcagtaagccatgtcatcacctctctctatctttcctctccctctctctctctcacttatctcctctcggcaggctgggcgggccgggcggtgggtggggaggtccccggggtgaggcgggagaggaggtccgacgaccgccgaccggcgacgcggcggcggcgacacgggagaaggggagggcggcggcaacccagcgtggtcgtggcgcccaacagacaggcacgggacgggcggcggtaaggacggtggcggcgcgtggttgtagacgaagccgaggaagacggtgtcgacgtctcccccagcctcagccaccaggaaaggagctgggcgcgggtggcagccgtcgagggcgtcgcggcttcggtcctcgagcgccgtcatggcgtcgccgtcgtcgctgcgttcctcccgcctcgccaccaccgccaagccgacgccgacgcgttcctcctgcctcgtcgccaccgcctagctgacgagctcgctagcctccccgcgcctccgccggccgcgcgtgtggctccagctcggccgccgcggtcacccgccgcttctcgtcggtgagcacggaaaggaagctgatgccgccgccttgctcccctgagccaacgccgacgcattcgtcacgcctcgacgccgacgccggcctccccatgcctccccgccgtcgtcaccgcgttcctcccgcctcgccgccggatttggacttgggaggagctcaccggcctccccgcgccaccgccgattccgcctccgccggccgcgcgtgtggctccagctccgccgccgctcctcctctccgccgcgccgaccctcttccccaccgcgtcggtgacgtcgccgccgccgccgccgcaccggctctcctctccgcatcagctatgatggccgcagccgcgtgccaccatagctgaccgcacgagggggacggggaggccggcgagctcgcaccggcctgagctcgcgcgccgccacccgagagccgttgtcgccggccgcaccacccttcggccgcacgctgcctcctgtgcgagagcagagagcgagaggaaaggagagaaatagagaaagagagaaagagtgctgacgtggcttactgacatgtggggtccacgtgggtctcacgctgagtcagccgccacgtgggacaaaaccagggtgaaaaccaccgagggacctattatgaccggttttgtaagttgggggacgccggatgtccggttttgcggttgagggacgattttgtatctggctaacaagttgagggaccttgcgtgtacttttcccccctggcgcggtcgggtcgccgtcgccgtgttcggcgggtgaagtgtcggccgcggctgcaggcagagggaggcgctggcaccgccgccgtcgagcaagtagaggcctaaatttcatgggccctagcccgtcgcccctctcgtttcggcccaggaacgaccctgatgctctgccatctcatctaatagtttaggacaggaggtatcgaaaacaacaaattaaatgcaaaaccgggcaaatacattttctcagtttgcaactttgcatacaaccaactaatttttgacggacaggtggattgagggtcgctcggtgggctcctcctcttgcagtgcttccttatcttcgggctttgggtacggtcgcctctatcctcgtgggcaactcctaggtaggggacatccgtgacgctctcaccgtaccagtcatctcccaattcctgatgctctaggatgcagtgctccctatccagctctcgccaggcatgacggatcgtcttgtttggcgttggatcagtgaccagcgttattcggcccgctcagcctaccaggttttcttccttgggcaacactccttagcttgcgtcgatgtgctctggcatgcaaaaggccctgctaaatgcaagctcttcctctggttggcgtttcagtagcgttgctggatggctgaccttctgcaaaagctaggtatcgatagtcatttggtctgccccgtctacgctcaagatcctgagacagcgaaccacattatccttgattgtgtgttcgctcagtaggtctagcatcttgtgttgtctattcctggttaggctaccccacttcgtcccgtggtgactcgctccaagcttggtagccgacctctagggcctgtctgcctgagtatcttcaagtgagcttcgactccgtagttcttctggtctcttggcagttgtgaaaagagtggaattctagggttttcaactcctttctcagtctctgtggttctcgagtccatcctccaggaagaccgtctgtggtcttctgctagcaccgcggcctttggggacttgttgggagcgtagtggggctctgccaccaccctccctctctataggagcaacgtttctctagtagtagtttcctgtctttagcaatccttttgtattttctcttttttccttgtcctctggcaatggacatccagccgattgcgttgtgtaacgaaaactttgctttcttctaatatattgaaaaaaattaaaaaaaaagctgatggaaaatatgatccctgcctccctgggatttgccatattacaatcaaggttcatacagtaaagataaaccatcctaactcacaattctaagctctaaacatcaacataatagagtactgcacatcatctagacagaatttatgtagtagccgccatgcaattccactccagttcaaagacatttgcagggcattctctagcatcaagtccagcagtgttctccccgcaaaaaaaaaaaaaaaaaaaaaaagtccagcagtgttctgtcctgtgtggcaagttttccactgcacaagcaagtgagcaaccactgttgccaacgcaaagtatccctgtctgtttccccagaacatagaccgtctggttcaggagttggcggccggcgggagtcgacgagggcggcgaagagttgccggcggtcggccaccgtcgcctcctctggagcggcggtcgtctggagttaacaaagtcggctggaggctgctgttcggcgcccgtagccggccacggcgacggcgaggtgaggcgcgctgctctgcacgagctgcctccgagcgacagatctcgatcctccctagtgtggatctaggggcaaaaacgtccacaaacttatcagagaaaaggaggggaaagtgcatttcgcagctctggcggcatagttgagcacttgagtggtaaaattgagctagctctttctcctcctcctcctcttcctcttcttattcttgttttctgatgttcttttcatttcctgattattaccttctcgagttcccaccagatcggacggagtggcggcgttgtacctgtcgtagagaagaagcgaacggtgggcggccgcaggatgtcggagctggaggtgtatagcttgctgcagaagatggcggcgatgagggacggcggcgactggccggccggtgcggagttggagttgcaggagttgtacaccgtcctcgagaaggtgcagcgcaagatggctcacgcggagccgctggtcgtcgtcgacagcggcaactccgcccgcgccgcctactccctcttcctcgcagaccttcgccgcgtcacgttcaccgtcgaccaagccctcgatagctactccgccagcgcccgccgctccccgttcatgcaccgcgtgcgttcggtggctctgatggggatggcggcatatggtgttttcgcgtttctctcggcccgttcgtcttccctgctgcaggaaaagcttttgccgcagccgctagagctgcgccccaagatcgccagaaagttggaagaggccgtgaaggacgtgaggatgcttctccgcctcttcagtacctacgtcgccgatctcctgccgccgccggagcaccagcagccagagcctggtctcggcgctgaccccgacgatacgtggtctcttgccgatcaaaaagaagccaacctccttgtcaaaggaagagaacaggacagatgtaaggtacggcagatcctcgaacatcctggaacgaaagtggtcgtaattgtaggaatggccggggccgggaagacgaagctcaccaggcatctgctgtgcgaaatgtgtagtgctactacgcatggcttcaactactctctttgggttacagtgtcccaagatttcaatccagaatggatttatcggcaggtgatgtctaagctgagcgatcaattgaaggcaggcgaagatgctgaaagcttctggtggtctctaaattcagatctaaatgaaggcttgatcaataagaagcatttgcttgtgctcgatggcgtctggaacgaagaccctcgtaagtggaaggaactgatggatctcctctacggcaattgcacgcaaaagaccaaaatcatcgtcactaccaggattcctgcggcggctgctgctataagctctgcagtaatctaccacctgcacccgttctcggtggagcataccttggagatgctccaaacgatcaatggggagctgcctgagaagttgctcggcggtggcagtagcaacgctaccgtgtctactgctgcggctaaagaattgagtaagaggaaggtcgcagagaaatgcagcggtttgcccaccatcataaagttcttgagctcttctcttgaatctatctgtgcaaacgaggttgctgatccactaaaacagtttgatatgatgtgtgctggcaaccaaggactgctgcacatcgctgaggccagctataaccatcttccaccacatctgaagcggtgcttcctctactgctccttgttcccatatcatcacatctttgatactgacgagatgattagcctgatggttgctgaaggtttaacacagactacaagcagggaagcccaagtggatggtgatatcagcaggcttcagagtgaatgctttgatcttgtcaataatcctgggtctaatgggggaatcagaagaggatgcatgatgcatcgagtattgcacatccttgcacggcacaaagggcaagaactatataaagctattgtgggtgatcattctgctgctttgaaagaacattccaatatcagatatatgtctctcacagttgatcatacaactacggagctcccagggtcgctgactgcgcacacagatttgaggacgctgatcctactcagaacgcagaagatggtcttgtctggtcagaagtctgaaatcaaagagatcccttctgattactgccgctatctcacatacttgcgtgtattggacctgcaggcaaccaagatcaataagttgcctgagaaagtcgaaatgctctcaaatctgaggtatctgaacctttcccaaaccgatattgacaaactgcctgaatcaattggcagacttcagtacctggtatccctcaacatttctcaaacatgcattgcgacagttccagattatattggcaaaattcactctttgaggtacctcaatctttctcaaactgatattggaaaactgcctgattcaatttgttcgctccgactgttgcaaaccttgcagctatcacgctgtgaaaagcttaccaaactaccacaaaatataggatccgtgacaagtttacaaaggttagacctagaaggttgctactatctatccgagatgcctcaggatataagcaacttgaaaaatgtgaaggagctaaatgtactggaatgtccctcactggataaaatgccttgtgggctgagtgcactaaccaagattgaagcattgccaaggtacattgcaaccagtggtgacaacaatcccatattggagctgcgggatttggtaaaattgaaaagactgggtttggaaaacattgcaaatatttccaatgaggatgccgagaaaatacaactgcaaaagaaacatgagctcgagcatttgacacttaattgcaatatggatgctgaaaacagaaaatcaagttctgaagtgaaggagctactggactgtctagagcccaacccagggttgaaaatactggagatcatttcttatgcaggggaaacgttcccgtgctggatggccaacacaaatccacaacttaagaagctcactcagatcagaatcatcagattgattaatctgaagtgcagcagtctcccgccgcttgggcagctacatcaacttgagactctagagatcagtggaatgaatgccataaaaaatgtcagcagtgagctacacggtgaactgaatgctgatacattccgttctctaaagaagatcgtcttttctcatatggttaacctacaatgttggccggtggaaaatggtgctatatgtgaacatcttaaagagttgtcaattatccaatgcccaaaatttcacaagctgtcgatgaatcttaatattgaaaagctgactctattgatgagtcctcacgaattgcttggcagagaaggattggcaggtgttgctaggagtctaaaaagcctatctatttcactgtgtgaagagctatcagcatcatcaaattgtgagggtctaacgatgctttctaaccttgaggagttaaagatttctggatgtgatgaactggagaacttaccgccgggtatggaaaatcttactgcactcaaaagattgtcagttattggatgccagaagttccaaaatttaacggacttactggaatgcactgctctgagctccctggtcatatcagattgtccaatgctaccatccgtcccacagggtttgagagggatcacaacttgcgagtaaactaacagcggtatagttcaaaaacagatagaagaactctagcacaaatatatcaagtatgtgaatgaccaagcttttgcgtcattttttctcataatcctatccacatacagtttcaatttttagatttatttatagatgccaaaaatgtttctgatcggtatctccaatgtattttatataagtttcacggctatcaagatacactatccttgttactttgcctttattacttacatcgatgatacactagcaggtggattttcattaaattttattgaatagtcatctcgttctcttaagattttaaaagatagaaccattgtcacaccccaatccggcaccgccatacaacagcacctgatagaagcgtgtcgtagcaaaaacggcgcaaaccacttcctacaaaaccacgatatcggtactagtcccagaacatagcgctggtatctacggtgacaattatgaatcattacaatcttgaatttaaatagaggacttatttaccttaacttaggctgcagctctcaggggaacccgataatgcaacagacgacgcggaagcagcaacaacaggagcaaaggcagtggaaaccaatgaatgaatacccaataccacaggcaatagcttggaactaggacgaaaccctaatctttacttcacttcaacttcaccttcaaagttggtagaactatatatagagagagcaaggttacttacgtacacagcaagtcagggaaacttaggtggttattgcaagcttcaaggggaccgttatttttgcaatcgattttgttttccagttttcaacaatctaagtatgtgctttccacaaccagcgtgagacaagtctcagctcggtcgggagtgagaagtaaaccaatttatttgcaagatttgcacacctcccagagttggcctaagctggtttcccaaaccaaaccaattttccaatctttcagagtttggttgcctccaaacaaccagatacttccagggattccctgtcccaatgtctccctaacagccacttgctttttgaaacatcaggtttcccaaacggcaacaccatttcataaaacagggtaaagcaaaaactacgctaagaatcacctcacatccgcccattaccgtgggcaaagctgttcgaatagttcgttaatctctgcaaaggggtacactttacccacatgacattactaacctaggtcacctagcccgtgcagaataaccacgtctggtgactttaaggttttcacgacaagacatttccaaagccggcacagggtcaccatatgccaacgagaggggtctcagaccaacagcaggttaggtcccagaccatgctgtgccaggaagcctaggggttctccctgacaccaccccgacgaatccacttgtcccttggcatcaaggtttccctggcctagctagttactcagccaggggtgttccatttcacctatatggtcgcacttgttatatgctcggatgtaattccaaaggaatcaatccttcaaagcgaccgcacaagcatcccgcccaggaatggacttgtgtcgtgagttttatttttaaaactcattttctttcacaatgcaccgacccaggcttgggtttttccaatgtttttgtaaaccaagtttttagtcaaggcgtttctcagattttaagtttgagggcgaccgtcgatactcacacagagtgcacgaataccgaggcacaacacaggtggattcaaggaaacatgatatggcaattaacaagggagaatcaaatgcaacaagttaggtaggtccaccgattgcctcgcagatggggcaaatagctcaagtgcaatcctatcaatgcataaatattttgcaagcaatataattaagttcaaatataggctcaagatgtccaaggtggcttgccttgctcaaggtcttgagcttcacgaatcttcaagaaatccatgcttagaagtaaatccggtaactgcaactatacgcaaacaatcaaaacctaaacaagggacaaaaaaaaagatcatattaaaactaattactagtgccattaaatatgtcacaattttagagtattactggaagtggaacagagtcaaacggaattagggatcaacaaatataagttttggaaatttatctgattttctggacaaaggaaaaggacttgttgaatttttggtaacatgcagggccagcaaatgtggtgggaggagagagggacttcggtccacaggtggctggtgagggactggatatcgacttttgttgagcgggtcgagagataaagaatcggctcggcagctcacaaggctaggggtgtgagcaaggcggggaaactgttttaaacactccggtggacatacacctgtttattacatgttatctaaaaagttatgaaaagttttcaaaaattttgacataataggttaatatgtaatatatcacttcacaaacatgcaaattcaaattcaacttctacaagttgtaacaaaaataacaaatttgactgtgaatatacgtatgctagttagagtttaatttgttatttttgttacaatttgtagaagtcgaagttgaacttatatgtttgtgaagtgataatctatcttgtaaatttttttaaaaattatttgtaatcatttagttgacatgcaaaaaagggtggatgtccacccgagagattagaatccatcttcggtcttgggtcgcagtcagaacgatatcgcacacatggtctcggattcgcagtttctgggaaagcacaggaaccgttagcatccccgtgagcaaagagtttacgtacttgcacttcctctccttcctagttgttagggcatccacaatgtacttcaaaagtggtccataagcaatataatatttgattcagccacctagcaacattgtggaactagtccatagggaagaaataacaaaagctacccataagcatatgggctgcccatagagaataaaatatattatttgtctctatatcttctctcctactaatactatttactattcatatacattgtgaaggttacaatagttaaagttcatatatgtgggtcccatctttatagactacttttaccatatacattattgttgcccttattcctttttcatgtataatcgagataatatctatctatctattatattattaaaacaaccttaaaagagagcatcatgttcactgtgggggttaaaaattcccacattaatcaggaaaaaaaagaaaagaagagtccaaagagaaatacaatctaaaaatagctaaaatttaaaattaaaaataagcaatattgaaagaagagtccatataagaacacgatacgagattaatcaaaatttggaataaaaataaaaaaaatgattaatcaaaatttggaataaaaaaacaggggcaaaatcacaaaccctaattaaaaagcaggggtaaaatcacaattgaatcgtaaagaagggcagaaacacaattgccccaaaatgtttcaatagtttaaatcgggcgttgtttcaccttatataaaaacaatgtttcaacaaatagcaaaagaatgtttcatttcaccgcaacattaaatccatacatagcaaaacattgtgagtacactaggtgaaacattttgtggaacaaaaaatgaacgaattctcttaatagagggtttccaaaatatgtgggtgatttgttacaaaagaatgtttcaattcgctgcaacattagatctatacatagcgaaacattgtgagtacactaggtgaaacatttttgatggaacaaaaaatgaaacgaattcccttaatagagggtttccaaaatatgtgggtgatttgttgcaaaagaatgtttcaattcacttcaacattatatctatacatagtgaaacattgtgagtacactaggtgaaacatttttggtgaaataaaaaatgaaactaattcccttaacagaggtttccaaaatatgtgggtgattttttgcaaaagaatgtttcaattcactgcaacattagatctatacatagtgaaacattgtgagtacactaggtaaaatatttttcgtggaacaaaaaaaatgaaacgaatttcgttaatagagggtttccaaaatatgtgggtgatttgttgcaaaagaatgtttcaattcactgcaacattagatctatacaaagtgatacattgtgagtacactaggtgaaacattttttgtggaaaaaaaatgaaacgaattcccttaataaagggtttccaaaatatgtaggtgatttgttgcaatagagtatgtagtggagatacatggcaggagggaatagggacacctaataggcccacaggatcacgcgcgcgcgtgggggggggggggagcgcccgatcctgctccacccccaccggtcgcccgggtttaagcatttccacatattttcataagggatatacagttatatctattatctattatatactaaaagtccattaaacttcctacaaacgctctcaagtcgccacatggcactctaataaattagagaaaatcctagaaattctaagaaaaaagcaaaacatctaccccttaattttcacttaaattggtgggtccaatattatacaccgttagatgaaattgatcttaaaataaaccaaaccaaatactatgggccccacctctcctcctccctagatatatacgtacgtacattctttcatttctctgttttttttcagtttttcttctttttttcatttatataagtacgtacgcttcttctttcctttctcttttttttttcattttttcttcttttttccatttatataatagatatatatatttttaaataatcataattcatgcgtacgcttcttctttcaattctttttttcctttttttactttttccatttatataatagatatatatattttaaataattatattttacaaacaaaaaatctaccatcatacaactcaggggtaactaaattatctctacaatttttgaaaataaaatttacatcattatctgttactcattaaattaataataatgtaagataattttcatttaaattagtgtactcattactttgtactattatgtttaaataatacactattttaaaataaagtttacacagttatatgtgtacatatgtacgtgtacgtacgcttctttcgcttattttttttcttttttccatttatataatggatatatattttttaaataatcataattttacaaacagagaatctaccatcatacaactcataggtaactaaattagctctacaatttttgaaaataaaatttacaccattatatgttacccattaaattaataatgtaatataatttccatttaaaccggtgtactcattactttgtactattatttttaaataatgcactattttaaaataaagttcacacattatattgtatacatacgtacgtatgtgtacgtacgcttctttcgcttattttttccccttttttcttctttttttctatttatatatggatatatattttttaaataatcataattttacaaatatagaatctaccatcgtacaacttgcatgtaactaaattagctctacaattttaaaaagtaaaatttagaccattatatgttacccataaaattaataattaccacttaaaccggtgtactcattagttcccaatagactgatttagtcttaatagtattagtgttggaagagggtttactttgtgctattattttccaataatgcactatttaaaaataaagtttacataattatattgtgtacctatcaaataaacaatttgagatctatattaactaatttgtacgtgcatttaagccgatggactcattatttaaatcactggatttattttttattacattggactattattctccaataatgcattgtttcaaaataaagtctacactattatattatattatgtacccattaaattaacaatttaaaatctatattaactaatttacacttacactagaaccggtggacccattatttaaatcatcggatctattgttttcttataaataaagctttcgaagttctcttttttggcccgctacacaatgcacgtctgcacttttgccttttgtacgcgtgacaaagcgtcgtgtctaaggcatctaaggtgattaccaccgccgctacgctaccactttgccacatatcaagtcatatatggagttgattaattttattaataacatgtaaagtaaattaaaggtgtgatgccgtgagagaataattaagcaccgcgggttgaattttttccaacacttagctctgtttaacctgaaactaagagttgattatagaataattataatgtattgtgttatgtcatatttggattttgtactatttattcgtacaggtgaaagaaatcattatgttataaatgtgagcataatattaacgaatattaatagaacttttactaagacaagcgtgctataagagagtttaaccctcttttttttcccaattccatagtttgggttttcgtttgcacgcttttcaagtttctaaatagtgtcttttttaaacaacagtttatctttttagaagtcaattcattcatttgtaccctcaaatagctatcatataaataagctattctaaatcctaagtagtacatgtttttttttcatgtgagtcatggtgatcagtaaattggggatcaacagataatcaaagtcgtaagataaatatgtaagagctactatgaacaactgtaaataggtgtcaaaattaattgctattaattagacatctaatggcttgctagccacataattaatttctctctagatgtatataaacatggacgaagctgcaataaataataccatatgccccatgcatatatattatgtggttaatattctaattacatgtgttaagtcctttaaaatttcttaaaatgctctcaaactgctacgtggtgctctaataaattaaagcaactattaaaaattctaagaaaaaaaaaagcaaaatatctattatttaattttcacttaaatcggtatgtccaatattataaaccattagattaaattgatcctagaacaaactagatagtacgaggttccacctctcctcccggggcataggtacgcacctacgtacgtgggtacgtatgcttcctctcccttttttcatttttccctttcttttttttccatgcatgcgctttcctcccgttcttactatatcatgcgtcttcatgagatgatttaatcataagaattttaagtatcttgctctataaatggattgtataataattaacttgcaatagtttcttatttactcgagaaaaaaaaacatgattcaaaagtcataagtacttaatccatctcctactcaaaagtttgtgaatgatttttttaagatactttaagaaaaatagaacccttaaattattataaaataacattatccaaacattagtttgcccttaatttatgagacaaaattttcgaacaaacaataatcttatctttcaataatataatgcccgcgcatccgcgcgggccaccttcctagttgcagtaaaccaaacagccaggcaaatagttgtatccaccttaagccacaaagagttttatgtaacagaaaatggtgtagtgttggttgttagagtttatgatgacatcatattggtatctatgggtatcatttctaacacctaaaatatcatattaacatcagcatagtaccaacatgctagaatttgatacctatatgtatcttgtctggtaactgcagtactgcagtgttcttgaaggaacgatataggccgtgtttagttccacagacaattttttttaaaagtatacggacacacatatgaaatattaaatgtagactaagaacaaaacaaattacagattccgcctgtaaactgcgagatgaatctataagcctaattaatccgtcattagcaaatgtttactgtagcaccatattgtcaaatcatggcgtaattaggctcaaaagattcgtctcgcaatttacttgtaaactgtgcaattatttttttcgtccatatttaatgcggcatgcatgtatccaaatatttgatgcgacggaatttttggaagtttgaagggaaataaacacagctatagtgttccctagtcatcctcttatgtaacagtctcagatatcaacaatgagcttggctctggcgtggccagactccaccctgtattggtctcccacgccgaagtgcgccatgagcagccacaccacggtgagcagctcgcctccctggctgagctgcctcgcgtgggcattgccactgcactttccggccgaatagcacaacatctccacccacacggcggccatgagctgccatctcctctcctcagtgatgccctcaagctccatgagctgcttcgcgagcttgcacgcctggaagagcaccgacttgctcctgtcccccttcacgtcccgtggctctgcgatcgacgtgtccacgtccgtgagcctgttagcacatcccttctcgtccctggtctcgtcgtctcgccggaagaagttcttggcctccgcgcaggtgtcaccaaagcggatttgaccgatgctcgccgtcatcatgaacgggcgcatgaccagcaggaacagcatgtagttcgatatctccctgctcacggtcaccagattatccgggtctctttctcgtgccgtggtgccatgatcgtcgtcgttgttgccggcaggggccgagctggagacgcagaggcaccggagacacttggacgacgaggagcagctgatacagcatccgtcatcatccttctccgccggagcccgataatgtttgttgtagaagcagagttctgtggcgatgtgccagaggaggatgctctcgtcaaactcgcagtcgacgctccagcccagcttctggtagagacccttgcgctggagcgcccactggccacggtgctcgccgaccttccggtagctcttgggatccttgctgatgctgcttgccttgctctttagctgttcgaagatgtggctcttcagctgctccgaaacgccgatgctcgtggtgtacctccagctgtcccacatcgtcttcacgcggaagttccacctccactccagccactccatgggtttcttgtaccagcgggacctgtccttgacacaatagctgatcaggttgtactgcgacatcttgttcgaccatctaggccgcttctctggctggaacaggccgatcagccaaaacaccgccgctgccacggggcggagcgcttctgtcctgcgcatgtcggtgtaggtccaggaggacacgacgatcaggagaatcgcgtaggtctccaagaagatggctccgcccaggagcacgaaggagatgttgatgtcaacctgcttgtagtagcctcgcatatcacccaacgcgcgggtgaagagcacgagcgacacgaccggcgcggccagggtgaagaagcgtaggccgcggcctaggcgaccatgaatcacgagggccttggagtggaggcattcgtacatgagcaccagctcgatctccaccaccttgtacgcctgttccatctccagcctccggaagaaggagaggctgtcgatccggtcctggaagctaaggatgaggtcgacgaagaggcggcggaagatctgaaagaacctgtgcgcactgtacaccaggtcgccatattcctgctgcttgacttcgacatggtggtcgtcgtctggaggccgctcctgcacgatgacgatcttggccaccagcccggcgtccgtcctcgactggcactcctccacgaatttggcgtagtttggccccggatctggcggcgtgagcatggagctgcgcaggcagcccatgctcgccgccctgagcgctagcgtccgctcgccgtacttggtgatgccggcgacgaacatgattatcgccgggatcatcagccggacgccgggccgtgatttccagtagacgtatccggcgagagcgacctgcgacagcaggctcaggaagtgacgcagccagagctcgttgtcctccacggcgaaggcggtgatggtgtcctgccccccgagatgaaggatgaggaaaggggcccagaagacgaggaggtgcatctcgccatcgagtgagccgtcgcagagcttctggttctgggacaggttgcccatcgcgtagatggcgatgtagtcggcgaggaggtaggcaagccagagtggcatgcgcagccaccaagcggctttgcgcttgcgcaggccgccggtgaagaggaggaagacctgaagggataggctggacaggacaagaacgcggatctcccactcaccccacacctcccgtaaccgtctcaggttcatctccgtctccaaaattctccaatgctccctggtttcaatctccccggctagctgctagtgaagctcctcctgcatcatcgatcgaggataagcatttagcactgtgcttgcacaagaggaatgctttctttttttcatttgcaaaaacgaaccgttctctctcagtttggacatttgtttactatatggctatccatggacaatgatttttttataactaggtgccatagcatccatcatttacatacgacataaatagttatagaaaaaattgaaaaaaaattagtaacatcgtttgtacaactagagaaagaaaaataataaaatcagaaagtgaatagtacacgtatattgtagataaaatttgttattttttcttcatatatcgatcgaatttatacttgcatgtttgtatgatgtctcatattatcatggtttatcttatcaaattttatgatatttttatataactgtttaaattacatgtatacatatagatgtggcacctagatatagaaaatactttctgggccatccagttgaactattaaagtcaactaatcattacggacacagtatttgctctatcgtgagagcaacaaggaggtgtgatctcttgcaaactaaagcgcacatgccagatgccattgcccattgacccaaatatttaacgcaaagttgccacctattaattccaagctagttttctctctagactccgctggctctagacttcgctggtcaacttgcattatcagccaacggttggctcgttagtcgttatctggcttaggggtgtgttcatctacacatcgacccagtctaaaacggaaattagctgtttttacggtttgagttatgcgggtttgacggaagcaacttcgagtcggacacccaattggagagataaatatcgggcgtcattacggggtgtgtttagattaggggatatcacatgtataacttaattttaattttagagtgtcacatcggatatgatattatatagggtgtcggatatgatatagggtgccgcatgggttttttttgacactaataaaaaactaattacataatccgtcagtaaaccgcgagacgaatttattaagactaattaatccatcattagcaaatgtttacagcttactgtagcaccatattatcaaatcatggagcaattaggcttaaaagattcgtctcgcaaattagtcgcaatgtgttgaattagttattttttagcctatatttaatatttcatgtaggtgttcaaacgttcgatgtgatgagatgtaaaattttagggtaggatcaaaacaggccctatgtcgtccgatcaattctgtatgcacgatcgaagggactctgcatgctcgaaatgactttgagggactctgcatgttgatttcagtgacttagagggtgtttagatcccacacaaaaaatttacatcccgtcactgttaacgaccaaatttggtaaatcatagatcggattcgaagttacaatcaaagcggatttggagagactttgtttctcagaaacagagtacgcatcggctattgactgcatcggctgacactgaatcagacaaggagaagcggatgtagccgatccccggaagatggttctagaatcattgttgggatcggttgaggcgccgcacaagcattgccacgagtggaaagagtccaaagaagacaattgtatctaattaatattttagtagttttcttagagatattttcggtaagagtcctcctaagaggcttattcgtatttttaagttataatagagatagagtcgtgtccagcaatgacatattatgtatttcaggtataaatatggccggacaccttgtaaaaaaggagatcaataataatacttttggcgcatcaccacctttatctacacttattgttttcgatgagttcttactttcgagttgggctgcattgggttcgatctcagacgaaaaggtaaagcttgttatggcggtttgcattctcgggattagtgcctacatcttcatgacaatctaatcctgttcatgtaaatcgccaagttatcatatatgctatataatctagatcaatatcgttatctgaccccattggctagtctctatcatcaaagacagccgatagggttagataccaacattgaattagattatatagcatatctaccatctaaaaaaggcttttataagcttgtttagatcttgtgtttttcttcgtgcttaatgttgcatcagttaagtttgatctattaagtaacgtgtagaccataatatctaacttgttttataattgctagtagagatagcatcagagattcagccgatcttacctggtttagtcatcttgtttccttgtatacttacttgatatgctaaacctgccctttatattaagatatcgcttggtcagaatatattaagcttgttgttaatctattaggtcatcctgttattagattgattttggttcagtatatttcatcttcattgatatcttggtacagattagtatcggagtactagccaatacatattaggtttgcttcatcggctatgctatgaatctatataatctttactttaaagtatttttagacatacgtgatttatactgtctcggcgtgctgtccgatctatcccaatcactgggtttaagcataattcggattatatagttattgatatctatagctgatcgagtagatctatttattcttgcattacatgttctcactaccgatctgattcatatcgcatcgccctggtgttaaatgatacgtcatcggcagtctagccaatcgactattgtttatggatttaaccttgttcttttttatttcttgttggtagcaagatcaaaccaactggccgatgacgtatattcaaatttaaaatcccaataacaataaggagaggaggcagcggatggactatatagaggagtatagtggcaatatttgacgggacttctaaaaattataaaaacaaaactcaacgagacaataaactctacaaactaaaaggtctaatttttaaaggttccaaagagaattaatagaaacagtggtagatcgagcaagcaaataaaaagaggagtgataaataagtaagagatagtaactgcgtgacttttaaaaactataaaattagaaacacagggatgataaggtttggtatttcaaatacttaagacaatgagatagctatttatcaaattttaaataaaacatattaaaaaatagataattttatatgggtgctagccgcacaattgcgcgagccacccagctagttttaataagattaacattaagtacatccaaacatgcccatgttctattaacattaggaaacgtggtgcctcctagtatctactcgagcaccaaaaaaagcctcctctagataagtatcatcttcaagtaaggtgtttccaaggatggtatagtcatcttcactgatggtttcttcaacaagccgaatgatttctttgtgcttcttgacttgagtagtagaatatcctcctacaagaacaatgtacttcccttaaaagcatatcattgattgaaacaagtgaatagcagcaagttagaaagcttctaaatataaatttttttgtggcgtttcctgaaagagaaaaatactccatgatacaattgcgagattacactttaaagggaattttttttggaagataactattcacatatggcaacaagaagatgatggtatactaaaagtcaattaaacttcctaacgctcctaagccaccacatagcatccctacaaacactctcaggtcaccacattggcgctatagaaaatcaaaacatttagccattgattttcattaaatctagtggacccattattttccaccctcccaaaaatacgtacgtacttctttttctttttttctttcccaaactaataattcgattccatattatctatgcttttatgctttaatttataaaaatatatttgattagtattattaaaaattactcgcttgtacggtaaaataatgtcacattactaaattatggttttctttatttatatattattagaaaattaacgaacaaatatattattttgaaaccaacatcctctctcctacttagactacatttgatctagctcattggttgaccttatccattatccagggcacgttaaacgacgtaggtcgtcagcacaagattaattaaatattaaatattacaaacttgaaaatagatttatttttctaaaaaaacctttgataggaagtatttgcaaaacatgcacaatttagtagttcggaaggcatgatcacgataaacgagggagtagccaatccaataaacactttagaacttaatcttaaatttattacttttgtacttaaacacttaatatgtagtatataatatactttgtcaatccaaaacagcctaatgtatcgatcgtatgttcctactaatcctaatgtatatagattctatatacaaaccactatccaccaatcgccaagtcatattgtttacaaggtatccgtgcatagtgcacctaatatttagctgacatgcaatggacatgtgtgtgatcaagtacagaaaataaaggaagatagtaagtgggcaaccatcaagaaatgatagataagtagaggatgccatcaaggcacaacaaacaatagttgagtacaaatagattgtgattatgagtaatagtgtttctacactcctacaaaaactccttatatgccacgtgatgctctaataaattagagaaaatctaagaaaaactataagacaaaaaagcaaaat

SEQ ID NO: 73827 - DNA, 984 bp, Oryza sativa
  unsure (1)..(984): unsure at all n locations
gcggccnggtagattgactanctcgnacccnacacatatacatatatatattttttttcttgtgttgtgtgggaaacaaattgtttagttttacatctggaccatatgcaatgaaatttcattgagttcctctaaagttggcagctcatgtcgaaacaatttatttggttttctatattatgtcaacaatatataaaaaatacaattcatgaattgtgtgtatactacttattctcacctttctctccttgtagggacatttcgcattccttatctgccatgaatcctcccatagcaaaggttttgcttgtctcctcttcgccattacttccatatgacaccgagacttcctttagtccatctgcagctcgtaaggctcatttgtttttattttcaatagacatttatatgagacatgcaatacattacactaatctcctttagttccaaataatatcatcttcgtttatgtatatttatttcttatgttctggggggaactaattgtgtagtttcacttttgggccatatgacacccagactattccgagttcccctacagttcatggtccatgtagaaataatttatgtagtttttccaaatatgtcaacaacatagagaaaacacagaacacataatgcactctcaaatattgtaccttcatctacatctgaagacttcttgcgttccttatctaacatataccctacttgagagaatgttttccttggctcctcttcaccatcacttccatatgtcatggagacttcctttagtcccgctgcaactcatatgcccccattttataattccaaatatacatgtatgcaacatatatacactacatgtaacatgaacatccacaagttctaatgtaacctccgcttgttagtatatatttctgatgtgcatacctgttgggaacaannatgctagtttcacgtttgagtcatatgacactgagacttctctgaggtcctcta

SEQ ID NO: 73828 - DNA, 1491 bp, Oryza sativa
  unsure (1)..(1491): unsure at all n locations
tgaacgcacaccagggagtagatttgttaacatgacagaaatagaagtgggggtgccccccgccaggaagattatcntcccgacggcggggaaaataacggcaggcggggacagancattatttgccaagaaaaaggagagtacgccccacacgcaccggataggaccacgcggaattccagccagagcgagtagatatcaggacgccgagaaaggacgaggacagacatttcatataagcaccgcaagagacaacagaagcgatgcaaaaggtagaccctcggcgatacatagaaaaagccggaaagaaaaaaacttaccgcagaggaataaacacaagggaaaggcaagagacattaaagcgcatttttttgttaaaagatgaacaatttgtgacccagggcgaaaagaaagctgcgtacataataaaagaaccccggtcgaatctgggtactttcccattaggcttccgccaccgacatcaaaataggattccaaacgacgacacgatcaagagacactgttttgcacaaataaatggnggtgnnngggtcntcaacaacaaagttgtataactcatcaatatgtacaacttttgttttggtcattttgctagatgactttgtttcaataatttgaatttgaatttcaaattatgacaacttcgaacaacatttacaagtactaaattatttcaaatggaaaactcatcaacaacaaagtggtatagctcatcaagatctataatttttattttggtcatctcttacaaatcgctttgtcagatgaagaaatgatccaaataaaaattatagatcttgatgtgttataccactttgttgttgatgactttttgagttgaaatcatttagtacttgtaaatgttgtttgaagttgtcataatttgaatttcaaattcatactattcaaacaaatacatatagaaaagtgaccaaaacaaaagttgtaaatcttgataagttatacaactttgttattgatgactttttcagttgaaatcatttagtatttgaaaatgttgtttgaagttgtctaaatttgaaattcaaattcaaattattgaaacaaagtcatatggtgaaatgacaaaaacaaaagttgtagatattgatgatttatacaactttgttgttgatgactttttcatttgaaatcatttagtatttaaaaatattgtttgaagttgtcataatttgaaattcaaattttatatagttcaatcaaactcggatgaagaaatgaccaaaaaaaatggtagatctaaatgagttctacaactttgttttttacaactttttcatacgagctgatttagtggcataaaattcgattcaaaatttgcaataaaaattttgccttctcaccactttaaaatatttcatctttccctcacctcttcctcccctaatattttcccttctttcagtgccggcgggagaaagacctaaatttcaacatgaaatgaccatt

SEQ ID NO: 73829 - DNA, 19008 bp, Oryza sativa
ttgtatatagtgtatcatgaaacacctggtataccatggtccttgaggtatcatgatacacctggtatctcaaggtatcatttggtacctcgagacatcattcggtatcctcaaattatcacctacggtacccttgaggtatcatttggtaccctcaagatatcgcccgtggtcctcgaggtatcatgagatacactcggtacctcacggtatcatttggtacgctcgaggtaccatgatacatatgataccctcgaggtatcatctagtacgctcaaagtatcacctacagtatcctcaaggtagtgcccgtggtcctcgaggtatcatgatacatatgggttatacatggggatttttttaggtatcaggtatgttatagtgatacatttagtctctatgctctagaaagagatatcaagtgattcaaataaaaaaacacaaagaaaggaaaagaatagtgaaaagaaaaaaaaaggaaaaaaaatgtatggttgggccgtggcccaatacacaggagcgcaacagccctaccgggccagctggcctatccatgtactcactctatcctataatataagacatgtacacattccaagattcaactttaaaaacatttaaccaacaattattataatataaattaaattttatttgttaaaattattatcattggattgacatttaaatttactttaagatggttataaatttgttgcaataaaccttatagtatatgagaaatttaaagtcaaagattagttttgaagactgtgccaatggttgaccatgtgttatattatggaatggagggagtacatatgtgcaagtgtaggagtccttgtggtctagctagccacgtaccgacgtatgtatgtataggagtcctcgctaaacgtggtggcttgtgtggatggaagcgtgccatgctagactgtcccgttgaagaatggtacaccgttctttaatatttctatctcagcaaaccattaattcatcaacagtgtgccaacatgatggtactagttttgcagtttttattaaattaataatacttcacaaaaaaggtcgttcattttctgggttactaaagatgtaacgagcaaatttcttgttaactagatctggcttatgccttttgttaatctcctttagtccactgtaatagtaccaatttgagttccctttccttagcttcacggcttgtttgttgaatactatgtgattgtcataaccaccatgatgattggcatgctcatgcccatcttctggattgccaaaggtgtaataatatgaaaatttcttcttagctaggtgaacatgatcatgtccatgtgcgaggttgccatagattgaacgtgaaaatttgttcttagctagcttcagcttaggctttttgtcaatcccattcacttcgctgtgttggtataaatctgaagttttcttctttagcttcatggcttcatagttgagtaccatgtatttgtcattgtgaccatcatagtaaacatgacggctaactgctgggttgtcataaatgtaacgtggaaatttcttcgtaactaggcaaacatgatgatgtccatctgctaggttgccatagatgtagcgtgaaagtttcttcttagccatgttcagcttagattctttgtcaatcccatttgcttcactgtgttggtacaaatctgagtttttcttttttagcttcttggctttgtggttgagtaccatgtatttgtcattgcgaccatcatagtgaacaaggtggtcatttgctgggttgccatagacgtaacgtgaagatttcttcttcactagattaagctcaggcttttggtcaatccccttcactgcactgaactggtacaaatatgagaattctttctttagcttcatggattcagtattgaataccatgtgattatcattgtggccatcatagtcaacacgaacatgcctgtctgctgggttgctatagatgtaacgcaacaatttcatcttatctagtagaatatgatcatgaccatgtgatgggttgttattgttgtgacgcgaaagtttcttgttggctaggtctagctcaggtttcttgttaatctgatttgttccactgtaccagtacatatccaagtttttcatctttatcttcagagcttcatactcgaataacatgtgcttatcactatcgccatcatagtaaacacgatcatacccgtctgctgggttattatagttgtatggtgaaaatttcttcttagcttggttgtctagcttgggattcaatttgagtattgagctcttctcatcagcccccttggctccactacctgatgtaagaaggagattcttcttctggttgcctgtagatacatgcacacgatgtcacagttcttgcattcgttgatcattataaactgaactaggagttggttattttcaccactgattttaactgtaaatgaaatctttattcttatgcgacatataatcttccccaaaggttgctcattcatgtactgttcttgtcaaaacatatctgacatttgtcagaatttacatgggaatcttccttattctaattctactacctccaccccaaaatataggggtagtgtggtgtaatcagcctcacatttgttacaaatttataaatagtgccattttacagttcgcaaattaatatacaaagtgcagtaccatggcacctttcaattaaatactatcacaaataaatgatgttttgggaaacaatatgatcatgcaccaaggtattagtttgattatgaataaattaataactagtataaaacgtataaaaatgaaccaaagtattttgaaattttttgaagataaaactagccataccattttcaagttgaattgaaatattcaaagagatattgatggtcaaagtatattgattgcatgcattacaaacattacccaactagtaggtatttaaattctatctttttttctagggacgcaatttgaagatcggatatataatttaaaatgcatatgcaggcagaggcctggattttattttcaattattaaaacaacagtttcaaatgttatgctacatttgcacaatcaactataaggcagtaaatttatctgcatcttcatatactgttgatgaaattggcaaaattcaacacttgcaacccctgtacatacgtacttgaaacattagtattttgtacgggattatatatagacacttaattttagtggacattttggactgtcaatgtccaaggcatatgttttggttacaggagagattacttactaaaacctcatcaactttgtttgatttgagttatcaccttataaaaaatttaataaaacttgagcaagtgaacggtattattatattgatcaagtataactatatattgttaactttccatgtttatagcattaacttcaaataaaatatgcatttggtcatgctggttttgagtgtgattttggctgtgttgtaccaccttgtaattaaatttgtactccctctgttccaaaaagaatctaatcctagagtgaacatgtgtctagattcattattaggattgttttttttaacaaagctaggggcccagcttttcaattacactagaaaatggcgcaccagttggcgcgcttattaattataacctgtatataatacttataacttatttagaatatatatttgttagtttttgagtttttctacaattttcaattttatcaattttatctgtttttaaaactcatggaaaatagactgtatatattttctggtttatttagaacacaataatttcgcacaattgtcagaacggctagttcaatgctcgtaaaatttatttaggatagagagtttagttttctactaacttatcgaaggttaaaatatttccaaatatcataaggaaatttgatgtattttggtaaagaaaatcacaaatctgaatatttttttctatctctaggggggtatgtgtaaacatcataatttacccaatagagtttcatatgcacacaccatagcaaaatttagtttgatatatgcacatgaattacatagcaaaattacttgtccaacttataaaaaaaatagcctacttgataataagttttatcttagggccatttataaacactccaaaccgagggcctatttgtaaatttaaattttttagaggaaaaagttcagaaaattgttttggtagaaccggacatgttttttttatcctctgcataatttttacctggggtgtgtaaaaatcataatttgcccattagaggtgcgtatgcatatcatttagcacaattttagtttgatatatgcacatgaattatatagaaaattttaatttgatgcccattgcctcatgccagagcaaaatttaaacttgataaaattagttgcgagctacctatcaagcaaaaggcacccctcttgctattttattttctatccacatttcattttatttctcgtttcaacgggtgaaaacaatctatctattatattataaagatagcttgaaaatgatacggtatttgctttgatcgcatagaaattgttacattaattaatataaaaagataatagttgtatatacataatataatgattgtatttatattaaatgtcacaaaactacaattatttggttaaatctaatcatgtttttaaaatatgttacaaaatatattgaacaaaagctaagaattgcaaatttaattctataattaaaatatgttgcacaaaacaataattgcaaaaatgaagtacatgtaatcctagtgatatttgcgtgggactttcgtcgagtttgggtagaatcatagtcggtgatattcggtgcaccgtactaccgtactatgtaggttatttgctcagtgaatcatagtcgaaaatactcattatttctcatagttcttgttctatgagtggtagggtgcaccataatattcaaaaaatgctatccacttagtatactcattcgtcagagtagcttggacgtaccgtcaagagatagaagtgcttgctcaatcacattgagttagtgaaaagaccacttggtttgatggtatgattgatcttctacgtccattataattaccacattgaatgtatatgtcagatatacttatagattcaacaaacttctagttcacgataagtcatctttagttaaaattcgcacaaataattccaatatattttatgcaattctatatattttaccgcaatattaattaaaaataataaaagcattacaaataatcaataatcataaatgccataaataaattttataatcatgaatatatgaaatataatttcagtgtattttgcaaatttacaatgccattcaaacaaatattccaaatacagagggccatttatgtattttctagaaatttcagggtttaaaacgcaaagtttccaatgcagaggaatatgcgattaatttttggaaaccacaagggcctttttgcaaaatctatggagattttttccttcttctctactttctttcctccttccttatctttccttccttcttctatttacttttctttccccttcctccactgatggcgccagcgggtgcagaggctggacggacggcaacggcgcggtgggtgcaaaggccggtgaggcgctgcggccggccgttggcgtcgtggccgggtgacggagaggaggaggccgtgtggcggctccgtgcgatttggaggccgggacggcgtggtggggctggctgcggcctcggatggaggaggcggtggcgacagctgcggccgctcgcgcgcgcggatcatgcagcggcggcttaggcgcgtggatccggtggcggcggctgctcgggcgcgcggatccgggtattcccccacacggatcctgagtcggcggcggcagcgtagtctcacctccccacggtggcggcgtgccctctcactccctctccttcccgtccctttcccctctcttctctatcgccggcaactcccacaggccggatccggcgtaggcgtcggtggcccggttgcggtgccttcccctccaccagatccggcggcgagaggggaggcggtggctgcccggtggcgggatgattatttagatgttcttgtgtgatgttttagtgaaaaatttctgtgatgtttttcaatgtttcctatgatgttttttggtttgggattgggattgattgatgcggggtggataaggtcgatgcatcagctcgattaggagaggggaatctgttgttcttgaggatttttattcaatgtgatttctttatctactactgagtcctgactgttctagatgaggtccattggatatttttttttcaccgttgatatgacatcagacggccacgggaggggtgcgcatacgtggccgcttctccagccgagaatcccgctggggctcgaagcgtggtgccacgtggcccaatcactgggcagggttagaaccgtgcaatcgtatatagagatatgtaggggcagacctaggtccaaggcaacatgggtcatggcctggcgcgggttcataatccaatgggtctagctagggacagaatagtatgggccagcttgggccttaattagcctatgccttgtccgcccctataactatgatgagatcatatggcggtataataattgtgtgtgaaataatggtatatatatagagggagtgaaacttggaacacatacatcattacaatcaacaggtgacgatgtcgttgctgtaaaatttactctacaaattatgtgaagtaattgttatataaattgaccaacatcggtcgaggagcagagtgatctaatatactccatgcatttatttttgtaaggtttattttgattctataagaaatcaaattttgtagattttgaccaatgtaaagttaggaaactcaaaagtatatttaattaatgcataaaattaaactaaaccatacgctttattcatacaattaatattggctttatgagaaattgatggctaaagtttgatcatgaagacattttataattactatatgtacatttaaagtagtaagtactacttcaacaaagcataggagttaaacaaacatttataatatgagtgaggattgagtaaagtaaagtaaagtatttcttgtattgtacaccatccccgcaatccaaactacaaattgctataagttgtatagtaccacctacacattcgatgattaattatgcatctcctctactatttttataaaaatagtagaattttcttacgccacatgtgtccgatttggccaacattgtctccactcgaagcaatgagagtctgcgtccgattcctgcgtacatcgtgcaacgccgcacgtttgttaccaatttgcgttgccggcatccgattggcattgatgtcttctctgcgtagcccactatatttccttccatatctcgcatgatctacgttgccgagggaggcgacttgacatgagacgggctgggccttcctgcatcgaccgtgccatgcatatagatcgaatccgtttcagtccgaagcaagagactacgatggaatatattgacgtgcaatcctttcgcgcattggcaaataaaaagggacgatgatgggataataaacaacaagacttaactgtctatctgtataggttttgcatggatgcaaaaatcatagcaagggctcctattttcatcaagcaaataatggccaactcgtcgaccgacctcgagcttcctttctagagtaggatatactgcatatacttaatatgtgatattaacattgcttcaacccattacaacgcatgagtattttctctagttactatataattgtatcccactaattagcttaaatattttatatgtctttccacaggcttcgtaatgatcactaaatcatacccgtacaattagattcattagtaaaatcatagctgtttgattagatctatatgtcaatctctatctatatactattataaaattggagatgtttctgttggaattttggtacgttatccttgtttgagttggttgtatgtcgtccgtatccaattcgatgcgaatctagaataactattatacacccatatcccatcccaacccaaccctaccggccaactctatcccgcgtgcctccaatcggcgccacacacgaccctcccttgatcggcatctttttttctctcccttttatttttatttttctcattttttctcccgataatcctaatactctccttctccttctaatctcgtctcatttatctttttctcttccaaatttccctcctcataaatagtttccttttgaatttatcattgtttaaggtgtgcatacgacaagtttgttactctgcaaatgctttccaactatagtaaaaaaattattaattgaataatcaaaatttcagtctttgatcgatgagtatagcaaaatgcacatgcgtcaacttatggaatggccacccgattgatttgtgaagctatggaaagacgtacataagtgattcttcgtgtgatgacacatgaagcacgcacaacccggttgaatgctatatatggtttctgactttgttttgctattgatttgtttgtttaatttcggtttgttgtttaaattgatcgagttttattaatcgtgaaaattattttcacctgttgcaatgcacatgtatttttgctagttatttaaatgccagaccagcccggaccaacttctacaaacaaatgagtccatccagaccaacaaagtaaaatcagctattggcatgtggcacaatatactagtatgcagggacttagaccatgtgcactttttccatatgaagatgctagggggatgtgtttggttgaaaggaaatccctacatggatatgaccatccaacttaactatgtttggttgataggaaggacgaatcatgaatgagaccgttataagagagaatatttcatgcagatgctggatgagctatttcggaaatattggccggatgagaccatccaccttttctaatcttgacaataatgataattaatatattttgttgttaaatagtaattaattgtcaaggtttgtgttgattagagataatgagtcattttgttgttaatttgtgtataatatggagaagttaatgataactaccgctaatatagaatatattatgttattaataaaaactttcatatttccagttattcatccacatcaatctaaccaagtaagaaactaaatcattcccatccacctaacaaattaaacaaaaaactggatcatatccctaaaaaattagatcatcatagctactcaaacttgacaatcaaccattaatctggatcataattcctggtcatggcttatcccttttgaaaattttgttaatagctagtccctagttacttctgttaagattgttctcagatacgttacaatgagcattcacatcgatctactcaaacaagtaccaccataatacctggggttgattgtcttataccaaaaactcttatggttttgtgcaacttgaaccataataccctgtattttatataatttaatatgtttttttatgcaggtgttaagtaattggtgctaaaatctagcactctattttggaagaaaagaaatgagaggaatgcatataaccagtaggaatcactatgaggtgctatagcctataggctgcagtattttttaattacttagctatcttaagcatggcctatggttccatcttggtgtttatatctagctactactatgcaaatatattacccttttatagagagagaattaccagatggttgtgtcaagaggttgagtatggctgatggtattggagaattgggatgaactgtcttccagtatgccatcacgtcagccgtgcggtctggcaccatcatcgtcatcttctttgcgctcaacaacttcctcccctcgccaactccgaccaccatcacctgtcaaccaaccaaccaaccatcatacatcactactgatgtagccaagatgtgttatttcaacaaaagctttcatagatgattttttcaatttatacacttaaaaaaaaaactaaaacacaactaaaccacccactacaatatcacttgtaggctacacgggccaatttcacaccacactgcaggttgcaaacaggcatgggtattacgaatctcccccaaagattctaccataggataacccaattcccgccacctaccagcttggcaaggaacaatcaaggcatcgttcaacacacatgtgaactatgaaagtatatatagcctgtgataatttgtgacatatacacaaacatcatatcgtgtagagtgtgattcaaaaaagtaaattattccttgcaaaaaggaaaagaagaaaaaatatatcgtgagtgggtgaaaaagcatggatgtaagagctcaacttaatggagacaacacttacaagaataaatgagaggagtgacaaaagagtactcattgcttagtctcagataattttagcattggctgcttatagttcttgctcaatttggtcaggactagcacaagaggtatttataggctagcatcgctatcacgatcacgtacaatcatctgctaaaaaacaaagaaattgagaaatggtggcaggatctaaaaattaattctgaattaattttccatgctggggcgcacatgctttttttacactgtatatgtattaaattcaaataaaggaataccctgtgaaaacagtgtaaatccactgcaaactttaaaaggtattaccaaagtaacttttcataacgtctatgtatcttattatataaaattttacaatggcgaaagatataaaatcatcaatttaaagtagtatggctagaaaactacatgaaatttagtaaatttacactgtataaatgtaatacatacattgtaaaaaagatggaaatccaaaaatgatcaatcaattgaacatctaatctataccttctataaaactacaatccactaatcacataaagctcaaaatgcaagcataacagttattagttaacatacaagtagatcacacatcaacccactaagcactaaaagatcaacatgcatagtaaatactaaaacttaaatgtaactacatacattacctataaattattattttttaaagctcaacatataaaaatgttaattcattattactcatatcatttccacaatatttatatctaaattcattcatcatttcaacatcatttaatacatattcattcatatatcctgtagcaaagcgcggggtgtcacctagtaactgctatacaacaatcactagtattctcgattgacaacctcctcaatccaagcttccatctcgtggtgcttggtcacgcagttcatacgagtgaacgaaagtgagttttactatgaacttaaggatactgtgaacgatctcctttcagaaatcactcctgttgagaggccctcctcctcccttttttctcaatatggaagagaggcagaagagaaatccagagatagctcaactttttcatggaaaagttggggatcgaatgcaagattgagtccctgctggatggaatggaaacactagaaagatcataagaaaccgagctcaaagtgaatcgcaagagaaccccccatcccttagaaggatttgaagctgtttagacactcatagacaagtaaaatccaactcaggttcctcgagaagtgaagtgaacgagcaaggtaaaacacaatcaagttaggaaaagagtctttcatgccaaggtgaacatagataggtagagttagtttattttccttaattaccagagagaagacttacatgcctgtttgactccgcatatatacccccattaaaaagagctctgcatatagatattcgatgacatgtaaatcaaccattttttcctttttgataatcctacggtctgctcttttccctggggtgctggatatgttcttcattgcttccgacagcaatatttcaacctgagcggcttttcctttatatatgtaggtattgcaatgaaacatttgttcctagtaaaatccctaatctaatcttgctagttagatctagagacaatgatgaaattcgtaccacttaatgtgttgctatgaagaccagaggagctgttaagttactctagttaatttggccacagcctaatttgccattagtgtcacattcacaaactgctgatcacaactgtactaaattttggcgactgtctgggcatataacatacagacaagtggtgtaataaaatgtttggcttgattcagttgtaaaattgaaccaaacagttcctgaataaattgtgcagctaaccaacaaacaagcccctcaagcttcaacatcattttgttaggtagcagttatgtttcgtttggatggtctcttgtgtgttctgtttggaggagtttttggcagctgtagttttcttgaagtcaaaagcttgtctaaacaatatagcttttcatccagattcttagaagatgtagttatagaatccagaaaataaactagattctcaccagctgaatttctactaatagcttcatagaatctaaagctacctaaacatgcccttagatgatgccaccagtgggagctattctattatcctttttagctagatgtgccatgactatgggtttgtttagccaatcttaaggttttagctagacgatgaaatctgtttgttgaataattttctatgtagtatgtttgtttcttattttgaaagaaatgtatggcatggttcctataactttaaatttttaatgtataatgtcattgacttttggagatatgtttgactattcatcttatattaaaaaataactaattagcaagtgtgaagaaaatataagttgtgcttaaagtagctttagtaataaacaaaccacagtaaattaaatgatagctacgcaatccttttagtaagaagaatttgatcaaatgttttctcaagtatagcagcatcatatattaaaaacgtacaggaggaattatagcacccgagggagaaaaagagggagcgaagggcttccagcagttcaatgggattgtaaatacttttggttttttcctcctttcaattaaattcccgcagttcttctgccgtcgtttctgcttaaaaaaaaaagggcttccagctgagtttcatgacagcgccattaattgattgttagcccgatagaggctccacgacaactcccaactaatatcatgaacatttatgcatacatgatctgacgatcggtatgtgctactgacttggaaggtatagaaggtttggtatggatcgaccattaataacacgttggccatattattaattagttgatgacctcaacggtatctaaaatttaaagtgtgactttcaaatacaggaagttagctagatggcatgtatgccattaaaattctgtttgtcactcccctttaaaagaaattgtttgtcacaaatagacagttcctatttcgaactaacacacaaatatgcaactgggtgacaaatgtgcccctactttcgtctgttcaaatgatctgggtttgaacaatgatttttgtttgtgtacttaaccaggaaaacatcctctcaaaataagaaaaatattgttgggaggaaggtgtagtatagtctattcatgatattttactagaattaattttacgatccatctattttactagaaattaatttactcacattgtttaattgaaaagacattatccaatataatgttttggaatagcttaaaatttatccaagcaaatatatatggacaaaagggtccagtttgagttttagcaaatgtattttgaagcgtattttgacttgtgtttagggtaggacacatgcctcgggagatttgtcatccaatggacaatgacacattctccctgggtttggaataataagcatgacatacttgtgccaagtgaatttttagaggcttatttaggatcgagagatgttcctttgaaatctttttttttcttataacctgaggagatccaaggtgacaagtcggccaccgaatactgtcgccacttccggagcatggatgatgcgatggccgacctcggcgaacctatcaccgagtgcacgctagtcctcgcactttcacgaggtttgaataaaaagtacaataatctgcaaactgtattgcccttatagcgtcgcttccccaccttcctcgaggcatgctctcagctgcttcttgcggaaatcaacaagggacaacagaccaccagaaccgccattgccttcgtcgcctccaccaacaacggttccggtggagctgggtctgtcgtcactgctgcatccagcaccaccaactccacctccgggaacggtggcaacaactgcaatcactgccatgggtgtggcaatggagatagcggcaacggtggcactgctcaggcctccgaacaaggtggcggcggcatccaagccacccactcaggccaacaggctgcgggagagtggcaactagtcccaacaccaagtcacgccgtagcacaccccttacaatccctgtgccgataccattcaaatatcaggccatgctctcagcatgctgggccaggtgttggcggtccttaaataccaaatgaaacactggacgtagtggtagggtttgttactaaccaattccacaagtgttggtaaatatttgtatgtagttgattatggatgaaagtacacctgctgtgtaacgaaattgtcctccaaacgtcagaacatcgtctcctactccagcactaaagccgagtatagagcatttgcaatgttgttgttggaacatgctggcttcaccaacttttgcacgagctgcattcacatcccactcgaaccactttggtctattgtgacaacatcactgcagttcagcaccagcacatcaagcacgtcgagattgatctccattttgtccatggttgtgtgactactcgcactattcaagttctacatgtgtgaactacatcccagtatgctgatatattcacaaaagggttgccgactgatgtcttctttgagtttcggtctagtctcaatgtccagcctgttgacgttgcgattgccgggggtgttagcatatctcatgtatatcgcatgttttctttcttttggccagtcctcccaatatccctcccaggcatgtttctataaactggttgagtaggatactaggataaggatgattatgtgcctatatgtactcggcgttgtgatcaatcgatattgtgttgagtccatcaatctaagagtctgttgggccactcctctcaggctctcacgatgcctgcgcctgcacacgctcttgcacttgacgtggccgatctcacatcagtcatggaacaccaatctatggagcttgcatgattgtgacgacacctgatctctatctgcaactctgtgtctccattttctcatcctggatccaatgggtggcggtgagaacattggggatattatggaataagttcaccggaggtccctcaatttaacaccaagattttttgagatcccttaaccacaaaacaagaaatgtgcacccctaaacttatataaaccgtgcacataaggtcctatggcagtatatgtgggtggtttcgctgacgtggcatcctagtaagcaaaaataaataaataaagtacgtggggcccacatgtaagagagaaaacgatatgggcccacatcccttgtttcttcccctttcttctcttctctcgtcttcttcgatgggccgagacgcgcggggcgacggctggcgagagcggccgcggcggcggcggcggcaggcgaagaagtcaggcgcggtggtggcaggcgaacgcggtggcggtgggcgagagcggcggcagcggcgggctaagcaggcaggggcggccggcgaagcaggcaagggcggcagggttgagcgccggcggccgcgcgtgcccaccgtggtcctccgtgtccgcctcgtcgtcctctgtggttgcgccgccggccgcgtcgttgaggcggctgctcgtcgcggtggtcttgttcacgtggccgagcagagcggacggcgggcggaggagggggccgcaacggcggaggtggccgaaggaggagcgtggcggcggtgggcgagctccgcgggcctacaccgccagccgagccgtcatcgtcctcgtcgtcggccgagccatcctcatccgcgccgagcgccgcgcaccgctggttccccctgccaactacaccctctccgcgtccccgtccgcatcctcgcgctctccgtctccgaccccgacgtcccgctcagccccgccgtcgacgagtcctacacgctctccgtcgacaagtcctacacgctctccccgccgtgctcgtccgctcgcccaccgtcgtgctcgttcgctctgcccgccgccgtgctcgtccgctcgctcgcaggccgcgctcgcctgctgccgctcggctgccgcgcggacccgccgccgcgctcgctcgctgcccgcccatcgctgctccgccctctccgccgccagcgtctacgcggccgcttcttgccgctgccggcggcaacggcactcccggagtccatggagctcggcgacgacgcgttgagcgagctgcaggcggccgagctcgcgtctttgctgctgctgctgcaggtgcaactattgctctcctgggttagcacttgctcttgctccatctgtgtgacgagctagcgcgcgacgaccaccaagattgcttgctagtggaccgccggcctcactcagtgaagaagaagagaaagaggagagataaaagagaagagaaggagaagaaaagcaaagaaaaaaaaagtactattgatatgtgggccccacgtacttttttaattttttttttactagaatgccacgtcagcgaaaccacccacatatactgccatgggacttcctttgaacggtttgtgtgagtttatgggtacacatttctggttttgtggttaagggacttcagaaaatctcgctgttaagttgagggacctccggtgaacttattccggatattattgacaggagcagtgtggagccaaatccgccgctgttgctgattgctactccatcaagggctcgagctgtgtggatcaggccgcttccgccgcttggcccactccactagcttgcctacaccctaacacagcaaggggtgggcacatggctacggtgtaggtgcccccacctaggtgaaccctcactttacagtgtagattgcaacaacaacatgtaaattacaacaacgattcttctgttaactatttcgacgaacctgcagtttaatctgaaaatttaggcaaaatgtgaccattgcagtctttttcttctttctcaaacacactattccagtcttttggaatgaccctaaagctgatcagttaattgtgaaggaaccctctacttcgcagaagcagaaatgatatttggcatatactttgcagaaacagaaacacaacttggcggtggctggtttatttagaaatctctgcttggttttgatggcaagcatggtaatttcagaattctccaattcttgttgacaaaaaaattctgctggttgaacatggtgtgatagtgatttgagacattaatcaatgatggattatctgcttgcctgttctttctgttacatgagttgtggggtgtttttctgttaaattaatctaggttgctctcttgatctgatctagacagatcctgagcaaaggttgcaattaggaaaacaaaaagaaaaggtgagagagggtgctagttgaagttattgaatggcttagtatacctgttgactgtagatcagtcaattttagttcaaatgtttattgattttgtcatgtatactgtactatggtttgtgaagaacaagaagaatttgtatttggtctacttaattgatctaaattatgtagaacttcatgattttcttcagtgcaaaacatttctaaaaaactgccaattgtagctttttttcatttttctttgtatccccataaagaactaccataacttttttttttaccttgtgcgaaatgacatatgcaattttttaacaaagaagcagtcttatatcatgcgtgtgaggccatatatcaacattttcttcagtgcaacagtcttttctattctaatctgctactagaaaatcatgtgcctcacattttacaggatctttgatgatatgaatgcttaaggatgctattttgaattgctggttttctcagcaagcaaaagttgcatggttttgtctgatcattttttattacttcacaatgatgatagataggatattgcattgtgttgtctgatttggacattcttgaactgcagccctttaaacttatatttttcatattgtccttacaaataatgagatcttctcatcaaatgtttctagacaaacactgcttactacaggggaatctctgtgctctttatccaatctgcagagatgagggtaccagggagttgtacaaggttcttggtgccacttacatattgttatatgttatactatttaatgaatgtctaaaacacaaggaataggtcccccatcatagcaataagcttctgctttatgttaaaaaaaaaacgattctatgtgtgaagctttgtgatctcataggcaactagagaggtaaaagcacatggtaaacctaggttccactggtggagaaatgctctttactcccggtttagaaccctttgtagtcccaatttttcaaccgggactacgaatccgggactaaagatcgctatctttagttccggttcaaataaccaggactaaagatcaatctttagtctcggttaataacaccaaccgggagtaaagaggggaatctttagtcccggggatagcggcagtccctcgaggtcccttttctttcttttttttttcattgttaatttgctaatggctagagttaatccctgt

SEQ ID NO: 73830 - DNA, 8382 bp, Oryza sativa
attcctgcagccctgcagattgagattcacatacctggctagttggttttagtagagatagagctcaagctccaccagtacagtcatgctcgagctctactcagccagtcagccttcgctgcccctgccacattcattcgtgctcaagatttaatgtgcagccttgattaagtgccctagctccaattaagctagtactgccatggatgaacttgggctagaatgggacctattgactagttggtggagcataagtgtggagtgataacatatggtgttagaatttcccaccgtgccaccgtgattcattggctatgtgctaattgagctcaagctggagctctgccgtgtgccgtgttgagctcaagacggagactaccacacactcaagctcaggcgctgacgtaggtcaaacacgtagatggaacctgaggaagtgtggtgagctcgaactaaaacagggaagagaagagaaaagggggagatctagaggaagaacaagactggttcaatatgaaaatttttgcaaagatttctggttcaaaccgaaaagaatgtcctacctctagtccaacatgcaacaatggtcaataaaagtggcccaggatgcaattttctcatatagataagtgaattcctgataagtacttataaagtatacctttgaagtatatgcaaacccaaccttctgagttgaattagtaggaagaaacttgagggaacacaggtgccttctgagttgaattagtaggaaggaacttgagggaacacaggtgccttctgagttgaattagtaggaaggaacttgagggaacacagatgcaccagagagtacccagctggcagctgccagcagacgataactggattgaatgaacggtgagcataaaggtccatgtccttggtggagaaaactcaagtaaatcaaagatgtggacgttaggtaagccttattctccagttgattatgccctctttgactgaccaatagtaaattttgttattaagactgaaagaccaagaacggctatagagggggggtgaatatagcaattcaaatcttgcccccgaaaatactcatcaagccggatttctcaaaatccttactagaaccgcggctattagagaagccggatctagaaaagaagatagaaggaattcccgaaactagaagaggaagagaaaaggaattcccgaaactagaagagaggtgaggaggagtgagcaaaactcatcatcgcaaagttcaaattgcaagcggaatttaaattgtggaatttaaatggacaagacaaaaacgaaatccttcaaatcatttcattcataggtgatgcaaaataaccgctcaactaggagcaaacatacaccttcagaggaacattaacacaaacttaaaatctctcggacaaacacactccaaactaatcctaatacaaaagcctctcgggcaaacacactccaaactcacacgaaaactctctcaccaagcatctcaaaaggattaccaaaggagcaacctccacccttgcatccatctctctatttatagcctaagacccctaagacattgtctcaaatacccctaggacgaaaccctatctcagatgcaatcctggctgttcattcttccttacatgcgaaggaaacctcttagatgcttgccacgtcgtcgatccgaagactcctcgcacccccgatccgcgtcgtgtccatccgagcctatccacatgcgccatgtgtccacgtgctccgcgcgcgctcgtgctctggccagcgagcgaagtttcccgcgcatcccgtccaaaatctgcgtaggacccacgcggtatagctcccgcgagagagcgcgcggtcaagtccgcgcctgccgcgtgtccctcacgcgcgcgcgccgtcgccgagatctcccgcgctcgcctccgagttgctgcctgccgcgtgtcacgtcttcctgccgatgccgtggtccgtcgaacgggaggacgccacgtcgcccgtacggctcccgccccccgcatgccttgtcttcatgggcccgtcgccgtgggctgtctccatcttgggccagtcaggaccggccatgtggcctcctgctgaccgaacacccgagccggacaggccggttggcctctcttccagccagcccacatgcagtcatgcatggtattggaccatatgcacgtatgcactgccgaagcatcacaagctagctagctaatcaactagctgcccatgcttgcatatgcacacactagtgcatatatgcaagctcttcttccattcaccattttctttgcgcacccggcacttgcacttgaccttgcaaagtccgttgcaaagacctcctcatacggtgttcgtccaccgtgtgcaaccttgtgtccaatcttgtcacccggtatccttgatcgctttggacctcaactcctccctgagtctagtcccgatccaccgttgaccaagatcgaccccgatcacctacacacacatgaaccaaacaaccattgtcttggcacagatgtcgcaacctgaccaatgttagtccacgcacacacttcttgcacttccggtacttgtcaatttcccatcacaaaagaactgtaaccacacatggtttcacaaagacattcaccgcaaccaaaccaaaaaagatgcttccgaatgctgactgaccaatattgcagaaaggctagctgaaaccacaacataatggtaattttccacattccagaagctggaatcatggtaatgagttgccaaggcttgcttgctgatttaattttttaaagttatgcataggatgcattcctcaattagcagacatgtttgcaactccagcgttggcatttgcttgccattccgctggtaataagcctgttcttggtaatattcctccagattacataagattttaaaagtaaaatcttggtatatagttgatgaaacgtgcttgctatttttggtttctaaatactcctcttaatacacattacagaaaaaaaatgctagaaatcttgaatttcacgtagtgaaaagaagaaaaatcatcgtcaccgcaatcacttccagttaggcggctactcatcttgaccggttgaatagatatggcgtaatagacatgatcaggtagtgatatgcagggagatcgagccttacctcgaactagtgcgccacggccgccgagggctcctcctccatccccgcatcgccggcggacgcgctcgtatcgtatatgtggcgccacgtggagacagtagtggcagaggatcgagcaagggaacgccatgcccggacctccttgcgccgccggcgccggtccacgcgcagcctgcctcatcgcggatcgtccggccggcggcggaggccatggctgccggccacggtggcggccgtgtgtcgcctgcttacgcaaatggagacggaggaggatttgtgcggcccagttatcatcagcaaaagagagccgatctcggctccaaaaaagcccacactaacaccaggcaataattacgcagcccgtatgagataaaattttttaggttaattagatccatgccactgtaactttgacaaattaaaaaaatgttactaccattcgtcatatccgctacatgtcactgggaatttttaaaattggaacccagggggaggacggccatggagcagggccttctcggcggttgttggtgatgggagcggtggagccgcgtcgggccgcaacggccgcgaaggcacgcaaggccggtggtgcggcggagtgcaccgggcaacggggggcctgcaggggaggcggaggcgcgcgggtccgcgcaaggacggcagaggtggaggggccacgcatggccgcggaggccgcggagccgcacgtggcctcgtgcagtcgcgctcgtccaccgcctcgtcaccgacggcgacccacactctaccccatggtggacgcagctatgctccgacgtcgccgtcgtgctcgccatcctccttgaccgcttcttcgacatggaacaccgccaagcaaaccgacgacgtcggcctcgcgcggttggtggactttgccgacgtcaagcgcatcaacgacagaatgcatctatgggcgggcaagctagacccgctgctgctacaagggatgtatgaccagggtgccatctgacagtaggtgggcgtgcaggcagccacggggagcgcgagcagcgtggcggcaccgtgccacgctcacggcacgtggggccgatggagccggcagagccgcgcgtcgagcggaggaggccggccggcgcagacggcggagccgtggagaggagggggatgaggacgggaatagagacggcataagagaggaggatagaaattatgaccggagtggcatggttctaattttaataactttcagtggcatatagccgatacgatgaatagcagtggtatttttttaatttggcaaattacagtggcatagatccaattaacccaaaaattttacagccaggtccctcaatgtttaaatgatatcccccgcaaaaaaaatgtttaaatgatacggagtatatggattgctaatttgctatatcattcctaacgatctggttatttacaaccagtcaatcaggtctccatttgggatcgctatatggtaatgatccgaccttttgcaaatcaactccacaaacttttttacacacaggtcaaatggagaaactatttaatgtaaacaatctgaaaactatcgttaattcaaaaaatatatatacgcttgagatttgttcatgtcacaattgcgagtaaaaatttccgtgcatcaccaatgcatcctcaccgcaaaaaccatggcaaattcagctgtaattttactcacagttatgacgtggaaaaatattactatacatctatttttagatccaacagtaaattttcactgtatattttccatgttgtgggtggacaggaagcaaatcctctaacatgaaaccctacatgtcaagcaccatgtttctctgactggcccacatgtcagtcaccacatattagcagaagaggcgagcgccaccgtcgtctctacctttactcccgccattgagtcggcctgcaccttgccatctccgtgcccatcttctccacgcacaggtaggcgacgccatgtcccgacctccagaacacctcgtacgccgccgccgccgacgatccatccaccgtgccatggacgtcgtggcagtggcacaggcgatcgatggcgccaggcagaagaaactcatccacctcgcgcaatccgatgtccgttcgcacggctggctcctccctcccatcgatcgccacgaccgcggcgctctcggatcctgacggcggcagctcctccggcgaggcgtgcggcgcgaagatggccgtcacctgcagcagaggcggcggcccggaatcttcagaggatctcctcctctcgccgtcgccgccgtgaccagatgatgatggtcgcgccgagacatgccgctgcacgaacagtttgatcacctgctccgggaatgtcgtcgtccctgacagctcaaccatgtcactgcttctgctctggccatggcagcatgccggatttggacgagcacggtgagtctcggaatggtggatgctccagtactctggatcagtagaatccacaaaggggaagcagtagaaggctcggtggtgaacctgagtgagctcctgctttgcagcttcagcgaccggcttgaaactagggagaagtgaatccaagcacctggccacaatcccagtcacgttcgtgcttgctgtcaaacgtagaagaattccaagaacaaagttctcctctggcctctcatggttgttgtagcgaagcaacacaccggcttcttgccctcgttctgcgaaactcattggctttgatattaggtagtactgatttccatgagaactttcatactgcagtgctttgcctgcgaggagatgcccagtgagaggatcaacgagcatgtagttgatgctgcctattctgccaaactccatgaatttcaggaactcgccggcgccatcggcgaacctttcaaacctctgaatggttgaagtggagttcaggctatcaacattcttgtcagcggcgaaggaggagaggaatgatcttgtggcaagggcgatccgtttggggaaagagcaccgactgatcttctccgtctcatcgtcttccatggcgcggcgcttgcatctgtccatgacatggctgcactcgtcggaggctcgcttcagcttcttcctccaacgcataagcgaggaatccatggccaaaggccacctgctggacacttccagggcggcctccatcttgatgtgtgccatctccagcctctccaggccatcttcctcgcttgatttgcggttatgattgtcgatgaggaaggtggagatcctgctcacagcctcaccgacgaccgcagaagcgatgacctcagacatcaggatgttcttggtgatcactgctgccctctattaaaaagggaattaaaggtcaggtgacaattattcatcacagaactagagatactggacttcagcacaaaatatacttaccacaccaaactggttgaaactgaaactagtgctttaaactgatagctttgcagattgtgaacagcataaacctgaatccagatggaaatggttcagagtcttcacgataccaattagacagtgaaagtcatgaaggagcatctgtacaatgagtgatgtcatgaagttgacagacattaggtaattaatgtgaccgtgatagcaagatgactagtcttcccttcacaacaccacaagtctgatgatttgaatgtacagttgatttgtcacaatcacacaaaacttaaaaagctgcctcgttgactgtcccaatcttgtaaaaagtctagctattgaagacaaattatcctcgtcaccgcaatccttttccttgaaaattcgtggtaatgcttcaatgtcatgttaatcatgatcttaaaaaactgtgtttcacttgcataaactcctaacagtttcagctgcacatacttaattatagtgccaactatgtatgtacttgctgaaagttgtagcatcaaaccaaagaaaaagttatcctcaggtgtgtctctatcattgtaaacaaagatcaacttagctcatgctcctcgttctacaatgttatttgcctgtatcaaaaacaagtggtacctgtttccctgcactaatttgtaatccagcgtttcaccagcaagaacgtgccccacaagagggtcgaagaacagataatagcatggcgtccctccaaactccacagatctcagaaaatcattagctccatctgcataccactcaaatcttcgaacaacagatctatttggctcatggatattgccgttatagatggataatactagagacttggtggcatgcacaatttgcataggaaaggatgaattccttactagttgttcagcctcttcttcctcgacgtgctgcctacacctgcatattttgttatcacactcttccacagcttcttttgccaacgtaatatcgggtcaccagtaatccgccacttatttgatgtctcaagtgtaacctccaacttgatttgtgccatctccaacctctccagatgatccgctgtacttgattttcactcacagctgtcaatcaacccagatgatcctctgtctcatgaaccacagcagaaacaaccacctcttctatcttcaataatctctacctgatcagcacagagcaagatatatcaatacatcaatcttttgcgaaatcgcaaaagaattgcacgtcaatatattagatcaatacatcattcaggatgctcaaataaaacaaaagatagatcagtgaattcctgataagtacaaagtgcattgttgaattatctgtgaacccaaccttctgagttgaattagtaggaaagatcttgagggaaaacaggtgagccacagagtatctagcagacgataactggtttgaatgaatggcgagaatgaaagtacatgtcttcggtggatagagaatcgagcaaaccaaaggtggttctctttcaagtttggttagtgctctagtctgttctccagttggtttctgcccactttgactgaccaatcgtcaatagtcaatactgaatgctgactgaccaatcttccagaaaggctagctaaagataaatatttttggaaataaacccctgtaggatttgttttcaacatataggtctccatgtacacactcccccttctgccgctgtaccacaccaaaactgaattttacatgtagctctctctcataagtcgatggttgggcgctcgcactcccctcttccggccctcccgctggggcgccgccacaagccaccagccaccacgccgt

SEQ ID NO: 73831 - DNA, 12308 bp, Oryza sativa
  unsure (1)..(12308): unsure at all n locations
attcctgcagcccagtgaaagatgatatgaacgattttgtggcatgggcgatccgtttagggaaggcgcactgcctgacctcctgttccatctcatcgtcttccatggcacggcgcttgcatctgtcatgatttggctgcactcatcggatgtgcgctttagctcttcctccaacgcaggagcgaggcgtctgtgacccgaggccacctgctggatatctcgagggctgcctccattctgatgtgtgcaatctccagcctctccatgccatcttcctcgcttaatttccatttatgcttgtcgatgaagaaggtggagatcctgctcacagcctcgctgactaccgcagaagcaactacttcagacatcaggatgttcttgtcgattaccctagcctgtttgtaaaaggggatggaaagataaggttacaacttacaattatattcacaacagaactagagatatagaggtttataagaatgtagcacggaatgtactcacctcaccaagctgcttgaaactagtgcttcaaacatactgcgattgtgacttgtgaagagcataaatctgtgtggtgaagaggggagttcaattgattcacaatgggacagtgaaaggtccttgagtacatctgtgctggaattgatgtcatgatatagaaatttggtaattaattaacatgaccgtgatagcaagatgacaagtcttccctccacaccgcctgtatttctccaaatactctgtaactgaatcaacttttgagtaatacatatgttcaggccgagaaaattgtgccatagttgtttcaaaaagagatgacaagtcttcatctgtggaaggatccatccgatataatgtgaattaaccaagcaaaagaaaagtctaagattgaacgatagattctggtgacaaattgattagtctcaatcacagactagtcagtcagaagaaataaggcgcaccgcacgacttgtcgacttaaccaaaaacaatgcttccgaatgttgactgaccagtcttgcagaaaggctagctaaagatgaatcctcttcgtcactgcaacatttttttttaaagaaaaaatcattgtcactggctcagtgcaatcacttccaggcttccagctactcctcttgaccggttgaatagatctcgcgcagtaaacgtgatcaggcagtgatatgcagggagacggagcctcacctcgtgctattgcgccgcggccgccgaggggaaacatcggtctcctccatctccgcatcgccggcggacgcgctcgtatatgtggcgccccatggagacagtggttgcagaggatcgagcaagggaacaccatgctcggacctcacctccttgcgccgccgccgcgggtccacgcgcggcgtagcctgcctcctcgcggatcgtccggcggcggaggccatggccgtggcggatgatggtggtcggcgaggagggtgaactggagacgaaggggtggcccagttgtcagcgaaagagagtccatcgcggcccaagtataagcccacacttacaccaggcaattacgcagcccccggatcagatgagatcagaaaatttacaaccaggtccctcagggccgttttggattgaagccaaaacgtgccataccaaaattttggtaatttaaatagaaaatgtgctagtttgaattgatgccaaacaattggtagtgcccatgttcaatttggctatattttagaatcttcctcaccatcctattaaaatttggctttatattggtcccaaaccaaacatagctagctaactttgctctacccaaaaagtatggtagacacgcatgtcaatacatgggtggatgcacgcccccttctaacaccaccggccgtcacattggagcacaggaggcaagcggcaccgtcgtctaccatcagaccagccattgagtcggcctagggacacaagcaagccgacttgcgagctcacttatagatcaaatatgtgataatccgtaggtttttatatcgtggtcccgcttgccacatctagatatgtaaatagatcaacccatatatccatttatagtttaaattaatagataacccgcgagttacccactaaattttgcctataaattaaacgagctcgtgggttggcccgcttgtatctcaaatcggcctgcattttgccatctcggtacccatcttttccacgcagaagttggtaggcgatgccatagtgggacttccagaatacctcgtgcgtcgacgatccatccacagcatcgtggttgtggctttggcgatcgacaacgagtcaatgactggtagaaagaactcctccacctcaaacagcacagcccaatgttcgttcatggcttgctcctcccttccatctatcgccacagccgcgacggccgacggtcatgtttcgggatagcaactcctccggcgacgcatgtgtcacttagaccgccttcatcagcagcatagatgccaaggaattttcagaaaatcaactactctcgtcgttgccgaccagataattgtcgcaccgagatatgtcgttgcacggacaatttaatcaccggccggctttaggaatgcacctgatggctctgaccatggtgctcttgtccttcgcggcatgccggttttgggcgatgtgctagcggctggtgggccttcttgaaaacgaaagggtagatgactattttttaatataaaatcctctaatttttttggagtagaacagagtctcttggagcaaaaagttgttattgttatagttcctttctttatttattattttcctcaataataacgtgtcactgatttataagttctttttatctttaaaaaaaagatatgcctacatatatctaatacgatatgaccgatgacaggtatagccggtgagctggctattctatttgtcaaaaataagtaaatattgtagataattttgaactataatataattttattttgatgatagccacgtaatagcagggccaaccttgctattttttttttacattgagtaatttgtattggtggtacacaaaacttattaggtgggtgcaattaagtatataaatttataaaatgctcgttttaatacacgaacttgtctaattcttgcgaatgaggatcaaaataacttggcaatgctaattatacgaaaccgatgttgattaggatgtgatgtgaatacgtgtagtgagtatgcataagatatgcaatatttataatttgatccttactttatccatgatgaatttcatatatttttaacccttatatcattgcttggtatttttaaaaatctttttctacaatcactatatcctattctatttttttattgaagaggtgtatatctaattacaaccttcttatatactccctctgtattttaatgtatgacgccgttgactttttaaccaacgtttgactattcgtcttattcaaactttttatgcgaatataaaaatacttatatcatgcttaaaaacatttgatgataaatcaagtcacaataaaataaatgataattacataaattttttgaataagacgaaaggtcaaacgtttgtcaaaaagtcaacagcgtcatacattaaaatatggagggagtatatgtttacatagtatcataatcagcccctaaatcaataagattagccatgtagtgtcattttcatctttctccgcacgtaccagacaagttcatgcaccaaaataagcattttacaaattcgtgtaccggcgatgcaatttactctttacattcatgaccctacccggctacttgcaacggatgtcagcaacccacaaatttacaatcaggtctgtcattggatcactaccacaatcaggtcactcatagagattacaaaatttacaatcgaaatccctaattttggcatttctttttttgcaaatcaatacctatcagtttttgttttttttttagaactagggccagagagcccccatttctcttactagaaatgagcatatccttacaaagtcagggaaacaaaaacaaatacgaggaaagaaagctaaagagcttatccagatgcctcacagggctcgatggctgaacacgaataacatcattcggtcatcaaaaggataaaacagatcacaaaaaactaataacatcttcatccttctatcctccagattccaggtctccatccatgtcttgagcagaagatgtcacttgccacctgtcttataagtctggctcccaactgcagtcttcttcgatttgcttccaactttgcaaagatgcccaggaatccacccaggaacaagccataaagaccaaatcagtaggatctcttggaaatttattttcaaaacaagctttattcttggacttccaaattgtccaaatgattgcagctaaaccaatcacaatcaagtgtttcatgtttttatcatgtctatccagccaatgtccaaaaatatcctgatgattcaaagtaggcagtatatccaaagcacaacacatgatattccagagaagtttggccaaagggcattcaaaaaacaagtgctgtatatcctcttttttatcacaaaattgacacttttcattcccctttctccaaccttttttatacaagttttccttagtgagaattttgtttttaacaaacagccaaataaagactctaattttcagaggaatcttanatttccatattttcttttgagggaaagacacctgatgcattttaagggctttgtaaaacgatttcacagaanaaattccatcctttgtcaaattccaatagattttatcttcagagtcatcctgtaagttcagactttccagactgtttttgattctcacccatctctcagtttatctccctctagatctcttctgaatttgatgcattgcaagcctttcattttcacctttgcaattgtcacatgtttggtcaaagctatattgtacagatttggaaactgaatgttaaggggttttccacctattcagctgtcctcccaaaacaaagttcttttcccattccccactttttttgaacaaaatttaaaaaaatcatcctttacttccatcaacccatgccagaaatgagagttaccctgtttaaagtttacctcagacatagttttatttttcaaatatttccccctaagaatctcctgccaccaaccttctttgttttccaaattccaaatccatttccccaacaaggccttattcataatgtccaggtccagaacacctaaacctccttgatctctaggtgaacaaataatgggccattgcactaaatgatattttctgatgccttggtcctcctgccacaaaaacctcctcctgaagaagtccattttttctttcactcctttgggtaacttgaaaaatgagatcatatacatgggaacactgcttaaactagaattgatcaaaattaatcttccccctattgactatcagttttggtttttacatagctctcatagatcgatggctgcgcggagtgggcgctttctcttccatcctcttgttctcccgccgccgccgccaccaccagccaccgcgccgtttccgccgccgcaccagagctgagctcggcgatgccacaacctttcacaatgacacggccaatgagtccgcctgcaccctgccatctctcttcccatcttcttcaagcagaggtaggcgacaccatggccggactgccacagcacctcatgcgtggacgacgacgacgacgatccatcgtacgccgcctcatggcggcacaggcgatcgatggcgttgggcagcagaagctcctccaccaacattcctgtgcacggcttgctcttccctcccgtcgattgcttcgacagcaacgctccgggctctgggcggcagctcctccagccaagcgtgcggcccgatcacggccgttagctgcagcaggggtgtcctcctatcgccatgaccagatgatgatgatgatgaagaagacgatgatggcttctgccatgcagagatataccgccgtacgaccaatttgatcaccggctccgggtatctaccatggtgattgtgtccttggcagcatgcggagtttgggcgagcatggtgagtctctgaatggtgggtcctcctcgagtactctggatcggtagaatcaacaaaggggaagcagtacaaggctcgatggtgcacctgagtgagctcctgctttgcagcttcagcaacaggcttgaaattgggtggtaacaactccaagcacctggccacaatcccggtcacgttcgtgcttgctgccaaacgtagtagaattccgaaaatgaagttcttctccggcctctcatggttctggtaccaaagcaacaccccggcttctagtcctcgctctgcgaaactcattggccatgctgctaggtagtgctgatttccttgagaaatttcataccgtagagctttgcctgcaagaaggtgcccggtaagaggatcaacgagcatgtagttgatcctcctgcctatgctaccgaattccatgaatctcaggaactcgctggcaccatcagcgagcctttcaaacttctgaatggttgaagtggtgatcaggctatcaactttcttctgtccagtgaaagatgataagaatgatcttgtggcatgggcgatccgtttagggaaggcgcactgcctgacctcctgctccatctcatcatcttccatggcacgacgcttgcatctttccatgacttggctgcactcatcagatgtgcgcttcagcttcttcctccaacgcaggagtgaggcgtctgtgaccggaggccacctgctggatatctccagggctgcctccattctgatgcgtgccatctccagcctctccatgccatcttcctcgtttaatttccgtttatgcttgttgatgaagaaggtggagaccctgctcacagcctcgctgattaccgcggaaacaactacttcagacatcaggatgttcttgttgataaaccccttcctgcttgtaaaagtggaacgaaaggtctagttagaactgttcatgacagatctagagaaacagaggtgtacaagaacttagaacaaaatgtactcacctcaccaagctgcttcaaactaatgctttaaacatactgcggttgtgacttgtgaagagcatacatctgtgtggtgaagaggggattcaattgattcacaatggcagggggacttgtcatccggtagcaggatgacaagtcttccctcaataccgcctgtatttctccaaatactccctgtaactgaaccaactttggaataatacatatgttcaggccgataaaatttctttccatactcgtttcaaaataattaaaagaaaaaaaagacaaatcttcttctgtggaaggatccatcaaatataaaatgaattaactgaggaaaataaaagtctaagattgaaagatagattctggtgacaaactgattggtctcaatcacagctagttggtcagaagaaataagtccatgactgacttcgtggagaaaaaggttagcaaagcaaaattgtgttttctcagaagttaagtgggtcatgttggatgtatggtctaattaacatagcacaaggtgagaagtgagaacacatcactttttagactctaattaacatagtctccgtatgatttgtcaagcaagaaaactgccctctatgaccgtccaatctcattgcaaggctagccaaagataaatcctccacgcctctgcaattaggacaatttaaagtaactactcgtcactgcaatcagtttcgggtactagtcttgactcttgtgtggtcgaacagatcttttgccaattctcactgaacttatctttcccctaaaaagaacagtaacccattgcctaaatctgttttgcaggttgtgtacagatcgatagccctgatgcagcgctggagggtgctccaaacaagaaaagactgcgccctgctagagctggacaacgtttttaagaagctgatggataagatgtacaggctgtgtctagtttcttccaaagttgaaagtttggattgaaattggtacgatgtgactgaaaagttgtgtgtgtatgacaggttgatgtaatggaaaaagttggaagtttggattcaaagtttggatctaaacacagccacagctttggcctggagatgccctgccctccgtccctaaatatttaacgccgttaactttttaaacatgtttgactgttcgtcttattaaaaaaattaagtacttattaattcttttcttatcatttgattcattgttaaatatacttttatgtatacatatagttttatatattttacaaaagtttttaaataagacaaacgatcaaacatgtttaaaaaagtcacggcatcaaatatttagggacggagagagtattagggaagatgggtgtgtgggggtgtttttggctggtttactctctgttctcccttcctggagatgggcaaagggcactgaaagctgacgatcccagtggtttaccatgtttccgatctggtagttttatttttctgttgtgtaagattctttcagtaagtttgaggctttctttcaaaaaacagggtaatgaaattacctgcagtttttttttaaaaaagaacagtaaccaaactgcacagaacaggtcgcgacaagcagcagtgaaattgaatgcgagcaaaatgtcgtacatatctgggatggagcgtatctgggatggagcgaattaacgcgaacaccatattacataaaatggcagatggcatttactaggaactgtcttttgtccgtacaactaagtaacataggaatgcgatgcaatagtggtgtggcgtcttgtaaataggtggtggctgcgaagcctcgccatctctgtgcattcttcaaattctcaatatactacggtcggcgtgccgacccggcgaatgcgatgcaataatctaccgtacaaaatgtaccaacctcatcaagctggttgaaactagtgcttagaatatactgtaattgtgccttaaccaaaagtttaagattgaacgatatattctgccattctggtgacaaactgattactctcaatcacagactaatcagtcagaagaaataaggaacacagggcttaaccaacctcaagctttgcaactgggctaagtaaaaatactgaaattattttaaacaataagggaatacctgtctgcttgtctgcttgatgattaaaattgtttggcttgacatgtccaccttcctcactcacccattcacagacccagcaatcaacttgttctccttcttgcaacttttttgtgtttccctttgtttctgtgtttcagtagacgatgaagtcagaataaatatgcatgtgttttaatgtttcatttcggaatcatcctaaatacatataatctgaaatgtaaaccgccccgaggataccactgtatgaaaattactgatatgcaaattacaatttttttacaaaaaataaagtgaatgggaatatgaaatagcaggaaatagggtaagtacaaaattttgtcatcaccttcaatcatggtaaacgcatgcgaattcaaataaaatatgtcacgcccaatgagtgaggatgtacattagattgatagagtatgaacatcatattatcaccattcaccaacataagtgatcagctggacaaacaatagcatatggagacatggagcacacattacagatcaacacactcctaaggacttctaaatttaactacctacaattcacttttcaccctataatattacatttccattcttcttaattctccctgtctccttaaccagtctctgtaaatgatctaaaatttcagacgcaatagtggagatgctaactctgtttccttttctttctgaatccaatcaaggatagagccctgcagctggacaggcgcatgagcagcccagaggttaaggaagtcacagatgaagtcacaggtcacaactgtgcgcctctgcgttctctgatccattccacgcagcagctttgctttcttggctcctcgaatggttctccgtgtgctcgtcatgttcatggttgccttcacaacctcaagatatgcaccgccatgtttagacttccaaagcatctggtacactctagcttttgcattctgatgaaaacaatctacagcctttggcagcatgatctgttccatttgttgtaaggcaatgtttgtgtgcaagcaatgttgctcattagcattaatcacctctaccacagaactctcgactgttgggaataggtctcctgaagagccatgcggcatatagataatgttaactttcaggtgcggaacttctttgatagaaggtttgccctcgacgatcgttccgcattctccaaacccacgcagtgaaacttcgcacttcaaactcacttcaataattggttctagagaaacgttttgtaatcctatcttgtccgtgtttccactgccacgtaccttcgcaccatgatgcttgcaacacagtgggtttgggcgaaaccattcaatagctatactatgaatgttgtaccaatggtttgaatgagcctgtggcacccaggagaagtcttgtgtaggtagcagagtaagttgctttctaacattttcagttgtagacttgaaatgaggggtaaacaactgcaagcccttaattatagtgccaactatgtttgtactctccgaaagttgtagcagcatacccaaaataaagttaccctcagatgcagtgccatcactgtaaacaaataacaacatagcttgtactcccctctccgctatgttattgggttgtatccaaaacaaaagctgcctgtttccctgcactatgtactctagagtttcacctgcaagaagatgcccaataagagggtcgaagaacaagtaatgacgtggtgtgcctccatactccacagatctcagaaagtcattagctccatctgcaaaccactcaaatcttcgaacaactgatctactcggctcgtctatattgccatggaagatggatgatatcagtgacttggtggcatgcgcaattcgcctaggaaagaaggaattccttgctacttgttcggcctcttgttcttcctggacacgctgcctgcacatgcgtattgtgtcatcgcactcttcagtagcacgcttcagcttcttctgccaacgtagcaatgggccactagtgatctgccacttattggatgtctccaatgcgaagtccaacttgatttgtgccatctccagcctctccaggttatcctgtgcacttgattttcgctcacacctatcaataaacccggatacgatcttgttaaccgtctcgtgaacgatagcagaaccgaccacctcttccatcttcaataatctctccctgatctgcgccgagcaagatacatcaatagatcgatcaggatgcccaaataaaacaaaaaatagataagtgaattcctgaaaactaataatgcgttgaagtatgtgaaaacggtaaaccgaaaccttctgagaggtgcaccagagagtacccagcacacgataactagattgaatgaatgctgagcctgagcatgaatgccatgtctttagtggagaaaaatcgagtaaatcaaagttggttgtattggaagttagataaccttttttttagccgggttggccataagaagaggccaaccaaatcttattaagattatgagagcaccttgacattaggtaacccttgacatatggttcgagaagaacaccttaattactattacactatgtgattctcctaattggaactattatactatgtgattctcctaattggaagcattaggagaatctgatgtcttttaatgcgttttttttgggttcttcttagccatggtaaggcgtggtgctatgtttggtgatcattttgccagtctgtctggtgtctgaacttgtaagcagagatgcgtttgacaggggtttgttagggggtagcaacctgaacttttgttgtgaaccttgtaatcgtatcgttttcattaatgaaagcgggaggggcttgacctctctttatcaaaaaacaaaaaacaaaaactatgtgattctccagttttttttaatgaaaacgcaacgattacagaagttccagagaagttcagcacgaagacagagggaacaaaagaaaaaaaaaacagaggacgattctccagttgatttatgctctctttcactgaccaaacgcaaattttgttattaagataagattgaaggcaaccaaaccaacaaggatggatgcttctgaatgctgattg

SEQ ID NO: 73832 - DNA, 2157 bp, Oryza sativa
  unsure (1)..(2157): unsure at all n locations
cgccgaagactttccgtccgatttgtgtacggaccccccccccttttttgaattttctgtttattggaaagagtacagggggtatgaataaacgncagtagcagggaagaacaggggagagcagtagcaagggaattggttctaagaaaaggaagagaggggatgatccaatcttatctaaatatctgtctgggacttaaccgatgtgggagagaaatatttactcccggttgataactccacccgagactaaagatagatttttagtcctggttggtagtaccaaccgggactaaagatctaaatgatctttagtcccggttggtagccccctgacatacctctgacagggatgaaccaggactaaaatcatctttagtcctggttggagatcaaaatttttttaaccggaactaaaaatcgtttttagtcccggtttttaatgaaaccgggactattgtggaatttggtcgaccgaccaaagatggtttctccaccagtgttcttatacattttcttaacattgatttttattttaactgcattttaagttgatcttaaaatcggaccatatgatttacttactctgaatagcttattttctggatgttcttcaggaatttggatgcaactgcactaggaattcatctggatttttttggttggttgtgataactgcagcaaaacatctcaagaggataaaccttcactgtcattgaaataaaaaatacacttattaattgaataacgtatttttaatccattctgaacagtgcagaactttctgaattatctatcggtgtttagcggttgattgttgttttattgaggggtattattaaatatcaaagtagatagatgcagataaagaatcaagttttatgacttggttttagttatacatatttttcttcaaagtgcaaaaataaaaattgtactccctccgtcccatgatataagggattttgagtttttgcttgcactgtttgaccactcgtcttatttaaaaaaattgtgatggtgactcatacatatattgtcattactaaatatcaccatagcattagcacgggcacaataatgttttatagtcaattaatgacttgtttctttttagtatcgctaagcagctcacctaaaaaagttagaacaaaaccatacacaggggccaaaaaaagcagggtgagtggcggccaaggatcaaagtgtcaagggggcatttgcccccgctcactgcaaaattgagtggtgttgatgaaaaacacgaggcctgggagatctgcttaactccagtgcaggtccaaaactcgccttcgggtatgctagcgtaccataccaaatttggtcgttaacaggtgggggcaaaggtccccacttgtaatactctagatctgcacatgaccatacatccctagctccctgccaaatctatgctccctgtagttggtcggcttgtagtagacttgtgacgtacaagtgtaaagaaaaatctatgcactccatcgttataaaaggaaacgctctctcactcccttctcatcacttcgctcactcactctcactcatttcctcccattagtcttcccactcacgtctcactcctctcactcacttctcactcgaatgagtcagcagccaccctgttgtgggcacgcattctaaggggctgccaaggcaaccagggcgggaagggtagtcggggtcagctaggatgaaaaggagaaccaggtggcgacggtggcttgagcgtacacggtggcgcaagcggcgacggtggtggtctaggttaccatggcgctagaggaggatgaggacaagatagcagaaatggtggccgcgggtcaacggcagtgggcgcataaggtctagggcgaggtggtaagccatgatgcggttatgatcgttaggttggtttagtcattctttttacaacttgcctcgatccttactgcaaatggcaaattcatgcaagaaagagtgtagctaataggtggaggataactagtgcaggtgaagacaaacatgctcagtgcggaattatctggccagtacttgcaactaacttccagggtttattggccacaggttacagacatttggtcaaactgagcccaatcttgtgtccctgtagggatnggtcgaggcaagtgagcaaat

SEQ ID NO: 73833 - DNA, 1994 bp, Oryza sativa
ccgtccaaaacgaatccaatggagatggcgcttggtcccgcacgcaggcaaaaaaaatctccgtttcggcctaacaggaagcccgcacgcgcacaggacgcgcttaacctcgccctcgtccgcgtacaccggcgcagcctgagacggactcaacttcgcctcgccctcaggtccgcgtacgccggcgcttcacctcgccctcgtccggccaccgccacgagtcagctgggaggcgcgtcgctgcgaccggagaggcaccaggccgccctgccctgccgccgcgaccgggggcgcgtggaggcggccggccgccgggcctgacggcgcggtggtgcaggcgggcagccgcgcagcccgagcccggcgcgtggaggaggccgcgctgctcctgccgcgccgcacgtcccgatttcggcggcctcaactccacgatggatttcagcgtccgagcccgcatccagagcccgcaccagtcggccgcccacttcgtcgccggcgagaggtgacaccgccgcccggcttcgtccagggtaggagtcactgctggttgagtttgtggagaacgacgcaccttttcctgtgcccgcgaggtgtttgtggaaatgccctgccgtctgggatgatgcagagtcctgattgaaagtgaattgttattgtttggctttgtgagattagaagcaaattgattctgtaatcttgattgagattgatttggttgtatgactcatatatgctgtaatttgaatgaatgaatgaataaatcagtaacttctgacgatgttttctaaaaaattttgagatgtttgagatgttgcccaggtccatgatttgttcaggtttaaagtctggaatggacttatagtattgtctggtttatactggacatgagttgtgctgccatttcctccttttcgctatctctgctgtaaatttttagttcatgctaggtgggaggttccatgtcttgttatgatcagttgtcctatgcagcaatgttgctctgaatctctctctctgaagatgctgaatggagtgccgtcgttgctgtagtgctatcgtgaaatttcatggtcagtagttcctgtgcatggtcgccctgatcaatagtgggtaggacatctttggagctgtttttatgcgagattcctgcaaaattcctagtacgaattcatgtgttgcaaacaagcccgtatgtctccttcatttcttgatacgatagggatggattgtgttttggttgacaaaatccaaagagagcaattttgtgaatgaaatgagaatgccagaatggggctgttgctttgagcgatctgatatccatcgtggagttgaggccgccgaaatcgggacgtgcggcgccgcaggagcagcacgacctcctccacacgccgggctcgggctgtgggccgcccgcctgcaccaccgctctgtcaggcccggcggctggccgcctccatgcgcccccggtcgcggcggcagggcagggcggcctggcgcctcccccggtcgcggcggcgccggacgagggcgaggtgaagcgccggcgtacgcggacttgagggcgaggctaagcgcgtgcgggcttcctgttaggctgaaacggggattttttttgcctgcgtgcgggtccaagcgctaccttcgttggattcgttttgaacgggcgagatgcatcgtatgtcacgctgtgacttgccttagctaagtcaccagctgagtccccggcggcggagggcggagggcggaggccatggcggtgggtgaggtggtggtggtcgggttgtgcttgtgcagcccagttgcagtgaaaaacaaggccgagcccaagtaaggcccacactagttcaactcggcccgcacatttaatcatcagagcaatgcaacccagggatgcaagcggtccaacccgcgaacctgcttataggtaaaatgagtgaataacccgcgggttgacttgtggattacctaataatttgatatatgggctgcaggaa

SEQ ID NO: 73834 - DNA, 5440 bp, Oryza sativa
  unsure (1)..(5440): unsure at all n locations
ccgctctttganaatcgatattcgagctcggtacccatcggcgtcaactatagaggaactcaaagaagtttcagtgtcatatggccatgaagtaaaactaagcaatttgttccctacgagattcggacataagaattatcaacacacattcgaaggtgagaatatttggaaatagcaagtttgtctgttatactttcatataacttatgaatgcgtctagaaaagcaattagggtattcatactgtaagttgttttcctttgaaccttttgtgtttcccttaaaattgtctaagcacgtacattttgatagagcgatgctattacatatctcggttaccaagagacactaaattttatgttaaaaatatatttgtcacctctcaccatcatccaggactgtaaaatttctcattttgatgactttcttaatcttgtatagcctatcgatatatgcatcggcatatatatatatatatatatatatatatatatatatatatatatatatatatatatatatatatatatatatatgtatatatatatatatatatatatatatatatatgtatatatatatgtatgtatatatgtatatatatgtatatatacatatatatatagatacctatatatacatttatttatatatatatgtatatatatatatgtatatatatatatatacatatatatatatagatatgatatatatatatatatacatatatatatatatatatatatgatatatatatatatacatatatatatatatacatatatatatgtatatacatatatgtgtatatatttatataacacaagaaaaaaaaaatatatatatatatgtatatgtatatgtatatatatatacatatatacatatatatatatatatacatatatacatatatacatatatacatatatatatacatatatacatatatatatacatatatatatatatatatacatatatatacatatatatatacatatatatacatacatacatacatagatacatatatacatatatatatagatacatatacacatatatagatacatatatatatatatatacatatatatacatatacatatatatatacatatatatatatatatatacatatacatatacatatacatatacatatacatatacatatacatatatatatacatacatatacatatacatatatatacatatacatatacatatacatatacatatatatatatacatatatatatatatatacatatatacatatatatatatacatatatacatatatatatatatatatatatatatatatatatatatatatatatatattcaaacaaatgcgagattattcgggactaaaagatgttagtgtattgtattctatgtaagacatagatgtctactgaaaataaaaataaatgggccatacgagttgcagagggactaaaggaagtctcggtgtcatatggaccagaagatgaagataagaaaagcaaagtattccctgcaaaaaattggtcaaacaatgaatacgaaaagtatttacacaaaagcgaaggtcagaatatttggaactaagatgtatgttgtaatacgttggatatcttatatatatgtctactgaaaacaaaaggaaatgggtcatattagctacagagggattgaaggaagtctctgtgtcatacggaagtgaaggtaaagaggagccgaggaaagcattccccatgggacaatatatgttagacaaggaacgagaaatgacttcacacacagataaaggttagaacatttgcatttggtatattgcattttcatatatgtcattgaaatatatagagaactaaataaattgtttctatatgggccttgaactagagacaatctcaaagaagtccgcgtatcatatggcccaaaaatgaaactaagcaatttgttccctactgggtatgaacacaacatgtagtatataatacatatacacgcaacagaagctgaggatatttggaactgtagggcactagtgtaatatatttcatgtatttcttatatacatgtatattgatttttttttaaaaaatggccttatgagttgcagatggtctaagggaagtttcggtgtcatatggaagtaaaggtgaagtggtgactcggaaagcatttcccatggaacgatacgtgctagacaaagaacctaaaaggaatctgcacagaaacaaaggtcagaatatttttaagtacagttgatgtattgtattttcatatatcatattgacatatgcagaaaactaaataatttttttctaaatgggcaaccaactttagatgaacttagagaagtctcggtgttgtatggctcaaaagggaagctaaaaaatttgttccccactgggtatggacataagaaacataagcatgcaaatgaaggtgagaatatttgaaattagcggatattggtgtaatatatttggtctatatcttatatacacatgtttattgaaaatttcaaaaatgggatgaatgagctacagcagatctaaaggaggtctcagtgtcgtatggaagtaacgatgaagagaagccaaggaaagcattccttagaggagggctttttttaggcaatgaatatgaaaagtctgtacacatagacaaaggtgagaatatttggaagaacatttggcgtattgtattttcgtaaaagttgttgacatatatagataatataaaaatattttctgtattgcccgtaaattgtagaggacctcaaagaagtctcagtgtcatatggctcaaatgtgaaactaagcaatttgttcccaacagggtatgcacatcagaaatatatattaacaagcggaggtaacattagaactagtggatgctcatgttacgtatattgtgtgtatatgttatatacatgtatatttgaaattataaaatgggccatatgagttgcagctggactaaaggaagtctccgtgacatatggaagtgatggtgaagaggagccaaggaaaacattctctaaagtagggtatatgttagataaggaatgcaagaagtcttcagatgtagacgaaggtacaatattttggagtgcattatgtattttgtatttttctctaggttgttgacatattcggaaaaactaaataaattgtttctacatggaccatgaactgtagaggaactcagagaagtctcagtctcatatggcccaaaattgaaactaaacaattagttccccacagaacataagaaatatatatacacaaacgaagataagattatttcgaactaaaggatgttagtgtaatgtattgtatgtctcatataaatgtatattgtaaataaaataaattggccatatgggctgtagggggactaaaggaagtctcggtgtcatatggaagtaatggtgaagaggagaccagcaaaaccactcctatgggaggatacatggtagatatgaaaaacgaaaagtctctgcaagcagagaaaggtgagaacaggatgtgtgcacaattcatgaattaatatattgttgacataatatagaaaactaaatgaattgtttctacatggactgccaactgtagaggaactcaaagaagtttcagtgtcatacggttcagatgtaaaactaggcaatttgttccccatagaacacaagaaatatgtatacagaaatgaaagtgagattattttgaaactaaaggagatgttagtgcaatgtattgtatgtcttatataaatgtctattgaaaataaaaataaatgagccatacgagctgcagatggactaaaggaagtctcggtgtcatatggaagtaatggtgaagaggatacaagcaaaacctttgctatgggaggatacatggttgataacgaacgtgaaatgtctctacaaggacagaaaggtgagaatagaaagtatactcacaattcatgaattgtagttttgtatacattgttgacataatatagaaaaccaaataacctgtttctacatgcatgagctaccaactttagaggaactcaatgacatttcattgtcacatggtccagatgtaaaactaaacattttgttttccacataacacaagaaatatatatatgcaaacaaatgtgagattatctgggactaaaagatgttagtgtaatgtattctatgtaagacatagatgtctactgaaaataaaaataaatgggccatacaagttgcattgggactaaaagaagtctcggtgtcatatggaagtaatgatgaagaggagacaagaaaaatcattcctatgaaaggatacatggaagacagggaacacgaaaagtccctacaagcggagaaaggtgagaataggaagtatgcataaaattgaattgataagtatattgttgatataatacagaaaactaaataaattgtctctacatcggcgtcaactatagaggaactcaaagaagtttcagtgtcatatggccatgaagtaaaactaagcaatttgttccctacgagattcggacataagaattatcaacacacattcgaaggtgagaatatttggaaatagcaagtttgtctgttatactttcatataacttatgaatgcgtctagaaaagcaattagggtattcatactgtaagttgttttcctttgaaccttttgtgtttcccttaaaattgtctaagcacgtacattttgatagagcgatgctattacatatctcggttaccaagagacactaaattttatgttaaaaatatatttgtcacctctcaccatcatccaggactgtaaaatttctcattttgatgactttcttaatcttgtatagcctatcgatatatgcatcggcatatatatatatatatatatatatatatagttcactatgcttgtaactcaaagatacaaagtggataattgtaataataataaaataaacatggttcaccaatctagaaatttcaaccattggcggatcttaatatatactctttccttgtcaaaatatatatctatctttgtatttcaaatttttacctcttaaccacttaagaaatgcatttccttaagatcttattcggtttagaggggattaaagaggattggaggggattgaggaggaataattccacaccacaatatgtgtggaataaatctcccccaatccgtccctcacagggattaaccaatcaaggcctaagggagctaccaaaatttatctcacaagttatactttcaattctttttcaaactctctgagacatatacatacatgtgtgaaacattaattttctttttttttctttcttttctatatggtatataaggatagaatgatattttattcataccgnttgtcgctgcatgcgaggatgacttggcatgctcacgtagcacctttttggg

SEQ ID NO: 73835 - DNA, 5467 bp, Oryza sativa
tgcagccctttcaaagctatgagtgaagttttgttttctgttaagttataaaaatatatatgcgctcaaaaaagtgtatgtggacatacgacaagtgatagagaaaaaagccgaacgcaatattcatcgaatgtaatatttttccttgtgcatgtatttcttcatttccgtactgaaaggaactcatatgatgcactggattattagaatttatgtggtattggattacaccatcgtgatattcgaactactcacagtcattgtttttatttatttttaaatcctagctcaatgttttaaaatttagtggttgaatagtgcgcgacatttttaaaattgcgtccaccgctccaccaaaccaaactagcacgaaatctctcttatggcaccatcatcctatagttagcgtgaaatctattagtgtgacacctgtgtcgtgctatatatgaggtgacaccaatatattttttcagaagttcttaaaatcggtatattcacgcaaaacactatgcaaaaagtgtgttttcaagaaaaaaaaattcccacatgccaacatacactaggaatctagcctttccattatctattatcttattaaaggaataaaaaaagaagtctccacgttcgctctcacggcctagaaattctcatattaatcagggaaaaagaaaaacagagtccatatagaaatacaatttaaaaatagctaaaattcggaattaaaaaataaggaatattagaagaagagtatagagtccatatagaaatataattaagaaataatagaaattcagaattgaaaataaggaatattagaagtagagtacagagtccatacagaagtacaattaaaaaataatagaaatttgaaattaaaaataagtaatattagaagtagagtatagattccatatagaaatataatttagaaataactaaaattcggaattaaaaaataaagaatattagaagaggagtatagagtacatatagaaatacaattagggaataatagaaattcggaattaaaaataacgaatattagaagtagagtatagagtccacatagaaatacaattaagaaataatagaaattcagaattaaaaataatgaatattaaaattagagtatagagtctatataggaatttaaaactaactaaattttggaataaacataataaaattaaaattagagtttagagtccataaaaaaatacaatttacaaataaccaaacttctaaattaaaaaaacatgggaagaagagtgcaaagtcaatacaggaatacaatttagaagtaaatgaaattcgaaattaaaaattaaagaatattgaaagatgagtttagagtccacatagaaatacaattagaaataataaaaattcagaaataaaaataataatattagaagaagagcctaagtatatatagaaatacaatttacagaaaattcagaattaaaaaaaatattaaaagacgagtctggagtccatataggaatatatataatctacaaataattaacatttaatattaaaaataattaatagctaacacatatatgaaatacaatatgaatattacacattagtagtttcgtaaagatagtacaaaatttaaaattatgtcgctcattttacatatttgaataatacattgagaaaatatatatgctcttatagagagaaaatataatgatgctagccgcacaatctgcgcggaccaccatactagttattaaataaagagaatacctgcaatgtgactgattcctgagatcctgtttcatacaaaaagatctttttgttgttcggtagtttcaccgactgatattccgctaatctccagtctccacagttcaccatctcccttcccacctccgaatgctcttcttccatcatctccattgctcactgcctcactctcgtcagctctctctctctctctctgctagtgcttctaggatccatcatccatggctgcttgcaaagtctacttcttgtgcagcatattgtaggattctattgtttgagaacattttagggagttgcatgttacaggtaaaccgcacttctttttcctgaatcaattctacatatgagctttttttcatgcacaaaaaaagtatataggcattgaatgaatctacttgttcttttttagtagtgagaggtctttttccacttgacaaaatgagaggtctgtttccttaattcagttaaccttcgttctgcaaaggatggttcagtgctttctgttactttgtttgccgatgtactggcgattattccctgaactctgtcttaccttataatgaaaaaagttcatgaaacagagtacaattgttcaaggttatttctgttttacacttcacttcttagttctgtgtttttcgtttatttattttcatgattgattttttttagacaatggcttttatgattgaatatgacaagaaacaggggtagctctaaatctaaatatccaagaaaaagactgtgatagttgacaaaaatatactcatggatgctcattactttttactacagttcaatgcatgtgtaactatagatatatgctttccttgtctacaaagtagggaatctgagggagcaaaaagtttatcacatggagggagcagatgaggagaggccactaattcatcacctgcctccacaggtactattctattaccttaagttggtaccaaatatattgcatctccatgtgacacatgacatgtaaagtcgataattaatttggcttcagtttatcagaaagaaacaagaaatacatgagttctcgcagcaaatttgcacatacatttaacgccgattctgtgtaataaaaattagcactggcattgtcattcaggaacaatgttcgcaatacacctgcgatggaacggttgatatcgacagaaggcccgcactgaagcatagcacagggaattggagagcatgcttcttcattttaggtatttcagagaagttcagaaatattccaaacaaatttaacactttctttgttaaacctgcacaacttttaaccaatatatattgggtctgaacatatatgaactaggtgctgaattcactcaatgcctgtgcttctctgcggtcgtgaagaacttagtcaggtatctgacgagtgtgctccaggaaagcaatgtcaatgctgcccgaagtgtgtcgacttggattggaacttgcttcttcacaccactcattggagccttcttggcggacacattttggggaagatacaggacaattgtaatatgcctctctgtttacagcatagtaagtgcaacaatcagaggctattaactgaataatctaatctatcaagtaaaattgctccatgaacatttcctatttttgtcagggaatgctcattctgacgacttcagcgtcgcttccatttctccttcatgattcctacaacaatggcgacgacattcgtcgtgttgtcgcctacctagggctctacctcattgcacttggagctggaggtatcaagccctgcatgtcggccctcggggctgaccaattcgacggtgccgacccggtagaacgggtgacaaagggctcattcttcaactattactacttctcaaacaacatgggcacgctgctgtccactaccgtgcttgtctgggtgcaggacaacatagggtggggcatcggtttcgcgactccgatgctgctcatgggttttggcctctccatgttcgtcgccggtaggagggtgtacaggtacaggaagctgggaaggagtccattgacaagggtgtcccaggttgtggttgcagctgcgaggaatcacaggctcaagttgcctgatgatagctcactcctgcatgagctgccttcactgaccgaaggtggctataggattcaacataccactcgattcaggtactattgctcatcatatcatcaaaatatatgtctagttactgctgcagacattaacctcaaggtccacaacctagtgataagcttatatatttttcaccatcactcttatgatatgagtggcattttgtgcaactatgtttagagtatgtgttgaaccttaaactaagcaggaatcttctaataacaatttattgaacgatcattgagcttataattataccacgcctaccaagaaaaatctgtcgcgttttgtggactaaaatttcctatatgtggaattcaccttcgtcgattgcttcaagagatatcaacagtttatttttgaaaacaaaagcagaactttgtctcatttcattgataagagttaccaagaaagggatcacacggaaaacaccatcctacaaacttctcaagatcattcctcaaagctacacttaacacctaaaaacaccaatgcaaccaaaaacttaaggatacatcggtttctaatttactctcagagaataattccttgttctttcttgaggcgatttgccatgcgacatatggggtaattaacagcatgttcgaagagctccaaaatctgaaatggatctagagttgtggacctaggaaaagttaactccatcattttaaaatgttttataaattagattcacctgctctgctcttaaagaaaaggaatatgggcttcagctctaccggataaggatccagatgagcttaaacccctgccaggcatgttctaactatttgccactctatagattactttgataatataccacttaattaacagatgttaattaatgattttccaattctaatttttgtaaaggttatttgctatcttaaaagttattactcccttggcctgttccataatacttcttgatatttttgatattaacacgatttacaaaatatatatgtaactatgtttttctcttataatacatacaataaataaatatattttccttttattatagtactttgtaagacaaataatttaaagttattgaatgtcaaagatataaaaatttaatctcaaccttatctaaaatgtctaagaattatgaaccaaacaatgggcccactattttcaaattctcgaaaatctaatctcaaagaaaacataatcccctgccctccctctccgcatggtgtccaggttcttggacaaagctgccatcccgtccgactccgacgacaactcgccggtgcaaccggacccatggaggctgtgcacggtgtcgcaggtggaggagctcaagatgctgctccgggtgttcccggtgtgggcttcgctgctcgtcttcttcgtggtgaccgcacagatgtcgtcgacgctgatcgagcagagcgcggccatggacggccgcgtcggccccttcaccgtgccgccggcctcgctcgccaccttcaacgtcgtcgccgtcctcatctgggtccccgtctacgacgccgtgctggtgccactggcacggcgcgccaccggcaacgaccggggcctctcgcacctgcagcgcatcggcgt

SEQ ID NO: 73836 - DNA, 14793 bp, Oryza sativa
gggatgccctaggcagtggcggcgaaggagaagccgatcggaggaaaaacttttaagtgtcggtggagcatacgagggcgcatagggagtatatatacccctagatctttagtcccggttggtcagagcaaccggcagtaaagaaccgggagtcaagatatctttactcccggttgttctcaccaacctggactaaagatatttttccgctatttccaaattctttttaatcccggttagggttaagaaccgggactaaagataatagcactcaatattgaatttagttgcctatgtatttctaaaatagtaaataatgcattaaaattatttaaagtcaaaaaattaatgacaaaaccttcaaaaaattattgttgtctatagtaaattaagtggataatatataataagcacgtgaatgatttaaaattgttaaaaattctaataatcatatataactaacatatgcatgatattaaattgttaaaaattctaattaacctatgtaaataccacatgcatgatttaaaattaataaaaattctaataatcatatataattagcatatgcatgatattaaattgttaaaaattctaattaacatatgtaaatcccacatgcatgatttaaaacttttaaaaattctaataattatatatacctagcatatgcatgatttaaatttgttaataatcatatataactagcatattcaataaatccaaaatagtttacaacaattacggcaatacatcggcggtgacggttgtccgcacgtactttctcctcactattgttccttccttgtgatcgctatgtgagtaaagggtgtcttcatttgataggaggatgctagggtcaatcgtcaccgtgaaagggggttgcccatcaaactgatcgtaatcctcgtcagttttgtcctctactccgacgatttttcttttgcctgggagaaccacgtggcgcttcggctcgtcaggccctttgaccttctttcctttgctagacatgtccttcacgtaaaaaacatgcgttacatcattggcaaggacaaaaggttcgtccgagtatccaaccttgttaaggtcaacatttgtcatcccactgtcatcaatcgttacgcctccaccagtcaacctaacccattggcaccggaacagagggaccttgagaggtccatagtcaagttcccatatctcctcgatggcaccgtaatacgtaccagttgtaccatcgtgtcccatggcatcgatacgaacaacactattctggttcgtgcttttcatgtcttcggctcttgtgtagaatgtgtacccattgatctcatatccctggaatgtcgcgatcgagctagatgaacccctcgccaggaaggccagttgctggttaatcgtctcgttatccatgagatgttgtcgcagccatccggggaaagtatcaatgtgatgccgtgtaatccatgcatcggacttatcgatgtttctcgagcgaactagagccaagtgctcctcgatgtaaggagccaccaatgaagattgttgtaaaaccgtgaaatgggctttacggaataaattgttgtctaccgtcattattgctttccttccgagagtcccctttccccgtagtctcccttcatggcgtgattcaggtaccccaattgggcgaaggtcttcaataaattctacgcagaattcaatgacctcctctgttccataccccttggcgatgcttgcctctggacgagcacggttacgaacatacttcttcagaacgcccatgtacctctcgaaaggaaacatgttgtgtaggaacacaggcccgagaataccgatctctttgactaagtgcaggagcagatgcatcattatattgaaaaatgaaggtggaaatatcaactcaaagctgacaagacattgcaccacatcattctgaagggcttctaacctatccggatcgatgaccctctgcgaaattgcgttcatgaaagaacatagctttgttattgttgcccggacattgtctgggaggataccccttattataactggtagcagttgtgtcatcaacacgtgacagtcatgagactttaggttagtgaacttcttctccttcgtgcttattattcgctttatattcgtggagtatacagatggtaccttgatgctctcaaagcattgaaacaaactttccttctctgccttgctaagagtgtagctggctggactcaagtaatggctgcctttctcctttggttccgggtgaaggtcgccgcgttgttccatatgcttcagatcattacgtgcttccagtgtatcttttgactttccatctacacctaggaagccaaaaaggtttacgcaaaggttcttagtaaggtgcatcacgtcgattgtgtggcggacgtccaagaattcccaatagggtaacacctaaaatattgagttttttttccacatcgccgcgtgaccatcttcgctctctataggctggctgccaggcccctttccaaacactactttaagatctttcaccatagcaaatactatttttccgctgcgatgtttaggcttcatacggtggtctgccttatgttcaaagtgcttgcctttcttccgtactgggtggtttgcagcaagaaatcgacgatgacccatgtacacaatcttcctacagtgtttaagatacgtactttctgtttcatccatacagtgagtgcaagccttgtaccccttgttggactgcccggataggttgctaagtgcaggccaatcgttgatggttacgaacagcagcgctagtaggttaaattcctcctgtttgtcttcgtcccacacggggacaccttccttcttccataatagtttaagatcttcgaccagtggtcttaggaacacatcgatgtcgttaccaggttgcttggggccttgaataataatcggcatcattatgtacttcctcttcatgcatagccaaggggggaggctgtagatacacatcgtaacaggccaagtgctatggccgctgctcatctctccaaaacgattcatgccatccgtacttaaaccaaaccgtatgtttcgtgcgtcttttccaaagtctttaaattttctgtcgatgtttcgccactgcgaaccatctacggggtgtctcagcatcccgtcctgttgacgttcttcagcgtgccaacgcatcattctagcattccccttgttcctgaacaaacgccttagccatggtattatagggaaataccacatcaccttagcaggaattctcttcttcgttagctgcccgtcaacctcacctggatcatctcgtctaatcttgtattgtagtgctttacaaacagggcatgcttctaggttctcgtactcctcaccgcgatataggatacaatcatttggacatgcgtgaatcttctaaacttccagtcctagagggcagactatcttcttagcctcgtacgttgtatcgggcaatttgtttccctccggaagaatgttcttgacaagtttcaataaatcgccaaatgccttgtcactaacaccattttttgccttccattgcaagaactccagagtggtatccaactttttgtgcccctgctcgcaacctgggtataacgatgttctgtggtcctctaatatcttgtccaatttatgggcccccttttcactttcgcagtcctccttggcatcctgcaacatctgaccaagatcatccgcaacatcgttataatcagcatctctatcctcctcgcccgtttgatttccttcaaatccagcgtactgagcaaagtctggaatattgtcgtcttccacttcatcttcttccatttcaagcccttgctctccgtgggatgtccaacaattatagcttggcatgaatcccgactcaaacaagtgaaaatgaatagtcctgaatgcagaatactccttctgattcttacacttattgcatggacaacaaataaaacccttctgcttgttagcttcggccactctcaaaaaataatgcatgccgtcaataaactctttggaccgccggtcagcgtacatccattgccgatccatctacatgaaataaaaaaaaatcgtacacaaataatcattcgtacaataatgatagtcatacaataatgataaaataatcacaaactctttcaacagtcatacaataatgacataccattattcatacaaaaattataaaatattccgttaaataattcttatttattatttttgaagttttaaattcttttaattttcaatttagtttgttttcttttatttaagattaactttcactatattttcctactcaactattttataaaaccttctttagcaaataaacaaaatttctatatattctttcttttcccacacaaattttctctctcatcaacttacaacaaaattttggagacaaaaaagtgtgcaaaacatagctccaaatgtaatatgacaaaaaaacattggaggatgaagttgctaaccttttaggcacctccgattcgtatataatcaccaaagtaaattcactataatttttggcatgacctcccctcttttttgaagaaattttgaagcttgctcaggctggaggaggaagaagacatatataaaggggtgggactttagtcccggttggtgttaccaaccggtactaaagatcagcgggatctttagtcctggttggtaataccaaacgggactaaagttacgatctttagtcccggttggtagatccccggggggcctgacaagccctaacagcatttaaaccaggactaaagataccaaccgggactaaagatcaaatatgcccgttaccctttttaatcgggactaaagatcatctttaggcccggtttttattgcaaccgggactattgtggaaatagcccgagcgacgaaagatggtttctccaccagtggatggtagtacgtatttatatgtatgattctctcttagcaattaagtggtaccgtggagggctaatccttctttttttcaatcataaatcgggactaaagatcatctttaggcccggtttttattgcaaccgggactattgtggaaatagcccgagcgacgaaagatggtttctccaccagtggatggtagtacgtatttatatgtatgattctctcttagcaattaagtggtaccgtggagggctaatccttctttttttcaatcataaatcgtataagtacgttttatttgttcatctttttccatgagtagttgtacgtacgtgtattgtatacgtacaactactcgcgatagaaattccgtttctgttcgtttttctcacggcaacaagtccgtttctgttcatttttttccgtgagtagtacgtacgtatatgtattctgctcattttttccgtgaagtactacgtacgctacgtactacatagtactactcacgggagcaattcagttttctaaaattcaagggaggttagctggatgtattttaaataaatctaatctaataatttaaaatataaaagattcactaattaaattaaaatcaaggattgtatgtttttttatagatttgtaaggtttctctaatttattagagtaccgtgtgatggcatatgagcatttgtaagagtgtcacatgttggtttatgagtgtttttaaaaaatttaatggacttttagtattagattatatagatatacgatattattttcagatgagcttatagctagtatttagctagatattattttcagatgagctatagctagtatttagctgatctactattaaacttgctattacgtgtattcctctttttcattcaagccatttttttaatagacacaagcaaataaattttaaattaaaaaaacaattacctgttaacagttaatatcgatttgaaaagacaagagcatcttgctattcaagagaggcctaaacaggttttctaaaatgtaaattttaggatttatatcaaaatcaggcctctaacagattcccagccaaggtcctaaaatttacccacacctaaaagcagtgccaatctcgcccagaacttgggaacatgtacgccctcccaatgacactcgattatcgcgccacttttttacctgtccatgctaatttctttctattggcaccattttttcttctgcctgcttccttttttccccttctctcgtcatcattttctttctcacgctagctcgcacacgccgccgtcacttcgccacttaggatttccactgggtcgcctccaatcctccgtccgtgccgtttcattcgccatctcccgcgccgccttcattccatccatagtgccagcgaccgtccatctggtgcaccggcggccctcgtattggtgggcagcggcccttcatcaagtgcgccgaaaacccctcctaacgtgagggtcgtctaggatattaacctgcagactgatgacacagccgtgtagaggatcagctaggccttctgtttttcccacattagaggcaaatctgtcgtcaatacaaccttctgtttttccacattataggaaaaatcttgtatcaatataaccgtggccggcgagggattctcttacggcggcatagaggtaagatagcactttaaaagggctaactccggcatgtatggttctatatatacatgatccgtaatgcttgtcctaacttattctcagatcgagctagagcctagacatagagaaagtatgagcattgtggtgagcaagtcggcgccggtggtcgtccggccaacgctgccgccggtgaagacttccggcagcaagatcgttctgtcgcctatggacaagcttagtgccatgacgccaaccacagtgctgcttgcgttcgaccatcccatcatccataaccatgagggcatccgatcatcctgcattcagatgcaggccacggcggaatacatcaagagaggtctcgctcaagcacttgtccactactatcctttcgccggccgcatttcctgcgacgacgacggcggcgatttttacatcgactgcaccggcgaggagctcggagcgacgttcgcgtgtcatcgacaaccagcccactgacgccgagacggcggtggtgcagcagctcgccttcaactgcacgcccgacgacgaccacctacctcactgtctgctgtgggtgcaggtcaccacgctgtcctgcggaggcttcgtcgtcggggtgacatggaaccatgccgtggctgatggtttcggcatagcacagttcatacaagccgtcggcgagctcgcccgtggcctgccatcggcgccgtccgtcaccccagtcaggttagatgaccaaaacaacgccgtttctcccttcaccatggccttcatgcagttagcagacaggcacaaggtaccagaccttaccttcaacaacgtgaccgtcccgtcgaggttgatggaccacatcatccgaggacgaacgaccaacgtcaccgtgttcgaggcggtcgccgccgtgctttggcagtgccgaacccgggcggtgatgacaaatccagaggcccccgccgtgctgctcttcgcggtgaatgcgcgaaagtatctcggagccaaggatgggtactacggaaactgcagcacgatgcacgtggccgtggcgaagagcggcgcggtggcgaacgccgacatcaacgacattgtagacatcatacggcgcgccaaggagcggataccggagcagctcaagatgaccggcggcagcgacatgacgatgctacgggagctcgccgatgaccatcgtctggatggatatgagagcctgctctacttgacatcctggcgaaacatcggattcgaggatgttgatttcggcagcggcaagacggcgagggtgatgacctacccgcagagggaggtgttctccaagaaaatgcccatctgcttcatgctcaagaacacaccacaaggggctagggtgatttcaggctgtgttaaagctcaccatgccgacgccttccatcaagaaatagccaagctcaacgccaccacctaattaactctgcgagctacctacagtattatataacacatgactctcagatcataataagtaaataaatccatcaaacaaactatatatgcctggtgttatcatgtaccctctcaatttgtgccatttatctataattagatttatcattatatcgttcacgcataaacaattcatgagcctatcctatctgtataataacaagccaggtgctcccttcattttttaatgtattatgccattgaattttttaaatacgcaagaccatttgtcttattaaaaaaataatctaatattcatttgtttttattgagatttgattcatcatcaaatattttttaagcatgatttaaatatttttatatttgcataaaaattttgaataagacaaatggtcaaactttgataaaaagttaactgtgtcagacattaaaatacggaggtagtaatctctattattgtacttcatcaattcgtcatgaagagatctactccctccgttcatattatatgtcgtttgatttttttttctagtcaaactaataaagtttgaccaaacttatagaaaaatttagcaatatctgaaatatcaaattagttttattaaatataacatggaatatatttcgataatatgtttattttatgtcgaaattactactatgtttttatctaaggtaggccaagcttaaaagtttaactagaaaaaaattaaacgacttgtattatgaaacagagagagcagtaaagtaattcttttttaaaaaaataaatcatcacaagacagttcctatttcgttgaatgtagcagcaaattccaaaaacattccgtcaggagagcggagaaaccatgtgctctgttagccctgacaaccatccttgccacctcagttggcgcccctcgccgctgttgcatcgaatacaggaaccaagccaactagagagaatgaatggttggaacacacttttagtggaaataaaagtaacacttaaacttgacaaagtttaaatgcaccgatcacacggctggattgatgtcagtctgaccgcagtactccggccgttctgaccaccgccttgagccggttggaccacctccctatcgccggtatgaccgcctgctagttagaccatacaatgaactccagtcaaaccgtcgggatctagaaaaacacgtatcgatgaaactcttgaaagtagatctactttattgcatcaatatgtgtttacaaagtgcatctaaagctagcattcctctctcaactctttaactaggattgaagcgtcgaagaaaaccctaacttttctctcccaaaaagtcgatttcttctagcctcaacccctcatgtatttatacccacaacctgcttcttgtcactgtattactgcaccaagtctgctgcgccccaatgcagtaatgcttgaagtgtttctcccaggatgcaccctggccgtgtttcagcaaacttttggatatcttaccacaaacaaactgaaccccccctgaaccagatgatgttcacactggtggagaaatcgtttgtagtcccagttcgtaacccccctttagtcccggttgtccaaccgggactacgaatctgggactaaagatagcgatctttagtcccgggtaaaataaccgggactaaagatcgatctttagtcccggttggtaacacgaaccgggactaaagatctatgtaccattttttttatttgcatggccctgtttgctgcatggttgattatatatatatatatatatattacaatacattatatatgcattgtaatatatatattatgcatgtatatagaatacatatatatatatatatgcgtatgtatatatatgtataaatacatatattacacacatatttataatttaaagcacttaacattttatgtacatatatgttaccaaaatatatattaacactaaagtaaatgtacatacatatataaatatatatatacatgcatgtatagtacaattcatttgctcgctagctatagctacgacttcgacgcctgcgttacatcagaagaggaaggaccgacgttatgaattgtcgatccatcgtagtagaattcatcatcgtgattaaggacttcttcgttaatgaaccccatcagttgttcttgaacagccgtgataaaatccttgtgtgggagtttttccctcatgtgaatacgctatcattcgaaaaataatgacatatcaatatatgaaattaataaacaacttaacaaatcgatacgcaatgaaattttgaatggtttatgtatacgtacatcgagctctcgtatggtgtatatttggtttgataggcagtgggcatactcgcatacgtagtagccgcataagttagttccattgtcctgctttgcacactacatgagaaacgatgagagatttaatatactctttatattaactgtaacaagagattcaattcaatataattttggatcatgcatgtactcactggaaaatgaaacctccgtccaagtttttctttccaagtcccgcggaccaattgacggaaccgatcccaagccctacatgtgcagttgcaagctatgattaactaaatattacccgagatcaacataatagcaacagagtcccgcgactttggaatagatggcattatattacatatctatcagttggaagagcttgtcaaaaaccttctcctctttattcattgagtcgtacacagtgactctgcatgcgtccaagtcgaaaaagaacaggacccagtggaatctagaatatgcgtgatatgagataaatatcagaatgtacatgttatatgtatgggaacgaaatttgttcgaacaacaataaaaactcactctgtgttgtacgtcaatagtatgaacgtcttgaaatgctgctgcgttaggagatggacgagattgtcctctgtgtctttctcgtacttgtcgagcatttcggtgttgattttccgagggtcgatgaacccagtatcgtaaaccccgtcgggccctttcaatctccattctacaataatgaaaggaaattattattgcttacacatatgccaggagctaattattgaacgaaacaaatcgaactcaaagatacttacaaaatccatgcgctcagaagagagacgtcgagggcgtcccgatggtacagatcgaagacatccttgaaatggatccatagaacatcttctccttgcaagaagtcggggtttctgatcctcgctccgaacatctctctaccattggcgctcatttccatgtaccgttcatggaatttgtacatttgtgtcggtagggactgcagctgctcaggcctgacaagcggtttaccgagttcaaactagtatgccacttccgccttcgggattggtgcgcctccaaccaactgagccatggttagaccagtgtccgaaatgaaatccgttatgccaaagtcttcgccggtcaccaacggctcgaccacttggtttggttgttctccaagctgaggaactgctttggacttcttgtaataggctttcctaagtgttcggtcatagtccgatagctttaaggcctccttgtttgtggtggacattcccttgaagaaattcttcacgctcgggtcaataggtatcttcttttcaggactccgaggcttgagttgcctcttcacttctcctgccacataagcgtcaagctcctcttaactgcaatcgtacggcggctccttgtttttggtggtgtcaactttggccttcttcgttgcccttgtgctggcaggaggtggagcttggcgagaccttgtcttgggaggtgcaggcggacacggtggaggtggaggtggaggaggcggaggagccggaggagatggtgcatgaggaggtggcggaggagccagaggagatggtgtaggaggacatggcggaggaaccggaggagatggtgcaggaggagacggcgaacccggaggagatggtgcacgagacgccgcttgtcgcccagggaggatgatgtaccgcttgcgctatagtataatggcgtgccttgtgtctcgtagatgcgtctcaccatctcctcctgggtagtccaactcgaggtcctcgtacacggcttccaccagctcaacttcgaccctcgagtatcctgctggaatcggcctgcagtggtaagtccctgaaatgtctgttgggatggccattcccgacgccaccttcacgtgatgagaggttatctattagtaatcaaactaaccagcaacttgcagaacgtacgagtcaaaaatcatatattacatcgagcataccttgattgataagttcttgaagggaatatgcagctcacatggtgtccgttgcgtgatctcatcaacggggcaggtggtgtcgtcatgggtttgcatggcgtccatgctatgtgatactacctgccccgttgaggcgcagctactacgattgcctgatgggctgaccattggaggaggtatgtacggctggggatcgtgtgaccgatgtgctgccatgcgttcatccactttccgggccacctcctcttgcatgctgagttcgtagctcgataccctgtactcaagatctgcaatcttcgcctcagtatctctcttgctcctcatccgactcctgtacgtgtggatgtcctccttgattcccatcttctagggaatcacgcctttccctcgtgttcgtcctagatgctcgagagtctgtagggcgagtgacagctcgtccttctctctgtcgggtcggaacgtgccctgagaagaggcttccactgcgtccgttagtcgattcgtagcctcgcgtatctgatcgctgaagaccaaggagccattaactgggttgagcgttccaccatgagaatagtaccagaacttcgatcgatcaggccatttagcggtggacggttcgatacccctctcaagcaagcttgcctccatctcctcccacttcggcatcgcgacgctatagccgcctgaccccaagtggtgatggtacttcttcttagcggcattttctttgtttctttccatcatcgcctgcccttgttgacctgtcttgtaagcaacgaactcgtcccagtgatcccttagcttcgggaatacatcgaagttcggtgtctgcccccttcaagatgtatttccggtacaaatctcccttgaaggtctagaactgttctgccattttcttaagagtccactgtttcactatgttctctgtacccgcagggagcgtgaacgtctcgagcattgtggtccacagcatctctttctctgattccgggacaaagctgtcatcatccccgcgtgcccttgttctgcgccagtacaccttgctaacaggcacgttatccctcacaacccaaccgctgtggcgtacaaaattcttggctacttgtgccggggcactaggtcggccgtctgcatccacctcagttatgatgtgccgaccctctatcttcttcgcagcacctcgttgtccgcgtgccctcttctgtccagcgtagggatgacttccactagcctcctcctcgttcccctccgcatccctctccacgttcccctcctcgttcccctctgcatccctctccgcgttcccctcctcgttcaagtactggtttggatcctcgttcccctcttcttcgttccagtactggctacttcccgatgcgattgtatcgtacagtatctgttcctcatcgcgatcagccatctgttcatagaagaaatatttgctaagcataatattaacactctactaatcttgtattaaaactcaaataatcatatatgctaagtctaagtgtcatgtatttgtatggtagataatcttatatgctaagtctaattaagtttcgaatattacatctctaataatcttatattaaatctctaacaatcaaatatgttttgaatattacatctctaataatcttatattaaatctctaacactcacatatgctaagtctaattaagtttcgtatattaaacctctaataatcttatattaaatctctaactatctctaacactcaaatatgctaagtctaagtgtcgtgtatttgtacgatagataatcatatatgctaagtctaactaagtttcgaatattacatctctaataatcttatattaaatctctaacactcacatatgctaagtctaattaagttttgtatattaaacctctaataatcttgtattaaatctctaactatctctaacactcaaatatgctagtctaataatctaataatatctaacactcacatatgctaactctaataatctaataatcttatattagaaatctaacaatcttatattatatctctaacaatcacatctttacatcacttgcctgcgcgaattccttcgagggctagctaccacttcggcttgagggacgacgacgacgacgtcttctctgcaacatgcaaaaaaaatgtattagtctaaacgcaaaggaacatataatgtatttcacgttttcaagtatatataatcatatatatatgctaagttcaacaatagtttaattatctcgttcgtacatgtttcgctcgcattcgttctaacacttttagttcaagtgcattcacgttcgttaacgtttcaatcacgtttgttcgcgtttcattcacgttcgtttacgttcgttcacgttcgttcactaacactcacgttcgttcacgtttcagtcacgttcgttcgcgttcgttcacgttcgttcatgtttcattcgcgttc

SEQ ID NO: 73837 - DNA, 8172 bp, Oryza sativa
atggctaaacattatctctaacagccccccctcaatcataacttatccaagttaatattgaacctgaaattctgaaactgttgcacaggaagagatttagtaaagccatctacctcttgatcccctaaggagataaacctgatctctaattgcttacttgcaactctttctctgacaaaatgataatctacctctatatgcttagtacgagcatgaaacacaggatttactaacaagtatgtagctcccatattatcacaccataatcttgcacatggaggtgaatcaataccaatttccttcaacaaagtctatatccacattacctctgccgttgcattagcaacagctttatattctgcttctgtactggacctggagactgtagcttgctttgtagcactccaggataccagatttgatcccaagtaaacaacaaagcctccagtagacctcctatcatcaacagatccagcccaatcttcatctgaaaaagcacttacaagagaagaagaagacatgttaattcttaacccaagattaacaatagacgtcacatatcttaaaatcctctttactgccatcgtgtgttgcactgttggacaatgcaaaaacggacaaaccttattgactgcaaaaggtaaatctggcctggtcaaggtcaaatactgaagagctccaactatacttctgtactttgttgcatcatttattcctaattcagaaccattataagctgagagtttctctatagtagagtgaggagtagaaacaggtttacaagcaatcattcctgcccttttcaacagatctgaagcatacttttcttgtgtcaataacataccatcactaaccttttcaatgccaagaaagtaatgcaaatctcccaaatccttaagggcaaaatccttcttcaaatcacttaacaaagcatctgttgccttctgtgtggagcttgccacaatgatatcatcaacatatattaaaacaaacatattaactcctcctttactttggaagaacaatgaaatatcagcttttgatgctttaaaaccaagatcacataatttgctgctaagcctagcataccacaccctaggagcttgctttagcccatataaagccttatcaagcttacaaatatgattgggtttactcttatcttcataacctcgaggttgtttcatatagacttcttcctctaacaagccatgaagaaaagcattctgaacatcaagttgacgaagtgaccaacctctagagacaacaatagataaaatggttctaattgtagctggcttaacaacaggactaaaggtgtcctcatagtctataccatatctttgtttaaatctctttgctactagacgagccttgtatcgatctaaagttccatcagacttgtgtttaatcttataaacccatttgcaatctataacatttttttccttacttggtggaactaagtgccatgtcctattattcagcaaagtactatattctagatccatagcatttttccagttttgattacagagagcttcatctaggttttgtggtttaccactagcagcaagtaaattatacctgactgttccatcagtgtagaccttctcctttctaatgcctctctatagacatgtcaggggacgtgacggctgttgctgatcagatgtcgttgtcgacgactgctgctgctgtgatgctatactactgcgactgccatcatgactgccgccatcattgcccccctatgtcgcacggcgactggcgctagcagccgacatgtcgccactagaatgggcgacatcaccaccagatgttgtgtcaggctgcacagactgctgtggcggtgatcccagcatggagtcaggaccaggaggagcgggagaatcgccctgggagtcagcgccgtcaggatcttctgcggcaatttctagatgatctgccgcttcattttcttcactattttgtgcactgttttcgtctgaattttctgctgcatgctcaatagagacattagaatgttcaggagaatcaaacatatgatcattcacatttacacccgcactagcaacatcaggattcaacaagttaggtggaagaagaagaatttcagaccgtagtcttgcaccgggcattggaatgcatttgagagaagggaaaatttttttcatcaaagaccacatcacgtgagatatagatcctgccggtagatggatccaaacatttgaaccctttatgaatgttactatagccaagaaaaacacattgtgtagatcgaaattgaagtttgcgggtgttgtagggtcgaaggttaggccaacaagcacatccaaaggttcttaaggaagactaatcatgtttctgttttaacagacgttctagaggtgtggcaaattggataactctagatggtgtgcgattaatgagatatgtagcagctaggaaagcttcatcccaaaattttagaggcattcaagcatgagcaagaagagcaaggccaacctctacaatgtgtctatgcttatgctcagcggagccattttgttgatgagcataaggacatgaaacatgatgactaataccaattttggtgaagaaagagtgtagcttttcatactctcctccccaatcagtttgtatggcaattatcttgtgatcaaagaccctctctacaagttgctgaaaatcaaggaatttctgaaacacttcagattttttctttagcaaatatatccaagtaaatttactaaaatcatttataaaactcacataatacttcctgcccccaaaagaatcaggagcaggtccccatacatctgaaaaaataagttcgagaggcacacttgacacacttgacttaggatatgggagtcggtgactcttagctttctgacaagcatcacagactcctgactcacttatatctcctaaacatgggagactattattcttcacaatttttgaactattgcaaaagaagaatggcgtaaacgactgtgccattgggtgaagctaggcttgatggctccaagggcttgcttgaatggagggatcgacgactgtcgtaggagatataacccattgcggcgaggtcctctaagaagaagattcttggtgtccagatccttaatagcaaagaaatgagaatgaacctcaataaaggcatgattatcaaaggcaagtcgatgagcagaaataagatttttgtgtgcatgcggaacatggagtatatttttgacacataaattgcgtgtgggtgtatgaatttgagaatggcctatatgtttgatttccataccttcaccacttgccgtgtagatctgatctttgccattgtatttttcatgggtcgtcagcttctctagctctcccgtaatatgatccgttgtaccggtatcgatatactagttttgatcaacattatatgatgcagctgctgctaccttggcatctggaacaaaagaatcatcaaacctgtgccaacagtcggcaacaacatgccctatcttgccacagagctagcacgtggggcacggcttggagttgttgtagcggccgcctccattgtagccgcgcccgcgaccaccgcgatccccgcgaccgccattgttgctgaagttcccgcgagctgcgccattgctgccgccatggttgaaggcgaagccgccgatgctgccaccttttccaccgccgccgcgctttgcgctattagcgcaggaatagccatgatttgctgcaatctgtcgcagcttccctctggactcgaaactgagaagttgtgagtaaacttcaaaaattgaaactggttcgtgtttgcctaccaaactggagaccaccggttcgtagtcatcaccaaggccgaccaaaacatagcccatcagttcttcgtcgacgaggggcttgccggctgatgccatctcgtcagcgagtgttttcatcttgctgatgtagttcgatacgctgaggtcgtctttgcgcgtcgtagagagcgcaagccgtgtgttgagggcacgcgatcgcgactgggaggacaccatctccgtgattgccctccacgcctgcgccgccgtgtccattgtcacgacttgcgtcaggatctcctttgacaaggaggagaagaggtagccgaggatttgctggtccgcagccaaccaggcttcgtacgccaggttcatggtttcggtggccctgccaccttccttctccgttggaaccatcaccatctgggacggcgacttggtggcaccggtgagatatccttccatacgtgcgcccctgatcacggtaaggaagttgctgtgggtaagtttgtctaggatcgcttgcctagagaggggattggaggtggcactactgatggaggaagccatcgcccatagatgcaacctcggcgtggcagataggccctgataccatatagaaattatgtaagcattatcacctcgtctcgaggccgcgtaattgtatttatatgagttgggaatagctcccaaacgtggcttacaagaatgagatcggatcagccagagttcggttgtaacagcccaaccttatgtcaaccaatccatatcacatgtgatatttcatgtaacaaactaatggctaaacattatctctaacagtgccctcccctcctccagatccgatgggaggggatacggcggtggcccggcggcggcggcctctccttacctcctcgtcgtggcctgtgaagactagctctacccccccctctctcctctcacctcagtggccactagcgtggaggtgggccaccggatctacccacttctgcgatgttgtcctgctgcttctacctccggtgagtacatgtgccgacgcacatcctctttctctttccatccatctctttctacccgcaccatttctttcccttaacattatcttgatttctagatttggaagaagcttttctctagtagatccaaccgacgacgcgcacggagggatggaggcggagcaatttttgaattttttttaacactaattttggatttattttttatggctgtgaagcatctgctcggcccaaattgagttgagctagttttttttttcaaatcatatacatcaaaggtgccggttcttaaactgacacctttgagtcattctcatcagtgtcgtctccatggtgccagttgggaaatccggcaccgatgggggttacccaaccagcaccaatagcccattctttagtagtgcgaatatcaccatcaatactggttttatctgttagagaagtcactatgcccggttttacggataaggaatataaataggattaaacttatatctgagagagttatattggcctttttccttagtaaaatgcccaaaacagaaaaccctggtcttaacctctcatccgttacgctagcattgctcctattccataaaaagataaaaatgaagaaaaaagtttaatcacttctaaataacgattatacccgttcaaacttttttttataataatacaccttcaagtttatactgccactaactagagtggtaatataaatagatctaaatccttctatcaaatgagatcgacggtttagattgcttcttactaccagtacagagcatgagcatcctagtgggactataattaagtgagggtgtgagatggagtccaggcgttgatcccaacgaggaggttgcacgtatgcgcggatatgcctggctcatgagcgaagctcgatttaaacattcctggcgtcctagctcgggagatacgggcctgcctcgcacgtgcatgcatgtgagctacatgcaaataccccctccgtactataaaaaattcaatcctaactacttcaatcctaactacaaacctgacttgttatttttggacagaatagtaacaatactctctctattcaaaagtctaacacctatttattttattaccaagattaggaagtaattaactcatccaccatatgaaaaaacttatgagcgtgcaatccataagtactaaaatgacttcttttttccgatcaataatttaatttagcacatagtgattaccaataagatttagagtttgaaacatatcaaacaattttagatttctggatggaggaaatatataatatacctgcacgcgggatgcgagacagcgacgaaataccaaagcttgccctaattaaataaataattaattcgacgaagactaggaacgaccaatgatatctattggccaaccatataacactgtggaactgcatatcgaccagtatatatgaaaagtcacggaggaggccagcagccagcagccagcagccagcaggtatgtatgtatgtgtgtttatagcaaatccgttatattatatggttgtaatctctatagtactagatctgtatgactactgtattaattatatgcttacgtgatcctaacttatcaatggtagaacacccagacggatattaatttagaatgagtattgtggtgagcaagtcagcgccggtggtcgtccggccatcggagccggccacatcgacggccgacaagatccttctgtcaactttggacaagcctgttgccacgataccagtgaccgtgctacttgcgttcgaccaccccatccatgacgccaccgcggagaccatcaagacggctctcgctcaatcactcgtccactactatcctatcgccggccgcatttcctgcgacaatgacgacggcggccatttctacatcgactgcaccggcgaggatctcggggtcacgttcgtggccgcgtccgccaactgcaccatggaggagctcatgtgtctcgtcgacgaccaggctcccgacgacgagacagcggtggtgcagcagctcgccttcaactgcacgcccgacgaccttcatcaccgtctgctgtgggtgcaggtcaccactctcaactgtggaggcttcgtcgtcggggtgacatggagccatggcgtggctgacggtcccggcatagcacagttcatacaagccgtcggcgagctcgcccgtggcctgccatcgccgtccgtcgtcccggtcaggttggacgacaagatcgcaacccaagccgtacctcccttcaccatggccgttcatcgcttcatatccggcctcaagccagtatcaaacctcgacgtacgcaacgtcaccgtctcatctagccttatcaaccacatcatcgtcggagctcgtcgtcgtgccaccgtgttcgaggcggtcgccgccgtgctctggcagtgccgtacacgggtggtgatgacggatcctgaggcccccgccgtgctgctcttcgcggtgaacgcacgcaagtacctcggcgccaaggacggctactacggatgctgcaccgccatgcacatggccgtgtccaagtccggcacggtggccaacggcgacatcatgaagttggtcggcatcatacgccgcgccaaggagcagataccggagcagctgaaggcagacgacggcgagatgatgctacggacgatggtaggggagaagcaggtgaatggatacgagagcctgctctacttgacatcctggcgaaacatcgggttcgaggacgtcgatttcggcagcgggaagacggcgagggtgatgacctacccgccgaggatgctgtccatgatgcccaggattgcgcccatctgcttcatgctcaaggccacagaggaaggggtcagggtcatgtcagactgtgttacggctgaccacgccgatgccttctatcaagaaatagccaagctcaaagccaccacctgattataactatatatgcgagctatctataccttcttcaatatgccaattatgatttatctacaataaaaatttgaatatatataccgtgcaagagcatgcatgaacaagtaattctatatgggactcttctacctgtatcactatttcactatacatttatggttctttaatttttagatatggaaatttattactggccactgggctatcaagtgcacatagcctacatctatatctaattaaacaatagagtaaaatgcattagcggtgcttaaacttgtaggattgtgtcatataggtctctaaactcttaaaatacatatctaggttctagaacttgtcaaagtgtatcatttaggtctcaaattgacacatcccctctaggatcctacgtggcg

SEQ ID NO: 73838 - DNA, 12079 bp, Oryza sativa
tcatcaaagattgggcccggtaaatcaggatcatgacccggaggatgatgaaaacaggaagactcaatggtgtcctcctggcatatttacaaagaatcagaagagaagggttcaaagattgagaaactgagaacgcttgcaggaggtcgagcaagagatcaatcaccggctaaagaaaacaaagccgaagcaggaatggcgcgttaagaaacaagctcctgtagccgatgaagcaaagagattggccaaagggaaaggcattgtgattgcgtcggttaacatggtttttaccttgccagccgaatttaggatcgaccaagccgatgttgaggaaacagaagaagaataggctaaattgattctatcaccagaacaagcagtctttaaaaagcccgagggtgcagagaatcggcatcttaaaccattgtatataaatgactatgttaatgggaagccgatgtctaagatgatggtcgatggtggagctgcattaaatttgatgctttatgctacgttcaggaagttgggtagaaacgccgaagatctcatcaaaacaaacatggtactcaaagactttggtggcaatccatcagaaaccaagggtgttctaaatgtggagctgacagtcggcggtaagactattcctactacgttttttgtcatcgatgggaagggttcttacagtttgttgcttggaagggattgggttcatgccaattgttgtattccttcaaccatgcatcaatgcttgatccaatggcaaggcgacaagatagaaatcgtgccagccgacaggtcagtcaatgttgctagtgccaatttagctctttgggagatggacggccttgattgtttatccggcaaagtttgggatggagattttctaaaagtgtccgattctgatatacagccaattgaagatggagaacccaagctattactttgagggcatcgtggagggttcaaacgtctacaccaaggacacagtagatgatctcgatgacaagcaaggtcaaggttttatgtcggccgatgatttggaagacatagatataggtccaggcgatcggccgaggccgacatttattagtcagaatttatcttcagagtttagaaccaagctgatagagctcttgaaagaatttagggattgcttcgcttggcaatattatgagatgcctggactcagccgatcgattgttgaacatcggctacctaccgaaccaggggttaggccacatcaacaacctcctaggagatgcaaagctgacatgctcgaacctgtcaaggctgagattaagtgcttatatgatgctagttttattcgtcgttgccgatatgccgaatgggtttctagcatagttcctgttatcaagaagaacggcaaggagagggtgtgcattgattttagagatttgaataaagctactccaaaggacgaatatccaatgccagtggccgatcagttggttgatgctgcttcaggatataagatattaagttttatggatggaaatgtgggatataatcaaatctttatggctgaagaagatatccataagacggctttcaggtgtcctagtgcaatcggcttgtttgagtgggttgtaatgactttcggcttaaagagtgctggagctacgtaccaaagagctatgaattatatatatcatgatttaatcagctggttggttgaagtctacattgatgatgtggttgttaagtctaaagaaatagaagaccacattgccgatttaagaaaggttttcgagaggaccaggaaatatggcttgaagatgaatccgacaaagtgtgcttttggcgtatcggctggccagttcttgggatttcttgttcatgagagggggattgaaataactcagagaagtatcaatgtgatcaagatgattaaacctccggaggacaagacagaattgcaggagatgatcggcaaaattaattttgttcgaaggtttatttctaatttgtctggaaggttagaaccttttacaccattattgagattgaaggccgatcagcaatctacttggggggcagaacaacagaaggctttggataatattaaggaatatttgagttcccctccagttttgattcctccacagaaaggaatacctttttggttatatttatcggccggtgataagtcaatcggctcggtcttcattcagaagcttgaaggaaaagagagggttgtgttctatttaagtcgtcggctcttggatgcagagactagatattcccctgtggaggagttatgcttgtgtttatatttttgatgtatgaggttaagacattatctactgtccaatgaatgtactatcatatgcaaggccgatgttgtcaagtatatgttatcggctcctattctgaaaggaaggattggaaagtggatattttcattgactgagtttgatctttggtatgagtcacagaaggcgatcaaaggacaagctatagctaattttattgttgaccatcgtgatgattctatcggcttggttgaggttgtgttgtggactttattttttgatgggtcagtctgtactcatggttgtggtatcggcttagttataatctcccctcggggggcatgctttgagtttgcctatactattaaaccttatgcaactaataatcaagcagagtatgaggcagttcttaaggggttgcaattactcaaggaagttcaagctgatactattgaaatcatgggggattctttgttggtgatcagtcaattggcaggagaatatgaatgtatgaatgatacgttgatagtttataatgacaagtgccaagaattgatgaaggaatttcggctagtaactttgaagcatgtatctcgagagcagaatattgaagctaatgatttagcccaaggggcatcgggatataagccgatgatcaaagatgttcagatttaagttgctgtcacaacagccgatgattggagatatgatgtctatcggtatttacgggatccatctcaatcggtttcttggaagttaagatataaaacgttgaagtatacattgttggacgatgagctttattatcggacgattgatggggtgttgctgaaatgtttgagtgccgatcaggcaaaagttgcaatcagtgaaattcatgaagggatatgtggcactcatcaatcggctcataaaatgaagtggctgcttcgacgtgctggatacttttggccgacgatgctggaggattgtttcagatattataaaggttgtcaagattgtcagaaatttggagcgatccagagagcgccggcatcgactacgaatcctattattaaatcatggccgtttagaggttggggaattgatatgatcagcatgattaatccaccgtcaagtaaagggtataagtttatattggtggcaaccgattattttaccaagtgggtagaggcgattcctttgaagaaagttgattctgggatgctatacagtttgttcaagagcatataatctatcgatttggtatccctcaaaccgttacgactgaccaaggttcaattttcgtgtctgatgagtttgttcagtttgccgatagcatgggaatcaaattgttgaattcttcaccgtattatacacaagctaatgggcaggccgaggcatctaacaagagcttgatcaagttgattaagaggaagatttctgattatcctcggcaatggcatactcgtttagccgaagcattgtggtcttatcggatggcttgtcatggatcgacacaggttcctccttataaacttgtttatggacatgaagctgttttgccatgggaagttagaatcgactctagaagaacggaattgcaaaatgatttaacagccgatgagtattacaaccttatggccgatgagagggaggatctggttcaatcacggttacgagcccttgcaaaggttaccaaggataaggagcgagttgcttggcattataacaagaaagtagtgcccaaagatttttcggaaggtgaacttgtatggaagttaattttgtcgattgggactcgggatagcaaattcagcaaatggtcgccaaattgggaaggaccgttccaaattcataaggtggtatctaagggggcttacatgttgcaaggactcgatggagaagtttatggcagagcactaaatggcaaatacttgaagaaatattacccaagtgtttgggttaacgcatgatcggctgatgttgccgatgcatgatagccgatgtgtttacattgccttgagatgaccgatatggttatatcgcacttagttcttttcatattgtaatcggttgtggtttgccgatgtgcaatggtcgatatggttatattgcccttagtcgtttttataattttatcaatgtttttgacattgtaaaattaggggggcacatacatggaaaattgcaaatttttgagcatatttggcagttatgttaatcggcacaaaggattatctagacaagttgaataatagcactagggtatcttagccgagtacaaaaaatttcttgaggtctattatacagaatatcactaagacaaatatcgttggatagccgatatagccctctgcctaatttgttctacttcttctatggcttgggcatcttgagcatcggttccagggatgactttcaaggacttggtcatatcagcgatattcttgatagccgatttcagcctcgccttctgttcttcgatagcttacgggagatcggctaacttcttgtgctccatatccagctcggcgttgcattcttgaagttgtgccatgagatcaatcttacgagcttcaagccgatcaatatttgacttgatcgggccctcagacggctgatcaagcttggacttctcttcgtgcataagctgccgattgtgctggattgtagcttcgatgtttttgcgttcccggcgatcggctaatctctacttggccttctccagcttgaattggtgttgctcaaggtaaacggctggagtaagggcatcggttagttcatccgggagtagagcttggatatctgtgaacctggcctggatcgagccacagttggtcactaagttgtctaatgatgcttctagccgatgagagatatcctcgagcattctcttcacatcatcagacagaggagctacagctttactggtggtgtcttcctctatttcatcgagataatccttgatgtcgaaagaaaacatatcggctaagacctgcaagagataatattatggatggttaaggatcaaaacatgattggctgatctcagatttgtatcaacaaaaacttactggaataacaggagcagctggttgttcttcctcttcgacgttatgactgtctgcaaccgatggagtacggttgcttgattctcgctgcacaagaggtgaaggaggaggaggaggctataaaaagataaatgttagacataattccggccgagattagttaatgagaagacttagaatatcttactggtggagccggtttgagagttggtgctgccgatttcttcctcacggcagttttcttcttctgtgattatacatctatgagtaatcggctgaaaggtaaagtagttacagaggaaatcgaagagagatgcttactctcgaaaaatgagctggggcagaaggagttggaggagtctgcttgggtgaagccgatggtgttctctctgtatcgctcatttcggctgcagcctgatcaatgtcctcttcaatctcttcttcatctagcgcttgttcgatagatggatctagggcagacagatcatcaactggcttggttttctttgatttgattttcttcttgagagctggagctgatgtgtccatagtcgatgatctggtttttcttttcttgcctgcatcagctggttccctgattaagccttggagaagagccgaagtcttgggggcatcatagccgatgaatggaggagatggtccacctccatttggaattattcctggggcatattcgatatcttgccactattgctctggtgtgggggagaagattctgttgtctataaaacagaggattagattaatcaagcgatgaatcggctaataattgttcaaatacgattaataaaataaagacatagctaaggaacaatatctggaaataggtctatcttgaacattgaagccggttgatggaaaagatgcagcttccattcaccccaccatctgtcgaagtttctactcctgaatcttgccaactctatattttcaatgctgcccaatggaggtccttgaagattaagcagccgattcatcattaaggtagatgagattttccctcggcattggatcttatcggcaaaaaataagccaattggaagttggcccattccaaactgcctagcagagctcattggatgataaaattcatatgagacgtaagtgtttcttccttgataaatgccaacaggaaggatacatgggctgattgcagttgagaaaatttctctgggtttctgatatctgtcatggttgatgtcttcgaatctaaagtccaaaggattttccagaagcgttgaatcttcatagaggaaccagactcgagcttctttctggaatccttcataaaagctgcaaaaccaatctttgagcagttcggctgatagctttgctcctgcatcgattggtgtggaggcatattctccgaaggaggtgcatctccgatgagtgcgttcttctctgtcactgtctttaatcggctccagtcttgggaattcagcttctgttacaaatggccgattgacaaacttcatgactactaaattcaaccaggattgcagtagccaccatggtccacccgctccgactactgagccgacagctaacttagccgatgcattatttagcatttggtacaagtagccgaggaggattttgcctaaagggaattgtctctttgtttctaaggcttcggctacagattgccaattggttgtagggccacagcttgatccaaagaagaagaatttctctagccacatcagcaagaaagccacatgttctcggggggtgaccggaccctggcccatgtatgctgcaatatagcccgaccagccgcctatgctcttagtcttgaagtcatattggttttttgtgttcaggctcatagggttagccgatgaggtgatatctagacctgtgatcatgatgatatctatgagagttggggtcatcggcccttggttgaataggaaggcgttgatggtgttgaaccagaaataagtggcagctgccattaggggttcgtccttagctgagttggctatggtaaggtcgagtgcttggccgattccaatttcatcccaatgaactcttttactggccgataagcgtttgaaccatgtgatccagctcttctcgggtgaggttttctctagagatggccaagatttaaaggtattctttcagtgacctagatctgggttggccaatctgaaaggaatcctattggtttcgccattgatgaattcagtaggatcaagactaccgattggaccaagaaaatagtggttctcgtgtgacagacttggaattgcaaccagattggacagatgctacagatgcaagtagggatagagaagaagaatacaggataaggcgagagaaaatcaatctactgtgaaagaaagagatctagccgatgggtacttacctttgcatactcagccgatggtgcggaggacggattggcggaggttgacatcgccgagggcggaaatctggtcggggatgaagtcacctggggatcgccttatgcgtcggaggaatcgccggagagagagagcataaagtttcgcttgagcggtgaaggcggaaataacggtgtgagatttctcaaggacaacagttagtatttaaagagttggagtaacggttagaaaacggcggagtgcgaaacttactcggagttgatacgcggcaaatccggaacattaccaaatctcccgaacttggggggcttgtgttaatgaccaaatttggtaatatcagcatcggagaaggagattagatcgaagtggaatcgaagataagggctgtcgcgaaaacagagtaagaatcggctagagtctggattggctacggtcaggattggcagagttcgagtcagacagggctagccgatacagccgattccaagaatacgactcggtgtacattatcgggttgagttgatatgcttcaagatgattgccacgcatggatagagtcctgaaaattcaattatatctattaattagaatattttatgtaaatttcttacagattaatgtgggcaaaagtctgtcgtaaagacttgtggtatcttagagtttgttagagataatagtcgtgtccggtatggacatatcttgtaattctcgggtataaatagaccccgagctccatgtaattaatctaacacacacattcaatacaattttggcgcatcgccacccttttactttcgttttgtttcgacgagttcttgctttcgggttgagctgcatcggtttcgatcttcaacaagaggtaaaacttgttatggcggcttgtgttctcaggattagtgcttccatctctatgatactctaatcttgtttatgtaattcatcaagttatcatatatcttgtataatcttcggtaatatcgtcatctaacctacaatcagctaacatctgttagtagaaggcagccgattaggttaaatagcggtgttagctaggattgtacaagatacttaccactctatgaaacatccagcggcttgattgtctagatattgttcttcttttcatacttaatgctgcatcagttgagtttgatctatcaagtcgtgcttagaatatcaatctctagcttgcttcctggttgccgattagtatagcatcggagttttagccgatcttacctgatttaactatagttatcctatatgtttgattgacatgttaaatctgccctttatgttaagatcttgttgcatttaagtatattatgcttctgtctgatatattctatttgctttaatatcttaatataaagtggtatcggagtattagccaatacatgctagatctatttaatcgactacgctattaacgtatatagttttgttgttgatttatatttcgatctaagtgatttaaccaatcacttgatttaagtatatatcgacataagaattatatattgttaatgtctacagccgatcaagtaggtttagttcttccttaattattcatgactgccgatcgatgcacacatgacatcggcataaaataaatgatttgtcatctgtacccagccgatcggctatcatttatatatttaattacggtttgtttgtcttcgtttcttgttcattgtaggatcaaatcaactggcacgctcacatatccgaaggcgagttctggacctgcactggagttaagcagatctcccaggcctcgtgttttctgtcaacacgcttttggcacgcccattgggactgattagaagtcagaaagcagttttcctcatggccgagaagccgccaccatcgccgtcttcggctagcccaggttctgttaaagagaagatccagcaattagacctatctgaggttaatgagggcaacgtcatgaccatcactctggacaaattgacacctgatcagaaggagtttgaagcaatgatgcagcaagcacggaaccagttcttgaactcattcatgcagacccgcaagggaacagtggtgcaaaagtatcaggtgcgagtagtggctgatgtccccgggaccggttcttccaaggatggggagatgaaacaagccttaggtggctcggctcaaccgagcaacaaaggtgctacaaatggatcggctcaggagaatcagggtgaccactctcaaggagtacatggagttcaaggtgatggcactcaggggccacgaggaggaagtcttaatcaagatggcagtgcgtcacaggaatttttcaataattttcaagaccgggttgactatgctgtgcacaatgctttcatcaatcaatctggggtattagtcaataccttgtcaaacatgatgaagtcaatagccgatggttcaatagctaaacatcaggctgcaggcccagtttatttgccaggaggtacctttccgaattatcggcctttggtcaccgatattcatccacctattcaagcggttcctcccattgcatcatcagcctagccgacggcgccggtatcgatttccccatctactccgtcaatgtcggcaccaggtcagctggttaatcctcggcagttgatgagagagaacccacagcatagtgggcaggttgcgaatcggctaacgcaggatcaggttgctaccatgtttctaccacttcaacctactgttgatctagtccagcagcagccgattcaacaaacacccccaatccaacaggtcgtacaaccaattcagcaacaggttgtgcagtcagttgaacaaacgccaccaaggcagcagattgtacatccgattcagcagacgccatcaagacagcagactatccaaccgattcaccagcaaggcttgatgaatccatcggctgggcaacatactctgaatcaggttgttccagagcatttggtccatcacgtgcagctggatcatacggtagtacctcagattgtccctgagcacttggtacgaaatattcagccaaactagcagaattaccaggggggcaatttaagttatcaatatcaacctccttccccgcaagaccaatatcagcaagggggattaattcagcctcaatttgctcctcagtacagtcaattcgagcccatgcagcaacaatcgcaaggagcagctcaacaacgaccgtgggccgatgtaattgctgacgtgatgagggaacagttcgggcttaaaccaaaagagactggaaatttatactgacaaccgtatcctgaagggtttgagagagtccctctccctaaccggttcaaagttccagatttttcaaaattctcggggcaagatagtacatcgacttatgagcatattagccgatttttagctcagtgtggtgaagcatcggctgtggatgccttgagggttaggttgttccggttgtctttggctggatcggcttttacttggttttctgctttaccctatgggttgattaacagctgggccgatctggagaagcagtttcatagctatttctatagtggggtacatgagatgaagttgtacaatttgacagcaatcaagcaaagacacgacgagcccgtgcatgaatatattcagaggttcagagagatgaggaataagttcattagcttgagcttaactgatgcccagatagccgatttggcttttcagggtatgattgctccgatcagggagaaattctcgtctgaagactttgaaagcttaccgcatcttacacaaaaggtaactttgcacgagcagaggtttgctgaagctaggaggaattctaggaaggttaatcatgtctgttcttatatgtgtggatcggacgatgaggatgatgattctgagatagctgcagccgagtgggtaaggagcaaaaaggttatgccatgccaatgggtgaagaattctggaaaagaagagaggtatgattttgatattaccaaggctgacaagatttttgatctattactctgggaaatgcaaattcagctccctgctggtcatactattccatcggctgaggaattaggcaagaaaaggtattgcaagtggcacaattctggatctcatactaccaatgatggcaaggtctttaggcagcagatccaatcggctatcgaaggaggcaaaatcaaatttgatgattccaagaagccgatgaaggttgatggtaatccttttcccgtaaatatggttcatacagctggccaaacagccgatgggggccgtgcaaggggttttcaaatgaattcggctaagatcatcaataagtaccaaaggaagtataataaacaacaggagaagcattacgaggaaggtgatgatggtt

SEQ ID NO: 73839 - DNA, 39171 bp, Oryza sativa
ctatgcagggtgctggcttctcatgtactgtgaccgtagcgaagttgagcccatctcagtcatggtggttttcatcctgttcccgttgtcatagagccgcaactgcatatggatctagctataaatgctccagcggttgctcatcagttactgccattccaaagtaatgttctacagcatacatgttcagctccttttttatatgtctgcttggcctctatgacagaaatttcatttttatatgttaggtaccgtctttgcctgataggaaccgatggaactaattcagcagagtttgtgctatttggacgtgttgcgcagcaagttgttggccgtcctgttatgaatcttatcaaatttcagggcagatcagacaatattcctaaagaaattgctgctgttgtttcacagaaatttacctttgctgtctctgtcactgagcggagccttatgcacaggaatatatcttttcaagttaatggaatcgagactttctttggaagacagggttctattccgcagcctagggaatagggtccatctgcaggcccttctactcctttggctcttgctgcttctggtatggataaggatgacgcctctcaatctcatgagtcaaccccggtcgattcatctacttcgactgctgatccagtcgatgaacttcctggtgacagcaagaagcggaaatccattgtccgtcatgtacgcccttccattcatatcccatacattaccttttgctttttttatggcccttctttttatatgtctgattgctattccagcctctagcagcacagaaaaaattgacctttgaaacagctccatccagcaaagaaaacaccagcccggttgaccctcctactaggtacaagtgtttttccacacttcttgttcttcttatatgttgaaactttctctatgttacatctgctttctaatttttatggccaacagtaaatgtggtttgcctctgctacatagcagagcacggtcagtccctccacttcaatcagatataagcatccaacccattctatttagtgagaaaccatgcattatgaacatattaatgtaggttccttgttaatctatattcctaatcatcctacctaggcctaatagacctaaataagtctttgctatttctcttgcttccatatgccattccgtacctctggtctactctgtactttgttccgccgtataaattgcctgtatgctaaatagaaccactttacattactatgacatggcctgctagctaatcaaaagaaacatgctcatagacaactacagaacattatttactacaggcagattagttgcttatttattatcttttatatgggatgtaatgcgctccaaaatgatctgcatatggcctaccatgttttgctaccactgaccattgcacgcagcctaccagttatatcttttgctttgcataggcatatcatgtaatattactaaccatgatggctatctgctatattgctcagttcttctcgcactgatgaccaagctgctgataagcaacatgttgtgcctcatgaggttgatgtttcttagattgcagctgcctctgctaaaccaaatactcaggttaagcataaatacaccactttccagctaatttagtggtcgaatttttttagtgacactggcaacctaattattcccgttctataggtcaaagatatcctaccaactgaagccaaaaagaaaaggtataaaactacatattcaagctgagaacgaataagaaaatccctatttttgtactagcggtggaagcatgtcacattcattgttaaatagactgcaccatttcgctttcgctgctctcccgtttttggttcttctagattaaccaggtgttcctctttgctttagtgttgatccaggctctacaggcacacgcaagactaagcctcctgtaccgaaagggaactaaatgctcaccttagcttttgtgctgatgtgagtatcctgttctgttatatatctatgggcatggcattagtttcacctagattgctgatcactttaaattatttttcaggggaacaataccctacatcagcgatcccaccctatgtctacatatttccttaatcttactgttggcgatgcagcttgacatggcacatcgtatcagacaatcttttgtttacatgattgctggcaccactgtgtccatgcatgtgcatgtttggtcctctacctgctgctctttcgccctttagtgtcagtgtgctttccataccgtagcagagacttcctatgaaacgctgccatacgactgcacatcaccccatcttttgcttgtatgttatttattgtaaccatgactgtcaatgtccatatggtgctctgtcagtcctatgaactcgttcagcaaacccccttctgttatggatcatattaatgcactagcgttctatctgctgttgttctgttcatattacatgccttgcagctgctttggatatatctagcacttgtgatacactatcgtcattaaaagcttatgtttcatgtgctatgtgcctgtgcaggaatttgaaatttgtagcatttccatcctacccagctaatgtgataagtaggattttgtgccatcctttctgtcctaaagaaagggtgggcaaaatttgcagccaaaaatagcatacgcgttggatcgatctgcattttccacttctacagggcaagccagatgcaaatgacatgcaaatgaccatcgatgttctgtagaccacacgtgaatagtcaatgtattcaggaccacttaccagctctactgccactgctatgttaattagtgttgcaccttaagattattatcataggtactgcagcaccttacaaatatcagacatatgtatgttgttagcgctgcaatctacttatctattgccgtctgctttcattacttttcccccaccaacactttttaaccgttcttccctggctatcagcttattgggcggcacacgtgcgtacaggcggcacgccaagggtgcgccccaacctctagtagtgttaataggtgatttaccacacaactggtcaaactgtgcatttagagctagcaaatacttcttgtactcatttcctatttattgcttctccaaaattattttctagatcactacagaactgaatctcaacaagaaaaaacacaagttaccaaaacctaaatttgatgtatacatccaccatgatctgaatccatacttacatccaccatgcatgaccctacaaatgaacacaaattgaccatgcatgaccctgtgggatgaaaatataccctgcaaatttcccagtgaaagaaatgcgtctgtctaggaaaggtcaggaaaaaaacagaataaatattgctactggcatttgaattttaaatccatgcacacaataaaggaattttttttgaccgaacgaggcattcaacaggcacccaaatgaaccggtacgtcctatcgctaaacataaaccaaattaaccttatcctatcctatccaacagccacccaaagttctgtataatcccaacagcattcacatagtctcctctatcatcaatatcagtttgaagaaaacaggaaacatgtgtagactaatggcattttttttttcgctgggccggagactaatggcattttcatttggctgggcaacgaaaatcctaaatgatagagcagaactggacagtgaagcacgacttggtcatcaaacatcagtttcttatggccgcaaggtctcaactaatttgcaagctcaacaaacaaaagaatcaatatcctctcagtttatttttttgacatgtacttccacaattccatattacgctatctagcttgacaaaagattaggcctgcaatctaaatcagagaaacatattaagataataactttctttgccacactgcccacacattcgcataataatttattttctcacaggtttatgcacgtacacacataatagccatgacactgtaataatgaaggaacgggatcgagcgacgattaccttgttcgcgtcacggtggagagggctaaggtggcggcgcaacggagagcagatggcacgagggagtcgacggcggcgtcgcagtatagaagggggtgcgtgggtgagcagtcccggtggcggcgcgaggggccggggatcgacggcccgtgacaacgatctacattgtgtgggggcattggtggcgtaaatctggaggcgggaatcgacgacgatcctcgtgagggacgctggcggtgtcatctggaggcgggaatcgacgcgctggttggggcgtcggcgacatcgatctggaggcgggattcgacgatgatcggagtgagggtcgaggtggagagacgggaatcgacagcgacgcgagggggcgccggtggcgtcgatgtgaaggcgtgatggggcatcgatggcgtcaatctgaaggcgggagtcgacggcggctcgatggcagagcgtgggcggcgtcgcacgcgatggcggggcgtcggaatcaacggcagcatgggagagaggaggaggtggtggcgacgattagggttcgccagggggagtgcggcggcgcttgtggtggcagaggggaggcgacggagcgctgtaggttgggagacggttgggggaaggagagcgcgttggggattttcggttgaggtgggaggaggagcgatagcggcgtgattttcgtgcgcgcggaggttgagggggtacgtggaacaatatgtggcattggattggatgattctggaccatcagatttgatgaatgagtaatgtaggtgtaagagtgagttggtgaattatagggtagatcgtgaaacggaattgctataaagatggcgacagatttttcactaatctcagtcggttttcatgtccattggattcgttcgcatgcaaacgctgcggcaaccgtatccacccgatcttccggttggttttatatacggaattgctatatcttaatcgacagttttcttgcaacgaatatgtcacttttcatattttatacaaatttacacggtagttacacaccacttagatatgtaattagtatgtaattttgggatttacatacgtaattttagaacttacatatgtaattttgagacttacattgtaaatacactaaaattacatatgtaatttaaggacttacaatgtaaaaacataccgactattttttagtgaaaaatatggcgctataaatatagctactcccacggtgaaatggccggtcaagggtaactaacaaacctgttggaactttggaacctcggccgcatctaaaaaccaaaggatcgccactttgcttggggaagtgaaagaaaaaaaagatgccttttgtagcctgaacatggttgcaacctgaagattttttttttgttttcttctctttacttgtgatcgagatagaaattacgcatcacgaggaggaggaggaaatacatcacgagaaaaacaatcaaacggcatgctaaacaggacacgagatcagtctcgatcgaagaaccaccaccccaaccctttttctgcacctagcccaggagtacaccgccgccgctgttggaacacgtaccaacacatgcgtgagccgtgaggtcgtagcctaagcaccgtacttgtagctggcgatgtcctccgtgatcatctccaggtccctggccgccacggccatcgacattgcccgccggtgccgccccgcctgcatcctcgccggctgctgctccgacgacgcgtccgccgccgccgcgggcttccgctgctcggcgccgccgccgccgatgacgtccgccgccacgtcctcgaggctggcgaagttctccggcagcacgaacacgctctgcgacgccctcctctggtgcctcccggctctctgcgacatcttgaagcttagcaacacacggcagcagcaacaacgaagaagctcttaagctgcgcgacttggttcgctcggcgccttagcaaattggaagaagaagaagccgttatatataggctaacgcatgcacggacactacatttattttattattccattgattatgctcattactactgctgatctactggtacaattgtaacttgtaaatgaattttgtgtcagttcctggctcccccaagtgcattgacttgtacgcattgcatccatgtgaagacgtactctctcccttggattgattaggataatttggcgattaaacaaggcgacctgattgctgaaatgtcacggcgctcttgctgatttggtgctcgatcgtctggcaccttgctaagctaggatctatactcctacttggctagcgcgtatgccgtgtgatgtgatcgattctgcctgatcaggcctctaaactgaagccaacttggcacgtactgttaactgtggtagttgacctggttggtgagtgcagtgtttttatccatttctgtgcgtgtacgatgtcgctatgaagcttcctcgagagtaaaaatatggtattcgtgaggcgtatgtacaggaatctcaggaccgagctcgccatttttattggggtagtgctccgctcatgaatcattctgacattatcagcagagaaccacgtgcaaaccgaagagagaatccaccagcagaatcaatcacataatactactaaccagatcaatcgcaaaaaaactgaaacatgcaagtacggatgccctgactaatcatgaagtttttctaataacacttgcaagaaatttcctcgtaatcctttgtccctgcacaatactatggctctagttgtgtacagatagtgctgttactacccacaaacaattgctaagaaattagtatcagttagctgtttcaataatttttccgatggttcgtgcttatcgcaatggaatcttttcgttttccttttaaggagcacaccactctgtttatgtaggtgctacaacctgatcaagctggatgtgttcatgcgtgcggaaagaaaaaaagaaaaggaaagggaagttgttaactgtcaaagaaagcaccatgcatgttagaagattccaaattcctagctcaaatccagcctcacatgggcggtacacgtgggttgatcccccacgcatgtaatgcaaatattattggggcccggggcgttcgctcgtgtgcatctccaacaaatttgctgcaagtcgccaaacttatgagacagggaaatgtgcaaggcagcagcacagggcgtgtatatgctcttctcattccaccaattaaaaggattgatttgtaatgcgggtctgggaagtgggaactgaattgttcataggatacgttgtttggtttgagtacgtcgatgatcaaaactgtggtttggcaggctgatctagtgctgtaaactggtgttcagtttggtattgataaggagttcctcttctgccaagactggaggaagcgttcgatgcttgagctgaaaagggaatatattgtcagttcagttccttgtgcagattgggaactgcagccatgccggctagttgcctccttcctcattctgcgacgtgctcaacgccgtgggcagagtaggtatcgtggttcgtggacgccgttgggctcaacgccgccgccgtagaatgtcgcgttgtggcggtcgcggaagtaggcgtacggccgtgcatcgtgtacggtcctggtctttgctgtctccgacaccttgatctagtacatactgaactctcattccggctcccggccggcggccggtggtggaactgtcaaccgcgtcgcccactcccgcacgccggcggcgtcgacgtgggatttctttctcctcgagcggtcgtgactcttcaatgagcatctccctcgtccgatctgaacggagagcgcccacgacacgccatcctctgggttgaggccacatgtgcgatcgatctgcgagtccgttactccacccgtttcatccttttaatgagttgttatgattttttttctaattaaacttcttttatgtttaatcaaatttatagaagaaattaacaatattttttgacacaaagcaagcatattatcaaaacatgtcagatgtaagttttagcaaaattaatttcatgctgtagatattattttttttataaatttagttaaattttaaaatgtttaactaagaaaaaaaatcaaaacgagtcaaaatatgaaacagaaggagtactacaaagtggtcggcaacggaaagaccgcgtttgcattagtgcaatttatttatcctcggtggaaccaaacgtaaaatcgaaccgatatgaaaatggtaccggtctcaaaaacactaacggagccatcattttgcttattcgcaaaataagcgaaacggtatatttgcaaacgaaaagtaacttgtaaatacaaattatatatatatatatatatatatatatatatatatatatatatatatatatatatatatatatatatatatatatatatatatatatatatatatacttagcgatctacaaataagtgcggaaaaataaattcgataaaaaaaacctcacaatcaacttcaaatttaaagttaaaaatttaaattttgactgataagcataagcataagtgaaaagattaggccctgaaaaaaggaccggaatgaagatgttagaattttttttattttaaaatttttattttttaatatttacagaaatattatatcatccaaaatatttacaggaatggccactgccgtccaagtggagggcggcaaggtgtgcgcattttgtactaaggtcccttgccaccctctgcaagggctgcaagggggcaaatgcaaatttcgccttgccaaaaatgtatttttctaattttttttatcaggcctacttctgtaaatattttcgccggtacaatatttctgtaaatatttaaaaaataaaaatttaaaaatgaaaaaaaatcgaaaatgttatatacccgtaccataatagcgaaccaaaatagcactcctaaacagggaccggattgcaggagcccattgaatgggccgtacaacatatagtgatttatcagtgggccgttgcccaagcccaactaggcaccgcagatccgacggccactaacgcgcatcatctcaccatccccagcatccacaggggccgtcggggggtcggccgccccggacggcgccgccgcccaccgccgatcgccgttggtagtggtatggtgtggcagcagcggcggagattggcctcgtcctcgcacgccggagtcgccgagttcatcctgccgcggcccgcgggccctcgctcgggtgctcgggtcgggggaatcctctaaaccgtacggcgtcgtgtccgcgagggccgccgtaccagatgctgctcaagtagcccggcgtgcatctcgttagagatctatacgaaggggaggacatgaacagcttccagcagaggctcgcggggaggttcagagatccgaccacaccacattggtcatccctaagaaagcgtggaggcgtcgagctactagattttctgataatggcaattttattaggttcttaatttctccgtgtttcgagttcatacatggaaatgcaaaccatttttttgatgcattgatagggaacaagaagtcgatataatgtcgtcatgctaactcctggaatcaaaaccaaatggtgaaatggagaatcatagtcgtttccatgttcatagtagcatattgtcataactcataaattctgacaagtatttgtgtaggtctatatgttttatgcttcagagctgtggcatgctcattgacttatggatctatggataactattttaggtcagcacctagctgatgcttccagactgtgccgaagaaggtaattcctgtaattgattggcaaattatcaagacatcactgataatgcatccagacaaaatgaaaatcatgaagcatgtcattgaaagaaacattgtggatcatgatcgtagccattttccaattgctgttcaaattaaaggtttcaattaaacttttttttttgaaagatccagcaagagcgctggcattatattataagcaggagaaaaataaatacaaagtttatgtacatagacaaatggccacctcgacgggtgccaataggaaggtctaaattaaactcggatgatagttaagtaggatactaggattgaacctctcctaacatgtcaatgaaagaaacatgaacccaaaaccaattcatgcattctaatttcgaaataacacgtaagcaaatgaggatcaagcttaaaatatatggatacaactttggcagacaatatccatttgctaaggggctgtttggtttccagggacttattccaaatccctgtcacatcggatgtttggacactaatttagagtattaaacatacactaattacaaaacccatttcataacattggactaatttgcgagacgaatcttttgagtctaattacgccataattttgacaatgtgatgctacagtaaacttttgataattatgaattaattaggcttaaaaaattagtctcgcggattagctctcatttatgaaattagtttttttattagtctatgtttaatactctaaattagcgtccaaacatccgatgtgacatggactaaaaaattttagccccatctaaacaccccctaagttgttctggaatctgcacctttgaattaggagcgttgctaaactatatgtgctgttccatggcagcactgctggagttattgataccattttgtttcagtgacccaataacacacttttgtgtttcatatcaccaaactgcagtttctgcagaccctaggacattatttgggggacaaagtagcactgtaactaggatcatgaagtcaattttgtgtttatcatcaatctattgaattcgttcaaaaaaaatataatcaatctattgaaactttgtaactgtatgtaagataacctttctactaatatgatgcattaaatatcttagtataaaacctagctaatttaacatattgtgcaagtatagtattattatatcctctgcaagtatatcctctactgcctggggctttgctttgcatttcccagataacagtaatcaaacactcacttgagctttccaactaaagaaatcaagaaaagatgccatgacaaatactagttcaccacaaaagatacagtagtctccacaacaagagcactagttctgattattactattgtaatagaacaactgatacatgatgatgaattctatcaagagagctccggggatatagacactccattaccatcttcttgtcgagatggagaaggaagacctgccaaagttgtttagttgccctacatggcctagcacctgcctagtggataccttcgctgcatcggccgttgaggcatcatcttcaacaccaccggcgaagctgagaagtagtgagaacactgcatgggttgcatgcagggcagcggtgtcaggccattgttgggggtagagaggaatccagaagaagggtcctccatggaagatgctgtgcttggtttcatttatagagagtacacgaggtttctttcacaaagtggaagcttaggtggtggagtgccttttcgcagaccgaaatgaggtatcttccttagcatattccttagcatgtggaaacttctttttctgttctatgcttttgatttgctttggagtttttcaaagtatattccatgcttttgtgtgctttttggggcctataggtttatgaacaataatttagatgatgaatacactctagatgtattggagtaccttgacgaagcatgggctggaaagttggttttggtggtgatcacccggagcagatcttgcgtcatggacctacttagcaggtgcagtttggctggtcttgcattgtgcctgtcagattagtgctgtacttgatgcattgttgtcgtttatacatgaaaccaaatgaaatacaagaaccatatgtagattgcagaacaaattattttccttctaaagagggtgagatcttagtagaactttattgcttgtggtgccctgctgtttgacaatgtaattggtgcgagacactggcatatgatctggcctgagccttgtgtatgatgttatcagactggactaggccaggtgggccttatgcctgctttggtcttcatgccaataaacagagggagggcccaaaataagtcctttaacaggacactgatgttcatgttccaatgtatacttacggagttgtggacttgtggttataacttataagttgcaagggacagatattgcccaatacatttcatgagaaaaatctcgctatgcttttgcatctttgcacgctcatttggtgcatacggaggattggcctaaggctgtaaaataacaacaataataataaagctcaaggcttgcgagttgctcgagctcttaacgaaccgagctcgagcccaaccccaagctcgcaaaatttgttgagctgagctgaaagcatctaatgagtctggttatatgggctggtacattctaaattgtttttttactacgaaattatcatcaaatatatgttatcacgtacttaagccaagcccgcctgaaagcataaaggggaataagcttggctcaacctctagcataaggcagccttacgctctggcttgcttgagctcggctcgttgacagccctaaattaaggcgtgtgaacctctgtcaactaatggcaggcacatggtggtggttcttaaaaaaaaatcttcgtttcaaaaattcacattgaagttactaggttggtcacaatcaatttgatgcaaagcggatcaattactaaattaattgataataaggctaatttccccatctaactcagatactatattacgttgcaggcaccgctaattaacccaaaattaaaaagagtaaatttcacaaaactaaatatactttgactaaacgatcacaaaactatggatttaagacattactagtaatcgtgcacgtgcaatgcacatattaacaaatattatatgaatatgaaccattttgataagcatatcacattcaaacgattggcaatagaccaaggctacataaacccaagaaacatgtttttttttctttaagacattgtagttctgcttttatttttatatagcaaggacatattactatataaaaaagagaagaataaacgttgttccgcttgtcatagcatgttgactgtagcatccaggtgaatcctttggcgtggcagcataaagatttattttagttgtttattttggcaacttaaaatttacataaaacttaatctgagacgcatcccatctaaagaaaaccaagagataaatctttgagactatagaattgattcattcactatatgtaaatcaatctctcttgcagtgtttgtggcaaaagatgagcgatgcaatcttgatcgtttgacatagtttattctctttccatcgtttgtacacgcttgttttttggtctcctacacatcaaaagaagaaaacacaaaagaggtagcaaatgacaatacatgctttactgaagattactggccacagaatggtatattaatggtacttattgcagttttaagccaggcctatccaatggaggaatgggcatccagtaaaaataaactcaatggagcagaccatgaacatgattacatgaatggagtcagaggtggagacaccatcttttgcatccccttcactgtgtagaacttgttatcagtaatcagttttagctaaaaggaagtcagctagatcaaaatccaagcaattgaaatatatccaatctgatgcagagaagtggagaaccaacctcgtgcaatcgctgagcactgctacacacctatgaattcctacttcaataggaaagaccataaacatagtagagctacctgttttccttcaattcaagaatttttggtttcattaatcgaaacaaaaagaagaaccgaaaaaattgcaaggagaggaactaaagattttctttagtacaagagccttcatcctcgggatgttgctttcaaaataaaagatatagagcagtgcaaagaaatatttttcacaggttaaatcgcaaaccaaatttcagtacagccgaaaaaaaatagatactccaatcatgcacagacatgaaaaaaaacatatttcaacaattagagcccatttcaaaagaagcggtttcagttctcacaaatatgacatgcaatttgttaatcttaatactggtgggctgaccatatcaaggctaacatggaaataaagcacatcagttgaacttcagattcggtagtggtagaaaattggcatatttagccattttattatagtagtagttttttgagcaggaagaaactttcacttcatatagcaatatattagtaactccacttcatgtagccagaaagtaacagaggagcttgatgaaatacatgtgcaacgctgattagaaatagcaggatgatgcttgatgataactcatccagataatgcaatgctatatgcagtggctgtttaatattccactccatgattcacatgacttttttgtcaataaaagaagacaggtaaatataataaggtaatactgggaagggtatatcatcttactttacatttgatagaacggacttagagagttcttaatggcccatctgtcacatctcgttatctgtggacttccaaatcagttgcagttgaacaatatgaagaaatgaagtatttgcctgcaccatatgaagtattcgagaccaaagaacaattcagctttagtttacacaagcagagctttaaatcacaacatatagtgcaaaatagagtaaatatgagataataataaggattcaaagagtaacatgagtgcacctcgaccatgcatttcatcaaacagttggtgtgctgcccatgggcacaacaaggaaccaccatgatagctgatctggaagacatcctcatcgtaatggaaggataccatccgcaacatgcagtcgctacagccgctgaaggcctaggtgcaaacatgaggctttcctgcgtggcttcagcgatggtgacatggaattctacatatctatcgaacccaacttttaaaacaatctatgcacttgtgtaatcacttgaacaccatgtggattagtttaatgataacaaaatgaaacacgatatataatcttatgattatacctagctgttaagtttgtattcttattggtccctgaaagataaattttcagctcctgcacttgaatcttgcatcatttatataggtaaaacaaattgacagctgcatttataatttcatttaggatttatcatgtaaattcagggtgaaagtgaaacaatacctcagaggtactgtcattgtgtgcaaggatcaaaaacaaaaatggccaactgataaaattatgaaatttgggatctggggcaatgacttttgttgttgattaagtacccaggatatcaatgatttacatatagattgatcttttcattttgtataatttccaaagcataatcaaacattttatcaaatttttaatttttgatatctattggaattgcattctaacatgtatcaatcaagcaaatttgccacaagtcaaaatcaatggtgcaataaacataccatttgagcgcacagctatttctcttatgcgccgaaccagtctagttatagagaaaacactttcgtctcaagatttccttccagataaagaatagaactgaaatgttgcaatggtacaatttacttgtgtttggggagtcaatcaaccaaagaattttaaaaaggaactgcacaaagctaaaaccttaaaacattattgccatgtcacttatatacaaattgacaactgcgaaagatagaccaatatatttagcttctaactacaagggtaatacagtagaacagtgatataatcacaaatgagaggtagagtaaattcaagtcgatagattgacacaagagaaaaaggcatctgccaatccccactcatgtagagctaaaggaatataccaaactctaccccaaggaaaccagtaacaagcatatcaagtataattataacagacgctttactcaccaacaaatcaattgcaacagagctatgaagttgaaccattgtaactaagaatctaatccaacatacaaagtctgaggttgtcacgctcaaacatcaggaaatgaccctttactacgtttacgcgatagctcgtctgcagaggcaacagagggctcaccaagtcttgacgtgcttgagcgcgaggctgccggcctgccgagccggtccgggtagatgcagacgcggtgccactgcacggagcagcgttcagcgtactggtgcggctcctcgcagtccagcgggcggcggttgttgcggatgccgccggtgccgactgccgagcgagaacagtacgaccgttctccctctccgcagccgcttctgtatcggctcctgccccaccttccccaccattatcgcctttgcgattcccacccacccaccctcccacacacacaaaaaaaaaaaaaaaatccccaatcaggctatcagctcctacctccgcggttggagtcatccctcctcgggcgtgtagatgtagataacgaagaaggcaaggacacgatggagaggaggatgatagggatggaagttgtccggtggcgtggaggtgggcagcgggcgttcgactccggggcgtcgagggtgaagacaactaaacatggcgcacgacagggatgcgcacgatgaagacgggggatgagtgcggcggcgacggcggatggggaagatctcggctccgtggggggttggggaagacctcgcctccggttcagtgcgcggtggcggcggcagcagaaggggacgacctcgtgggcagcggtggactgcggcgacgacggcggatggggaagaccttgtctccggcggcggcggatggggacgacgtcggctccggccgcagcggatggggaagctccggcggtggctggggaagacctcgcctccggttcagtgcgcggaagcggcggcggtagagtgcgcagtggcggcggaaggggacgacgatgcgaggagcgagccgcgcattgagagggtgatgaggcgtaatcttcgcccggccttcgcgcctggagagtgggaatcgtgcggtggagaaggctggacggtacagattacatctgatttacgaatggacggtagggatgtaaacatttgatttggcatgtaggattagagggggcaactcatttttatattagtatagatatcacaaaattacatattaaggttaaggatcacaaaactacaaatttaatattgaagttatcgcaaaatacatattctaggatttaaatacctattactaacgttatattggatctataaatgttgtagatctgggatatgtactaaacctgtcatttttgtaatttttttcctaattaatttttatttttatgatacttcatcctaaatatgtagttttatgagaaattttgcgctaaatatataattttgtgatacaagaccttaatatatgtagtttttgtgatagtttggtaaaagtatgtgtagttttgtgaaatttacttaattaaaaatggcgactaagaacgaacaattcactcacactttaccattctaatttctaactataaaattaatttattttagtttacttggaattgagttattgtacaaattgattgctcatttctactttcagtttcgaatttcgttatttttttaaatagagatgagtttttatacaaatataatttttgatatgctttcaattttatttggaatatcagttatcacatattttaaacttacttggacaattctttttattgtggattaattaaccgtgaaagtttgatcccacaaaagttgatgaatgatgaatgagcatatataccctttttctgtctagaaaaatatcggattagtgtgttgaatttcaaaggagtgaaagggtttgatagctcgatattagcagtacgtagaaatatcaatgattaaaaaaataatttaggggtagatctttatatatgtagccaacgctgaaaaatatatgagtatgacaagaaccccaaaatcaacttctaaattaaattttaaaatttaaattttggttgtatagctaataagtcaagaaacaaatggtataaattgacagatactctctctacccctaaaaaatcaatagtaccatatgcgacacattgtcacaatatgtctagttaaacatgcatgttatgatctcacaaaggtaatcgcctctaaaagtaataaaacaatgttcgatctacaactcacgggcaactcaattacacattgtcagagttgaatcgaggttgtcgtgttacaactgacgtcagaaatatgcaacggaggaatgacaagaaaaaaccataccactaactttcatgaatttattgttatttacaacaaaaatacaagagttcatctctgagttcattctcaactaccctggcatattataaaaccccccaaaattacatcaattctacgaaatgttaaaaagtaaataaagaaaggtaaagatcaaaaggaaaaatcagcggtgtatattttatcaagaaacaaaggaataatcggcaacagctatcatgcaataatatgtgcagtttgaacggctcaaaggaaacaatccaacatggcgagcgccttgtgtacgccctgcccgccggcgccgagacccaccacgttccggcactttgcgcggttctccgacggcgtcaggttcaagtccaggcagacaccgccgccgtcgcaggccttcacggccgccgccttgcctacgtcgccgttcttcgtcgtcgtcgtcgtcgttgtcgccgccgcctcggcctccgcgcggtgccgacgcatgtgcccgccgagcgcctgcccgatggggaactcgagcccgcagacggggcactcgtgcaccctcggcttcgccggctgcggccgcggcggcgtcggctgcctcccgaggcatagccccgcgtcgtcggcgccggcgccgccgccgagcgcgtgctgctgctgctgcctcggccgcttgtggctggcgcggtggcccccgagcgcctggaacgtcgggaactgccggttgcacgtcttgcactcgaacacgcggtcgtgcgcgccgccgcgcaccaccaccggctgcgcgccggcggcgaagccgccgccgcccagcaggccgtgctggctctgctgcgcgaggagcatcagcacgcgggccgtgtccacgctgccgacgaactcctgcatgtcccacatgctcctgctcctcttgctcatggctatagctagcttaattagccacgtaattaattaacccagctgatcactaacgtcgccgatcgaaatctgtatatccgctgcactgtgcaacaatacttgcacatatgctgcgcgtatgactatatatatagagagagttagaaagaccaaatggcagcaaagctgaaacttgtggtttggtgcacacgtaggaaatggatcgagctagcacgacgaacaacggcccggcttgcttctagatgtggatgtgtgtgtacttttctaaccatttgaccacgagagagcatgatcagattaattagttcctcccgtagtagtagtacatgggacgaacaccttgttttagtacaagtagctagctagctttagtcaacatgtgtgtgcactgcatatctgtggtggtgacgggctatgtcttgttgtcttctagagtggctgcagcagcagcgccaagttgcctccaaccactcggatggatagcgagagagcgagctcgcggcgccggaggcggttgcgagtgacgtgcgcggcgcgcggccggggtggcgttctggctcgggcaattcgccatgttttcttgcctcagcgcgcgacgtcgcgtgcgggcgtggcctgctcgccggccggtcgttcaatcccaagcctgcacactgaagctgcagagcacgggtttcacacacgtacctcaagctgctgacgacgacgcatatactacatgctacggccgttccattcattggaccggctggcagaatctattatattattaaatgaataggaaaaggagtctacacattcgttctcatggtctagaaattcttacattaatcgaagaaaaagaaaatgcagagtctatatagaaatacaatttagatatagctgaaattcgaaattaaaaaataagaaatattagaatagaagactagagtccatatagaaatacaatttagaaatagttaaaattcagaattaaaaaataagaaatattagaagaggagactagagtccatatagaaatacaatttagaaatagttaaaattcggaattaaaaaataaggaatattagaagaggatattagagtccatatagaaatacaattaggaaataactgaaattcggaattaaaaataaggaatattagaagtagagtatagagtccatatagaaatacaattagaaaataatagaaattcagaattaaaaataaggaatattagaagtagagtatagagtccatatagaaatacaattaagaaaaaaatagaaattcggaattaaaaaaataaggaatattagaagtagagtatagagtccatataggaatttaaaactaactaaaattcggaataaacataataaaattaaaggtagagttttgagtctgtataaaaatataatttacaaataactaaaattcgaaattaagaaaaacacgggaagaagagtttaaagtcaacataggaatacaatttagaagtaactgaaattcgaaattaaaaattaaagaatattgaaagatgagtttagagtccacataaaaatacaatttgaaataataaaaattcagaaataaaaataaataatattggaagaagagcctagagtctatatagaaatacaatttacagaaaattcggaatataatttacaaataactaaaatttgatattaaaaataattaataactaacacgtatataaaatacaatatgaatattacacatttgtagtttcgtaaagttattgcaaaatttaaaattatgatgttattttaatatatttgaataatataatgagaaagcatatatgctattatatgagagaaaatataatgatgctagccgcgcaatctgcgcgggccaccatgctaattgtattaaaacgtttaaccaagatgttctgtacggacaaaatgtgatcgaacacgagctgaattcagagagagctttaaaaaactagtgcagtactgtactagtgtgttccgttgggactgcataaggtactcgtggttagctagttatagctgtttgacacggcaatgttcatgccttcattcacccacaaatttcttgactggaatagtggaatgcatggtctttatttttactttctgatgagcacttcatctggattaaccttgtatgaataatcagcttgacagctttgcagtagctgagtcaaatgccaatccgtgttaattagctcacgttctgagctttaccgaggaattcaaacttacatgtttaaacttttggaacttgcgaagattattattgtggtgggcacacctaacttcagatgcaactccgcaattacgcttgtaacagaattcagaattgagaaagaagagagaaagatgagtttggtgatgcagtccaggtcttggcggcaaattaaacgatttgaccggttatcagtggggcgaaatggctaggtgtgtgcattttgtttggctgactgggcccatccaatattccaatgattcagttaatgcctttctctgcacactacttaacgcattctacgcttttaattgttgcaccgcctgttcataggtgagaacagcagatgccactacgagaacatgtcttcaatgcaactactcccccgtcacaaactactaattgccaatagtcaaattaagttttgatagtttgactaaaagatttccaaaattataagaaatcatagtgcctaaacttgataaatagtagtagaagggatcagctgaactagatgaactcccaagatcggtcaaatggtcaacacacacgcatgtcttaggctggtagcctggggcgttctctctctcaaaaaaaaaaaagagagaaggtattgagctgaacctcaaaagctaatttttgcagcacatatagatatagaacgaccactatcatgcatgactcatgcgtgcaaagagttctagttacacctaccatttgttcctgaatcctgcatattttgtcaacacaaacatcacgagtagtgagtaccatgttctaaccaagaaccaaatcttggactccgactgactgactcaccagtcaccacagcaacacacacatcaatgtgcggcacgatttcacgaaacgtgttctttgaattttcttgcagcagttgtacatagagcactaataaattagcttcttttaaacaactctaattaggcaagtgccgaagagataagtgttaacgtacttgctaggtcatgcttgcataagttgtattccgtttttataatataaaaaatataacgtcttccatgtttcatcattcgtcttttaaaaaaaaaggtaaatatgtcaaaatataagtcacacttatttaaagtacatttaatactacgcccatcccaatttatgtataactgtgggtttttgtgtccaacgtttgatcgtctttcttattttaaaaatttatgaaaaaaatttaaaaaatagtctcacatgaagtactattcatgttttatcatctaataacaataaaaatactaataatatttttttcaaataatatggacagttaaacgttggacataaacagtacaaaattacagtctttctgggatagaggtagtaataaaatactacctccgtgcaaataagtgcagttgtgggtattcgtgtccaacgtttgaccgttcatcttatttaaaaattttatgatttttttaaaaatagtgacacataaagtactattcatattttatcatctactaacaataaaataactaattataaaaagttttcaaataagttgaacggtcaatattggacataaacaatacaaaagtgcacttattatgggatggagggagtaaatcataacaaaataaacaacaatctctgtgtcacactattattcatatttaataatattattactatatttatatagctgcacgatcatctgagtgccaaaggtcaactcggcatatttaatatcggacgacttctgtgatagtggctcaggtgtctggaatggttgtctttccaaggtctggttgcttctagctgatggaatttgcaaaaatgtctaagaaaattaggtcacaatgttgtacagattttgctctagaagtatacgactggactgactgcatggtaattctctatgagcaactcagcatgatggttacgctcgcggctaatcatcattgtggaaaaagaaacgccgaacttaattaatatgcattttctcatctagtatacccgattggaacgtacgatgcgaaaaatagagaaatcgattttgcacgattcaaatcatatagggtagttccgacgtcatttggaattaattagtgggtgaccccaacattaatgtttttctttttaagttcctagccatggcttgtcctttagggcggtcccaacccatgatatccataagcagtgtctatgataccatttcaataagacatcacaacataaactacactttacaacccatgatttcttaaagtgggccattaataaatacatcatctctcttctctaccaataatatttattcttcatctattatgaagacactattctctcccaatgcaaaacttgatagcgttgaagctatgtcatgcatgagacccagtttcttcctctcttcactctttctcttaattaatatagtgtcatataagttaaaagtcctacatagcaatataattaatgtcatacacaccatcctaggtggagggttaggactgcccttaatagtaatgacaaaatatgaaaagctaagactattttttgtgggttattacttattactagcgtaccgtttaactataccgtacagcgttttctagtctgtacatatgttttttcactgtgctgatgaagagcgcggactgcatttgtaatagttagaggttaacttctccaatttttgagagcaaaaaaatttccgttttaatttaggtgatgaccaacttaaactattgcatgattaaaatttgagaacaaaataaaaccttttcatttccaacattagactagaaatgtcatcaagcttttgagcatacacgtgcataatgcatgcctaggctcgagtaccttgtgcatttggattttggtctcgcttttcataataggtctcatgagcataaactaaaagggttaaaattactaaacaaacctatagttaatcttgggtgataacatgtggacttaatattaaactcaaatatcatcttctcagcccaaaagaagtttaatgtaatccctgtaacaatattaggtgcaattatgaagtgggaacacatatacaaagtaaagtaatcctaattctctaaaatattatgtgcaagttaaaaaccatggaaaaaaattagatagacaatgtttagcacaagcaattcactataatattggtacaagttaataactaagtttaataccacaaattaatcagtcaaagcataaaactaaaaggaatcaaattaaattttaatcggctaaagccatacttcatccaaaagtacatttaactgctcataagtgaacatggaaaataatttattcaaatactagattatttatcatgcctaaatataacttttctagaattttcctcctctatttaagcctcctaaaaattcaatctagctttctaatagcccgtctttgtttaatttctatgagcagtctacccattatttttaagtgcaatcaaagaaaatggaatctagatataaacatctaccaccagtaaaatctacactaattcttctggtccacatattaagatattgagttgcaaacttagggggaagaaataattccgaaaattatccaaaaactaagtctacccaaactcctacccatacctctcttcctagcctagcttccatcgacttggccccacctggcagcctctccagctcgcccttcttctgtccgtcatccttagccgaccaagaaacacagagagcaagagatcgagagccgaccgagtcctggacgcgtcgacgcgtggtgacgacgtgtcgacgccttcaagtcactgagtcatgcctccatctcctccagaccgagtcgcccaactccacacatcactctggagctgaagaagtcgagggagaggtcctcagcctctccgtcatcctcaacctcgccgccggtcatagtgacgacgaccttcgccatctccgtttgagtcaaggtcacctccatctctttcgcgttcccatctctccacacaatgccgagcatttcctcttttgacctaaacccctctcgtgcagtgcatcgctgggaacgcaagccacgctgacaacgccctggagcacgcaccggagcgccgccacttcaaccatcgtcgtcgtccggccattctcgaccacctcagagcaagccactgcgccatcgtcatcgcctcatcctcctcttcaatacgcctcaagaaccccagccggagatgtgaaggacttggagaacacatcttttcttcaccggcgccgatctagaattgcctccgccgtcatcatcgattaccgctgcctcggtgagccattgttcgattccttgcgcatacaccatctccttgacctcacaaccctcgtgcatgcttgcttgaagcagctcattgtcccgttcgagccgtcgtcgttcacccgaggaggagcgccgtcgccgagccgttccacaagtcaccgctgccgccaagacctcgacaaccctagctcgacccacggtgagcatcctgaagtctagaagaccacatgcatgcatccttttcgttcggaatcgacttccatgcacacatgcactttcaccccaagaaccaccgccgctcacactcgccatcggcgctactccgatgtcctctaaccaagaaaactagaggaatggaatcgcgagagcttgctcttcattttatctcttgacctcaacctcaaacgagccaccgtttgccgccggcgagctcgagatcgagctcagccatggctagctctgctctgtctagagcagagggatgacttccgtgaattagattaagtgcagggatccgtttacaattgtagaaacacactgacatatgggcctaggactgcgggttgattcctagaaacctcaagggcctttgtgcatattggtccctcacagccatgtggaccccatcctttaaaatctgaagaataattaagaaaatgcccaaacaaatatatgtttagcagaaaaatgcacaaagttgtaaaatctatataaaatcaaatatagctcattttaaagtgattacagttgctgtagattcttgaagttatgaactttattccaggaatataaaacttgacactcactgtacaaataatgtctctaaaatttatctaagataggtcatacataaaacatgtacaaacttataaaatacatagaaaattcatctcaactcattttgaaacaaactcaaaaactgcagattcatcatcatgcatgcactctctgattaggtgaaataaaagtaattacttactttgcatcaaattcctctaaaactattatatctaaaatgattagttttagataagctaaactttagaaattcatgtagaacccaatttagcttcaatttgaataaacttaagttctgtaggatcaccaaaacatgtatttccatgttatgaaataagattatatacttactgtgtagtaaaagtctctaaatattcatataaggatttactaacatagagcagcctttaatttgtaaaacttgtagaaaattcatttttagtccaaatgaaatgaacaaagtttccatagaaccagcaaatagttatcttcaacatagtaaaataaaatttggcaccttttgtagagaacatagatcaaaaccttaacttagtgaaataagaatttaaacacatagtgttgtttaagtaatacataaacatgtataagtatatatacactttaggtctaattaaacctaaataaaaacttgattgaccagtgaagccatagttccatcctcatccactaaaacttagaagaacttagctcatatgacaatttctaggttaatataatatattgctagtttagattagagcatctctagtttataaaatatgaaccatagtagtaaagaccataaacatgtgaaataaaaatgttttagttaaccaaattattccttttattcaacttaaacaggaagtagcatgttctgaacctataactcaaaagtcatgaacatataaaacactatatgcctaaaacacgttgtaacttgtaaaatctataagaaaatcattataactccaaaaattgtgaaaccaaatgtgttagtcttagaaaacacatctccacacccctgtgaagtctaatataataaaaatcactttacaaaagtattttataacactacctaagactatactactataaaccgataaaacttctaaaattcataactcccaaatggaataaaataaaataggaattatttcacctaaagtcattttagatcagtaccaacccactgtgcataaatcatgcattttagagcattttggattttcagctctttcggtatttaattgcatatcgtgtcctttatctagataattgcataatcggtgaagaagtggattaggtgctaacatttatctgatcaaggcaagttttctcctcccatcctttgaacgcattgaatcccatgatttgaggaatgaaaatatttgtttgcaaagttgcatgtgaacttaaactatattggtatttaaaattgggttaaggtagttatgacctatttgctgcattccctaccttgaataattgagcctcttgcagcttgaacccctagaaatggttacagtacactctttgtgctcaaattggtttatatatgctctatgtgcaactacttgcttagccatgcttagaaatatgcaaatgctcattccatctataattaaaatgtgattttcatatgtgaacctttgctggaataaaatgaatatgatgggtatttgcgaactaaaatatgtaaaatgtgattttatacttgggcggcaagtggtgtgcatatggtgttagttgcataccgatagggggagtgtttgcccaagtccataaggacagaacttgtgttacccatttaaagttattcgtacatccacatgtgctagtatgggatggcctaagctgattaatctatttaggaatagccttgcattctggtaggccggtgtgtatgagttcgtataattcagaggagcttcctatttaccccgacgtggtagtttaggtgactaagcgtgtccaatataacggtattgtgccacgtggtgggttcccgtcgtgtccgccaccacggcgttaagtttaaggtgtgggcccgccacttaacggttctaggtatattccaagtatgcctaggatggaggaacacgtatcgtgctggtgcaaggctaggctctaagtagtgtaaaggcttcgttatggcctctagatcacattcaacatgaagagtgtggtggagtcttgcaaactcaaaacaaactagagagttcatatcatgtgggtaaagctgtacaaactctgcagagttctttaaactaattgattagccatgctcacggtcatgagcgctttggtgatgtgtcatgagtatagactatgttttaaaaatgtgatcatgtgacattggtttgaaattgataaatgtgttgagttgtgtgtgtggtgatacattatgacttattgttaagtatggcaataagagattgattatgatggaattatgaagaagttaataatgaaacttaaaacttgtctttgttaattgaagcatcaactcctttacaaaagaattgcgaaacaaaacttgctttatgctgaaattgaactacatatttccttcctttgaatatatgccttacatgtagtatggtaggattgacttgtgcttgctagtacattaacttgtttaatgtactgactcttgctgttgatataaccttttgtttgcaggtttagacttagtctttgagtgatgcgggtttcgattgcttcttctaggatgagaacttaatggggtaaacccttagtcggtgtgcttgtgattgggtagtcaagcttccgctgttctctaataagtctatttggccggtcggcctatctaattattaagttgttgtatgtcttaagtttctttcatcttagttgtgtttgctatgtataatcatgcttaagatgaaagtgttaatctagtgcacatcatcctgggaactagatttacatgagtatgagttaggaatatttgagaggttgtagatctttagtcatttttgtcaagtcttctgaatgtgtaacacatctggtcgccgccttcgagtggtttgacgggcacatatcaggctgaagttgactggcaggctaagggctcagcaatgtctccaatatttctctctcgaggcgtcggatgtttcattatgcttgtttgatgacttgaattattcacttcatctctcaaatatctctcaaatataatgaaggtccggagagcctacgacagcatttattataagcacaagaaaaacattggtgttcaaaaaaatgtcgatcagattttttcaggtttagctcatctatattaatgccagtaaagacttatagtgtaaaatatataagttgaaacatttattagcgctaaaaaattatgaataaaaatttatcagaaatattacaaaatggtataccgttccaacgaaatagatgacgtcatgatgccgtcaatatgatacctagatatcggatctggtacatacgagatatcatatatatctaataccggaggtactagatccgatatctatgatatcatactgatactatcatgatacctagttatcagatctagtacatacgagatatcatatttgataccggaggtaatatattcggtacctacaatatcatgttgatgttagcacacattagcattctgttagaacatgtatatcgttctgtagtttccctcaacttttatacatgtgtttttagtgactcaagcaaaggttgaaaaataaattatgataaaagaacattaaaattaactttaaattcacattttagttgtggctgataagctgacgaataaacgatggtagtttatactttatagtagcatgtgcttgcaacttttcgttaggaattctaccaatatattatatcctctatttcttaaaacaactgaaatggctaaaaatgtgtttcccattttagaattttcatcgaaattctaacatttgaaatattgtatctatatattccaggcacttaatttcgcggtccaaaacacaccgcataatataattatttttttcaccggatgcataatataattattgcacttttgacttttatgtcatatgattgttttcttttagcccgtagcaacgcacatacattccggtagtcttctcaacaacagtaaaatacctgttttttcgtgtataactagaattctttgtaatcttggtggcgtgcaggcatttataaatccgtatctgctgtactcgaatgaattaattaggcgggactttcgctctcttcgcaaaaaggttctctgcgacataccctctgctttctagacacgcgtggccctgaacatcgatgtacacagtacactgcgttccaatgcgtacgaacacctgttgcaaatggcaataatactggctccacacggtgatccactctaacgtgaaacaatacttcaatctcagaacatgggaagtcaacaaatgcagatggaatgtacgcgccatatgatgtggactttggaattggtatggaattcatccgatgcaacttggatccaacaagcactcaactcggttaattaccaacgggatatcagaatatgcatgcagatgatggctaatcaccagcaatggacgcatggttcattgtatcaggatgacgactcctaaatccggcaagtcaaaaaaatataatagtaactacttgaactacatatgcataattgcaggtatgcatgtctctcttccatgttttgatgtttaatctgcatttgctttgctgtttcactgagtcaatgaaagaatgtgtctctgtcaggatctgtaattaattggtatcaactgaaggttcatccagaagaaatcaaatgaggatttgtgcgaatgcgattgcatcatagatgacatagcagtaccaaggtcagagtttatttttatgccttgtcatatctaggcgcacaccatgccaattcatgatttcttacttagtacattgcaccttgcatcatcacgttgatgatatgttaatggttagcgacgaacatatctattctaggcatggttgtatctagtaaacgattattgttttctatcttgctatataaatgcaggaaaccaaatttgcagaaactgaaggttcaccaggttttggcaatgcgtcgtggatgacatgaaaccagttacagctgcagtttcagttatgtcaaagatgcttcatttatattagtgtttcttgaattgtgagccatatactttttctccttgctaatcttgtgtggatatgaaacaccggaacttctctgcgcctacttgtttatatctttcgtgagaaaaaccatttgcctgaattttcagagagaagcttgtttgctgcaactactcgattccaacccaaagtacaggctgtggaagcagaacaccatcgtccttgtcttacttttccttgaactcatcctcaagccagccaacttcccagtattttcaggttttcaaagagcaattcgagacgaaataaatttcacacttaattttcgttatactactattcttaaccgattaacatgtgcacaagtcgaacctgaactagcccgtttccttctactacttttcagtagaaaatacccttgaaccccttttgtttcagaccaggatgtgcccaggtcaagagaaaaaacttaactacccagctgttgctgtgtctgcaactctgaatgcaatcaagacatcaagatcagaagataccgtgctgcttttgaaggtgatttactgagttctgacttgattagcagtcgactacgtactgacttagctatccagtgggaaggaagtcaacacacgggaaggactagtagtagtgacctcgccactgatccaatttgcagcttctttttttcagagttattcggtttacttgccggagtagacgactttaggaagctagcttgtgcagtacttctcaagttgtcgctgaaaagccttacctgatgaaagagagaagatgagataacaagttgcttctgagattgaagtcttgtttcaggttagctaagagtgctgattaagtgtgtaaggttgacagctctcttcaaccaagctgagtttccagaaaaagaacccaatgaggcaaggatctatggaccatttgaaacttggcaggacattttgcaagtatagcacatgccctaatatttttgtatctgatctatttattaattttagatagagaaaggaccaaggatatgctaagagaaaatgttggggctgtttggttatttgccaaattcaaccctaccaaaaaggttggctctgccagaacatttgccacttgtttggtttgctaccacaaatttggcgatacctttttttttccgttactagtctaactaatcttgccagcaatccaagcaatcatctttgccaaaaaaataatttgcaatagccaaatcttgccaatggttgccattgtaaaaatgttagcaatactaaaaatggaagagaatcaagtaggcccattaaggctgcgttcttttgtagggttccctactcccctctcgtttttcatgcacacgttttttaaactgcttaacggtatgtttttttaaaaaaaaattataggaaagttgctttaaaaaattatattaatctattttttaagttagttttagttaatacttaattaatcatgtgctattgtactccgttttccgtgctggaagagaatagaaggttttcaactagcacaacgaacacagcctaagccctgctacttcatcaaattattgctgtgaattatttgctctatgctacttctcaagaaaaaaaaccagcacttattctaagtcatttgttaagtttatcttaaaatattgtattattcctataatcaagtagataatcaagtaaaaatttaggtctcatcttttcgcttatacttatacttatacttatcggccaaaatttaaatttaagctgattttaaggtctttttaatcaaagtttattttttagcctaaaaacacgtatataaaaattttatttacaaattaatttacgtttacaaatatgccgtttcgcttattcaaaacaatgccttttttgaatgggctctaacgcccctggccgaaggatttatttattgatattcttatctttttcttaaccgtaagtctgtaaccagcccaataattatgggccgttgtttgggctttgggccggatcatgatattgcagttatcggatttgtacccgaaaaggaaaaatccgcttcactcgcctcctttctcctcctccgtcctcgtcctggtctcgcggactcgctccctcctcccctccgccatcgcctcgctcgcgcagcaatccgcgacaaatccaccagccaatcgcggcatcgcgcccatcccttcccctatactgcaaatccgcttccccgagatggtaatttccttccgccagtctctcctctcacgatgtttaattgcgcgcatctctgtttcttcggtctagttatgtcgtttagggtttatgaccaagagcagatggtgaaaaatccggagttcttggtcactcggcgtgccattccatatcttttatgcgtaataagaccttttttttatgtttttgtttcccaaattttgctgtctggaaataatttcttgaaagggttggctttgatcgtttgctcgtgcaggaatcctgtccttcggtgaagaacattcttgtgctggattccgaagggaagcgcgtggcggtgaagtactacagcgatgactggccctctttgtcctcgaagcaagctttcgagaagtcggtctttgctaaaacccagaaaacgagcgctagaacagaaggtgattaaaatatacttttattctagttctgttctggaagaatcaaaacaatgtttgtttcttttttttcaaaaaaaaaaggtgctctgtgctacttgtgtagagaacaactgccttatccctgagaacatcaattagcaatttagcatctcacaatatggcattgttgattattgtaagactcctgtggaatattctagaggcatacacatatcttccagttcgagcatcattccattgtttggctcatcttctgtaaacctgtggtttgcttgttatgagatgttaattggtcgatttctgaattttggcagagttatcaccagattttgctgtggaatactaaccttatattatagaataacaggttatctgttttttactgctcatgaattccgttgcatttcttaaaattgactgaaagattcaagtttcggaaaaatgaatttttgttccaacaaatgaaatgatctcgatgcctgtgtcatctgaaatgccttatttttggttgatcattcattttgggggattttagaataattgcattgcacatgagtgtaaaatttgcatggtaggttgtttagttcaagtcatccaactatattcatccagtgatttctttcttttctttcccaatttgcagctgagatagtaatgtttgacagttacttcgttgtatacaagttcatccaagatctacacttttttgtaactggaggtgatgaagagaatgagctcattttagcatctgttcttcagggcttctctgaagctattgattaccttctcaggtgtggacatttcctgtgccgtacactcctatcttttttaacatccattataaatgcttgtcagtactgtatactattttaacaactctctttcttgttttcagaaacaaagtgcacagaagggctgcgcttgaaaacttggatcttatcttcttatgccttgacgaagttgttgatggagggtaattactatgtttgcattgcaatatgctaacctttgctttccatcaattgaacaagcccagttttgataactatcacatttttacgttcatatcaaaggcaacagacaaggtcttgggcttgtattgctgaaatgtgaggttaggcactagttggttaatgtaaagaaactacactctggccttgtttaggtgatgagaattgagccagaattttacacaaaatcagcattgacagctatcagttatctataatatttttatagttcattgttgggtatgctcagttcacagccaaccaattttcagataaacatttgcacaaatgctatgctaatgtagaacatctacaatcaggcatattaaacatttgacaacctgtagttattgattgacgctactaattgtttcttcacaatcgggttttgcaggattgttctggaaacagatgcaaaggcgattcttgaaaaggtatcaggtcatggattggaaggatccgggtctctcactgagcaggtatggcaagccgtcgcatcaccttaagtgcaattgcacaatgagatgcaatcatggtgtcgtaattgccaccaaaccaacatgagaaaattcccaagtgaattaattcttttttgtacatgcagaagttaagcagtgccctagcaacggcaagagaacactttgcgagatctattttcagctgatggcgtgtcatccttcaggttgacgatgagcaagcctcagatagtgtctctgttagcagatcagtactcccagtttgcaatgtcctttgaacatttgccacgggttagtggtaggtgcagcttaactggcgatcattgtcatcctaagaaggttgtggtcggcacacttgttactcttgtggtttcatgtcgatcttggctgtaatcgagcacagtaaccatgtagcaacatgtttctgctcaaagacgagccagtttccaaattgtcttcagtatacagccgccatgttttgacgtagtactacatacatttacttcggcctggtttggaatttgaatggtattctttatagctaagttgcttaataatgtttgactaatttcagaatacttgctatcaaaaccgaccaatcatcgaaagtaaccaaaattcgcattacaattctatcacctgttggtatgtttcatctcatgtcaaggtaaacaaaaagagacaaaagtaatcaagcaaagcgaccagaatcacgccggcaaactgctgccaatcctgctcacatactggcacagctggtccctcagcgcggccgcgccgacgtcggcgacatcgctgaactgctgccggtagccgtcgtcgtggttgtgcgacggcggcatgccgcccctcgccgcgtcctcgaggtcgatcatgatgttggtgagcaggcagcagacgtagatgatcctcggcagccggtgcttgtccggcctccacagctctcccttgagaacctgccacctctccttcagcttggccagagcaccctgcaccaccatgatcgtcgcggcgtgccgcttgttgaagtcggctttcgccggagatagatccttctcacggtatggagtcatcagccagggaaggagagggtagcttgcatccccaagaatgtagtctctgaccactgacccagctggctctcctggaagctccgtttgtccgtccagcctcgcgcctttctcgcagagcctgtagaatcctgaggtgcgcaggatgcacgagtcattcaagctgccaggccagccactgacaacgtctctgaaccgcatgtcggcatcgacgatggcctgcaggaccatgctgttcctgttctcgccgtcgagccagacattgctgttaggctgagctgaagagcacatgaggatgtgcgttgtgtctatggcgccgcagcagttggggaggccctgaatcttttcaaacttagatttgacggttgccatctcctcaggagtaggccacttaagatgattggcagcgcgctcctccaaggcctcaataaacttccaagtgatgtttgagatagctgagtggttcatcccgaagcggttccctatgctcaaaagcgactcaccggtggtcaatcttaacagagcaacacctacttgatcttccacgcctagaattgccttgtctccaaacctgaaatttctgaaactttgtgtctttcttgtgaagtccccactaatcagagagcaaaggtagtcaaaggtcttcctcgacatcttgaagacggactcaaagttttggcagtctttggaaaattgtcctgtggacataagacatagtcaaagatcgcagtggcgttagtcgagcatatcataaattatttggcagggaacttgaaagcataaaagggaaaattcagatatattgaaattcaaagaattcgattcgttctcctcatattgaaattagaagggcagaggaagaaacggggtaaaccttatgatagcaaatttaacagaagagattcaaatctaatagaacatggtccacaagtgtcgagaacagaaaatgaacaatactagcaatatcatgaatgaactgagcatattatatgagaaaaggtttagctgttttggcaatacagtgaatatcgattcaaaatttagaagaatcatcagtagaagggacactgcccttgttaaatagatgactagaatgctatcattcctgtatctaccttcttaaatcactcacacttgatgctcaggtttgtactaattgttcaaaatgtcactcttgtcaaaatttgaaaattctaacaatgtcacttgtcataaaggataggtaggcattcaaaaccaatgttttccagtgtttcagatcatttcagcaatcagggaagctcagaataaatatcactaacgacttcaagaattcaaaaatatattgtctatgtttttgtaagaacatgtatgatcaaaataagaatacagcagccagacaaatagctatacaaatctactttatttgttcaagctaaattgtacttgtatgggctgcttcacccaatgatctctgaaagactcacttgaacaccatacagagaggcctaatgaatctatactcctggatgatctatcacattgaattataaaacagtatttgctgtggtaccaggtactataagattcaagaaacttatcgtgggaatccatttctcggaacacatcattcaaccgacctacctttgagccacactaatcattttctggatttgccagtcaatctattggaacccaatcccctcacgtgtttcctttaaaaaaaaatattaacagccaatcggatgatgaaattggggaaactacctgtgaacagatgagctaattacttaaaaaaaacgcatatgctacactttacaattctggactgaacaggcaaagcaattcgatggcaagtacagactaattgttctccgggagatgttgttttccccttagcaaaatgaagttacttcataagttgcaaagagaaaagaagttagttcttgcaatgtcaaggcatgaacagtcaaccaacctattctgaattagattgacacaatgggcaaaagccaacagcacccgtaaatttctagccccaaaataccattgcaccaaaggcttcatagatctggattggagaaggaaacaacaaaaccacagatggcacaaccaattcttctcccaaacacggtctactcgatcgatacccatcagagcaacggcattca

SEQ ID NO: 73840 - DNA, 24758 bp, Oryza sativa
ttcaacgtgatctaacgtacgcacacaaagaaacgaccaaataagcctataataaaaatactacaaataaatggtaaaataaatattgtgaatcagagcccgaacaaaaaaaaatgataaattgagagttaacttaatttggaatggcaaacgatttatcctagggttatgatttatggcatgtgtaatagtggttgcaatttgagagtaacgctatagacaacaaaggtgaaaactgaaattgatttggtgttttagagcttgaacaggaggaaaacaacctaatagaagtgtttggactggttttattgtggttgggcactatttaggtggttttgatggggttggttgggttcaaccaataggaaatagtgctggccggcactgtttatcttcttcccgtggcttttctcgtgattaacagaagtggagagaaaggctccagaacttaagtgagggaacggcgacggagacgatagcatgatgtgttccacaggctgacacccccacaggacgtggacgctgggctggaagacaacaaagctagccggaacgcaagttctagatctgcagctatggtgacatcgggcatggaagtggcagccccggtggcgaacgcgggcgggtgagcgcgtcaaaacatgttcccggatgagaaggttccatttttgtggttagttgatagaggtgaagcgtcggccatgccgaccacggtggcagccatggtgacggacaggagcacgatgggagctcgacacaagcaaggaaagaaggttggggaaaattctcaccagtgagaggtgatcctgctggtgctatggggaggaggcagaaaagtcgacgacggcgaaacgggtgcacagccggccttggccctggcaggagaaattttgggatgaaaacgtacgagattagcacttgatgtctacagaggaatagcagacttcggctcgttcactttgaaggagagaaggactggaggaggagggaaaacaaaggagggatggctacgagcagctgcgtggctgtttcggagccgcacggcacgacggccattggagatcggcgcgtggttggcgcgaggcggcacgaggctgcacaaggcggtcatgagttgggctcagggtggcacaaggagcagcgtaggcaggtgcaaggcggcacgcagctagcgcgtgcggacacgagcaggacacagggcggcacgagcggcggctagagcgaacgaagcgagcagcggcttggctggggtggctgcctcggctgggccaggacatgagctagaacagcccaacacagagagtgacaagggaaaaagaaatccgggatatgggctggaatgcaaggaactcggcccgagaaaaaacacagtgatctatttgaatttttggagagatttttgcatagaattttggtaggatattttttaataggaattgatgggatttggggtcttagaatatttgcatgatgactctgggataacttaaaataaacacgagctcttctgatgattttgggaattttctttgggatatctcggattttgtttggagagggaaactaaacaaggttatgtgggagtaggaaacttagagcgaacaaaagaaatataaggattgggagactccaattcgaaagaacgaagaacatcgactttaaatattttcgcaaaaattttaccctgaaaaatctagtatgttacagtatgtgatacaatcatctctatgattgtctctagggcatatcactaacactatgagccgcccacatatatgagtcccatcctatccaccgagttgatcaagcaagaacagacttgcgcctcttgttcttgcccgatcagctaaagaaggtgtggttttgctccttttttttttaaagattgaagcctgcaaggtaaatattcattatttctcactccattcctctcttactttatgatttgaattaccatgtgctatgtatgcatgtaaaattatgtgttgtttttagagataattcttatcttttttggtgcccattaatctcattagatctattctcggatgacatgctaaatttgaattaatgttttcttccatatgtaggatcgaattactagaactaagccaaccagagaggagtgaatggttggtgtacccaaaaaatcaaactttttacggaattaaaagttaccctcaaatcgatgtagatcggtctgaccgcgcctgtgctgccggtctgaccgatctggatcacccggtccaaccgcctgaaatcgcctctgcctcttgacgctgccgccggtctgatcggtgtgtacccgccggtctgaccgccgtgatgccgtcggtctgaccaccggtgtttcgtcggttagaccgccgaacctgagcaaacacaaatcgaagatctctcaaagtagatgacaactttattacttctctctgtgtttacaaagtgcaacaaccacactccttatgaaaatctcaactaaactcgaaaccctaactcaactatcaactcaatgctctcaaaagcgatactgggaggccacgccctccctctctatttatacatgaggtagacagtctaaaactacgaacccaactcatacaagaccacactttacataaccaattgtaccaaatttggactccttccaaattcgacttcgtatcccatacgcacacaatatctccatcgtatgccatatggaaccttcaccaaccatttgcattgaaccctagcctaagtataccgcatgatatctgatcatcacggacgtcgccttatccccaagtcgactcccgatccataaccggcaatactctcccgaggcatcaagtcacctacatatgaatcaaacaaagaaaccatattccgagaccaagctatctccaacttgactcattgttagcaaacaacagtattacatacatatagtatctatctagaagccataaacatgaaacaatcatggatatccaaacaaacaacccgaaaccgaaaccgacatagagtcggctagtcagactgcgggctggccggtctgacagctcgatatatgccagtctgaccgctcggtatatgctggtctgaccggcagcacttacccgatctgaccggtcccgacaaagcagtagtccctgttcaccgtctagaaatccatcatctccaaaaccacttcgccaataatctccaaatatcaaaaccaataatcacagatgccaattgttcatcacaaaataataatcaaacacactttgattttacgccatatctatgctatcaccgttagtcaattgttagtcaatctccgttaaggacaagaaattgtttgtcttttcgttatcccatatcccgtaagtggtaacctcaaaatattttttttctagcatatgtggcatgagtaatagcataacaaaattgcagagaatccctgtgtggtggagatggtactattgggcaaacccagttgcctggagcctctagcgtctgacttacatcgcagttaggggatcgggatggcatgctggacaccggcgaacccataagggcattccttctgcggtactttggtttcgagatgggcttcttgaagcttgccgccatggctgttcttggcttcaatctcctctttgctctcatattcgtagtgtccatgaaagtgctcaactttcagaatagatgaacatcattgaccatctcccctctttcatgtacttcctgggcatgttagccctaaaatctaagctccaataaaaagaagaaacaatcttcttgtcttgaacgagagctagtctatcttttcaggccaacttgtgttgcaaagatacttgctttacttgcacaacatttcggattgattcagtgttccaggacgcatcagattatggaatacatcaacacttgcagcatccacgaaaacgtacacaaacagttggtgatacttaataaaaatgggagaaattaacatccaaggctccaagccattgaattcggaaatcctaattggcgatcgatcgtctgggacgggggtagcgatcaattcccctcccccctccctcactccactggtttccttttttggtaccgcattacttttctattttagtaaatttatgcacctcaagtttatacacctcaagtttacacatctaaagtttagagacccaaagtttacacatctaaagtttagagaccaaaagtttatatatccgattcaaatttgaatttgaattcaaaattttttatatatagtatttctatacatctaaagtttatagaccaaaattttatagacccaaagtttataagtcaaaagtttacatacccgattcaaatttgaatttgaattatatctgatttaaatttgaatttgaattcaaatattttctatatatagtatttttatgcatctaaagtttatagacctaaagtttataagtcaaaagtttacatacccgattcaaatttaaatttgaattatatccgattcaatttgaatttaaattcaaatattttctatatataatatttctatacatctaaagtttatacacctaaagtttatagacccaaagtttataagtgaaaagtttacatacccgattcaaatttaaatttgagttcaaatttgaatttgaattcaaattttttatatatagtatttctatacataaatttttctaactttttgtttttttaaaaaaaattatgtggtgtactgtagtaggaagagaagaaggggaggagaaaggggggagagaagggaggaatgtatcgagtatagggggaggggggcggatatgatcgctggatcgatcgcccgcccattagggcccccccactgaattagatcaagggaagggtttctttgcatcctgtttggcgatggcccaatgtgaagccaggaacaagcccaacatctggtgggcgttggccttcggagaatgattcggttttctgggctgcatctaaactttgaagagttttttttccccttcttttgttcaccttgagattcgttttgaaacatattacaatcgcagtcgcttacaatgcgcgcacactcaccactataaaggcacatatgcacaccctacgcctatgacgcagtcgctcataacgcgcgcacactcacctatataaaggcacacatgcacaccttatccctatgagcacctccggaagactgagccggcatatattgagattaacgaagtcaccataggtatctcactgtcgacgtgtatgtcacttactactaaaagaataaatagccataaatgcgagcacctatatcaagtttaaaacttgaaccagttgaactatactctgaaaagctagctattgagactttttttaaggggaaacattacttaaggaaagttgtttttctcatcttctagatttagggttatcttctaaaatctgtaggtagtaattgtaaaaaaaactagagattttacagaaactacatgtgttataggattcctcaaaaggggttcaatttctaattattttttttctttgcgaagaaaagggttacaagatttagggtgagtttgaggagaaggagattgggaaaatatgcaaaacgaggtgagccattagcgtattattaattgagtattaactattttaaatttcaaaaatggattaatatgatttttttaaacaacttccttatagaaaatttttgcaaaaaaacgcaccgtttgttagtttgggaagcgtgcacgcggaaaacgagttgttttctcaccctatctcacatgaactaacacagccttacagctcttgcttatcccttcctaagcattctccccttgtctaaataaaaggattttttttatatggcagtagattataatttggtagtgcaacaacttacaatttcggtacagtttagtcgtaaaggtctgacggctcatgtttattttggcggttgaaaaaccatggccgaataatgccagtgaagaatcaagcataaatcatggcctcatgggtgcaacaactatccagccttcttgtgttgtgagacagatttttgcatcatacagttaggtgttcagccaacctaactttgagagctcgattgaatgtgtgctttttctataacatagtatgattcttctgtcctctaaaggaacatccgttcttttcccttttatttttttttgaataaactgtattttgttgtacggcacacggggtacacagatgcacctaacagtctatctatcaatcaactatggctggttattatacatacatggtgtgcttagctagagcaacctaatataaccaccgccgtccaaggttagatcgccaaattaagtgacggaattccacaaaacagaccaagcgtacgtataatccgtactccctctctcgatcggtcataaaaacatgtactccctctgtttttcaagccattcatattagaattagaattttgaccaccgattagatcattagactaaacttaacaaaagatttactattatatctaagtacatggtacactttagtaacataaaattattttaagtatttttaaatattttttaaaaagataaatagtcaaattttgaaaatgaatagtatccgttgtcatttatttaaatatgaagggagcatcttttcagcattgacgggtatccagaatataattttgaccattgatttctacacaataaatacttacaaaatctgacataataatattatgaaagtacaaatttgaacacataagtttcacacgcccagtctaaatatttgaaaagatatattcggcacactatgtatgttttttttatgttctaacatagttggatctaggggtgatcatgggaaaaaatattaacccaatttatatatatatgcatatataaaaatacttttgaaaaaaaaaacaaaactcttttattgatatattttttgcggggtcttttattgatatattatgatgcatatttcatcaattcatacttctaactttggtatgtttagggtatttaataaaattatataaatttgatcaactatataaaaatatatgatacattgcgttttaaacgagttctttgcccagtttgctactagtaccatgagctaagatacaacaagtaaaagtctttcgcgtggcgcgtgactcctgtgtcgtgagaaagtcgtcatggcatcttgctctgtctgtccgtagtgaatctccccgtctttacgctcggatcgatcggtttccgttttctctggcccatgccaacgcacccagcagtcgtactgtcggctgaaaaatagcaattttccatgttgaccaacttgtcgactataaaaatatttggtcattctggcaaggagatgctctcccctacccaccggttcatattcataacctgctttttctttagagtattttgttttttacatgcttttgtgatagattatggttatgtttagctcacactgaaatttggaagtttggttgaaattggaacgtgtgactgaaaagttatgtgtatgaaaggtttgatgtaatggtaagttggaagtagaaaaaaactttgaaactaaacaggcctatatatgggtgaagtttgtaggtgacctagctaggcagctagctatattttgcttctgagctttgtttggggtcatataatgtctaaacgtcaagtactacctgagtcttaaatatttgatgttggtaacgtcaaataaaaagtagagggagtatattagcgataggaaatttggtttataagtgaagaaggtcctgtgtcccagatttaaataaaagatatgtgtctttccaagaaaaagaccagaagttaaaactttacaaaagtggtataaatggatttgtatttaaaagtattttctatgatattaattccatagtcgttgataatatattacgaaagaaattcatatcatcaggattttttgcactaccgctatgtcggtgacatgggaccgggagtatcatgactagaggcttgggcaggagcaatcacccacgaggtctgaccccctcgggggggtcgggtccgagggtgatgtggccgcccccctctttgtctccccgaggggtcggaccgctcccgtttcggccccgagggctgaggcgccccgacctcttgggggttttgcgccgcgtgtctgggttaggcaagcgcagcggggctcacctaaccgcatttattgcggtttggtcaagcgcgtcacgccgcatgtaacgcagtgcagcgcgctcgtttatccggtctgtgaccagtcacagaccgatcagatcgtggattaggtggcgacaggcggtctgacacacgccttgccccatcccgtcaagatgagagcctccaagcactcgtccctagccggagccggcgtgttacctcctggagatggcacgttggtcccggtcagatatatgccaggcttcatcctaaccattacaagcaagatattgtatgaagaagggcaaacatgcagattgttaaactgacacgtggtggacaagaatgaccgatttgtaaccggactgactatggtcatgtcatcagcagacagccatgttcccacgtcgcgcctgcttccggcggaagtggaggtaggtatgggccgtcccatcagaaggtcattcggacggcagccatacaaatctccgtccattaatgaagagaagtcaagttggagggaagggaggatgagtcccgacacaaaagaaagagagggagagatggtgcatgtggtatccccttgagatataaaaggaggaccttgcccacttagaaaagggggaaaaaacgatcccagaacgatcaggggctggcaggcactttgtagcttcttcatacacagatccaccaaaacacaggagtagggtattacgcttctcagcggcccgaacctgtatacatcgcccgtgtcttgtgctttttccattctcgcgaaccttccacacacagaccaggagtttagaacctcacccagggcccccggccgaaccggcaaaggggggcctgcgcggtctcccggtgaggagccccaagctccgtcagttgtttttttcaattttgctatatatttgtcgaaaaattttctcctaaaaatttgacaaatgtaaattacaatacaatcgtagtataattacactgtaacttatataacttttacataattttaaaccgttagatttgtttcaagatttatgcaagtgaagaaggaaaaaagtcataacacgcacacatgtgagaggattcgttcccacgacctccgtttcaccaagatagcatgttacgtagagattttaaaagttacattgtaattacatgcaagttacagtgtaattacatggtgattatattataattacatctgtcaaatttttgattgaaaatttatcgataaatatataggtaatcattttttttggaatttatgatgcaataggtagaggagaagggaaggagcatgcccgatcgctctcggtgatcacccacccattagccctccccgaacaaatcaagtgcctgccagttgggaacaaatcaagtgcaaactcttcattattcataaaaaaatcattaagagaacactacttgtcaatacattgatttcttgtgttgctatcacaagacaattatttttttatacaagatcaaaatacactcatatatattatgatgaaaactacgtgttgatgaatttttgcaaacgtatatagtaatagtattcttatctcacaaccacaaactagtcgataagagatccatgcatgcatatgtacgacagtacaagaccagcctcgacgttcgtgcgtccggccgatcagcaagcgccgacgcggaagccgaagacgcccccgccgacgtcgtacaggacctcgaacgtgcgctgctgcacgttgccgatggtgccgaaggccttgtcgtcgcgggtgggcgcgaacgcgaggcagccgccggacaccatgccgtgcgcgtcgaggtcgacgacggcgccgccggcgaacaccagcgcgacggtcggtatgctgaccttgtccaggccggtgaagttgaagcacgtgtcgagaatgcccaggggctccgccctcgcgtaccgcgtcatcccggctcggaacgccgacgacagcgccgcgtacgccgccggcggcagccgcgtgatcaccgtgccggagtccaccagcgacccggcggcgaacaccgacggcgacagcccgagcttcttcccgcccacggcgatgtcctccagggccgcgaagtagtacgtcgggaccttcttgctcctgagcatcggcgtcgtcgcgaaccgcgacgcgccgccgccgccgccgctcgccggcgcgcccagcgtgaggaaccccgacgaggccggcgtcgccgggaggcagtagaagaaggacttgccgtacctcgccgccgtctgcgacaccggcgactgcgcgtcgccgccgaggccgatgaagccgtcggtcttgtcgtccatgccggcgcccagcttggcgtggctgcacccgaactggaagcccctgacgacgtcgaagccggacagcgtcagcacgtcggagctgtacgtcccggttgtgttcgagccgtcgccgtacttgacgatgtactggcaccgcgacttggcgtcgcagccgttggcctcgccgctgtcgccgagctgcgcgcacgcggcggcgctgcagttgaacgccgcgtacgtgctcgacgcggccgggtcgaacagcgcgccggcgtgggcgtggcacggcgacggggcggggcacggctcgcactgcacccacgacacgtcgctgccggtgtcgatgaccaccctctgcgtcaccgccggcgagccgagcccgacggagatgacgtactccagcgtgtccagggaggagcccagcgtggtcggcacggacaccttggacgactggccgtcctcgccggcggccgtgccgttgctgccggagaacttgcgtcggatgtagtcagctcggagctggtcacggcggagcagctcctcgtcggttggcctcttctcgccggagttgggatccgccggcgagcatgggccgtaccggtggctcaacgtcaccgagctcgttccatctgaggatgacggaatggtcgctgcaaaaattaaatttcatttcttaggaaatttgaactttcacaagaagtatattaaaactttcactgcatgcaaagtatattaaactttcactgcatgcatgaaattttagttgcagaaagatacgagagatttttatggacagttcactaccattgggctcagagcagacggccctactaggattaaggtcaagaaccttgtaactctattcatttcctgcacgagcaacgaaagaatggtaactgcacaagaggagcagcaacacaagcgaaacagaagtcattgctgttcctttgcttcgtcctaggtagctaaggctatgggcaaacctgagctagatagatgcagcttcaaaaccctaccttctctatatataagaatcggagatcgattttcatcctccgatgggacatcctctcgtttctttcatttcatctaaatagttataaaaaaataaaaaaactgataacatagattaaatatgatatatatcacttcatagacgtcaaattcgacttttaaaagttgtaaaaaaactgaaactagttaacatacaatcatagttgtatttattgtttttgttacaatatgtaaaagtcgaattttaaactcgcatatctatggagtgatacatgccatattaatctaaattatcatttttaaaaaaaaaagtataactatttaggtgataaagagatattttcttgagggatgaaaacaccttctcataagaaactatcttaatcacagcccattcagttcagctgatatgctaacaggttccactagccaataaatattatagattataaagttaataaatagtaaaaaaactatggaccaagtatagggtggcacgaattagaaagtggattgtttctgtccttcgagggacatcctcttgttttcttgttttatgcatggtatttaaaaaatcataaatttttgttaaaaaaagttaaaataaaaaacatacaagttgaaattcaacttatacaaatttgactgtgattacgcgttctatccatagtcaaatttattttttttcaatttgtataagttgaatctaaacatgtatgtttgtgatgaagcgatatatcacatatttatctattttactatttttttaaaaaaatgatgatttttagactacatgtaaaaacaggggacattcttaaatgaatagagtttccccacgaattatccatatgcatctccattaactctaaaaaagacagaccccttgaccgagactcatagttgacccagtaaatcaaagttcttgcattttaaaactagatttaatttgttgaaagccatagcaaagaaatgcaacctaggcaagatcatcgcaagtacgtcatgcatgtatagcaaattaaatggcgacgcgcaaccgttagtatgagaaaaatcattgctgtcacctgtcacagcattctctgttcattttataaacttctttaaccacagaaatattaacatcccaaaaaatcagtaaagctatttaagttagcaagcaaaatatcccaaaatgagaagtttggattttgaacacaatatatagcaattagaaaaaaagatcataatacgagcaagaaagaaaataaaaaactaaataaaaaatataaatatcagtaacatttttcctgttctaggtattcaaaattctatctcgatctaaattaaattttattaatggagaactttttggatcacatttgatattttttatgcaacatttaataagttcatggataaagaaaggcaaatcttttttttttaagaaacgactcgcacccgatggtgcaaaattttatattgatatagcatgaaagatacaacattataacctttggaggttaaccgggaaaaaaaacaaaaacaaacacaccagcaccgcacgctggcagctcctcacacaacccaaaagaaggcgctagcaccaagccgaccgccatatgcgtgcgatcactgctaaactttaaggggggttgcaaatatttcccacataccgactctgtacagaagatagtcgaagtttatggttatcatcatgtagaggtgttgaagagagggagagggcgagagagaagaaaatacacatactcatccctcctgacaacatgatgatgacaatcaagaaccgccaacaatcaaaccgagagaaggcggcaaaggcagggaacaagacctcctaagcaacgtcttcaaggaggtcatgacatcctaggtgccaccgttgtccatccaactagactggtttttccagccgatgagatttgcaagtaggaggaagggtagctgcttgacaacggcccaaaaggggtcacggcgcccgaacacgttgtcattgctggctcgggaaatccaccctctcccacaccttcgatgccaccccagaactcctccgcccaacaatctctatcggccggcagctccaccacacccggtgccactgggccaccttcacgaccgacgctgcattccgtagtggcgtagagtcgttacccacgttgaccactatctcggccagcactgcgagtagccgttcctgccctctgcaacagccgcagccttctctgtccatgtcgacctcaccttcaccaaatgcctgctataggctcgtatcgggcttcttgccctttggccctggtcatggtggtctcctcccgtcgtcgcccacgtgggcctcctatcgccgcaagccatcatagcctcccgctatcattgctcgtgctgacctccttgccactaacccccgtggcatcttgttgctgctgcttcgttgcactggctgctccggccagatccggcacaagggccaacgaatacacacacgggccgaccagacctagctgtggtagagccggatccgtagtctccacgtcgtcttccctatgctccacgcaccaagccactttcctcgcgctgaaggcgaggcaccaccatggtttagtcccgccgccgccatcccggttgaccactcaattctccggtggcgagaagaggaaaaaaaggggagatggggcagcgagcgctagggttcaaccccctaggtaactctcatgtgcggaagaagggcaaaccaattatttgtatcatttttctctaacttgaatggatgctttgcatatggattgaaaaactatcgatcggtgagatggtacttttcagatttatgtgttcattcccgcaaaaaaaaagatttatgtgttcatttgcaatatcatttggctatgagagaattttcaattgtgtttttctaatacctaagtggctaagtcatgcttatatgcgatgggatttatcaaatttcctcttaaaattactccctcagcaggacaatatagtatgcattttgatatagaaatgtcaaactttttagaatttgatcgagtagtcaaattatagaatatttagtatataaaaattattctaatatttatattttaaggtgattttgcaaataatagagagctatgaaaagatatatagaatgagcccaatgcaaacaaggctcgaaagaaccgaatgaaatacatatatattttacgaggaatgcatggtcaaagttgactaaatgacttaaaaattaaagtaaatgtacgaaagggataagatcttgttaaattcatctggtgcgatgctgccgtcatcagggcaggaagtgatacatgaattgaatcgtacgtccttgaatcttatatactccctacgtactctaccatttaaatgcaatcacaggtttttttacaatatttaaccatccatcttatttgtaattttattattattattattattattattattattattattattattattattattattattattattattattatataatacatgactagtactttatgcatgattttttaaaatttttttataaattttttaaataagacgaatgggcagagggagtagataacgtgattggtttacattgaccggtgttctaccgctgttagcctgttttgattttgatcaccaacaaattttaagagagaatctattctatacaattgagtttgttcgagttcaataatttgtcattaacattttcactttctataatatatttttgactttatcaattattctacaataagtcattgggcctggggccttcttttcaaaaataccaaaaatacccttatggacatacaaggttaacaattaatttatctcattagaagtttaaaaaatatatgaaaactttcatgtgacctccttacataacatggaaatttgtatagaatttctttcttttttacatttttattttttaaaaaatataacttatctgttgtatgctatataaaataattttttattgttgtttttagtataaatcatctttcatacactacataagatattttgtgctattttctcttatataagcaaattctctctcatataccacatgaaaatattttctttctaaaaaataaatataccagaaaacacttgaaacatgtacacaaacttccatgttgtgtaaggaggtcacgtgaaaattttctctcttttttttaaacttttgatgaaataaatcaattgttaatcttgtatgtctcaaagggctcaaaacttagatttagatatgcaaacacgagattccctgtaatctatgacgggctgtccctattgtaggtattctcacgcccaatgacgtattgtagaataattgataaagtcgacagtatattatagaaagagacaatgtcgatgataaattgttaaagccgaataaactcattggtatagaagagattctctcaaatttttaagagagaattactgtttgtgccaggtaaagatgcatagctttatgtgaaaaccttagattggaggtagtccaaagggaaactttgattaaaaaacatgtctcaaactacaatttactcaaatttaaattatgaagttttggccaaagataattgaagatcatatttagatacagcatactttcatagtacagtttattgctaaaatataagtagtcaaacattatatagaaatagagtccagtgacaattgtttaagaaccgaggttgctagatgtagttaatgttatttcttattctcttatcatgcaacaatataccaaatatttataactattggatgattaatatatagtctaataaattgtccttcttctttatttttgcttctgtgacgaaggtaatcacatcgattatttttagccttcatccagagtgtatgtctttcctgctatatatagcttgcaccatctcaattatttctagctttttgggacaattgattaaagttcaacttgtgaagagcacataaatcacgtaatgtaactataaaacaaatccatcttgcaacccataattgcccattgtcaacagtgcatgcaaggttatcatatagtatattttaatagcattggcagtttttatatggtagaggcactggacttttgacgttgtagtactttagattatacatgttttacaaaaatagatcctctagaaaacttgtcgtatttgactacacggagggactttttttttattcaactgtgctaatcttggtatggaagatacataatcttggtatggaagatacatttaatacatgtttctctcaagttatttagggcctgtttagttccaaaaacatcacattaaatttttagatatatgtataaagcattaaatatagatttaaaaaactaattacacagttagaggcgaaatcgcgagacgaatcttttgagtctaattagtccatgattagccacaagtactacagtaacccacatgtgctaatgacggattaattaggctcaaaagatttgtatcgcggtttccaggcgagttatgaaattagtttttttatttgtgtcaaaaacccctttcgttatccggtcaaatgttcgatgtgacgttaaaaattttcttttcgcgaactaaacaggccgatgtgacgttaaaaattttcttttcgcgaactaaacaggccggtatagacctctacctggggatcagctaggtcgtggtcttgcactactacacagaaggttttcccatgtggtcgaacggattttcgcgtgcagagattcgggccgtctggagcaattcgtctgcgaaaattgctatttgtgcgtgcgagcggcacaaccgcacgcgaaaatccgattttcgcgtgcgggtgcttatgtcgcccacacgcacaaataaaaaaataaaaaaaaacaaaattgaaaaaacaaaaccctaaccctagccgtcgccgccttcccatcgccgtcgtcatcccgtagtcgccatcgccttcccgtcgctgtcaccgccttcccgtcgtcgtcgccgtcgccatggccagatccgccgccttcccgtcgtcgtcgccgttgccgtcgccagatctgccgccttcccgtcgtcttcccgtagtcgccgtcgccttcccgtcgccgtcaccgccttcccatcgtcatcgccgtcgtcggaggcccgccgccaccgtcacgccgccggatccgcgcggggggcggccgccgccgccggatccacgcgggggcggacgccgccgccgttgcaccaccggatccgcgcggggggtggccgctgccgccggatccgcgcggggggcggttgccgtcacctacgcccaccacgcgccgtcatcgccgtcgccgtcgccgcgggccaccgccctcgcctacacccgccgccgtcgccgtcggtgcgggccgccgccctcgcctacatccgccacgggaggagaggagagaggagtgaggagaggataggaggggcactgaggagagataggagagagagcactgagagaataaaggagagggatgggaccgaggcatggaaaaaggaaaattttgaagtgggtacgagggaaaggagggatgattacttttgcgttcttaataggcccgcacggaaaaattggtttatttttctgtgcggttcatttaggaggactgcacgggaaaattgatttttccgtgtgggcgacagcctgacaccaggcctctatttttctgtgcggttccacttacgaaccgcatggaaacaaaaggggatcgcgtccagaaaaatcaatcctctagtagtgttggcgctcattgttttggctctgacctctctcacttaagaacaactcctttctttagattaaaataatatattcatttgttttctaagttttagaaaaactgacatatcagtgtatcctaattcatttccgatagtttatttcaaaacacacatattatagtttaaattggacaaaaccacatggtgacacataactctgggtattataatcctaaaatttcacaaaatcacattactgatcattttgactttgatctaacatattttttagttatacaatcagatcttaaatttataaagaatttatccatcatgtaaatgataaatccactttatagaattttgatataggagtatgttaaaataattaatggtgtaatattgtaaatttttagaaacataataccctggattatgtgccatgtatcaaaatccacgtggttttgtataacttgaaccataatagataacattttataaaatttgctcttacttttatttttaaaaactcatttgggaggagaatgtgggtcccccccttcatgctttcagaggtgaaagttgtgaactttacctccccacaagcaaatccattagtgcatgattaattaagctttatctggaataaatctaaaagtattaatatgatttttaaagcaattttcattttatttttgcaacacacatgctgtttaacggtttgggaagtgtgcgcgtgaaaacccgaggaagtagaagttgagaagaggtgaaaatgaacacaactttaagttttattgatttgctttcgtattttctgaaaaaaataggggaattaaattatggcgcatgatttgtaattgttttctcaaattttgatacaggattttggtatgacaaggagggagggaaccatatcctccctaattaagttggatgacggcaaatttttcggagcttctttttctttaggttctatgtttacgtttatgttatatatgcaatggaaccaaatattttctatatttttttacggtttgattaaatgcaccgctggagatagcctaattgtatcgatcaaggatttagattttcgttgaatggaagctcataaattcaatgtgtttggtttaagggcaatacttgataggacttgaccatctatggttttcggatgaacaatccattaagggtttgtttggttgggtggatagaaagggttaatattttgtttggttatattagataaactcgagggtggatagattgagaatagtaaacaattgattaataatgaactactcattaacaataaagtagactataaccaatcgagtatgttatttagtaataataatcttattgtgataataccaatgatgcgaactaaaccaattatcactaatcaaataactaataattaattaaggtcagtgaagatgggtagtacttcgtttggccaattttaccatatgacctcgtccaacagcttcctagaatattcctctagctatcatccacccttattgtcaaaccaaacaggttcaaaacttaaaatggtcatctcctatctaagactgtgtttagcttcacaccaaaattaaaagtttgaagaaaaaagttgaaaatttatgtgcgtaggaaagttttgatgtgataaaaaagttggaaactaaacaagggctcaggataattatttactccgaatgtaccgtacatggtatgaagagggtcaaccttctagttttttctcctctggtgatgcacatgcatcagaaatgctcaaaaaaaattataaaatcatatggaatttttaaaactttgactctgatgtttaatacacttagtttaaaaatgtaaaaatggtgcttgtaaatttgtattgaaaaatactttcaacctcttataaactcctcgtgctttagaagatgataccccaatataaaactggaccaatgtcaatccttcatatccatatcaaaaagtcaaacatcaagtagaatttttaccgaatgaaatgttagtctatatttctttacccaactcttgaagctccggattcttcctttacaaattgcacggaagaacatcgccagagttatttatccaattggaaatatttgtgcaataatatgaacaggtcttggctggtttgaaatgttaaatggagtatatctacactaaccaaacaacgatggcaacacttatacataagtgcatgtttatacgcattgaaaagcttatcctttttgccattttgtgccactagccgcgtttgccagttcaaatggcggttgccagactgtataaagagtatatatagtagtgaaaaatcgagtgacgattgcctgaaataatggccaaatcaaataccggatgcttgtacgcatcatcgatcttaattactactacctccatattttaatatatgacgctgttgtctttttattcaacgtttgaccattcatcttattaaaaaaaattatataattatcatttattttattgtaacttgattcatcatcaaatattctttaagtatgatataaatattttcatatttacataaaaattttaaataaaacgaaggataaaaattgataaaaagtcaacggcgtcataaattaaaatacgaatacggagggagtacgtactatgtcaacttcttgctgagtttggtgatttgtgacattgcaagagaggacttggcgttgcctcgaactttctataaggtcgatcggtcgtcgtcgccatatatactaggcatcggtgcaccatcattcaagagctatcgatctctccttgaaaatataattgatctaccagacatctgtccgtgcaagatcagacgatgacaccaaaaacacgatgtttaattcataacggtgcagccaaagtctatatatatctccgaagcacacatcacgggtgtttctcttcaattagcatcaaccggctaagccggccaatcgtacctattagtgacggcttcgagaggtggtccatatagcccttgaggccttgaaccatccactaccacagaacccctaatacaagtggacactataagtgtcgaaagtggtaaaacaagcacctatagtatcgttcccgcctacccgcctgctcacgccaccccgcctaaaccctgaaaaccaacaccttttttcttcaaatagttgctggtttttaaaaagatctttcacctattacctctgtcagagaaaggtgccgttttgtatataaaatccggcaccttatattccccagcccatcggagtagttggtgcgggacccaccctagaaccggcatctttttggtgaaagagattgattttattttaagaaccgacatttttcacccttcacctcctgaactatagctgttgggggacccaccctgtaaaccggcaccttttgtactgtcaaacataggtgccggttttagtgtgtagggatacgcgtaagctacgatagcataaatcaaaattttctaccgcgtaaaccaggaaccaagcaagtcttagatcatagatcgttaccactcgacgcgctgcgcagtagaagaaagcgctaagaaggcaaaggaaccctcacgatgtagcgcgcgttgatgtagaggaagtagtcgatcgcaccggctcgaccttctcctcctcgtgcgttctcctcgccgtgctcccacgccgatcagcaccgcagagcagcggcgcctctatcggtatccacacgtatagggacagaacgccacgtgcagatgtgctagcacccgcgcgcggctaaggttttgctcggggaggggagcggcggctagggtttctcacgtgatgcaatacctccgccggtcacacccctcacgaatatatacgatccacgactcgggcctccaaggcccgtaggatttatattcggatccctatccgaattaagctcatattggatatccatccattccccttattccagcccattaagtgtgtaaccctataggttcatatacactcgcctgtaacccgaaaactctttttcggtccatgtgtcaatagtggtccctagccgaatgtattgacccaccggacatacataaagatcatatcggctgaacctctagtgtatacttgtatgaacccctttgcctcacgatatcgattaagcttaaggctagatatgtgccatcctctaatagctcattcactcgaacttgtgatagattatatattacttgtgattgactcctcaatcacctttggcatggccatgcactttcataatctataacatcgaggggcctagggatatcttttcataggaggggcaaatcccatcttgatttttcatatcccactacatgtttcatagcatacccgaaaactacttttataactacccaattacagagtagcgtttagcagtctctaagtaagctactacatatgttgggaaccatgataatctcaagtctaaggattcgacaccaacactaaatgagatcactgatgacagaacacatatggctcttgcagtgtctcatgttgggtctatccaacaatatgttccccaacatgtgtccacattattaatttagtatctctataccatgatccatgagacataatcatcaattaatacatgtgctgattatttaaacatatttgttccacatttgatatttgatcagtgatcctttagaaatagtgacatacaacataaagaatctcatgaaagaatcacatattcattaaccaataatgagttatctatttcaaggaacaatatcagataaatatgtaaacatagtatgtgtggggatacccggtttgagtatggtatcccgaaaccacccaaccgtccaggatttcgatcgcgcacagattgatatacagaacaactttcgatacgtatacccaagtttttatagaaattattacataaaagataactaagacaggttttaggggccgacagggcaaacacactccccacaaacagaagacccatacacaaaataggataaaaacaccacaggcaacgcctgagagcagatcgacctagaacaagaactcgtcagcaccatagaattcttccccttcctgcgcctcctcagggaagaaccgatcgtctgaaccacattttatgcaagaggtgagtaccgaggtacccagcaagccacatccataataatacaaatagaatatgtgcaaggcgtacaaagaagaatatagttcatcaaggaggtttcataacaagcctattataaatagttttttactactttgtaaaacatttcatttgcaaacagttgtaaatcattattttaaaatagtagcaatattaatcaccattcatcctcatcttcatcatattccatattttaatttaaaatctactcataccatgataaataggaatcacccaatgacatagcttcttaaccggaagcacggcacattcgaatgatttaagactcatctctgcagagactgcctagctttacccacctgatgtcaacagcgagctaggctgaggacaacatagccgttcgagagtcccacttactactagttactgcccagtgggatattgatccgtcctagcagtcgggcacttgctgggcctaagcaaggctagacggtcgctgctttcatgggttccaccgttgcggatcatgtcaacctggcagaagccccttccacatgtccaccccaaacctgctcatagagccaccctacagtctttcatatagtgggaccatgtactaggctaagtctgattacttggtcctgtggatgggcgcaaattacatcattttccatggcataagggggtagtccttatatccgagggaagccaccaaaactagcacaggcccgtgcatactttaagtgtaaatatacactttcaacaaaataattataacaatatgcacggcctaacacaccacaacatccatcttcatccggaattaatcttccatatcactccaggcgagtgactcatatcaaataacatattttatatcacccgacacgccaccacgtgacaacgggtaaaccatgtatatgagtatagatattttgtggtcttatccactagaatattattgtgaagtatataaatctacacctaggttatcaaaggacgtgatatagcaattcatggatctggccaataataacaatgtaatattgggtaataactaaactaacaagtttattcaaaaataattcatacgcaaaataattttataaatactcaatgcataaaataactaagtggttctctactaggtttcaatatgatcaaagattggaactgtggcttgccttacggaacgtggccttccgaagcttcagcgtagccttctaggtccacttcaattcccgtgagtccggtgggatcttcaacgtgatctaacgtacgcacacaaagaaacgaccaaataagcctataataaaaatactacaaataaatggtaaaataaatattgtgaatcagagcccgaacaaaaaaaaatgataaattgagagttaa

SEQ ID NO: 73841 - DNA, 553 bp, Oryza sativa
ctacatgagaaagacttctctttatctcatttctttaaccttattggttcatcatccttaataagctcctattgtacgaggaccctaactcatttctttgaaaatggtgtacatctgtgcagcttttatgttaaatccttccatatagaatccgtgcacggaccctttaaacctatgtcaatacttagtatcctgcagcagcacgcagggtatcatctagttgctaagaaatcacaagcgtacatccctaacaagagcattttaaatatctgatgtgttgtactgttgtgccttatggttaatggaaggtccgaatcggtgctagggaggacaaggaaagaatgtgggtgggaagcgaatagtcagtccattatagcattactcatatgctccgatgacacgagtattccaacaacatcctccaaaacatcatgtatttattcaatcttgtcacaaaaaaaaaaagccgcacagcattacataggtgtatccccgttatcttcaaagatgaagatctctctcatcctcatccgatcgagagcagataactaac

SEQ ID NO: 73842 - DNA, 30397 bp, Oryza sativa
  unsure (1)..(30397): unsure at all n locations
taggatatggttaaatcaggcaacaaataaagaaacagttgaacacatcaaccgagcacaaacttgtggaaacatttgattgcattgatcttctggttcaacttctgaatattttggtgattggcatacagagattatttttacagtctagtctaccaccttaatttccttattcttaagtatggagaatacaggctggttatccaccagtaaggtttgtttggattcctcggtgtcagtagatctcagcattgccatattccacgttgctacacgctccatgcgaccatgccctgttcctgcctcctgctctactgttgtatccatccttctcggaagaacaaccattttttttttcgaaaataggaagaacagcctttgttcccatgaggccatgacagccatgccgacatctctacgaagttgctagcacatccgtttcataacaactgatactaaacggtgaatgcttcactatagccaatgtaatagctaattcatacaatagtatagcccactactagctctatatcttctatagctaatgtaatagccaattcatacaatagttacttactgtactagtaatacctggtcctacatgtcatacacacattatgtcttgaagtccgtgcgtccgatttcgattattatttgcatttattaatttgaggaattagctctagattaaattgaacaatttcttcggacgatttattttacaaattttaaagctggaaaggggaacttcagggcgtgacacccgctgctcttctctctcttcctttatctctttaaaatatgtttatagctggcttatagcctgctattgtacctgctcttaaactttaaccactcatctttcttcttaaataattatgaacgctagaaatgatgttatggtattaaaatgggttatttcctaaatatacacataaaaaaaagtccatttcgatccaacaatatataggtaattaattgatggttaaagtttaaatgagaaagtcgaaattatcagttgctaaaacttggaagggggagtatgttttggacgtctaaaacttgctggcggtcatgaatgaattcagcccactattttctcgtcaatgaattcggtccactgactgattccaatgaattcggcttggttagttcatgtcagcaatttgggcccagaagtgaattcagcccacaaacatcccatcaacaaagtcagcccaataaaggctaaaatgaattcggcccacttaaattcccataacaaattcagcctacaaaagaaattggcccagctactgcgtatgaacgaattaggcccatgaatattattggcccaactttaattccaatctacgaactgggccaagaataaatatggcccacctaattgcagtcgacaatttggcccaccaatgaatttggtccactgaattctcgtcagcaaatgcagcccacgagggaatttggaccacaaaattcccgtcaccaaattcagcccactggaaaatttggtccacctgtctcgtcaacagatttcatcgcccgcggccaccggcggccggcgaacgcctccgtcgcggccggcgcaggctggggaattccaccggcgggttcgcccatggcctcccctcgcgaaccgagatccgggagcgctgcaccgccgaaagggaagaaggcggcggcggcgatggcggcgcctcccaattcaccgattgggtggtggcgcgaggtgagagcgcgcttgtggctgcacacggtgnaagtatgtcccccagaccaatggcttgtttggcgccgctcggctccgccgtgccgccgccaccgccctcgttttgcagagccggctggcccgccctggtaacgctttttcttaatcttagggtanagtctccgtagagtttttaaatgtcgcacatcggtgaagtcaatcatgtgttgtcctaagggaatgattagtggattagtggattattgagagggaatgaactaataggagttgagcgggtttgatgttattattaacatttttttttcttgtcagtggatggatgtaggaatttaacagggatggaaaatataagggattgatacaccatcatttcaataccattttttttcttgtctgttgatggatgtaggaattcaacagggatggaaatataagggatcaacaccatcatttcaatacaggagagaaatcctttttttttaaagcagagagatgagtagatcttagctccttatgatactacatccaagctaatttttttataaccaaccagatattttatattgtagttgcttggtaaaacgcaatcagcattacacacagagctaggattggtaatagaagatagactttaatcccacaccaacactttcatctaaactcctccccttcctcaagactctaagtggcaaaacagtctgtatattattttcttggcatctcatacggaacaatttgttagtaaaactttctccacagaccgactgccactgcctgctttgatgcatcggaagccaaaccgctggaatttcacggtgattccacctattctgctaggtggagtgtacctacctccgctctccagctgttataagatttggttggtcgtctctttggtcaacccggctaataaagccctccagctgttgtttgtgtgagaacgtgggatgcatacaagatacggagtaattctttactcaaagttgaaaaaacctctccttttttctttgtttgaagaggtggaagtcaactttcttgcacatccatttgtggtttactcccatttccctctgtttgaatctggctctcctcctagtttctctctgaaagcagccttgcatttgatcagcaagaagaaagatcaagggcctcttcttctaggagtgagctgcagttctgatcttactactagtcaggtaaacaatatttcaataatcactagctggcagttgtcctattctgttttctgactgcatcattgaagaatgaagacaatatttactcttactcgtgtatccaatttttgccgttaaagttgcaaatttgtgtttgaggcccatatttcggtcttcttatacatggcctgatagagtttaagagtagagtagcccatattgactgcatctttgagcaataatttcttattttggttagttctaattattttcaatgtttattaggtgaatggattattgagtttcaagctgtatggtcatttgaagaaaacagtatattttgaaaaaaagggaaataggtttgtacattgaccaacatggctacactaccaatagccaccggcattgggtgggtagtttgtcctatcatcaagcttatctttgagaaggtccaatcttatacatcaacccagtacaagtggcaatctgacttggaggatgatctaaaaaagatcgaatccactttgataaaaatccaattggtgctgggtgctgctgaaaggtcgcaaatgctagattgcaaccaagaagctctactttgccaaaatgaaagattctgcctatgatgccgacgacgtcatggatgaatttgattacctgattctgaaggcaaatgctcagcagaagagcaagctaagtagcttggcctccagttctcttgccataggaaagcgtttggttggccaagacaagttcagatccaagttaaggagggtcctcaatagcctgattagagtaaaagaatgtgctgacatgctcatcaaagtgattggggctgaaaactctaattcatatatgcctcctcagccacttcaatggcgtgtcaccagctcaatttctcctggccaaattatcattggccgacaaaatgagcaggatgatctagtgcaccgacttctgagagaagctgatggaccagagccaagcagaggactaacaatatcaccaacaccatctataattaccatagttggcagtggtggcattgggaaaactgcattagctcagcttatttacaatgacagaagaatagtcagtggttttgatctgaggacatggatatatgtttcaaatatcttcaataaggtcaaaatcaccaaagagattttgaaatcaattgatagaaacagtgatataacaaatttcagttttaacatgctccaggaagatcttaagaacaagttaacagcaaagaagtttctacttgtgctagatgatgtgtggtatgatgaaaagattggtgagcttacaaatgctgatagatggagagaattgtttgctcctctatgctatggagctaaaggaagcaaaattcttgttactgctcgaacaaatattgtttcaaggattttgggttgcccagcaccattccatttggagggtctgaagggtgaagatagttggaacctcttcaggatctgcgcatttggcgctgaagatccaggaaattatccagaactagagtctatcggtgaatgtattgtccaaaagttgaatggctcagcattagtcataaaggttgttggtgcacatttgaatgctaacctcaacgttgaagagtggacacgagttatgaaaagtagttcatcaaacaaggaagacattatgcaaattttgcgtctgagctatgaatgcttgccaggtcacctccagcaatgttttactttttgcagcctgttccccaaaggctattctcttgagcctgacttgttggtgaatatgtggatagcccataaatttgttcatggtcatataggcacatatgaaagtatgagagaaactggtagaagttatttcaatgaactattatctagatcattttttcaggaacttcagtatggccatacaatacgttatgttatgcatgacctcatgaatgaccttgcttctcacatttccagaggtgagtactccagaatagaaagagatggtaatcttgcagaaatttcaggaacaactcggcatctgtctatacctgtcgaaagagtaaatgaactccatggattccataacttgcaaaggctgcgcacgctaatagtttctgaacgaaggcaggtctctttgctcaaaactttgtctgcaggcggatgtttttaaggaattcaagtgcataagagtattggatttaagtggctgttgcttagaatttctgcctacatatattgatcatttgatacatctcagatttctttatctccaacatgttggataagtctttgtgatccttggttgtgattcttctttttgcttttggatagtttcacctttttcaggacagcatctaccctttagcatatttttcaggtgctaggacagctgcggttagtaggacagcaacagttagcatcttctttatgcctcctttatgctttattcagtttggatgccctctaggacagcatcccattcaaatttcgaattttagactaggagggtgtagcaataggctagcagccagctctggctatatatatgtatccaacctccctcgggtaggtatggcttttgtgtttttgtgaatgaagaaaaccagaaaattgccccatctcgagtgccatcctcttctcaatgagagtaaccattgaaattctaacatctggtatcagagccacactttcctgtaggctaaacatctcttgttccaccccttcccaagctcggttgagctctcagccagcagcagcagcactggttgctcctccttcccctttcccttccccctctccacgcagcagccccccggaggtgcgccatgtccgacgctcggtctcggcgtttggtcgcctcgagcacttggcgtcagcaggacgccgagctcgccgcagcagaagagcgcaggcgagcaacggctcagaccgctgcagcagcagcagcgagggtggccaaactggcggcagtggagttggcagcagccagggcggaggcggaggcggaggcggcggaagatgcggcacgtgcggcggaggtagaggttgagaccttgcgcagcagcatcaacggctccatcgccggcgacatcaccgccgacagggagcttgaggagttggcaagaggaagggcatgggagcgggcagagcggtgggcagcagcccacctccacggcggcggcggcggcccaagggaccgcgcgcccgccgacgggaacccagacgggcgctggcgtgccggcggcagcccggagcccgcacgcggccctcgcaggcagcgcggctctctctcccctgactggcgccatggtcaccacggcgtccagacggtggtcagggactttggtcccggcggtgggtggcctaccctcaccaaaaccaactacatcgagtgggccgcggtgatgagggtgaggctccaggtgcggcacatgtgggaggcagtccggtacgggcgacgtcgactacgacgaggatcggcgggcactggatgccctcatcgctgcagtcccgcccgagatgcagttctcgctttcccagaagcggactgccaaggaggcctgggacgccatcgctgcggcacgcatcggcagcgaccgcgcccgcaagtccacactgcaggcactccgcaaggagtgggagaacctgcccttcaagccaggtgaggatgttgatgactttgctctccgtctcaacactctcttgcagaaaatggtgcagtacggcgacgacacctacgacgaggagagagctgtcgagaagctcttccgctgtgtccctgagaagtacaggcagatcgctcgctcgatcgaatctctgctggacctctccacgatgtcgatcgaggaggcgttaggtcgcctcaaggtcgtcgatggtgatgagccacagcctctctcggggcccatcaccatcggcgggaagctcaatctcactcgggagcagtgggaggcctctcagggtgacgggaggaagggggagtcatcttccccgacaggcggccgtaagccgcgcaaggcgcggggaggtgtccagctacggtgggcgcgaagacgtgccgagggtggcgcccgcagaggcgcccagggcgttgccaccggcaaccacaagccggcacgagacaacgcctgccgcaactgtggcaagcttggccattgggccaaagactgtcgacagccacgacgtggccaggcccacgtcgcacgggtggaggaggaagagccggctctgctcctggctcatgcaagcatcgagctacctccagcggcaccggccgcagcggctttcctccaccttgatgagccgaaggtactcgtctccctctgcaacggctccagcaacgacaaggctgatgggtggtacctcgacaccggcgccacccatcacatgaccggctgacgggagttcttcaccgagttcgactccagcgtccaaggctccgtcaagttcggggacgcctccggcgtggagatcaagggtgttggctccgtcaccttcactgccaagtccggtgagcacaggctgctcaccggagtctactacatccccgcgttgaggaattctatcatcagcgtgggacagctggatgagaacggctcacgcgtgttggtcgaggacggactcatgaggatttgggatcgccgtcgtcgccttcttgccaaggtaaccagaggcactaatcaactctacatcctcagcgcgcaggtcgcacaaccagtttgcctcgccgctcgtcgggacgacgaggcgtggcagtggcacgagcgcttcgggcacctccacttcgaggccctgaagcagctcagtgctaaggagatggtgcgaggcatgccgtgcctggaccacgtggagcagctctgcgacgtttgcgtggtgacgaagcagcggcggctcccctttccccagcagacgagcttccgagccaaggagcggctcgagctcgtgcacggggacttgtgtggcccagtgacagcggccacaccaggaggacgacgttacttcctgctgctcgtcgacgacctctcccgttacatgtgggtgatggtcctcggcagcaagggagaggctgcggacgccatcaggcatgcgcaagctactgcagaggcggagtgcgaccgcaagctgcgcgtgctgcgcaccgacaacggcggcaaattcagttcgcgtcgtactgcgctgatgagggcattcagcgccactacaccacgccgtacagcccgcagtagaacggcgtcgtcgagcggcgcaaccagacggttgtggggatggctcgggccctcctcaagcagagggggatgccggccatcttttggggggaggcggtggtgacggccgcctacatcctcaaccgctcgcctaccaaggccctcgatggcaggacaccgtacgaggcttggcatgggcgcaagccggcggtctcccacctatgggtcttcggctgcctcgcgttcgccaaggagcttggccacatcggcaagctcgacgacaggagcaccccaggggtgttcatcggctacgcggagggctcgaaggcctaccgcatcctcgacctggagacacagcgtgtgcgcactgcgcgcgacgttgtgttcgacgaagggcgagggtgggtatgggacaaggcggtggacgatggttcgactccgatgtacgacgacttcaccgtcgagtacgtccacttcgagggagctgggggagtaggcagctcttcttcatcgagcgtgtctaccccagcccccgaatctccaccgactccgacaccaacacaccctcgggccacgacttcgactacgacgagctcttcgtcgacaccaccccagccagtgactccacatgctccagcaccaacagtcactcctccaagcacgtctacttcgacgccagctcgtgttgagcgcagcccggtggagttcgctactccgctctcccacgacggggagcgcatcgcataccacgacggtgagcagctacggtaccgtacgatggaggatcttctcggcgaccagccggtgccgggactggtgcctcgcgacctagaggcgcagttgcaccttgcgtgcgacgacggtgagcctcggtcttttgcagaggccgagaaacacgcggcatggcgtgccgcgatgcagtcggagatggacgcggttcaggagaaccgcacctgggagcttgctgacctccctcgtggtcaccgcgcgatcacccttaagtgggtgttcaagctgaagagggatgaagccggagccatcgtcaagcacaaggctcgcttggtggcacgcggtttcgtgcagcaggaggggatcgactacgacgatgccttcgctcccgtggcacggatggagtccgtgcgactccttcatgcgctggctgctcaggaaggctggggcgtccatcacatggacgtcaagtcggcgtttctgaacggcgacttgaaggaggaggtctacgtgcaccagccgccgggatttgtgatccccggcaaggagggcaaggtgctacgcctgcacaaggccctctacggcttgcggcaggcaccgagggcgtggaatgccaagttggattccacgctcaaggggatgggcttcgagcaaagcccacacgaggcggccatctaccggcggggcaatggaggaaatgccttgctggtgggtgtctacgtcgacgacttggtgatcaccggcaccaaggatgcggaggtcgcggcgttcaaggaggagatgaaggccaccttctagatgagtgatctggggcctctctccttctacctggggatcgaagtgcaccaggacgactccgggatcacgcttcgacagaccgcctacgccaagcgcgtcgttgagctggctgggctcaccgattgcaacccagctctcactccgatggaggagagactgaagctgagccgcgacagcacggcggaggaggtggatgctacacagtaccggcgtcttgtggggagccttcgctacctcacccacacacggccggacttggccttctccgtcggctacgtcagtcggttcatgcagcgaccgacgacggagcaccagcaggctgtgaagaggatcatccgctacgttgcggggactctcgaccacggtctctactacccaaggtgtcctggcaaggcacacttcgtcgggtacagcgacagcgaccacgccggcgacatcgacaccagcaagagcacgagcgggattctcttcttcctcggcaagtgctcgttagctggcagtcggtcaagcagcaggtggtggccctgtccagctgcgaggccgagtacatggcggcctccgccgcttcgacccaggcgctctggcttgctcgactgcttagtgatctcctcggcagagacactggaacggtggagctcagggtggatagcaagtccgctctggccctgacaaagaaccccgtttttcacgaacggagcaagcacatccgggtgaggtaccacttcatccgaagctacttggaagaagggagcatcaaggcgagctacatcaacaccaaggaccagcttgcggacttgctcaccaagcctcttgggaggatcaagttcctcgagctctgctccaggatcgggatggcccaacttccccacaagacgacgcacaagacttagggggagaatgttggataagtctttgtgatccttggtcgtgattcttctttttgcttttgggtagtttcacctttttcaggacagcatctaccctttagcatatttttcagttgctaggacagctgcggttagtaggacagcagcagttagcatctcctttatgcctcctttatgctttattcagtttggatgccttctaggacaacatcccattcaaattttgaattttagactaggagggtgcagcaataggctagcagccagctatggctatatatatgtatccaacctccctcgggtaggtatggcttttgtgtttttgtgaatgaagaaaaccagaaaattgccccatctcgagtgccatcctcttctcaatgagagtaaccattgaaattctaacacaacatacgcaaaactcgcttccaaattcactctgtaaacttcaccatttacttgtgttgtccatacgctggcattcatgtttcatggacaggcgacttgttacttttcctaagtgcttgggcaccttgagcagcattttgtgtattgatgttcatcgtatgtgcactgttgatttagctgccagcagccatatgccatgtcttcgagcggctggggaattctgtgttgataagagtaaagtgcagggactagaggtgctgaagcagatgaatgaacttcaggggtcgcttgctattacatctcttgagaatgtgaaaagcagggatgaggcaactgatgctcaactattcagaaagagtcaaatctttaaactgaaactgcaatggggttcttctaatgcttctagcaagtctgacaaagcgaatgatgtgttcgatgctttaagacctcactcgggccttgaggaattgattgttcagggatatccagggtgtgtgtccccatcttggttggagtcagagtggctctctagactgagacacattagcatttctgattgcaagtgttggaagttgcttccatctttaggccaaatacaatctctcaggacacttcgtattgctagactgaatgcagtggtttgtataggccccgagttttatgggactgctggctttccctcactggagattctggaaatgatagagttgccagaattggcagaatggtcttctgtggactgtttttttcctgctcttcttgaggtgtgcatcagaggatgccccaagctgaaacaattgccaccagttgttctcccacctgtaagaatgagtatatatgtatctaccgaagtttgcaggctgcgaaatcataatcgcctggagacatgttttactcaggaggtgagcttaagcacactcttggatatgttgcatcttcgtcgtctggaacctgtgaaatgtgtaaatatcatctttgaaggagcaaacactctggaagatggacttaaagatgtaacaacaaatctgccatcccttgaagagttggttatcaggggatgttctgatctgcagcatgcttttgcagctagtaaacagcgggaagaggatgggaatgtcttttcttcggcatctattcaatgtctcaaaatgattggctgcaacctgacagtggacatttttcttagtgtgtttcagaacattagtttcctttcattgtggataaacgattgcaacatcacttattcaactcctgaacgtgtgttggccatgccaaagtcagtgactggagtacttgagaagctgtgtattttaagctgtgatgggttgacagctttcatgggcctagaaacattcttaaggttaagcacaatagaaattgcaagttgccccaagttaacgtcagtgccagactttaggtgtcttccagccctccagaacttgatcataaagaattgccctgagctcaaggaactacctgaaaatggtaacctaacaacattaactgcactggttgtggaacactgcaacgcgctaatatcactgaggaacctgcgagacctttctttcctctcaaaactggtggtcagaaattgtatgaagttaatggctttgcctcagatgattagtttctcttccctcagagtcttgatcataaaaaactgccctgaagtagtttctttaccagaagatggtcttcctgtgtcccttaattgtttgtatttggctggatgccatccagtgctggaggaacagtttgaccagaaaaatggtagtgaatgggagaagtatgaagtgttgccgttttgtttctttgctgataaatcaatagaagatatcgaaggtaaacatctcccatcctcggattgctgtctgtgaaattcaggcacataatatttgaattttgatgatgatgaatctacaatttctttgttgcaaaaataaaacgtcaattgactgactcctattgattccaatctactgcagagatagccaaagaagtacttatggcggatgatcttaccaggatttccattcagggcaatcgagttcatgcaactgattctgcagcaagctcgtccagtttcccttagtaagctctccgagggtaatatgagctgttgtgatatgttgatcattttgcatcatggccctacctgcgcaactgtgcaactgctgaaattcatgtgcttgtatatttgttccattttaaaccggactcgtttttcctaaaagacaggaaatcgaacatcgtattaccaatttatcatgctggtgcatttacggatgttaacacattggatgcaccacacactgttcaaccgaataatgattgtgcaactcattaaagttagtcacggttattcctcatcaaggaaattattttttattcttgaaggataacttgattgtgattctggaagaacacattggatgcaccacacacgttgcaacttatgctttattagtatcagttgatgtaacagccctatagaaccgcgtagcctagcccaaccgacgggtgggcccaattacacataccatttcacacttacattttcgtcctcgcttcgtgtaaaagggttaacccgagagtggcatggttgaagagacaaggcttataagttggtttcacctttactaaattagcaatgtgttaataaacatacgcacacagctctcatgggccacacatgccgcatcttaattggaccagaatgtcacgtacacctccctcaaaggacttatgtcctgtcggtccaactcaccacatagccacacaagcatataggcaaatgtacaggaacacgctccctcttagcattggaccaactcacccacataaccaccaagaagataggcaaatgtccagaaacatgccccctcttagcactggaccaactcacccacataaccacacatgcaaatgtccagaaacatgccccctcttagcactggaccaactcaccacatagccacacatgcataatgtccagaaacatgccccctcttaggaacacatgcatacatctcacccacatagccacacatgcatataaactcacccacatagccacacatgcatataaactcacccacgtagccacacatgcatataggcaaatatccagcaacacgccccctcttagcacacgtccaatgctggtgctatatgtcatgccatgtgtctcacatagaagccacatgcgccatgcaccataacacactaacccgcgcaaccgcgagggtcggctctgataccatttgtaatagccctatctccagaaccgcatagcccagcccaaccgacaggctggtctacttacacataccactccacttacacattcgtcctcacttcgtgtaaaagggttaacctggaagtggcatagttagagggacaaggccttataagttgtttcaccttgctaaactagtaaggtggtaataaacatgcgtacacagcttttatgggccacgccgcatctaattgggttaggatgtcacggttgattggttggtctcctagcggttgtatcataatttctccataaattggtcatgtgctgtcattttttttctgtacgattgatttaagtttttgtgcatgtagttactcaaagtcataatgaacgtctgatccatctcttgcaaattacaagggcgttatgatcaacgcgataagttttcccccctgcagatatgcagaattcttatggtttaattgcacggtgatactgagataaataccatagcagacgtagttttgcacttttgctcatgtttatccatatagcttatcaaaaacttaataatactgaatttctgagtaaaacttttatatatatgccatgattaaaaattcaaaagttaatgtagtaaaataaactatgattaaaaatcataaaattaactcatgagatttaaaatttggcttataggtataggcacaattaaaatgatgctcattaaacccagtgtaacagtgcaatatggcaggatcagttatccatgaaggcttaatagttctttgagcactcttgccccagaaacaggagaccatctgttcgtggcatgtcattttactaagcaagtaaaacgagaatctgctaacaacttttcctctagcgtcgtctcctctcgggcggcacgggaggtgcccaggccgccgtcgcccgccctccctccctcctcctctgcctccgccgcccgaccggccgccagtaaagccgcgcagcggcaaggacagcggcggcggggcttcgcttcgtctcgccgcacaagggcagggggaggtctgccggcatcgggaggcagaaaccgcccagatctgcgtcggccagccggagttcgcggggagttaagccggcggtggggcagtgtgctcgggcgcggcctttggcggggatggcggcggagctttggaggcgctggcggcggtggaagaggccgccagatccggcgcggatctggcggggaggtttccggcggcccccggtgggggtccggcgccggcggaggaggtcggcgtcctcagggcgatagcgacgacggtgccggtgccacggcggccggaactggcggcggtggagccggacgacgactgccgaggaggcggccggatccggcggcgacgggcgtgacggcgcggagacgctggagaaggaggtgcggtggctgcgacgacggtcgaggggtggccgggtttggtggtcggctggcgacagcagcagcggcggcgtcggctggcgacgacggcggagggcatggaggcggcatcggggcgttgctggctccttggtggcggagagcgacggtgcagcagcggtctgcggaggcgatgactggtgccggtggcagcggcgacggcggccgtgactgtggaggcggtggtgacgtcggcggcggggaaggagtcgggtgcgagtggctgggcgttcgacaacagtggctgtggtggtggtgactgcgactgcggtcaccggaggcatgacagtctcggacggctagccgagggcgtgggagacggctgcttctggcaggcgcggcatcgttcggtggaggggtcggagaccggcttggcgcagagagtcgcagtcgatggtagcggaggccggctcggcgcgagaggcgcgggcagcggagatggaggctggcttggcgcgagaggcgtggccggcagtggaggaggcgacctaggtgtgaggaggagttgccggtggatgtggcgtggtcttcgacgcatgaaagatggccggcgggggatgccggtgtaggggtcccacatgtcggcaaagcttatgtggtggtggagcatcggtgcgtcagccgtagatttgcagccggtgagcggcgggtgaaaacccagtccggccttggctggaccgacaacgatcctcttgagggcgttgtcgtgctgtctcacccctcaagggtgatagccgggcgaaagcccagtcttgattgagtcccgacggacggcggcggcggtttttccgtcgcttctcttcttgcagacatcgttttggcattccttagggggcgatctcgtctgtgtccctttgttggtctagtggcggtcggtcacgcttagcggtggccgctccggtgctagccttctcctgggcttgtgtgttggcgatgtcggtgtgtgggtggtggtattcttttttctttttcctggttacgatcctacagggttgtaatctcgtttttttttcctgctctatcaatataacttcgcaccgtctcgcgcgagccgttaaaaaaaaatttactaagcaagtttggacctttgaggggtcttccaccgagggtatgccaccttctcaaccacctgatgccatcgatcttgcatcttgaggcctgtttagtttgcaaaaagaaaattttggggtgtcacatctgatgtttgactgagggtataccaccttctcaaccacctgatgccattgatcttgcatcttgaggcctgtttagttcgcgaaaagaaaattttaggttgccatatcggatgtttgactgtatgtcggaagaggtttttggacacgaatgaaaaaactaatttcatagcttgcctggaaatcgtgagacgaatcttttgagcctaattaattcgtcattagcacatgtgggttactgtagcacttatagctaatcattggctaattaggctcaaaagattcgtcttgcgattttcatgtaaactgtgcaattagtttttttgtttaatctatatttaatgctatatacatgtgtccaaagattcgatgcgatggttttgggaaaaaatttggggaactaaaccatgccttggtggctggatgcacgtgcagggcttgacaagctgggcaagaaggcgtttgatgcggccttttccctgttttgatggatgatctggaaggaatgcaatgcgcgagtgatgctccgccctttggtctatgtttttttggcttgtgattgtgctccatagtatcttagcaccttgatactaagattttcttttcatcaactgtgttgttgttcacagcaaccaaatttctctttaatcttaataaattttggccggtttctctttgcggacccgacaaaattttttttaataaattggattaatttgatcgtaccattgtaaatgtgccaattcctataaatatcattacaattcgtctattcgtaaccgcatcactcaaattttacaaagtcggaaccatgccttcgctgtcacattttgcatcttcttcctcatctacacgtggggcccatctgttagattcatcttctttctccatcattccctcttctcttggggcatgtggggcgcactcagaacgccacgggggcgtgaccgtcccggcatagctcccgcgtcgacgacagcgaggcggagcgatggggacgacatggaaggatcgcgaggcgtgcacaatttcgcttcggatttctgttgcaccggagcgcgctgcccaccgatgggtggtgatgttgttgcgagccgtgggaagatgatagattggtggagaggaggctaagaaggagagagatgggaaaaaagagaagaggcggggatggaggaagaagatgaatctgacaggtggtcccacctacgaatggggaagaggaggaaaacatgacgacgatggcatcattctaattttataaaattttagtgccacaactacgaatagatgaattgtaacattttaatatatgacgacgttgacgactattcgtcttattaaaaaaatttatataataataatttattttattgtgacttgatctatcatcaaatattatttaaacatgacataaatatttttatatctaaaatggtccaacgttaaagaaaaccaggggagggagtaacatttatcatctggatatacacatttgcagtggcaatggttcaaatagttaaatgcccgggttcatcgcctggcgctgcgccgccccggccaacggcggcgggcgaacgcctccgtcgcaactcgcaagccgggggatccgggagcgctgcgctgcccgacatggatacatggaacgggagctccggttcaccggctggccggcggcgaggggagcggccgcatcgatcctccgcttacgccggaagcaatgtcttgtgtggtgtcgctcggccgtggtaagggtttcgactgcaatcaatctctccacccgtattttaatgatctaatcaactgcgtagacagcttttcagggcccagcgaagcaaccactacattggcgtcgtcccgctgccatttacgaccagatcgggttcttcgccctggcggctagcgcacgggccatgaatttcggtgattttcaatcgctctccctgtctcataaaaaatacctaacctcatagtaaaatgagacgcatcctagtaccagtggcaaagccagaacaaattgaagggggtgcaccactcaactgtacatgtagtggcacgtagaattttcaagccatgatatataaaacgtacgatgaaatgtgattaaaaattcctacttaaaaatgtaaaatcaagggagccataataaaagagatactcagtattgcatcgaaccattaaataagggtgtgtttttgtgaggagaggaaagtagaagaaagcgtatgattaattaaatattaattattttaaacttggaaaatgaattaatatgatttttaaagtaacttttctatagaagatctttgcaaaaacacacggttggggaagtatgtgcgcaaaaaacaagggatttttctccatgcttcaaaccaacgcactctaaaactggtggagtatgaatactagatattagaatgtgataaaattcaaaagtcagggagctagtgccataacttctcaaattgaaattttagtacttaattaggatcaatatacaattactccactttcctaaatcccaacgtaaatcctaaactagtatgtagaaccattaaaataataactgaaattgaactctatatttaaactttaactctttaaggtttgaagtgaagaattcagataaattgaggaaatacgatgaggaagatctatgcccttgcctctatgtcattaacataagcacatacgggagatacacatgatcaataaaacgataaaacaaatgaacaaagcagtacgctgatgcagcaaattgggcaccaactgaacgcgtgcggccaagtgacctcgcggccgtgcgtccgtcgtcctgccgcgctttggccagccgtcggggggtgcacgtaagggagctgaggggggtgcacatgtggcaaaaacaggatatcaagcactgtacagccaatataacttcgcccctgcctagtacaacgaatttagacgtagagtatatctagatttattgtatgaggttggtttttttttttgggatagggagtatgcccccatctctgcactattcaattcgagtctattctcacttattaaattgttcacactccacactgcaaactaatcatgcgccattgtgaggattctccacctaacctcaacttggtctggttccgagttgcttagtgctattgctactagctagaaccagaacacgctctgcctttctcctgctggctgctgctctttggcctgcttcagccttcagcttctccatggttttctttttgtttgctccagcttctccatggttttttttgtttttgttctgagaggaaaaagggattttatatattgataaggtattattcttggtttctttcacttgatagcatgagttcagcatttgtaggctgtcaaatttttaaggatttctcaccatagtaaaacgattatattgaatttacttggtggatcttgatccgtatgtagctcctctttgcttcccaggcatatgagttatctatgtttcccttttgctgaaatacatatggagttaattttgcaaaaccatagatatttttgtcaaaactatagatttatgccgctgtattgcaaaaccacgtactccctccattctaaaatataatggatttttggagggatgtgacgcatcatagtattacaaatctagaacatagtattaccacgaatccggacagcctctctatccagattctagaactagaactaggatgtgtcacatccctccaaaatcgcttatatgggacatagggagtatttagcatatggagttccataattcttgacgtttggacaaaattgagggctatctataacttttaaaatatttagtttgaagaagctagaacatgatatagattattcttaaaagtattttaacaaaattaaatatttcataatttccctcctaggaaattttaggaactgaagtctacttaacaaaagacaactgcagctgagacacagagagtccgagatagctgcaacattagtactaatttttttggtgtctaggggtctactggtttaactaattaatggaatcaaggaataatgggaaattttatatagttccatctctgatagtaatcttacatgcatttgaataatgcggattttatttctgaattgttctattaaatgtactgactaatggacaccagtatgcctcacttcgacatgttttctttatgttcttatatttaattaattatcttatcaatgctaggtacatcagttgaaagctgtaaggagaaactgaagagccaagagacagtatattgagcaacatggccactttaccactagccactggagttggatgggtagtatctcctgtcatcaagcttatgtttgagaaggtccaatcatatatatcaactcagtacaagtggcagtccaatttggtggatgaccttaaaaagctggagactattttaactgaaattctcttggtagtaggcactgcagaaaggcggagaacacttgattgcaatcagcaagctttactccgccagctgaaagatgctgtctacgatgccgaggacatcatggatgaatttgattacatgtttctgaaagcgaatgctcaaaagagaaagctaagaagcttaggctccagttctatctctattgccaagcgtttggttggccatgacaagtttcggtccaaattgggaaagatgctcaaaagcttgagtacagtaaaggaatgtgcccatatgctcgtcagggtgatgggagtagaaaactttagttcacacatgttacctgagccccttcaatggcgtatctccagctcgatttcaattggtgagtttgtagttggtcgtcagaaggaacgggaagaactagtgcaccaattgctggaacaatctgacaaacctgaatctagaagcaaaggagcaaggtcaacatcattagaggtaattactatagtcggcaatggcggaattggaaaaactactttagctcaacttatttacaatgataaaagaatcgaggataattttgatatgagggcatgggtatgtgtatcacatgtctttgataaggtcagaatcaccaaagaaatcctaacaactattgataaaagcattgacctaacgaattttaattttagcatgctgcaagaagaactcaagaacaaaataaccatgaagaagtttctacttgtattggatgatgtttggtatgatgaaaaggttggggtacccataaatgctgatagatggagagaattgtttgctcctttatggcatggggcgaaagtaatcaagattttagttacaactcgaatgggtattgttgcaaatacattaggatgtgccactccattctgtttgagtggtctagagagtaaagatagctgggaacttttcagaagatgtgcatttagcactagagatccaaatgaacatctcgaattgaagtctataggtgaacacattgtgcaaaaattgaatggatcggcattagctataaaggctgttggtgggcatcttagttcaaacttcaactatgaagaatggaatcgagttctaaaaagtggtctatcgaatgagaaagatattatgacaattttacgcctaagctatgaatgcttgccagagcaccttcagcaatgcttttcgttctgtggtttgttcccaaaaggttattatttcgagcctgacatgttggttaacatgtggatagctcatgaatttattcaggatcgtggacgcacctatggaagcttgacaagcactgggaaaagttattttgatgagttgttatcaagatcatttttccaggcacttcgatatggaggtacagtgcattatgttatgcatgacctcatgaatgatcttgctgtccacgtgtccaatggtaagtgttacagagtagaagccaatgaacctcaagagatttttccagaagttcaacatctgtctatactggctgaaagagttgaccttcttcgtgcctgtaagttgcaaaggctgcgcaccctaataatttggaataaagaaagatgttattgctaacgagtttgtgtgggagtagattttttcaaagagttcaagagcttgagattattggatttgactggttgctgcttaagatatttgccggacttaaatcacatgatacaccttaggtgcttaattctcccaaatactaaccgtcctctacctgattcactctgcagtctttaccatttacaaatgttgtttctacaccggcattcatgttttatatgtgcaaaacatgtcatcttccccaaaaacctggataacctgagcaatattttgactattgatgttcatagggatcttactgttgatttggcttctgtggggcatatgccatacctccgggctgcaggggaattctgtgttgagaagaggaaagcgcaggggctagaggtgctgcatgacatgaatgaaaaaaaaaactagaatattagggaaggacctaatatcaaataattaggaggggtgaggctttgaacccaggtcgtctagcccaccaccttgtggagctagccggaagacccctgggcatttctcctgcatgacatgaatgaactccgagggtttcttatatttacatctctcgagaatgtgaaaaacaaggatgaagcaattgatgctcagttagtcaacaagagtcaaatatctaggttggacctacaatggagtttttctaatgcagatagccaatctgacaaagaatatgatgtgctcaatgctttaacacctcatccttgccttgaggaattgaatgttgaaggatactcaggctgtacatctccatgttggctggagtccaagtggctatctagattgcaacacatcagcattcatgattgcacatgttggaagttgcttccacctttaggtcagttaccatctctcagggaacttcatattgatggaatgaaatcattagagtgcatcggcacatctttctatggagatgctggctttccctccctgaaaacactagaattgacagaattgccagaattggcagattggtcttcaatcgattatgcttttcctgttcttcacgatgtactcatcagtaggtgtccaaagctgaaagaactgccaccagtctttcctccacctgtaaaaatggaagtgctcccatccaccatcgtttacacacagcatactgatcatcgcctggacacatgtattactcaaaaggaggttagcttaactagcctttcgggtatttttcacgtatgtcaccaggaatctgtggaaattgcagaaattagctttgacggagcagacatggtgaatgatgggcttagagatctaggccccaatcttccatcccaccaaggaccatttatctgctggtatgctgatttacaccgtgcgtttgcgagtttaacagaaatgaaaattgttggttgccccaacataacatcgttgttggacttcagatattttcctgtcctcaagaacttgatcatacaagattgccccgaattgaatgaactacaagaggatggacacctaacaaccttgacagaggttcttatagagcactgcaacaaactggtatcactgaggagcttgagaaacctttctttcctttccaaactggagatcagaaattgcctgaagttagtggctttgcctgagatgtttgacttcttctccctcagagtcatgatcatacacaaatgccctgaaattgtttctttaccggaagatggtcttcctctgacccttaaatttttgtatttgaatggatgccatccattgctagaggagcagtttgaatggcaacatggtgttgagtgggagaagtatgccatgttgccgtcatgtttgtttgctggtgaatcgataggatatggtcaaggtaattcacagcagcttgaattttgaaaaggataggtctagcaattatttgttgcaaaaatattaccacaatccactgatttgtgttagtgccaacctattgcagatatagctgaggaaatacttcgcgagaatgatataatccagcggtcaattcaatccagtctactgcatccaactgattcttcagcaagttcttccagttttcttcagtaaactatctgggctgtcctccgaagctgtaggcctgccggtgatcacctacagcttcatcacatctacctgtgtggctgtgctgacctggccaaaaaaaaaaaaattccacctgtgggttctattttaatcaagccaacttattatgaggcttgtgcattttcacatctaaacctattatttatgcattacagaacattcaccattcattgcttgcgttttatactttttctacaagatgcaatgttgccatctgctcaccaggagtatctttcttgtggagttattttttcccttttctttggaataatcagatatgtatcacacaatatgtatgctggcttttgagataaataccggagattgaaatgacattttgagatttgagcatatcacattaagttgagaaaactcggcagccttttttgcctgcatcatggtctttctaaccatactttctatgctactaatgtattatatatgatatactgctagtatgtgatcatgagggatccaagctgcatttatagaagtcgtagctagttcgcaacattcttactgtttgtcattcacagaagtcatttatatcatttacagaagttatactaggcttgtccgtgtagttgtagcctgtttattttgctgccatgttattagtagctttcagtatgaggatcagcaaaaagatgatggtccccccttgcaaaatacagtgatcactgatcaggttgatctcctgaatcctgggtaaggtcaattttgttgtctgcccggctttttttttttggttgtctgctcaattttcagggaaaatacctctcggctcgttaaaacacttgccaattctgatggtttttattgcacggcgtgatatatagctagatatatagcttttgctcgttaaacccgttataatggcaggatcagtcaacaggcaacccaatcctccatccgttaacatatacgagtatatgattcaagaaataggtaaggcagaagaaaatttaagaaacagctgagcaaatcaaccaagcagcaaccttttcgaactatatttgacgaagcgaatactttgccattttgccaactgacctatttctgccacctctttagtcgtaactacggtatggtcttctatgtttacataggggagatttgctctgaaccagtaaaaatatcttacggtaccaaatattcctctcaatatattcggcccacaaatgaacttggcccacctaatagccatcaaaggattcagcccaccactgataattcccgttaacaaattcagcctgcgagataatttggaccacctaataaccatgattgaatttggcccattactgaatttgcccccacttaattctcgtccataaatccagcctactaatctatttggcccatcagtttccagtaacgaatcaggcctactggattcagcccatctctttctcctcaacaaatttggcccacgtgttaaaaaaacaaaacggcccatatacagaagagagtgaactcatgggtgtattttttggcccacgagaacgtggccgacgtggccaccggcggcgggcgtacgcctccgccgcggccggcgcagaccgggcgaatactccggcgaggtcactggaggtccatggcctgccctcgtgagccgggatccggggggcgctgcaccgcctacgtggtgcgggtgctccggttcaccggcttggccgggcggccgctggcggcggggcgggcggccgtatcgatctacacgctttgtggcggaagcatggcttgtttggcgccgctccgccgatcgccgtggtagggtttcgaatgcaatcaattgctgcatcctttcccccattttctatatggatttcgagacaccacccgtattttaatgaattgcataatgtgcataggctttttcagggcccagctaagcaaaatcatacagctgcctttgaagactagatcggcgtcttcccgtgtggctggctgctggcgcgcttccgaccaaaccgcccagggattccgtgcatttgttatgtagaaaaatatatgtgagaggaagattgagattaatgggacaattgtggcttggtgatttagtgaccaatccaattctctaaagataagtaaagaccaaatcccatcaaattagaatcgatcataatctggtataatttatttattgaattagtgttcacatgacaaactaatcatgtgctgggggaagaaaatgacaactgtatggctcaccatttaaccccatcttgctttggccaatgcccaccactttgtcaatccccattgcttgcagtatcgctacagcttctttatggtttcttgttctggaagggaaaaaagaatttatgccataatactgatcaggtattattcttggtctctttcgcttgatagcaggagtttatgccataatattgatcaggtattcttcagagtttaaaggcttctaaatttcgaaggatttgttttttgaagcaggagcagtgctattcattagcttgacggaagtttatttacaaggaaaaacaaatcaactaagacatgtacttagaattgaagttcaacattgctacgctattgcttcctagaaggtttcaatttcttccttgatcatgaagcgctcatctaccatcttcagttgatgttcaacaattttcctatttgtctccttccattattccaaactgtgtatgttcctattgttattatcctccttctcctgctttatttttcctaccgtcagtgcattcccatgatgccagagtataaccataatttgttggatagagattaatgtccagccaaacagagatcttgggccaaagttgtttggagaatggccattgatgaagcaagtgttttgctttttcctgtacttgatcacataattgaaaaatatcatcattcagaaatcatcttgcttgtagtttgtgagctgttaatattttctcctgcaatagtagccacatgaagaacataaggttttgttatgtttccaacctccagatactagctaggcatgtttgctgaacagcgcaacaaattgtactctataatctgatctagcactgtggattccagaatggcagaatgatgtccatttccaggttatggagtttggatggtcattagaacttatattttgcaattttatccacaagtagaagattgccaggaagttaacatttttacttctatgcaatcctctcatccttttgttgcctgtaaaatttcgaaggatttctcagcataataaaactcacaaaatcgaaattttcgaaggatttttcaggacatatgaattatctatgagtgtgctggattgaagttggtatccccagcagttcatgttgtgcccatgcttttgttttgtttgggctgtataagactctctatttgttccttttggctttctccaaaaaaccgggtaattaaaattacctgttatctaaaataagtatgatttatctatgctttacttggtcgaagtatatatgttgaacctaattctgtcttttgattactcaaatagattttgtgaactataaggaacttgtgaacctgtgtggttttgcataatcaatatgattgcccttctgtctggactgtttcacggggagaggattatttatgtctcagtaacagttgctgacaattgaatttgttggtcccaatcatagtttagtatctttgttctgaaacacctaaatcaggcttacacaagcttttatattttacacattgggctcctaggttgtttcatcctctctagaaattaagcttctgaaaattctttgcatactgtgttttcggctattttggtccccatagttataacaattcattatttatgatatcatgcagggaatttctgattacatggctgagttttcagcaatgagttctgtaggatggattgtttcacctatcattcgtaaaatggtttctgtggtgcagtcctatatatcaagccagttcacctggaagtctgagatgatgtctgatctcaagaatttggagtccactttggtacagattttgttggtggttggcgcagcggaaagacgaagtagaaaagacagtagtcaagtgatgtcattgcaccaaatgaaagatgcagtctgtgaagctgatgatgtcttggatgagtttgactatctgatcaaagaaaagattgaagacctaggcatgttctcatctgttctctctattggcaagcgtttagttagcattgataagctcagatcaaaattacaagaagttataaaaacactgggcagagttagagcttccgcagagatgtttgctcaagttatggcaggggaggtctctagcttcagtcagtctcctgagtatgctccagcaagagccacaggatctcttttgcgtgaagatacaatttttggacggaagaatgagattgatgaactagtaagtatattggtgaaggattgtgatgaacatttgtcttatgattgtcagttatttaatacagtggtgcattctattgttggtgttgggggcatcggcaagactacactagcacaagctatttacaatgatgagcggattactgagatttttgatctgaagatatgggtttgtgtctcccataattttgacaaaactagactaactaaggagatcatagcatgcacagctggcacagaacatattgaattggccagtttcaatttcagtatgctccaagaaaagcttcgagatagactgatgtgcaaaaggtttcttctagtgctggatgatgtgtggtatgatgaaagagttggagagcacatgaacagagaaacgtggaaggagttgatagctcccataagaaatatatatataagttctgaggctttagagagaaagagaacaggaagcaaaatactagtgacaacccgggcagaattggtagcaaaaatgctagattcgagaagcttatttttcttgcagggccttggaaaagatgacagcagaatgctcttccggaaatgtgcatttggaaacaggaatccagaagattacccagagttgaagataattgaggaccaaattgttgaaaacctaaaaggctcagctctagccattaaggtgactggaggccatttaagtggcaaatacaacgctctggaatggaacaaaattcttcagaaaagtgtactcaaccctaatgacattatgacaatcttacgctcaagttatgaaagcttaccaaattatcttcagcagtgttttacgtactgcagttattccctaaaggttaccgcattgatccaaacaggctgatccatatgtgggcagctcagggttttgttcattcagacagaaatatcaatactagtctggaggatattggcagaggctatttcaatgatttgctacagcgctcatttttccaagtgttccgatgtggagaccaaatttactatattatgcatgatgtattgaatgatctggcacttcatggggctgcaggaat

SEQ ID NO: 73843 - DNA, 1020 bp, Oryza sativa
tgctcaatcagagatagaggccaataataacacactgccatcttgacatttatactctttttcgtcatcattttctaaaattaaattgttgtcactcttttttgatctcttgccaacttactggggatgcaagaaaatgcagattttgtatggaaatctaggccaatggaggcactttaacctactacctccattccaaaataagttaagctagtacgggaagtgacatatcctagtagttatatcgcactactgtgaatctggataggatatatcatattccgtactagattaacttattctgagacgaaggtaatatatttcattttgcatttctgaaaagcaacacggccatattttaccaaaatttaatcacagatgggaaacggagatgactggaaacccaaaataatttcaactttctttgtgtgatgaacaattggcatatgagattattggttttcatatttagagattattggtgaagtggttttgaagatgattggattttcaggtgatgaataggtgctgctgattgtcaggtccggtcagactgggcaagtgctgccggtcagaccggaggtatgtgaatggtcggaccggcctgcccacggtttgtccggcggactctgtatcagtttcggttttggtttcgggctgtttctttggatatccgtggatagttcatgtttatagcttctatatggatactatgagtatgtaatactgttgtttgctaacaatgagtcaagttagagatagcttggtctcagaatatggtttctttgtttgattcatgtgtaggtgacttgatgcctcaggagagtattgccggtgatggatcgggagtcaacttggagataaggtgacgtccggatggtcaaatatcatgcggaatacttaggctaaagatcaatgcacatggttggtgaagattccatatgacatacgatggagatattgtgtgcgttgcggagtcaaatttggaaggagtctaaatttggtacaattggagtttgt

SEQ ID NO: 73844 - DNA, 4788 bp, Oryza sativa
tgaccgatggatccaaatgaccctaaaatcatgaaacaaacctagtcgatgcttcaactcttggattattaccccatacatcgatctattggcgttctcaccagtcaccattttctgaagctttcagactgtcgttacaaggattaattttgaaacacctaattgtaaattttgtttgcggctcaagagccaacaagcagattctcagttaagatggtagaactactcaactacagacaaaaaaaaaagtcaaataagtcagtgctatgtttcatattttaagctaaacccttagccatcaacatctggtgttgaacttgaatttaattgtttgcaaccggtacgatcaacagccattcgcatcattatctaaaacaaatgatcatcaggcattgcatatgttgagtatgaaaactttcttgctactgaaaaattaacgcagaatacttccaagaaagggtaagaaaatattaacatataacaaaatctaaaaaataatattactacctccatctcaaaatatagtaatcttatactagatgcaatggaatctactttcctccgtttcacaatgtaagtcatcctcacttacattgtgaaacaaagtgagtatctagattggaagtcctaacatgtattacattggtcctaaaagtgatatattttaggatggaggagtaacatgcattattaaagcagctcatcaatgccactctggttcttgttagagcatgtagcccagctcacacaagtagtccaacttgtcacattagatccgctccaccatatatctaatcggaaccataactttaggtttcgagactacacatcccaaaagacgttatatatagtcgcctcgcgttgtccatggatatacttcatctatcattgaaagtgttggcaccttttttggcaagaagacaattatgatcgggacacctaaacatgttgtggtgatatggagtcacaaccacctcgatctagaccaagaagggtttttttaaaactaaaccggctagcggagccggtttagagatcaaaatcagcctctaggtcgatttagattgagatggacgaactattaaaactaaacccatctcgtgggtgaattggaaagtttaaagaacaaacctacaaagggcatcacactctcacagcgaaggcggacaatttatggcgcaaatcaacaaatatggatgaactattactaggtagaagataaagtagaaagcatggctaaaaagcaaagataaaagaacgattcaatagattatagggattgtggtctatggttagaatcgaaccagccatagcccttataaaggggtcgctcttgccatctacggaccctttccatgtcttacttggggtagagaccaattagaactcaagaaataccttccgaagcaaggaaacctgagacccgacaaaattggactcggcgtcagactgagccagtctgaccggcccaacaccccggccttatgacggcggttagaccggccccgtgaaggataccggatcatttccaaattcgtccatattttcctatttttgttctaggtgccaaatttgggtgttaacacatgccccctacctttttggcgaacttgcgagccgaaaagcatacaacacatggtcttagggtgacaatctatattggccataagggcttccaagtgcctagtagatctttctctttagagcactgctcccgtcctgcattttgtaccgcatggtacatgtaccatgtggaaccaaaacccatccagccgttgattttgcaagggtaggattggaacaggcaaagaagcgaggcaccgctccatcctttgattttgcgcgacttctcccccaaatcagacacgagacccgcctaccagacatcgtaaaccctagccgccgaacaaatgtccgccttctgaatcacgccacaaatctcgccgacgtcgccgcccgaaatcacatcgccgccggaaacatttgccgccccaaatcacatcgccgccggaagcatctgccgccacaaatcacatcgccgccggaagcaactgcagccccaaatcacattgccagaagcaactacggcgtagcagttgccatcgtctgagtcgctggagcagccgccattccccttgagcggtgtacatcaccggcgaagaagcccttgcgatgcggcggctcaattgggacaaatcgctagggttaccccttcactccagcactcatcgatccagatattgtgaaaagacatcagtgcctttgcaccaaacgttccaggtggtaccgcgtggtaccgtgaattcctaaccattagatctgtgcgaatcaacggcgcagattttgtacctcgttggtaccgcgcggttcctcgggggtgtgctgtacgataaaattcctattctctttatagtgtcctaacatattagcaattttcttagagtgattcacataactcagcatagatattcccaactaaatgattacccattgagcacctcgcacttggaccctaacggtaaaatcgttttttgatgccaagtccctaatcttgaaacgatcttactccaattataaaacttggctatacttctcctttcatctttttagtccattccaaagtcttcaagccttcatcggtccctttgtcactgttagtgtcttataactattggctgataaatcaactcactgaacataggagaatcaaccagctgaataatacatcccccaagccaattgataagttccacgatgccttatagcatttcatccataagatttcaggttgaccggtatctaaacatgtatcttgaaaatactaactccatggtttggcaatgcaattctttattaaacaaaatatatttaaatgcttattgccgaactctccaatagatcttatccgatcaaccatcttgcttagatcatggaagtattaaactagtggaatcctccaattggtaaaattgaatttcatagcacatcaaccgaattttataggatcaattcggctatataatcaaatttaagctcatgcccccagctacatactgtgggttgccatccccggtcagggcggcattaaagttatggtctgaccagttctatattcggtcagaccggtcgagaagctacgattagatcattcaagaagcattggtcagaccggtgtggttgcggttagaccgacctgatctggagtaatcaagcaccggcttttagaacatgcctctcctatctttatggccagatgtttggtgtgtcaaattactggtcaacatgatttctcaagtggctattttaaataactaggaaggtagccgcgcattcgcgcgggcatgtgtcgtacgcttagttcgaaacacttataagagtgaaatattaaacggataacatctgccacgatttctccaaaaattgtttacgtcggcattaattgcttttataattttctaacttatattatatcataattaagtaatatctataagcaattgaaaagaaggtagacttattttcttaagaaaacatgtcaacgaaagtaaaagtaaggtgtttttcttttcttagttgcatatattatcatggattattagaggatgaattgtgttagacacgaagctccactaaatgtatgggtttatatagacactaataattgatgtagtttgagaggtgatccatttatgaacatttcatgtagagtgggtcagaacctccacgcagcttaacatgaatacgataaagatgaaatataattgcgcagtaatatttttgaaatgtgatgtaccatgaatacacacttgtttttttaataagatagatctaacaattagaaataatggttctaccggtttaaaaggcataggtgtattccaaaaatgtagcataaaaattatagttgttttagtatccaacattattataaagcaagcgtagctcaactggttaggttacttgttctggaacttgccacctgggttcaagtcctatacttgatatgggtgcttgcatttacgattaattgttctttcagttgtaggtgacgtacccatcaatagtgaggcatccgtggtgatttctttaatctcaaaatatgccggcccagtttttcggagatagtcataatggtaggtatgtgtgtgtggattcatagtatgactttttacgaaataaagacaaaatatattacttcataaatataaatatacttagttaaatcatatagtaaaattattttaacatagcatgatttcatagtagcaggactaatttctttcctatttttactttacatatttatgattatttgagcgaccggtaaaattttagaacatgaaccaacacaaaatatttccttttcaagaatacctatgaaatagatttttttctcgcaccataaatttaatcgaagttgactggcaggctaaaggcccagcaatgtctccaatattcttctctcgaggcgtcagatatttcattatgtttgtttgatgacttgaattattcacttcatctctcaaatataatggaaggtccggagaggctacggcatttaattgtaagaaatataacggtgtgagcgaataataattgtttgggtacctaaaagttgcttttttgagatttattatgataaattaaaaatattatctcaactacttaaaaataaggagtaaaggggagataagacgaggtgaggagaggggtggtgggacagttggcagaaaggcattgtgtatatttctaatgatagaaaggcattgcatatatttctaacggcat

SEQ ID NO: 73845 - DNA, 1134 bp, Oryza sativa
tacccatgaattcagaaccccagagtccgcacatcctcaaatacaaagcacttccctagttagatgtaggttagacttcccgttcgagaaactctaccttctacctgccctcaatttatgcacgattaatgaatgccacctgggtggaagcgagaggtggaaatggaaggtcttagttcggaggtgggatctctacctgatagttgcattgccattcatgatgatcccctggcattcgtccattcagccattcaccattcacccattcaactggaattttggttgaatgccggaattgtgtccacaaattgtggatggatagttggttggctggctggatggctggctggatggctggctggatggatggtgaatggctggcggcggttcggttgctttgaagcatttgttgctatctaaattccatttaaggtcgtaccttatcgcccagcatcatcttattctctatttgtattccctccatctttcagatacggatgtagccttggatgtgcccgtgcccaatgaagaggaagagcgcaacatgaaacgtaagtacaaaagtaccggacacccacccagatcccaatagaatccgccaaatcctgcgggaaattgtaatcccattcaccagctcctacatttaattaacaagagaactattgtatttatctaacacctggattatctccacctttcatttgatccctatttatagattacgctgcgttgctaacgggccgcacctcctatttcctcaagggtgaggaaatgaagtccatgtacaccacctacaatccgcagaatgtggtggccaccgcccgtttcctgttccacaagaagaatctatactactccttctacacctcatcgcgaatcggtcgtccgcgtgccattcaattcgttgatgatgcgggtgtaatcctggaggagcatcaactggagaccaccttggcgggcactctcagtgtctatcagaatgccacgggcaagatctgcggtgtctggcgacgagttccacgtgattacaagcgcatcctgcgcgacgatcgtctccatgttgtcctcctctggggcaacaaacagcaggccgagttggctctggccggaaaggtggccaaatacacggcctgc

SEQ ID NO: 73846 - DNA, 39745 bp, Oryza sativa
tctttttcgttttcttctcattcttctttttttcctttttttctgcacgggtcacagagaaaggagaagaaagggaaaaaaagaagaaaaaagaaaaaggaaaaaaaaattaaatgggacccatttgtcagtcaaaataatgccagccatatcatgtccgtgtggcatgccacatcaacgccacgtaggatcctgaaggggttgtggcgatttgggacctagatgacacactatgataagttctaggacttgaatattcattttgagagtttagggacctagatgacatacccctacatgtttaaagaccacccgtacactttactcaaaaaaatacataaggatttcgcgactactttcgtccatcgtcgttatcatacgtatacgtgatgggaaattctagtgaaacggactctgagatgagaaattctagagttcgcttatttaggataggcctcgattccaagcacgatacgatgaggttttgctttgattcttcagaaaatggaaagagtatgagataaaaatcgaaacccctcaatctcagttttggattatctccaaggatgccaccagatttcatggtggagacgattttagacatcgtcttgaagctgcgggagtctagctggaggtaggagacaaacctgtagcactaggacccacgcgacagtgagaggagcgaagcgaggactattagacttgtggttgcttgataggcttggtgcgcttaagggccagaggcggaggggaggagaagggaagaaagcgtgccggctcaactgcagtttgacagaagaaatgggctaaaagtggcccagagaaaaagaagggtttttatttagatttttatttaaataaatgctgaaatgatatttgtattattaaaattaacaattgaactctgaaaattctgaaagaatttcagatagtgtaattaattatggagaatttaataaaaattaaatccagctatattttatttgggaaattttatttcccacatttacatcaccggaaaattaattgaactttaggataaattctacaaataatttataaaatgatttataaatctcttaaacaaaaatcaaggtggacagtccatcccgttctcaatttggattaggacgatacatacatatatcctataccccacaagaatcatgcatcattcaaaatttctgttgtcgctgctcttcaaaatagaggtcaatgagatcaatttaatgaaaatgacttgatgaaaatacgttcttgagatctgtgaactcaatgatgtcatctcttttcaaaggagatgtgcaactaagacgcaacattacatgcaactccaatcgttcgtccgggcgtttttgattcagcgtctatctgttgaccgtgtgttcatgtgtgtccttccatggcagtctcacgacaaaacaagctagtacagtgatgctagacctacgttttctgtgtttctgtgtttccttccatggcagtcccaacgttccaagcacgactgctttatcaagccactccaaaactagatagtacagtgatgttagaccaaacacatcgctagacctaacatatagccaggtcagtttagaattcatttttaattattttcttcaacatcatatatatctgtaattgcgattttcttatttagcagggatgaaaatgcaattacagagacacacacacatatagtttcttcgtataaagaagatggtgaatttgaattttaattaattacataatgtaaatatttctcaatatttcctcaatttattatattttcatcccgttgcaacgcacgggcacttttctagttttttaatacatgccatagcagtacaaacaaagatgaagaaatattaatcgtgaagaaagcatataactgaataatacgaaggcacatggtttctattattgtacttccatcgatacattgtgtagagatccgatccagtcaagtaatctattattcttttaacaaatcggcacgaggcggtgcccattcattgaatatagcacaaaaaagtttacatcttcatatggtttaaactcaagcaagcgcttctctctagcgagcgaccatgttctagctctcttcattgtctacctccctcttcagatcttgaccctcatagaccctgtatcccattaccagtagagaaaacccatgaatacatcaacctttagctatgtattttttagttggtcccaagaccactcttgagatatgcctatgtggcatagtctgttggtggtttctataggactaggatgtgtatttgtgcgtttataaaggagagtacgtgcgtgtgtatatgaacgctcgtaacgtgtttccagaacaaaaaaattcataggaaagccactctatccatttgtttatatttattaaaccgagcactattcatatttaaattgtgttcgtttgtcttttctgaaagaaattctaaatccataaatatgtagatatcatattatccaagaatattactacatgcttaagtattaatttttttatcattatgctctaatcatttttttgcgaagactctaaccattttaaaattacggttacaatagtatggatcaatggtgacagttatattaaaccgagggagtagggagtaccatataatagcctactcaaccaggcaaaattaatgggcaaaccgatcaaagctatgccaaacaaaagaaataagaccacttttttatgggctttatctacctacggtatttataaagtacggaggacgttgatactaggatatatgtgagattgtatctagacaaggacaagggtttatactggttcagaccctctaaaaagagtaatagctctaacacagtttatacgtatatctaggaaaagactacaatgattacaaatgaggagaatagactagctaaggcaatccgtcgattagaactcgccgagtatgacttagcgagagcttatcagcaaatagggcttcggtttcctctggattgtctactgatgtggttggtggttatggctcgtaattcaatgatctctatcctcataagggctttatatttgtatcgataattgattttcctccaattagaaccgatgattgacttttaatttttctacaagtagaactcggagaccctaaatagaaaattaaccatgggaaccttgtgttttttgaataggactttagagccttccacccagcgaagacagtttccgtccagaatcatcaattttattactgtttccaagggcatcttcccgtataatattaggtttggtattaacatacaacaaaaacccacatataggagatatgccttatatataatcctgccaatttgactcctttaaatataggtcctatctgattcgtatccctcaactgcaataccggatatctggaacacccccgccccaaaaaaaaaactgttataacccatgtaatttaactcacaagacaatattgatggtggtatttgtagatggcatccacatggcaactaggtcatcaacgaaattaaaagattgatgtgggacctacatgcaagttactcttatttagtcatcttcttccaccaccattcctctctctgatcgagctggcggcgatggatacacacattgactacggcattgggcctgacgtgatttttcgccgacctcgctgtcacactcgaagtgctcaagaaatcctctcaccgacctcgttgtcagcctcttactcctttccattcaagttatccattcattaattaacacacacaaatatattttaagttacaaaaaacaattacatatcaaccgttagggcaacagcaatgttacttgcccaacttggtagtagtgtgtcagtagtgtgggccagggctacaggcagcagtaagcaatcatgcactctacaatgtatcagcatatcagtgggaaacaaggtagggccagcttcagaaaaaatcatggatggcagtctctagccgtgacttctttctataacttttgttaggaaaactgggcatagtttaattcctgttacccggttgtagtcgtgttaccgggctgcatctacttactagtctcacaatggttgctaccgggtaagaagagggcatttaatgcttattacctgctgaaatgctacattgtggatgcccttagagctagtataatagtatagcccactaatagctccaattcatctatagctaatctaatagtcaatttatacaatagttgcttactatactattaatatatgatctcacctatcgtacacacagtgtgtcttggagtctgtgctgcagctggctatagatctgtagcccgctactcttctctctcatcgtttatctcattaaaacatatttacagctggctaagagcctgctattgtacctactcttgggatcggtttgaagcccttagagttataaaatagcaccataaaagggctcatggctcattcgtctttacgttgcttcacgttctctctgcggacagccacggcgggttaatattgctatgatgcttttgttcctttggtggcatccaccttccttgtgacgactcgtctctgattgccattgcaggttgcacataatatgctcatagtgtggcgacgtacgtgatgattaacatcaacagtagagagggtattaattaatttggacgtaataccgttatggtgttaatatgtatacctataataaaaccatatttaatattggagcgctagtagataagaattaaactatttgaaagttagctatagcaagtctgcgtgaagaacgtgcatgttttcttattagagagctcaagcataaaccaatatataacgaatgatgtttattccttgcaggcacggccactctcctagcccatactaccaattaatatttgatgggacagtctctagtcatgcattatttgattactaaagaaactttgtagagaggaagttataagaaacttgttgcttctacttaaatgtaaaattgaatctatagtaaggaaagttctcgattttagttttattgcatcaaaagtttacaattcaccatataatagcatctaacgtactttccctcagctatacttccaagtcacttccgtctcttccaacctgatttgctatctgttgggaatcacttcctagctagatagactcgcacacactcctgataaacacacacacatttagaggcaaagaacagtggagtttggtgctgcacaaacgcagcgtttttctcttttttactcaattaacaaagatgctaagtacatgcttaaatagacaaagttagaggccaaaacgtgcgccactagcagccgcatgctactcttagccacacgactagatcatccatatgcacacctagtaattaactaagatcctaatggcccggctattatgctaatgactctactaaccagccactatttgtgtgctcctgcagcatctcacatacccggccgtctcgcacggctcttgggcctactcgtatacggatctcgcgtactactactatagcttcttcgggtaccttatcctatcctgctacctatacatttatttgctacatgcgaccaaattaagcaaacatgattatgcactaataacaagattatttctaacactatcttatttgacctatgttaactcagctacccacttagaatgacattctaaatttgtcatccattatcttctaacaaaatcgatatgccccctaccctatgtgtatatcgtcaaactcattctgtgtcacatgtacttatatatggatatccatctctcggtgaaccggtgacagtcttctttggctcgtggcgtgcatatgtggaggagagagataataggtactaactcttatgtaagagttacctctacctatactagataagtgagaagaaaagaaaggactatgataaaaataaagaaaaccttatagctaagccattttacaagttgactaatattattttcagatgagcttatagctagtatttagctctactattaaacttgctcttacgtgtattactcttttccattaaagccattcatttattgattgacagatatgcaaacatattttaaattaagaaataattgtatgttaacggttaggatggatatgaagaccttaaaagggctcatagctcatcagtcttgacattgcttcgatcacttttgtctcgtcaattccatagaggtaaccagtgctatgatgcttttgtttaaggattgtatggttgtatacatgatctgtaattgcttgtcctaacttattctcagagcgagctagagcctagacatagagaaagtatgagcattgtggtgagcaagtcggcgccggtggtcgtccggccatcgcagccgccggtgaagactacctccggcagcaagatcgttctgtcgcctatggacaagcctagttccatgatgccaaccacagtgctacttgcgttcgaccatcccaccatccaatcagagtgcacggcggagaccatcaagagaggtctcgctcaagcgctcgtcccctactatcctatcgccggccgcctttcctgcgacgacgacggcgatttctacatcgactgcaccggcgaggagctcggagtcacgttcgtggcggcgtccgccaactgcaccatggaggagctcatgtgttgcgtcgacgaccagcctcccgacgccgagacggcggtggtgcagcagctcgccttcaactgcacgcccgacgaccttcatcaccgtctgctgtggatgcaggtcaccacactctcctgtggaggcttcgtagtcggggtgacatggaaccatggcctggctgacggcttcggcatggcacagttcatacaagccgtcggcgagctcacccgtggcctgccatcgccgtccgtcgtcccggtcaggttagacgacgacaacaacgccacccaggccatacctcccttcgccatggccgtttatcagtttatgtccagctccagccacaaggcatccatcgaccacaccttcaacaacatcaccgtcccgtcgagcttgatcgaccacatccgattccgaggacgacgaaccaacgacgacgtcaccgtgttcgaggctgtcgccgccgtgctttggcagtgccgtacccgggcggtgatgaaaaatccggaggcccccgccgtactgctcttcgcggtgaatgcgcgaaagtatctcggagccaaggacgggtactacggaaactgcagcacgatgcacgtggccgtggcgaagagcggcgcggtggcgaacgccgacatcaacgacattgtagacatcatacggcgcgccaaggagcggataccggagcagctcaagatgaccggcggcagcgacatgacgatgctacgggagctcgccgatgaccatcgtctggatggatatgagagcctgctctacttgacatcatggcgaaacatcggattcgaagatgttgacttcggcagcgggaagacggcgagggtgatgacctacccgcagagggtggtgctctccatgtcgatgatggtaaaggctatgccgatctgcgtcatgctcaaggcaacagagcaaggggctagggtgatgtcagcgtgtgttacagctcaccacgtcgatgcattccatgacgaaatcgcaaagctcaacgccaccgcctgattaataaactatgcgaagcatttccctaaatgaataaaattggtcaaacccctactactgttattatgattatatcccttcttcaatttgtgatatttaattatctacagaaaaatttaaatgtatcatgcacgcatcaacaatttatatggtgttgacagaaaacacgaggcctggaagatctgcttaactccagtgcaggtccaaaactcgccttcggatatatgagcgtgccagtcgatttgatcctacaatcaacaaaaaatgaagacaaagaaaccgtaattaaatctataaatgatagccgatcggctgggtactgatgacatcatttattttagaccgatgtcatgtgtgcatcgatcagcagtcatgaataattaaggaagaactaaacctactcgattggctgtagacattaacaatatataattcttatgtcgatatatacttaaatcaagtgattgggatagatcggtcgccatgccgagacagtataaatcacttagatcgaaatataaatcaacaacaaaactatatacgttaatagcgtagccgattagatagatctagcatatatcggctaatactccgataccactctatattaagatattaaagcaaatagaatatatcagacagaagcataatatacttaaatgcaacaagatcttaacataaagggcagatttaacatgtcaatcaagcatataggataactatagttaaatcaggtaagatcggctgaaactccgatgctatactaatcggcaaccaggaagcaggctagagattgatattctaagcacgacttgatagatcaaacttaactgatgcagcattaagtatgaaaagaagaacaatatctagacaatcaagccactggatgtttcatagagtggtaagtatcttgtacaatccaagctaacaccgctatttaacctaatcggctgccttctactaacagatgttagctgattgtaggttagatgacgatattaccgaagattatacaagatatatgataacttgatgaattacataaacaagattagagtatcatagagatggaagcactaatcctgagaacacaagccgccataacaagttttacctcttgttgaagatcgaaaccgatgcagctcaacccgaaagcaagaactcgtcgaaacaaaacgaaagtaaaagggtggcgatgcgccaaaattgtattgaatgtgtgtgttagattaattacatggagctcggggtctatttatacccgagaattacaagatatgtccataccggacacgactattatctctaacaaactctaagataccacaagtctttacgacagacttttgcccacattaatctgtaagaaatttacataaaatattctaattaatagatataattgaattttcaggactctatccatgcgtggcaatcatcttgaagcatatcaactcaacccgataatgtacaccgagtcgtattcttggaatcggctgtatcggctagccctgtctgactcgaactctgccaatcctgaccgtagccaatccagactctagccgattcttactctgttttcgcgacagcccttatcttcgattccacttcgatctaatctccttctccgatgctgatattaccaaatttggtcattaacacaagccccccaagttcgggagatttggtaatgttccggatttgccgcgtatcaactccgagtaagtttcgcactccgccgttttctaaccgttactccaactctttaaatactaactgttgtccttgagaaatctcacaccgttatttccgccttcaccgctcaagcgaaactttatgctctctctctccggcgattcctccgacgcataaggcgatccccaggtgacttcatccccgaccagatttccgccctcggcgatgtcaacctccgccaatccgtcctccgcaccatcggctgagtatgcaaaggtaagtacccatcggctagatctctttctttcacagtagattgattttctctcgccttatcctgtattcttcttctctatccctacttgcatctgtagcatctgtccaatctggttgcaattccaagtctgtcacacgagaaccactattttcttggtccaatcggtagtcttgatcctactgaattcatcaatggcgaaaccaataggattcctttcagattggccaacccagatctaggtcactgaaagaatacctttaaatcttggccatctctagagaaaacctcacccgagaagagctggatcacatggttcaaacgcttatcggccagtaaaagagttcattgggatgaaattggaatcggccaagcactcgaccttaccatagccaactcagctaaggacgaacccctaatggcagctgccacttatttctggttcaacaccatcaacgccttcctattcaaccaagggccgatgaccccaactctcatagatatcatcatgatcacaggtctagatatcacctcatcggctaaccctatgagcctgaacacaaaaaaccaatatgacttcaagactaagagcataggcggctggtcgggctatattgcagcatacatgggccagggtccggtcaccccccgagaacatgtggctttcttgctgatgtggctagagaaattcttcttctttggatcaagctgtggccctacaaccaattggcaatctgtagccgaagccttagaaacaaagagacaattccctttaggcaaaatcctcctcggctacttgtaccaaatgctaaataatgcatcggctaagttagctgtcggctcagtagtcggagcgggtggaccatggtggctactgcaatcctggttgaatttagtagtcatgaagtttgtcaatcggccatttgtaacagaagctgaattcccaagactggagccgattaaagacagtgacagagaagaacgcactcatcggagatgcacctccttcggagaatatgcctccacaccaatcgatgcaggagcaaagctatcagccgaactgctcaaagattggttttgcagcttttatgaaggattccagaaagaagctcgagtctggttcctctatgaagattcaacgcttctggaaaatcctttggactttagattcgaagacatcaaccatgacagatatcagaaacccagagaaattttctcaactgcaatcagcccatgtatccttcctgttggcatttatcaaggaagaaacacttacgtctcatatgaattttatcatccaatgagctctgctaggcagtttggaatgggccaacttccaattggcttattttttgccgataagatccaatgccgagggaaaatctcatctaccttaatgatgaatcggctgcttaatcttcaaggacctccattgggcagcattgaaaatatagagttggcaagattcaggagtagaaacttcgacagatggtggggtgaatggaagctgcatcttttccatcaaccggcttcaatgttcaagatagacctatttccagatattgttccttagctatgtctttattttattaatcgtatttgaacaattattagccgattcatcgcttgattaatctaatcctctgttttatagacaacagaatcttctcccccacaccagagcaatagtggcaagatatcgaatatgccccaggaataattccaaatggaggtggaccatctcctccattcatcggctatgatgcccccaagacttcggctcttctccaaggcttaatcagggaaccagctgatgcaggcaagaaaagaaaaaccagatcatcgactatggacacatcagctccagctctcaagaagaaaatcaaatcaaagaaaaccaagccagttgatgatctgtctgccctagatccatctatcgaacaagcgctagatgaagaagagattgaagaggacattgatcaggctgcagccgaaatgagcgatacagagagaacaccatcggcttcacccaagcagactcctccaactccttctgccccagctcatttttcgagagtaagcatctctcttcgatttcctctgtaactactttacctttcagccgattactcatagatgtataatcacagaagaagaaaactgccgtgaggaagaaatcggcagcaccaactctcaaaccggctccaccagtaagatattctaagtcttctcattaactaatctcggccggaattatgtctaacatttatctttttatagcctcctcctcctccttcacctcttgtgcagcgagaatcaagcaaccgtactccatcggttgcagacagtcataacgtcgaagaggaagaacaaccagctgctcctgttattccagtaagtttttgttgatacaaatctgagatcagccaatcatgttttgatccttaaccatccataatattatctcttgcaggtcttagccgatatgttttctttcgacatcaaggattatctcgatgaaatagaggaagacaccaccagtaaagctgtagctcctctgtctgatgatgtgaagagaatgctcgaggatatctctcatcggctagaagcatcattagacaacttagtgaccaactgtggctcgatccaggccaggttcacagatatccaagctctactcccggatgaactaaccgatgcccttactccagccgtttaccttgagcaacaccaattcaagctggagaaggccaagtagagattagccgatcgccgggaacgcaaaaacatcgaagctacaatccagcacaatcggcagcttatgcacgaagagaagtccaagcttgatcagccgtctgagggcccgatcaagtcaaatattgatcggcttgaagctcgtaagattgatctcatggcacaacttcaagaatgcaacgccgagctggatatggagcacaagaagttagccgatctcccgtaagctatcgaagaacagaaggcgaggctgaaatcggctatcaagaatatcgctgatatgaccaagtccttgaaagtcatccctggaaccgatgctcaagatgcccaagccatagaagaagtagaacaaattaggcagagggctatatcggctatccaacgatatttgtcttagtgatattctgtataatagacctcaagaaattttttgtactcggctaagataccctagtgctattattcaacttgtctagataatcctttgtgccgattaacataactgccaaatatgctcaaaaatttgcaattttccatgtatgtgcccccctaattttacaatgtcaaaaacattgataaaattataaaaacgactaagggcaatataaccatatcgaccattgcacatcggcaaaccacaaccgattacaatatgaaaagaactaagtgcgatataaccatatcggtcatctcaaggcaatgtaaacacatcggctatcatgcatcggcaacatcagccgatcatgcgttaacccaaaacacttgggtaatatttcttcaagtatttgccatttagtgctctgccataaacttctccatcgagtccttgcaacatgtaagcccccttagataccaccttatgaatttggaacggtccttcccaatttggcgaccatttgctgaatttgctatcccgagtcccaatcgacaaaattaacttccatacaagttcaccttccgaaaaatctttgggcactactttcttgttataatgccaagcaactcgctccttatccttggtaacctttgcaagggctcgtaaccgtgattgaaccagatcctccctctcatcggccataaggttgtaatactcatcggctgttaaatcattttgcaattccgttcttctagagtcgattctaacttcccatggcaaaacagcttcatgtccataaacaagtttataaggaggaacctgtgtcgatccatgacaagccatccgataagaccacaatgcttcggctaaacgagtatgccattgccgaggataatcagaaatcttcctcttaatcaacttgatcaagctcttgttagatgcctcggcctgcccattagcttgtgtataatacggtgaagaattcaacaatttgattcccatgctatcggcaaactgaacaaactcatcagacacgaaaattgaaccttggtcagtcgtaacggtttgagggataccaaatcgatagattatatgctcttgaacaaactgtatagcatcccagaatcaactttcttcaaaggaatcgcctctacccacttggtaaaataatcggttgccaccaatataaacttataccctttacttgacggtggattaatcatgctgatcatatcaattccccaacctctaaacggccatgatttaataataggattcgtagtcgatgccggcgctctctggatcgctccaaatttctgacaatcttgacaacctttataatatctgaaacaatcctccagcatcgtcggccaaaagtatccagcacgtcgaagcagccacttcattttatgagccgattgatgagtgccacatatcccttcatgaatttcactgattgcaacttttgcctgatcggcactcaaacatttcagcaacaccccatcaatcgtccgataataaagctcatcgtccaacaatgtatacttcaacgttttatatcttaacttccaagaaaccgattgagatggatcccgtaaataccgatagacatcatatctccaatcatcggctgttgtgacagcaacttaaatctgaacatctttgatcatcggcttatatcccgatgccccttgggctaaatcattagcttcaatattctgctctcgagatacatgcttcaaagttactagccgaaattccttcatcaattcttggcacttgtcattataaactatcaacgtatcattcatacattcatattctcctgccaattgactgatcaccaacaaagaatcccccatgatttcaatagtatcagcttgaacttccttgagtaattgcaaccccttaagaactgcctcatactctgcttgattattagttgcataaggtttaatagtataggcaaactcaaagcatgccccccgaggggagattataactaagccgataccacaaccatgagtacagactgacccatcaaaaaataaagtccacaacacaacctcaaccaagccgatagaatcatcacgatggtcaacaataaaattagctatagcttgtcctttgatcgccttctgtgactcataccaaagatcaaactcagtcaatgaaaatatccactttccaatccttcctttcagaataggagccgataacatatacttgacaacatcggccttgcatatgatagtacattcattggacagtagataatgtcttaacctcatacatcaaaaatataaacacaagcataactcctccacaggggaatatctagtctctgcatccaagagccgacgacttaaatagaacacaaccctctcttttccttcaagcttctgaatgaagaccgagccgattgacttatcaccggccgataaatataaccaaaaaggtattcctttctgtggaggaatcaaaactggaggggaactcaaatattccttaatattatccaaagccttctgttgttctgccccccaagtagattgctgatcggccttcaatctcaataatggtgtaaaaggttctaaccttccagacaaattagaaataaaccttcgaacaaaattaattttgccgatcatctcctgcaattctgtcttgtcctccggaggtttaatcatcttgatcacattgatacttctctgagttatttcaatccccctctcatgaacaagaaatcccaagaactggccagccgatacgccaaaagcacactttgtcggattcatcttcaagccatatttcctggtcctctcgaaaacctttcttaaatcggcaatgtggtcttctatttctttagacttaacaaccacatcatcaatgtagacttcaaccaaccagctgattaaatcatgatatatataattcatagctctttggtacgtagctccagcactctttaagccgaaagtcattacaacccactcaaacaagccgattgcactaggacacctgaaagccgtcttatggatatcttcttcagccataaagatttgattatatcccacatttccatccataaaacttaatatcttatatcctgaagcagcatcaaccaactgatcggccactggcattggatattcgtcctttggagtagctttattcaaatctctaaaatcaatgcacaccctctccttgccgttcttcttgataacaggaactatgctagaaacccattcggcatatcggcaacgacgaataaaactagcatcatataagcacttaatctcagccttgacaggttcgagcatgtcagctttgcatctcctaggaggttgttgatgtggcctaacccctggttcggtaggtagccgatgttcaacaatcgatcggctgagtccaggcatctcataatattgccaagcgaagcaatccctaaattctttcaagagctctatcagcttggttctaaactctgaagataaattctgactaataaatgtcggcctcggccgatcgcctggacctatatctatgtcttccaaatcatcggccgacataaaaccttgaccttgcttgtcatcgagatcatctactgtgtccttggtgtagacgtttgaaccctccacgatgccctcaaagtaatagcttgggttctccatcttcaattggctgtatatcagaatcggacacttttagaaaatctccatcccaaactttgccggataaacaatcaaggccgtccatctcccaaagagctaaattggcactagcaacattgactgacctgtcggctggcacgatttctatcttgtcgccttgccattggatcaagcattgatgcatggttgaaggaatacaacaattggcatgaacccaatcccttccaagcaacaaactgtaagaacccttcccatcgatgacaaaaaacgtagtaggaatagtcttaccgccgactgtcagctccacatttagaacacccttggtttctgatggattgccaccaaagtctttgagtaccatgtttgttttgatgagatcttcggcgtttctacccaacttcctgaacgtagcataaagcatcaaatttaatgcagctccaccatcgaccatcatcttagacatcggcttcccattaacatagtcatttatatacaatggtttaagatgccgattctctgcaccctcgggctttttaaagactgcttgttctggtgatagaatcaatttagcctattcttcttctgtttcctcaacatcggcttggtcgatcctaaattcggctggcaaggtaaaaaccatgttaaccgacgcaatcacaatgcctttccctttggccaatctctttgcttcatcggctacaggagcttgtttcttaacgcgccattcctgcttcggctttgttttctttagccgttgattgatctcttgctcgacctcctgcaagcgttctcagtttctcaatctttgaacccttctcttctgattctttgtaaatatgccaggaggacaccattgagtcttcctgttttcatcatcctccgggtcatgatcctgatttaccgggcccaatctttgatgaacaggaacccttgcatgcttcagtcgattgcccttaatatacgaccggcttgaactctctgcaacgttaccgcatccaggatagtcttcaatatatggcagcctcataccctcattccaacaaaatctaaagaactcacaaccccaatgaggatcgaaaccatcatcaccttcctcgtaatgcttctcctgttgtttattatacttcctttggtacttattgatgatcttagccgaattcatttgaaaaccccttgcacggcccccatcggctgtttggccagctgtatgaaccatatttacgggaaaaggattaccatcaaccttcatcggcttcttggaatcatcaaatttgattttgcctccttcgatagccgattggatctgctgcctaaagaccttgccatcattggtagtatgagatccagaattgtgccacttgcaataccttttcttgcctaattcctcagccgatggaatagtatgaccagcagggagctgaatttgcatttcccagagtaatagatcaaaaatcttgtcagccttggtaatatcaaaatcatacctctcttcttttccagaattcttcacccattggcatggcataacctttttgctccttacccactcggctgcagctatctcagaatcatcatcctcatcgtccgatccacacatataagaacagacatgattaaccttcctagaattcctcctagcttcagcaaacctctgctcgtgcaaagttaccttttgtgtaagatgcggtaagctttcaaagtcttcagacgagaatttctccctgatcggagcaatcataccctgaaaagccaaatcggctatctgggcatcagttaagctcaagctaatgaacttattcctcatctctctgaacctctgaatatattcatgcacgggctcgtcgtgtctttgcttgattgctgtcaaattgtacaacttcatctcatgtaccccactatagaaatagctatgaaactgcttctccagatcggcccagctgttaatcaacccatagggtaaagcagaaaaccaagtaaaagccgatccagccaaagacaaccggaacaacctaaccctcaaggcatccacagccgatgcttcaccacactgagctaaaaatcggctaatatgctcataagtcgatgtactatcttgccccgagaattttgaaaaatctggaactttgaaccggttagggagagggactctctcaaacccttcaggatacggttgtcagtataaatttccagtctcttttggtttaagcccgaactgttccctcatcacgtcagcaattacatcggcccacggtcgttgttgagctgctccttgcgattgttgctgcatgggctcgaattgactgtactgaggagcaaattgaggctgaattaatcccccttgctgatattggtcttgcggggaaggaggttgatattgataacttaaattgcccccctggtaattctgctagtttggctgaatatttcgtaccaagtgctcagggacaatctgaggtactaccgtatgatccagctgcacgtgatggaccaaatgctctggaacaacctgattcagagtatgttgcccagccgatggattcatcaagccttgctggtgaatcggttggatagtctgctgtcttgatggcgtctgctgaatcggatgtacaatctgctgccttggtggcgtttgttcaactgactgcacaacctgttgctgaattggttgtacgacctgttggattgggggtgtttgttgaatcggctgctgctggactagatcaacagtaggttgaagtggtagaaacatggtagcaacctgatcctgcgttagccgattcgcaacctgcccactatgctgtgggttctctctcatcaactgccgaggattaaccagctgacctggtgccgacattgacggagtagatggggaaatcgataccggcgccgtcggctaggctgatgatgcaatgggaggaaccgcttgaataggtggatgaatatcggtgaccaaaggccgataattcggaaaggtacctcctggcaaataaactgggcctgcagcctgatgtttagctattgaaccatcggctattgacttcatcatgtttgacaaggtattgactaataccccagattgattgatgaaagcattgtgcacagcatagtcaacccggtcttgaaaattattgaaaaattcctgtgacgcactgccatcttgattaagacttcctcctcgtggcccctgagtgccatcaccttgaactccatgtactccttgagagtggtcaccctgattctcctgagccgatccatttgtagcacctttgttgctcggttgagccgagccacctaaggcttgtttcatctccccatccttggaagaaccggtcccggggacatcagccactactcgcacctgatacttttgcaccactgttcccttgcgggtctgcatgaatgagttcaagaactggttccgtgcttgctgcatcattgcttcaaactccttctgatcaggtgtcaatttgtccagagtgatggtcatgacgttgccctcattaacctcagataggtctaattgctggatcttctctttaacagaacctgggctagccgaagacggcgatggtggcggcttctcggccatgaggaaaactgctttctgacttctaatcagtcccaatgggcgtgccaaaagcgtgttgacagaaaacacgaggcctgggagatctgcttaactccagtgcaggtccagaactcgccttcggatatgtgagcgtgccagttgatttgatcctacaatgaacaagaaacgaagacaaacaaaccgtaattaaatatataaatgatagccgatcggctgggtacagatgacaaatcatttattttatgccgatgtcatgtgtgcatcgatcggcagtcatgaataattaaggaagaactaaacctacttgatcggctgtagacattaacaatatataattcttatgtcgatatatacttaaatcaagtgattggttaaatcacttagatcgaaatataaatcaacaacaaaactatatacgttaatagcgtagtcgattaaatagatctagcatgtattggctaatactccgataccactttatattaagatattaaagcaaatagaatatatcagacagaagcataatatacttaaatgcaacaagatcttaacataaagggcagatttaacatgtcaatcaaacatataggataactatagttaaatcaggtaagatcggctaaaactccgatgctatactaatcggcaaccaggaagcaagctagagattgatattctaagcacgacttgatagatcaaactcaactgatgcagcattaagtatgaaaagaagaacaatatctagacaatcaagccgctggatgtttcatagagtggtaagtatcttgtacaatcctagctaacaccgctatttaacctaatcggctgccttctactaacagatgttagccgattgtaggttagatgactatattaccgaagaatatacaagatatatgataacttgacgaattacataaacaagattagagtatcatagagatggaagcactaatcccgagaacacaagcagccataacaagttttacctcttgttgaagattgaaaccgatgcagctcaacccgaaagcaagaactcgttgaaacaaaatgaaagtaaaagggtggcgatgcgccaaaattgtattgaatgtgtgtgttagattaattacatggagctaggggtctatttatacccgagtattacaagatatgtccataccggacacgactattatctctaacaaactctaagataccacaagtctttgcggcagacttttgcccacatttatctctaaggactttgcataaaatatcctaattaatagatacaattgccttttcaggactttatccatgcgtggcaatcatcttgaagcatatcaactccacccgctgatgtacaccgagtcgtattcttggaatcggttgtatcggctagccctgtctgactcgaactctgccgatcctgaccgtagccgatccagactctacccgattcttactctgttttcgcgacagcccttatcttcgattccgcttctgtcgaggagtgatcctctctagcgggagatcgtgggatccccctttcgtgagttcgaccgggggaaaaggcccgcctctgaaaatcacgtatccgcccactagactaccaggtagtgtgcacacaacaagattatacaggttcgggccgcaaaggagcgtaataccctactgctgtgtatgggatttaggcacaagttacaaaggtccctaagccctggagattgcccttacttcctttctcattgagctcaggttttttcccttggtcccccccttttcggtgggaaggtcctccttttatacctcaaggggaaaccacatgcaccgactctactattcttctctcgggtgggggggagcccacccttccttgaccggatcttgacccgtgccttcgcctggaagctaagccacggtttgtccttgagtggggttcagcgccgtcccttgcctaacacgggggacacccctgtcaatcccccattaatggatgaagaattgtggtggccgtcctctcatggggaggacctcgaatgacccttccgatgggacgggtcatacctacctccactctgccggaggtagatgtgacgtgggggcacatctgtccgtccagtcaaatgtgaccggtgacaggccggtcacagatcagatgtgaccgacgacgggatgtgtgagcgcaagcccccccatcgagagtggcgacagttccctgaggtacctggaactccagaccctcgctgtcatcgccatcgtcggcgggggccttcttcttagactcctctcgctgatcattggctggggtcgtgagggctttgccctcccgtcgactctgccgcttctcctcatcggcttttcgaaaccgctcggccaagttcttgaccgagcggcagtcggcaagactgtgccgataagtattgtgcaccgagcaccacttgtccgcggaccgacccttaccagaaggggcggtatagctcgtcttgccgtcggtggccctttccctgcgcggggcccgcgagggcccatcagccgcaaggacgtggccctcgtcatcagagcgggctggcttccgcttgccccttctgtcccgccgcttggagcggggggcagtctcgggggcggccgctgccgccgcaccggtgctgggggagttccaagcccacgcctcctccttctgagccaccttgtccgctagctcgaagagctcagcggtggtcttaggctccttggaggcgatcttctccagcttgcggttgtgccgcacgccgttccaaaatgcataaacgaccgcgtgggctgggatgcatggaataatgttgcggacctagcagaagcgctgtatgtatgagcggagggactcgtcgtacttttgctgcacagcgtgtaggtccgcctcctcccccagacgggggtatgtgccctggaagtttgtgataaactgctggcacaggtcctcccaggagtggatggagtcggggggctaggtcataagccatccacgcgcctgacccttaagagccatggggaaataattcgccatgacccggtcatcccctcccgccgccacaatgattgtggtatagatctggaggaactcggagggattgatgctgccattatatttctctgtgaggttgaggcaaaactttgggggccaccggacgttccggagactcgccacgaaggccttgtaaccagttccccctggggtggacgtgaggggcgggccgccgcgcgaggagaaacgcggcactccagacgaggaggcgccttctcccatgcgggtagcgcggcgctcgtctcgtcgacgctcaatgttgactcgagcgtcctgctccccgtataggctatcgtgacgcctccgactttccgaggcccctgacgacgttggggccgtagatcgccttgaggctgtggctatccgacgggccctcctccttgctgacgaggagagggtggtggaggtacgtgatgtacctgtggcggtggaacggccacttacggccaaccgccgctgggcagtggtgaccaagttggcgacgtcgtccaaccatcgttggacgggggcctccggctccacgttcaccggggggtgccgcaggagggctccccctgcctaaagcgcgccctggggcgagctgccgtcgcggtaggtcaggcagcggcgcgctcggacgtgccatggcctccccccatccagaggcggggagagggccgagccacccgatcaggcgtgaacctccctccgcagggggtcggagaggggcggagtccgcgagccgcgtcggcggtgacgcgggttgcgactcccgctggcaccttcactcctggaaggagtaagggtctgcacctccacctcttcctctaaaacctccaccatgatcgttggggccggaggaaggcttggagcggaaggaaacgacttctcttcgaagcgcgcgaaatccccctacctggcgcgccagctgtcgaggaatgatcctctctagcgggagatcgtgggatccccctttcgtgagttcggccgggggaaaaggcccgcctctggaaatcacgtatccgtcccctagactaccagctaatgtgcacacaacaagattatacaggttcgtgctgctaaggagcgtaataccctactgctgtgtatgggatttaggctcaagttacaaaggtccctaagccccagagagtgcccttacttcctttctccttgagctcaggttttttctcttggtcccccccttttcggtgggcaaggtcctccttttatacctcaagggataccacatgcaccgactctactactcttctctcgggtggggggggcccaccctaccttgaccggatctcgacccgtgccttcgcctggaagctaagccacggattgtccttgagtggggttcagcgccgtcccttgcctgacacgggggacacccctgtcaatcccccattaatggatgaagaattgtggtggccatcctctcatggggaggacctcgaatgacccttccgatgggacgggtcatacctacctccactctgccggaggcagatgtgacgtgggggcacagctgtccgtccagtcatatgtgaccggtgacaggccggtcacagactagtcattcctgaccatcgcgcgccagttgggcatgccgcacgtctgcccctaccgcattgaatgcggcagggggcagttggggcgctgcgttcattaaaggaggttcggcttgggccccctccccgcttgctccccccgccagatggcggataggcgagggcccgaggggcacgacgtgacaccccgaggcctcggggcaaaacgggcgagggcccgaggggcacgacgtggcaccccgaggccccctggccgctcctgcgatccgcggggtacgggggtagggccatgctgtaggtcatgcgccaggatgggaaaggtaaattcccctcattccacatacccccgggcccacttcaccgatagcttcgatctaatctccttctccgatgctgatattaccaaatttggttcgttaacatatgtgccttgtatcaatgtatatttaaaaatgtgtcaatcaagctgaatataataagaagcaagatgatctctattattgtactgcaccaatgcatatcgtgtagagatccagtcaaaagtaatcattttttttaaatgaatagacacaaagacggtgctatttcattcattgaatatagcaaaaagaaaaattgcatcctctaagggctgcaaattaaggatctatctaaaccaattcggtttgaagaaaaacaaagaatttagattcctaatgattaactactacaagtgccattcggtttgtaggaatgaggtatagaaaaaccaaagaaatttttttgttttcctccaagttgtagagagaaaactagaaaaattttcatttaatttactctaaactcttgaaaaaatttcctatggattggtgtgtgcatacatttccactccttcacttttcctatttctgtgagtagaaacttctcataggattaggaaaagtggaggaatagaaaagcatgcatacttcaatccgtaagaatttttccatgaggtttatgtggatggaaagtttcctttcttctctctgcaacttgtagaaaaagaaaattttctttgattttctatatctacattcctacgaaccgaatgacattcataggatccttagaaatccaaatcctttgaaattcctcccaaacgaatacaccctaaaccaaacaatccctcagtataaaaggaagaaaaacatgtgactaaacatggttgaactcaagcaagcgcttcactacagcgcacatccacattcttgcgctcgtcgtggcctatctccttctcgaggttttgactcttgacactatagcctataatcccatgtgaatgcaaccatggtcagagttcctttgacatggtagttgtttcaatcttttttctctccatcccaaagtgatggtggcagctaatgtttcttggacatataacagccttccagtgcctcatcttcttctctacttcttaataatgataccctggtcagggttgtggaacctttagggtcaagggtattacgcaaccctcctgctacacaaagcagttcaagagggtcccgtaattctacagaaaatattggagacacaaagtttaggggtgagactctctttactattcaatcctccaatcaactgtacaaatgattagccccctcctctctttatatagtgcattccaatatatgaaaggttcgttgatgggcccattaagtgtatttgggccaggccttcatcggccaagcctaaagtttcttaacactcccccttgggcactcaccgcgtgatgtctatgcctcgttaaaactccataaaaacccagtgggaaaaattgcagaaagagtacatagcatacgcatgtatgtcacatagattgccttattaaaaaccttgataagaaactgcaagaaaacttatctaagggaaaaagagtacaatttacccaaattcttgtatcgattttcttaatcgtttttgggtacttgattctttagttcatgcttttgttaatagactggcagaattccccccttgaattttgcatctcttttaagtgtgaaccatcaaaactcgttgctcttatgttttcaaaagatagtccgagtgatgcttcaatggtcaaatcttgcatgatttttccataacttgtagagatcatacaatctattagtgttggtgtgacgcacatatcattatcttcttgataatgattttggggtttgggcaaagctcgaaccatgttacttgctagaaatggtgaactatatccaaggaacctatgtattctcacattctgatattctatggttcacttcttcatgtgttgtaggtttatgagccaaagaaacgtaggtttctacctattttatctcaaacttgttcggaaagagtgagctttctttctttatgcgatgatattaagatcatcaacttggtttgggacttttaatgcttgtatgcgagtgcccaatccaaaatttctttaaccattcattgtcaactacaggtcagctttgcgggttgatcttttagttgattttaaactccaggttgactgccaatgatttgctgtatgaagagaatatttcccatagcaggtctcattaccaattcctattggttgtatgtgacacttatgtgagtatccatcgatatatggggatatgcaattttcttatgcttctattctttgacatgggcatgatcctttcattttaccggcattggtgtgcactccaactgctggttttcttccttgataggaagatgtggtatacatgttctgaggttccataccatttgccagctctgaacaggctccccctcaaattctggggttacttttagtgactatgagcttgaaagttcctttcgtcccattttcaccatacgtctccagttactttagagatttaaggagccggagttcttgtcctatttattttttgaggcatctggacaagatgaggtatacctttgcattcttcggtatttcaccctcctccggtgcattacattcgggtaatgcaacttagtcatgctctccagatcacaaaagtgataggtagttatccaattcttatgtgtgctttccatactttcattcgctggttcttgattaaatgtgcatccatcctttctttgaccatttttcctgacatttatcattttaagggttatttctctccccctaaacgactgaaaataatccttcttattgtcaaggaatttaggataagttcgtacctctgttaaaaatttccattttttttcggtgggagcccttatggttgtgggacatgcacgtgtgtcgagtcaacactagtattcttttaagtggacaacacatttcgaatagtccggttattgatatttcgttgtctttggagctaagagtccattgaagtggcaggaatttcaataatggtgcggtggacatttttagtcctattcttgtggacgtccggtacttagtgcttttcttaatgtgctgatgccaacatgcatgatcttgcaggatcgatttggcaagagcgtagtgtcaattagacacaattgaagcttttcataagtgcagtatgtatcggatgatccattaatgggctaaatatgtatgtgaattcatgtggcatgcgcgaattcattccggtatacctttcaaggtatgtcgaaatttatgtggtggtcgatgtttgacatgcatccgatgttcgatggtatgtgcgaccagagtgaccacgggttatgcagccgatgcaactatggcgcatggtaggagttgcatggcgcgacctaatgtggcatgattcgtccagtcccccagtacagcaaggttgctagttggtgcatcgtacagcatttagtgcacggagctagtagcggccttagtgttcatcatgatgctgtatgatgcatgccaatgtctggtgcaagtctggcgcgaggcgctcaggcagtgcgcgtgacaaatatctcatcgtggcgatacgacagatgatgtgagattgtttgtgctatattcatttgcaagatactaaattctaagaaacactgactatgagatagcctattttagcctacatttcttagtgaggacattgatctcgcatgcttaggtgatgagtatgcttctctcatcttctagttcccacaagggaacttttctgcgagagtttgccattctcaagaaatttgaggtgtaatcgtttttctaccgaaaaacaatatcctttacaatcattgcatgcagttgtgaaggtagttcacgtctttgcatagattgaacttgtctcatgtctctcaatattacactttgtggtgcttttgttccacaatgttcctctttaccttaggctatgcatattgtctatgtgaataaagtaaaatatcactacttcaaggcaagaagtaaaactttatcatatagcaaaatgcaacataatattggaaataaagtctagccatgcaaggcgaatcacgaaataaatgttgtgctctcatagagcttacaaaaccattattcaaaaatgttcataatgcaacttagctcaaaataaaataggagcatcaaatactcaaatggaatcaaccagagtattgagctctgcaaagatctgctcctgggtgacggcctcttcatttgcttcgcctgctgcagctgtaggggcgtcaagtggagggagtagccgcagtgacggcctcacccatgtgtgcttctgcggacgccttgggcttcctgctggcctggtatgcatcgatgacgtgctggggctcctcgcaaatatggctccagtgaccccaattgccacagttgtagcatgtctagtcctgctggccatatgccttgtcattgcgaggtggcttggcttccttcttgcccttgcctccctgtgctccctgggcagctggagcttttccctctgacttctcagctaccttcttcccaccacgcttgcccctcttcctctggacaggcttgcggaccttgtaactgctagcattgacttcaaggccaacactcttgccaggcggttgggagacaaagttcttgcggagaacctcgtcatgagattcagacacctgcatgatgtcgatcatctcgtcatactccttgtatgacgcttgcctgtagttacaagcgctctgcacagtgctagggtggaaggtggagagtgtcttctcgatcttctccgtatccgtgacaaccttgtcgcagagggagaggttagtacagatctggtgcagcgtggagttgtactcggagacgctcttgaagtcggcgaacctcaggcgagcccagtcctgctctgcttggggcaggatggtgtacttcaacttctcgaaccgcttcttgagtatggtccaaagagtgagtgggctccgcaatcccatgtactcattcttgagcgtggcgcaaaggtggtgccgtaggaagtgcagcacccgatcgttctcatcaggggtaggcgctcggtcctgcggggtgcccatcccgatcgtctggcggagcttcttggctccaaggacgatctagacatcggatccccaggtcaggtagttctggccatgctaagctagttcggcgaactccttattcgtgatccctgacattttattgcaaaagtactacaataagatagttgcaactatttcatgctttttccaatatttatattcatagggaatgcgaataaaaagtgcaaaatattaaataaataaatactagagttcatattaaaatgcatacaaatattcatacaaaaagaaaaggtgcaaaagttgcatatattcatataaatactgaaaacgaaaaattaaaaatattcattaacagtaataaatgccttaataaatttaaattcaaattttataagacagaaaatgcttaaatatggaatataagcgacatttgtaaaattcaagggcctatttctaagttttacatgcggggaatggataaaaatgaacgtttccgaaattctacggtcctatgcgcaaaaggtttccacgctgggagttatgcgcgtaatttttagaaaatctaggagcctttctgcaaaatcgccaatctatttccttctttcttcttctttcctgcggggccatgcggggtgcggccggcggcggtgcgcggctgcgcgtggtggcgcgcgcggcagcggcggcgcatgcggcagcgccatgcggggcgcggccgacattgcggcgttgcggtgcgcgcgcgggcgctagaggcgctgtgcggtgggcgtggaatcgggcagcggcgctgtgcggggcgcggctgttggaagctcgcggcagccgcgcgcggcgtgcggcgacgccgggcggggcgcggccggcggcagctcgcggcaatgcgaacggctgctacgacggcgggcggcggtgccgtgcggggcacagccggcggcggctcacggcggtgcggcggcgtggtcggcgtcgcaacgtgatgccatgctgcgtcgtgtctccgatccgtgcttgcattggtgaggttcgtctctgccatgatggatgatgccgagaaaaccccaatcaactagatgccgacgactccacctcggcgacggcggttttcatcgggagttacaaaaacggaacgaggaacatgcaaagatttccttttttctaaattcaatctacaagatgcaaagaggattcacgaagcacttcaagagggtccagtagagcttcgtacccgataacgtattaagcaaccctcatgctacacgaagcagtccaagagggtcacgtaattctacagaaagtggagacataaagtttaggggtgagactctttattatttaatcctccaatcaactgtacaaatgagtagcaacgatggtcagagttcgtttgacatggtagttgtttcaatcttttttctctccatcccaaagtgatggtggcagctaatgtttcttggacatataacagccttccagtgcctcatcttcttctctacttcgtaataatgataccctagtcagggttgtggaacctttagggtcaggggtattacgcaaccctcctgctacacgaagcagtccaagagggtcccgtaattctacagaaaatagaaacacaaagtttaggggtgagactctctttactattcaatcctccaatcaactactctatttttatagtgcattccaatatatgaaaggttcggtgataggcccattaagtgtattttggccagaccctcatggtccaagcccaaagtttcttaacaaggggcacctttgccctgagtaattagtggtttgggccaagggaccagatcatggattgggccttattgctcaactaaaaatggatcatggtgctaatgaaattctatttttgcctatataagtcactcagcctactcaaccaggcgaaatgggcatttcaattttttttcctttccgtggaaaccaggcagaccgttctgtgtatggcgaccaacaggaggaatttcattttgcctctctcaagtatgccacgagttctattaattcatctccctcaaccacaaaagttggtgtagagactatcttaactattaaaaccaaatcaatttgccttcccatacggttttaatgttaagtgtctatacataggaatcgggaaaaaaaaatccagtgagacgttcaacagattcatcacacacttgctatgcacactcatatagtacaaatagttgatacctcacgctttactgcgagatatacgagtgaatgcatgctatacgttataatcaatcaataactcccctaaccgtaccctttttctccgcgtttttaattattttcgggctatctcgttgctttacacatcgctcctcctcctcccggctcctcgcacgtgcctgcgtgcggtcaccagtccaacaattttttgggcgctgtaggggcgtgcgcacgcgtcggtctcgacggcaggttggaaccggtttcattagtaggctattttgtaaaaaaagtctttgcgtttccacaaaatatcgtatacgtccttggactggttcacaacccgttgtgtttgttacgaaaaagccctcctatttcacaaaaatacaatgtgaaaaatagaaaattccgttttaggggtagcgctataaacataaaaaacaaaggggtttttccaaaaaacaaccacatataccccaaaccctaaccacgagttgttccccactccccacatcacggccgccgccccacccacgccctgcgcctcgtgctcggcgccggcgccggcgcgggactccccccacctccgtccgccctcccgcagtcgcctccctcgtcgtccgccctctacccgccgccaccgatgtcatccgtcctccccccgttctccgttgactctccttgcaggccgtgcgacggcgcggctcgtggcctcgtcttcggtgccgccgtagtcagatccggccctcccgcggctggatccagctccgctgccgccggatctggcggccggaggagacggcgcgacggaggaggatgaccgcgataggttcgtacgacgaagcggcggaggccgatgggtgtggcaccatcgtcgccttcatcgtccgccttccctgcgacaccacactcccccccttgttctccccccaccccacccaccgacaacgaggcttgtggcggcggcgcatccggctgtgcacgggcgctgtgccaccgccgcctgtcatctcaatcgggtgcttttttggcccgattgagatggcttccttgtgacggcccactaatttcaggtattttagaggccatcatagatgagaggatctgtactagtataagtatgtttgaataatgtgaaaatgatgtggagataatgatgtggcattgcttgcatattgagttctaaaaatacaacaaaattataaatgatatgtcatatttgcatgatatttgaaatactctagataataattactagtgtgtgtgatgatgtggtagcttgcatgtgattgaaaaatgtaattaatacttaagacttgtagcgagaatcacgtgaaaaaattatttgctcgagcactaatccttagacacatatgagttaatattggttgtgatatctctcctgttacttatatcagttatgaatgttcgtggggtaacatatgacggaataacctatgcactgtcaaatttgctttatattttactactggtgagactatttggtcaaaacgtagttaatatatttataaatttctagataaacgatgagtagccactgttaattatttagaaaaaaaaaagagaaagagagcatgactattctatgtgataattttttaatatcaaatatagtcctaatattttccaacatacgtctagtttattagagaacggatggatgtttgcttgtaataagtataaagattcgagaagagaagtacggtacgtagtatgtacagtacatatttatatgtacatgttagaattgtttttagttttttgcggtgaacagaagtaatacgtatgcatgaatgtttctctcgtacgtagcaattaggtgggacagtcccaatcgtaattaaatcgtaagtacatttttttgttcgtttttttctgcgagtagtaagtatgtatgtttacatacaactattcacggatattttttttattcaggaaggttagctgagatgtattttaaataaatctcatttagtgtccatcaacttaaataaaaatcaagaatttgattttttttcagagtttgtagtaaagtaactcgttaattacagtgccgtttgtagagtacttatgtatatacacgagagatttattttctcaatctagtgaatcactagtggagaaaccgtttgtagtcccggttcgtaaccccctttagtcctggttgtccaaccgggactacgaatccgggactaaagatagcgatctttagttccgggtgaaataaccgggactaaagatcgatctttagtctcggtcggtaacacgaaccgggactaaagttcggtcagatacgtggccggttgattcatctttagtctgtgtaccattttttttatttgcatagccctgtttgctgcatggttgattatatatatatatatatgtattctatatatatgtattgtatatatatatatatattacaatacatatatatagaatacatatatatatatatatgtatctgtgtatgtgtatatgtataaatacatatattacacacatatttataatttaaagcacttaacattttatgtgtatatatgttaccaaaatatatattaacactaaagtaaatgtacgtacatatataaatatatatatataaatgcatgtatagtacaatttatttgctcgctagctatagctacgacttcgacgccagcgttacgtcagaagaggaaggaccgacgttatggattgtcgatccgtcgtagtagaattcaccatcgggaataaggtcttcttcgttgatgaaccccatcagttgttcttgaacagccgtgataaaatccttgtatgggagatttttcctcatgtgaatacgctatcattcgaaaaataatgacatatcaatatatgaaattaatatacaacttaacaaatcgatacgcaatgaaattttgaatggtttatgtatacatacatcgagctctcgtgtggtgtatatttggtttgataggcagtgggcatactcgcatacgtagtagccgcataagttagttccctggtcctgctttgcacactacatgagaaacgatgagagatttaatatactctttatattaactgtaattagagattcaattcaatataattttggatcatgcatgtactcactggaaaatgaaacctccgtccaagtttttctttccaagtcccgcggaccaattgacggaaccgatcccaagccctacatgtgcagttgcaagctatgattaattaaatattacccgagatcagcataatagcaacagagtcccgcgactttggaatagatggcattatattacatatctatcagttggaagagcttgtcaaaaaccttctcctctttattcattgagtcgtacacagtgactctgcatgcgtccaagtcgaaaaagaacaggacccagtggaatctagaatatgcgtgatatgagataaatatcagaatgtacatgttatatgtatgggaacgaaatttgttcgaacgacaataaaaactcactctgtgttgtacgtcaatagtatgaacgtcttgaaatgctgctgcgttaggagatggacgagattgtcctctgtgtctttctcgtacttgtcgagcatttcggtgttgattttccgagggtcgatgaacccagtatcgtaaaccccgtcgggccctttcaatctccattctacaataatgaaaggaaattattattgcttacacatatgccaggagctaattattgaacgaaacaaatcgaactcaaagatacttacaaaatccatgcgctcagaagagagacgtcgagggcgtcccgatgataccgatcgaagacatccttgaaatggatccttagaacatcttctccttccaagaagtcggggtttctgatcctcgctccgaacatctctctacccttggcgctcatttccatgtaccgttcatggaatttgtacatttgtgttggtagggactgcagctgctcaggcctgacaagcggtttaccgagttcaaacttgtatgccacttccgccttcgggattggtgcgcctccaaccaactgagcaacagttagaccggtgtccgaaatgaaatacgttatgccaaagtcttcgccggtcgccaacggctcgaccacttggtttggttgtctccaagctgaggaactggtttggacttcttgtaataggctttcctaagtgttcggtcatagtccgatagctttaaggcctccttgtttgtggtggacattcccttgaagaaattcttcacgctcgggtcaataggtatcttcttttcaggactccgaggcttgagttgcctcttcacttctcctgccacataagcgtcaagctcctcttaactgcaatcgtacggcggctccttgtttttggtggtgtcaacttttgtccttcttcgttgcccttgtgctggcaggaggtggagcttggcgagaccgtgtcttggaaggtgcaggcggacacggtggaggtggaggcggagaagccggaggagccggaggagatggtgcatgagaaggcggaggaggcgtaggagccggaggagatggtgcaggaggtggtggcggaggagctgaaggagatggtgcaggaggagacggtggagccggaggagatggtgcacgagacgccgcttgtcgcccagggaggatgatgtaccgtttgcgccatagtataatggcgtgccttgtgtctcgtagatgcgtctcaccatctcctcctaggtagtccaactcgaggtcctcgtacacggcttccaccagctcaacttcgaccctcgagtatcctgctggaatcggcctgcagtggtaagtccctgaaatgtccgttgggatggccattcccgacgccaccttcacgtgatgagaggttatctattagtaatcaacctaagcagcaacttgcggaacgtacaagtcaaaaatcatatattacatcgaggataccttgattgataagttcttgaagggaatatgcagctcacatggtgtccgttgcgtgatctcatcaacggggcaggtggtttcatcatgggtttgcatggcgtccatgctatgtgatcctacctgccccgttgaggcgcagctgctacgattacctgattggctgaccattggaggaggtatgtacggctagggatcatgtgaccgatgtgctgccatgcgttcatccaccttccgggccacctaatcttgcatgctgagctcgtagctcgataccctgtactcaagatctgcaatcttcgcctcggtatctctcttgctcctcatccgactcctgtacgtgtggatgtcctccttgaatcaaatcttccagggaatcacgccttttactcgtgttcgtcttggatgctcgggaatctgtagggcgagtgacagctcgtccttctctctgtcgggtcggaacgtgcactgagaagaggcttccactatgtccgttagtcgactggcagcctcacgtatctgatcgctgaagaccagggagccatcaactgggttaagcgttccaccgtgagcatagtaccagaacttcgatcgatccggccatttagcggtggccggttcgatacccctctcaatcattcttgcctccatctcctcccacttcagtattgcgacgctatagccacctaaccccaagtggtgatggtacttcttcttggcagcgttttccttgtttttgaccatcatcgcttgcccttgttgccctgtcttgtcagcaacgaactcgtcctaatgatcccttagctttgggaatacgtcgaagttcggtgttagtaccttcaggatgtatttcttgtacagatgtcccttgaagctcttgaactgttctgccattttcttaagagtccactgtttcactatgttctccgtacccgcagggagcgtgaacgtctcgagcattgtggtccacagcttctctttctctgattccgggacaaagctgtcattatccccgcgtgcccttgttctgcgctagtacaccttcctgacaggcacgttatccctcacaacccaaccgctgtgtcgtacaaaattcttggctacttctgccgggacactaggtcggccgtctgcgtccacctcagttatgatgtgccgaccctctatcttcttcgcagcacctcgttgtccgcgtgccctcttctgtccagtggagggatgacttccactagccgcctcctcgttcccctccgcatccctctccacgttgccctcctcgttcccctccgcatccctctccacgttcccctcctcgttcccctctgcatccctctccacgttcccctccttgttcaagtactggtttggatcctcgttcccctcttcttcgttccagtactggctgcttccctctgcgattgtatcgtacagtatctatttctcatcacgatcagccatctgttcatagaagaaatatttgctaagcgtaatattaaaactctactaatcttgtattaaaactcaaataatcatatatgctaagtctaagtgtcgtgtattagaaccctagataatcatatatgctaagtctaattaagtttcgaatattacatctctaataatcttatattaaatctctaacaatctctaacaatcaaatatgctaagtctaattaagttccgtatattaaacctctaataatcttatattaaatctctaacaatctctaacactcacatatgctaagtctaattaagttccgtatattaaacatctaataatcttatattaaatctctaacaatctctaacactcacatatgctaagtctaattaagtttcgtatattaaacctctaataatcttatattaaatctctaactatctctaacactcaaatatgctaagtctaataatctaataatcactaacactcacatatgctaactctaataatctaataatcttatattagaaatctaacaatcttatattatatctctaacaatcacatctttacatcacttgcctgcacgaattccttcgagggctagctaccacttcggcttgagggacgacgacgatgacgtcttctctgcaacatgcaaaaaaaatgtattagtctaaacgcaaaggaacatataatgtatttcacgttttcaagtatatataatcatatatatatatatatatatatatatatatatatatatgctaagttcaacaatagtttaattatctcgttcgtacacgtttcgctcgcgttcgttcgcgttcgttcacgttcgttcgcgtttcgttcacgttcgttcgtgttcgttcacgtttcgttcatgttcgttcacgtttcgttcgcgtttcaatcacgttcgtttacgtcgttcgcattcgttcacgtttcgttcgcgttcgttcgcgttcgttcaagttcgtttgcgttcgttcgcgttcgttcacgtttcattcacgttcccctccacatccctctccacgt

SEQ ID NO: 73847 - DNA, 53187 bp, Oryza sativa
attcctgcagcccgtaacagtagtaagtgctggccattatattcctaggattaagactgagcatactcagtagcttttcaccttgcctggccaaattgatcgacctttttctatcaacttgtgccatgataagattgcttttactgccacttgctagagaaacggacgcagagtgaggagaatcgacggaagggggaaaagggaggggggagcgggacgacggcgcttggctcctgccctgctatgcgcgtcaaacgtggaaacgaccgggggagcaggaagtgatatgtatcgtttggaagttgggctcactttggcttggcccgttagacgaagacatcaggctttcaggtgttagctggacggaaaaagtacaccgaaggtccctcaacatcgagttacaaaatcatccttcaaccacaaaaccagatatatgacattcttcaacttacaaaaccgttcactttaggtcctccgacgtggcggctgagtcaatgtaggacccgcgtggaccccatatgtcagactgtccacgtcagccacttcttaccctcccccctcaactcacttcgtctctcctcccctctccacggacggtggccggtggagagcagccagggcacggcaggatggtgcggcaggcatggtcgccagtgcagaggagcacgttgcggtcgggcgccgccatggcctgccttgtctccgccgcgcttcgtccccgctatggcctcccttgtctcctcgccccaagggtcggcagcgagcacgactccgcgacgcggtgtgccccatcaaaggcctcccggccgaccagatcggcggatgcaagcggggaggggcgttagtggcgggaccataggggcagagcgaaggggagttggaggtgagcagcggtggcgaggcagaggaggaggacgccactctgattaaactcccatctagggtgaggaaggagcagaagacgaagacggcggcagcgggagggaggtggggatggaggcggcgaggagggaattggccggccgacacgctgtcgccaccgccgtcgttgtccttcctgcccttgctcatccgtgaggctgtccccaacgagccgccgctccagccgtcctcccccatccccgtaccaggcctaattaagccgtcattagcacatgtgggttactgtagcacttaaggctaatcatggactaattaggctcaaacgattcgtctcgcgacttacatgcaaactgtgtaattagtttttgtttttatctatatttaatgctccatacatatgttaaaagatttgatgtgatgtttttggaaaaaaaaaattttggaaactaaactgggtctcagaccgttgggattgggacaagaccggtcagatcgccattgcgccgccggtcatatactggtagttaagttgtggtccgaccggtcgtggcccagtcagaccttcacatgactagtagtctgacaggccttggtgtaaggctctgaatatttccaaatttaactcaaaatcgttctatattgagactgatgctaaatttggttgccgacaaatgccgagcggttaggaggtagtggggagacaacgaaggtgaggcaggacaggggagtctcgtcgccatgggagaacgacaagacagagaagaaggtcagcaaggttgctcgagaaagaagatgatctgatggtggagataaaagtgactgacaatcccacattcccactgggtgaaggcggtcttgcagccctctgaagttacgggagaattgttcagttatctccgtttggtccaatgcgttgttcattgggttgccatgagtcaaacaactgaacaaggtgaaagcgtatttaactgtagaatctgatagcaaagatgtgtacatataatttgaagaggtagaaactcaaaagggaaaagcaaaaaaaaaaaaggaaaactaataaaatgtatgatcacgatcaatgaaaaaaagacacagggcagtacttaggacttgtagcacaaaccgaggaacaactactaagattggagaaaatatataaataataaaccaaattgtgcccagtgatcagcctggtatgttcttcaactgcctgagttgtacataggttggttctatttaaaagatgagttctgcccactgtgatctccatgaagctctccaatcatgcaaggagtataaacaaatgactcatatataccatttgtatagtttcggtagtaacactttgggcgtgagtagcccagatattggaccttcgagctatccaaatgataggctactgttctgaatgtttcatccaagaaaatagcttccttataaggatgaaatccaagaatatctaagtgtgcataatcatgtactgattacttggtacttgtcatttgacagtgaaaacctgaaaaagaaaagatgagtcaatttacaacatataagtaattcatatgatatcttacaagttattaaaatattcagcgtatagaataacgtgagcataaacaaggataataaacacatccaacttgtatgtgcagtagtagcagtactgaagctaaatttgctaatcattaagcttccatagcatagcatttgtgtcctttactgaaaattatgaacactacctgattttggttgcaactgaaataacttctgtaagagtgctagcaggtttcaaatttcgaaagaagggtttctgccggaggggagcgaaataaccgaaatttcggatttttttctcgtaccaaaatatatactctcaccgtcccaaaatataacatgctagagcttagatgggatcctacgaatctagacaggctctgatacatctaatccggtcctaagttgctgaagatggattagaatctctctagtggacatcctaagttgctatatattttaggatcagtaaatgaaccaaatgtgaaataagaaacgagggcccaaggcgtgatctgctggcgatgaacttacctggtaacagaagtaccacgagaatgcacatacagtgctccctgccaggacacgctgtaccggtgtacccttggcgagggccttcaagaggacactcccatggttccatgtcatccaccgtcgtcgtcgccgccgccgtctcaccgccttccctgacgaaggccctctcctcccaccgcccgctcctcgacgagaacacgtacaccttgtacggcgacggcggccattccatcaaacggtacaggtcagcatcacccatggaggacgccggtggagatggtggcggcggcggctccacctcctccatagtccagcaggcgccgtccagcgatgcgagcagcgaatccaggcagaacggcggcgcggtgattgctttcgccttctgctttggtggtggcggcgggggcttctccggcaagccggggatcaagaacacctcgtagtgcggcggcgacgcggccgccggatcgaacgcgaggtacgcgccgccggtgccgtagcggatcggcttcggcgactccgggcatcggggcagcgtcgcccaccgccgcgtcgccgggttgcagacgcagagacgattcccccactcgacggcgcagaggaggaggccgtcgcagtggtccatgacgtgccaccagtccatgtcgcccttgggcggcaccgaggagaggttgccgtcgatatcccccccgccgctcgacgccgccggcgaggaggaggaccgggatcgggaccgggatcggcggcgggagaagaggtgggggcggtcgtggtcgatgtagttgatgaggacgccgtgcaccgagtggggcaggaggcgcgggaggagcagcgcgcggccgtcgacgaggtcgcgccacggcttgcagacgcaacgcgccgcggcgaggctgcgtggcggcaggcggcggaggatgtcggcgagggcgtcgtccggcaccggcagcgccatgggggatcgatcgatcgatcgatgggtacgagctgccgcagttgatcgatcgatgggtacttttttttttatcgttcttgttaagcagcatgatcagatcactcagactcagcatagttaatgggcccaggcccacaatataaaaaaaaaagaggaaaatgtctctcggcttcttcggtccaatgtaattgatgtgtccactggctcatgaaatgtcgctgataggtgaccatgctgcaattttttacttaaggtgaaaacttgaaaaccgatggtcaccggcgagcccttcgccaccggcatatggcgtcgttgacgaggccgagcccggcttcgtccgcgcggatcttgctctcgtccgccggctcgacgctctgcacgccgccggccgggcagctcaccctgacgccgttctgcgggcaggcgccgcacccgttggccacggtcacctcgtactccggcagcccctccaccaccttccctgtcctcgccgccgtgacggtgatgcccgacagcttgccgtcgccggcggcggtggcggcgttgcccgagcgtgctgcgtgacagctaatgacgatggcagcggcggcgaggaagaactaagaagaagacggtggcatttgccatgcatgccatttctgttttgcttctgatttgattttcgtttgatttggagtggaagaagaggattatatgtgggtgagaggattgatcattgatgtgtctgaggagaagaagatagaggagattggaaagatacacaaaacgagacgagccattagcgtatgattaattgagtactgccgtcccataatataaaggattttaattttttattgttttgtttgatcattcgtcttattcaaaaaaatttggaataattatttattttatctgtgacttactgtattatctaaagtactttaaacacaacttttcgttttttatatttgcataaattttgtgaataagacaagtggtcaaacagtaccagcaaaaagtcaaaaacccttatattataggacggaggaagtattaactattttaaacttcaaaaatagattaatatgattttttaaattaactttctatagaaaatttttacaaaaaacacatattttagtagttcgggaaacgtgcacgcaaaaaacgaaacaaactcactcaaaatcacccaggaaaaacacagccagtcaaatttggtgtgtgatgattcggaggagaaatgtgtcagaatgcactgattttctgtcgatcgctaccgctgctagttttctcgaattattgccttcctaaagtgtaaaagttcctgtattagttaaatttgaaaccagattcatccgtcttaattttagagaaaagctgaataccggccgactaaaaaaatggctacgccaggctgcaatacgacgatgtggcatagttttgcagctcgctgggttacaatagtagactactagaaaataagcgcgacagttggcgcgctcgatttatagcctatgtatgttatttttgtgttattaattaacgcatttttcataaaaaaaagttacagaaatcagtttagtttccttgaaactcatgtaaaaatcatagttgaacggaatttttagagttcctatttaacataatcaatcatattgtagagaaatttgtcaaactttctctcttttttccaaccatactattaattcttcttttgtttatctaaaattataattaaattgctattaattcttcttttatttgtctaaatttataattaaattgtttgctaatgataaaataggtgtcggtatttcttttattttaaaaaaacaaagtgttctagaatttcgttttgttaggagtcacaatgttttgtattgatggctaattagtggtaggtgatatataggttgaccatgagttatatatggtgatttaatctattcaaagagaaagtctattttaccctctgaactatttcgccagagcacttaacctcctaaacttttttttactcattttacatcctgaattattgaaaacagttcactttacttccctaatggtatttctctctcttttttaatttctctatactagtagcatgcccgtgctaacgctacggcgatattttattaattaaccaaaagataatgtatcttttgccaatcaaatataaaatgagataagttttaagaactaagaaatgtcaactaaagatctgtatagcattagtgtcaatccaaattgtcaaatcagccatactttgtaattgctatatacagaatgaaaattgttcatctccttgatacaatccatttatttttgttgcgtgacaccccatatttaacaatcacaaagaggatcaccttaggcaatccgatcgaaacaatgtcgtttgtcactacaagcatcacatgaaagagcagtatcttgatatagaactgttggaataatgttgcatgccctctctgagggcaccagcacaagctacaacatcatctgaagctacgcaattcttgctgaagatgtggtagatattgatgtccaagggaaagggggcggagatcgcatgtttctccgcatgggtaacgttacggtgatatttgatattgtaattcaaacatccaaagtataatataggttttggcaatcaaaactacgatgctccagatagtttatagattggaaaagaaaaagaacaagtgagataattatattgctcaaccatttatcaacctacagtgtgcataaacaggtccaaatatacgtattctataaaatacaaaaatatttgcaactaatgaaccgaccccatacccagaaaatattctatataaaaaatatttgaatccaaatggggcatataaagttaaaaaaaagaaaggaaaataaaatttgtgtgacacccaaaaaaaaagaatctggttgggggtgggggtggaggcgaccgaccattactttctcgcaattatatattaaaatcttgctatatgtagataatctgagctttgaactgctatattcatttatcagatcatctcatagagttgtaagcattcaaatttgtacaggactgtttatcaaattttatcgagcaacctatcaaagttcatccatcagtttgctataattttgatttgttaacaaattacttaggctgcattaagttgaacacattaattagtaaccccacaacacctgaacactgaatgaggatttatcggattagggccaactgataaatccagaaaatgcatgctattttatctaaaacagggaaagctgcaaaaaaatacttccaaaacagtagcagaggcaacatatcgtgcccatcttgccatccatatcaaggaaacatatgttttcaaatctgctttagaagaacatgtgagtaataaattagtggactacttacctccaaatctgaagagtaatctgcgattggattcaaaacaaacagaaagctctatgcataggggataaatatcacaacaatgaactgctaaaagctatattaaactgtttggtccactcgtcaagtaactataaagggcatgatataagaaaatattggacacgaaataatttcacaagattttgccggatcaaagggaaatcattagatagtatagcagaaaatcattggatttaatagtaatagattgcagcattatttgcataccaagaactcgtggtccttggtagccattggagattttccatcaggattgcgtaaaatttcaggtcaacacactgctcctcatccgccaaacaaaagcataaaaaggttgatgtataatgtaagcactaaaacagaaacaaagctagaaaacaatatgtaacatgagtaggtgtagaaaaaggagcaatctagttagatttgctatctgaattttgttcagtttatgcttgttgcaaacaatttaggggataggtaaggcaagctttacttcatgggatatctcggagctgatagtttgtcatctggctgattgcaaagtcattattctgattaaagaggtctccatcctcactgcgacaaaacattcagcaacaccagtgggcagcatcaccgcctagcaggtcaggtgtcaccgtagattcaattttctccaatggaaaatcacatcaattttgttaagtatttacatacagccaaatctaaatctaggataaatcagcactgaatgcctcagacactgaatgacgcttgaatattgtacagaggtaaacagatcgacaactacatctatattttttttaaagaaaaactcttcatgtactcaagagtgatatgaaataataccttggagctactattaccatgtgcaagctagttgccacccagaaaaaaacccagaactatatgtatatttttttcccaacttggacacaatacaccgtgatgccatggattacggtaccatttgtgtcctccatcaagatatgagaggaccgaggagagaaagtttgttgtttcagatactgaatcacactatacaccaaataaatctgagctgttgaaaacaccatgaactccgtatatacaggagattaattaaaccattgaatcatattatcgagcagtagggaagcatatacacaaagcaatgtacctggtggcaaactggatgatccagtgggctcagtgagcagtagagatgccatggaggacagccagcaatccaatctccattaccagaaattaaaatttttatttatgaagaatgaaaaagtaatgagttaatataacggatggtccaattagtaggtccaaaatcagtttttgacttcagctttgaagaaaggaacagaagatatgatgaagaaatgcatggcccgggtagcctcagttaccgtaggcacctgctggctgctgcactgttgacagatcgaagcattgctgctggctggcgacgacgacgggtcttggagaagaccttgtgccggcggtggtactcgtggccgcacagattggtggaatggtgggtgcaggactgcagggaggcagagcggctggcggcgttcttcctttttcacggatcgggggcggagcggtggagggagaggcggcgatggggagcggaggaggcggcgacaggagagggcgggcgggtgcgattgataagcgcgtggagcggttgtgggaaagaggcggcgaggaaggcggagaaaatcgcgtggcgtgtgggagggaagcgagatctgtgagggaggcggagaaacgtgcgtgggtgggagcgatctgcgaggggacgtccaagcaatctcggtcgttcgatcgaatacagataataccgtccgttagattcggacaatgatgaatgagtagatcagttggtgaagttagtgaattatagggtagataagtcatattttgcatgcatttacaaacatacatctcaacatttttttttattttttttctcattgtttatgtaggttgaaagcacttaagactaatttaaacatcacaatttaaagttcaagcaaacatccataacattttttttaaaaaaatgaactttaataatgatcccatgtatggttcagtttaaaagacaattaatacaaagagtaataaaattgagacgtgctattatggagtaaagtgaaccgagccaaaaattagatttttttaatagtgtctattgaattagtacgaagaaataaaatatgttttttattttaagatatgcagttcaatatttcaaaaatactcatagagatatgtatgaatatgagtagttgtatatatatgcattcaacattttttttttgtaaatgtactatagaatagtaatgactattgaacgtgtatatgtagggcaagtgggctgacataggcatttgctccttcccctaattttccataggaataagttcatccgaggtcccttaattttacatcgaatccaatttcatctttgaaccctaaaaccagatacagccggttcttgaactgtcaaaaccagtataaacaaagtcccttggtggtttggaaggcggttttgacggacgtggtgcccacgtggctagtttgactaggtctccatctgttaacaaccaaaattggtaaatcatgcatcggccgaggcggattcggaaggattttttcagatggagtcagcctcagtcctgccttccctctcccttctctcttcttcgtcctcacttctctcttcttcccccccccccctctctctctctctctcttcgtcttcccgggcggcggacggcgcgggtgggcggcggagcaggcgagcgaggcgggtgggcgagctccggcggcggcggggtggccttggccgggtgccttggtggatttggtgggtggcgcggtggccggacctggggtggtgggcgccgcggtgggggccagggtggcggggtggaggagaccgacagcgtggtggttggcgccgccgcgggggtgggcggagatggcggatttgggcgggaggccgctggcccgactcactccccgcccttcacgacgcgctcgccaccgcccacaaggagcgccgcaagctcagacccatgttcaacgtcgtgccggggctcgacgggaagcccggctccgtctcgctcgagctcgggagcaagcctgggtgcttcttgatcgccggcaccagcgcgaaggtgcaggttggttgcaggagccgcggcggcgacgggttaattaattctttgatcctttcgatgctcaatttagtaattagcatggcaattagcagttgaatgggaaaatgagttggatttacatatgtacactctgcctctcagtgtttactggagtagcagtgttgttactctgcaatgtcagctctttatcttgccattcttttcttagaaagagtatatacctcttgatgcagttgagtatactcgaaaagttctgcaaatgaaagagtaattaaggatcaaggatattcttgacctgattcctaaagcgcattttctgatgcctcattccaaatgcattatattagagcaagtacagtagcaggctataagtcagctgtagcacgcactctaagacgcagtgtgtgtatggcaagtgggaacatgtattaatagtgtgatatgaccaggtattaatagtgtgatatgtaactattgtatgaattagctattagactggctataaatgaattggagctagtagttggctatactattaaacttgcttttaccatcttggtgtataaaacattatctggaggccatgattacaacatactcctctctttcttagataactatggatcatattgcactaatctgattggtgcaaattgctgcaagtctgcaacttgtcgacgcgctccgggagcatggcctcacgctgcagaacttcgcgtccattcgggagcagcaggtcggcggatttgggcgggaggtcgtcggcgacggcgaggtcaatggaggaggcggtggcatgggcaccgacgcccagctcctctccgccgggtgccgcagccagggccacagccgccggagccgtgccaccgtcgctagagaggagaggggagagagagttgaagagagggagaaggggagagagagagaggaggaaggagagggggctgagaatgacatgtggggtccacgtgggccgtaccattttttattaatttctatgtgaaactgatatgtgggtctcataaggtttattattttttcgagattgaattgtcacgtaagcgccatgtcaataccacatcagatgaagactaagtcaaattagccacgtaggcgtcacgtcagctaaaaccacttttaaaaccgccgagggatctcatctgcactggctttgatagttgagggacctattgtatctggtttttcggtagaagaacgaaaatcggattcgttaacaagttaagggaccccatataaacttattccttttccataccgcagggcggctagataatgggcttcttatgcaggaggtgctttaggcccagatgcacgcgtacgtacgcgatggatagagaagaacagcagccgcgctggagaatcatctatacgttgttggttcacgccacgtgtctgaaaatacaagccgtcatctccaccaatcagctagcgggaagacccgccagctctagatagatagatagataagtcaactacaaacatattttaaaggcaacatatcctatacacataggccctcacgtgtacacacgtacacaccaactaaaaaatatcactaaaaaatttagaaaaaatcatacacatactttcaattgtattacacctagggttaaaattttaacgtcaaattcactgtattttagccgtaacaaaaaaaacaaaaaatctgacagttttaagattgcaattttgtcataattttatcttttttgttattctctatgtagaatgaatttgaagatgcgactttgcacgtagatgtaatactattgaaagtacatatatgaattttcctagaattttttgtgataatttttagttggtgtacacggtgtgtacacgcgagggcctgtgtgcataggatacactgcctattttaaaaagataaaagaaaaaagataagagcagcgggctacaaatttatagccggatgcagcacggacttcaaaacacatgtgtgtatgataggtgggaccagatattgattgtgtagtactatatgtttatatgtaactattgtatgaattagctattaagttaactatagatgatttggagccagtagttggctatagtattaaacttgcttgcttgaaaacttgctacagacccttgaactccttgaactctttttgggtgtcatgctttgctagattttattaaaaaacatcatagaaaggctgtgtttagttcacaccaaaattaaaagtttggttgaaattggaacgatgtgacggaaaagttggaagtttatgtgtgtaggaaactaaacacgaggtgtgtttagttcatgctaaaattagaagtttgattgaaattggaacgatgtgatggaaaagttggaagtttgtgtgtgtaggaaagttttgatttgatggaaaatttggaagtttgaagaaaaagtttgtaactaaactcggccacggtgaaactttaaacatcatatgttggacacgaaaacttatgactgcacttataattataagagcaggtacaatagctgactataagccagctataaccacatattgacgtgaagagagaagagagagaagaaagcatgctacatatttgtagccggccgcaagacggactccagacattatgtgtgtataagatgtgagaccagatattaatatgtattatagttttatagttaattattgtatgaatgggttattagattagtttatagatcatttgaagcccgtagttgattatattattaaacttgctctaatgggagtatgggacagagggagtagtacactactgatcgacctaccttaaaaatttgctacctttgacgagtcaaatttcaccgattgaagatagagacatttagtgcagctgtacacgttatacgagaaatctaatttgtgcagcttcgctacgtgccaacattttgagcccaacaggctcatggcatatctgtctattgatatggtcatacggagtagagcggatgcggtgtccgtgtagccgcgcctgatccttcgctctcattttatttttccaatgaaaaaatgtgaattgaaacttgaaaaagtgagttaacattcagtttaaatttcaaaaacttccaaccaagttttaaaactttcaactgaatatttaaaactttatactgaaaatttctgaacaattatttttaaaatttcaacaaaattttagaactttcacctcaaaattcaaaatgttaaccaaaatttaaactttcaactcaattttttataaaaacctttcaactggaattttaaagtttgaactcaatttcaaacgtttaactgaatttttaaaattttcttctgaaaattcaaaatttttgaaactttcaactttgtattaatatgtgtttagataataaaacttccgattcaactttatattattattttattgctgaaagaaattaaagaggtctaattggagatagaaataggggggttaacggggtgatagcgtgcagccggtgtactaagagcaaggtcaataatatagaccgctgttgactccaaaaaaaatagccatatcatctatataaaacagtgtagctaatgtctacaatagaaatattgtaacacgcatattttattgattcgtgggacccaccatcttctcctacctcacatcctctttctccctcctatcccctcacagttcgtcttcttctcctatcccctcgataacctatcactgacgatgaaatacggcggcggccgtgcggcagacgtcggagatagcggcagccgggccgcggcggaggcgaaagacgacgacggccatgtggcgagtgacgggggcagcggcagccaggccacacggcggaggcgaagtcggcagcgactgtgcggcgggtgacaggggtagcgacggccgggtcgctcggctgaggcagaagacggcggcgaccgtgcggcatacgtcggaagacggcgatggccaggccacgcggcggaagcgaaagacggtgacggccgtgcagtggacgacggggacagtggcggccagcccgctcagctgaggtggaagacggcggcggccgtgtcgggcggcgaaggcagcagtggccgggccgctcagctaaggcggaagacggcggtgggccgcgcagcagaggcggaagacggcggcgaccgtgcaagcgggggcgacggaggccatgcgccggatgtgggagacagcagaggtcgtgcgtcggcgccggcgaggctgtgggcggcggtccggtggccgtgggagttggtgacggaggcatgcagctcaaggcatggccgatgcttctccatgccttgcactttgctgtgagaagaggcagcacaaggtgggccccacaatctcgagcggcgcgtgcagcccggcgataaattagtcgccggctcacactctctctctcttcccctctctcctccaaatcatcccaaaatcctaggtggaactaccaccgcccattactgtacctgctctaagcgaactaacgcaattgcgccactgcgcgtattaggagtcctccccatcaacgttatttaataatgtgatgaatccaatatgcatgttagtatggcctcgtttagatctattggcaaaattttataccctatcgcatcaaaataactaattacacagattgcacgtaaaattgcgagacaaatattttaagcataattactctatgatttgacaatgtggtgctacagtaaacatttgctaatgacggattaattagacttaataaatttgtctcgcagtttacaagtggattttgtaattaattttgttattagtctacatttaatactttaaatgtgtgtctatatattcgatgtgacacgccaaaactttagactatggatctaacacagcctatgttacgaaatttatagtctgagaagatattcgagagttaccacattttcctcccagtactagcttagtttacgccctcaaatcaaatcgagttcgactggacaagaagagcctcttggcctgagagcaggtgaatccgtatggatgaacgaggacgacgatgaatccgtatagctcggaagatgaggcggcgcgtggacctcgaccacaccctccagcatctgcaccacttgatggatcgtcggccggagcgacggattgtgcacgatacaccagaaagccacacgagcgaaccgctccactctctccagatcctccgccgcatcatcgtcgctgcgcaggaggacctccaccctaccatggctgaccagcccggctgcccacccgaacagagtgacggtgtcatcatcgcaatcgccattgtcatcctgatgaagctggctggtgatcgggtcctggcatctcctgcagcaaatcatctccagcagcacgacgccgaagctgtacacgtccaccttggtgtcgatgcgcctgtcgccgtgcagccactcgggcgcgatgtaccctctggttcccctcacgttggtcaccgtggtgtgcagctgctcatcgccgaggagcctggagatcccgaagtcggctatctttgggttgttcttgtcatccagcagtatgttgtccggcttgatgtcgcagtggatgatcggcgaagcgcacccttcgtgcaggtactcgatgcccttagctatggcgagcgccgcctcggcgcgccaggtccatggcggcggcggcggccgtcgtcgaggctgctggtggaagaggaagctccggagcgagccccccggcatgaactcgaagacgagcatccgctgctcccgctccttgcagtagccgatcatgcggacaaggctccggtggtggatcctcccgatggactgcacctcgttcgcgaactccctctcggtgtactcgttggagacgatgagcttcttcaccgcgatgtcagtgtcaggtgagtgcagcagatgcagcgaattcgccacgccatggtagacctcgccgaagccacctcttcctagcaacctctggaaaccattggtggcatcgtaaagctccttcctggtgaagagtctcatcaccatgtcatggtcgctggagcttcttcttctaatgcggcggtgcaggagcacgaggctggtcgtagaggcgagcaggagaaacgccgagaaaccgaggaggagtatgtacggcagcggtggcgccctcctccgcgccaccgccgccgccggaggggtactgcgcgtccgaaccttgatcagcgccttccccgtgacgttactcccctgccgtccggcgcccgtgagggacgccatcttggtgcagcgggttccgtcgaacagcgccgccacgcagaagcagtcgttcaggcacaagccgccgcactgctcctccgccgtgtaggagtataccttgtacggcgaggccgtccaggtggtgttgggcagcttggcgatcacgaattcgccggagcggttggcgacatcgtccccgacgaagtcgcacctcggcggcgcgaacgccggcgagcagccgcggtaccgtagctgcgcgtcgacgaaggagtatccgctcgggcacgcacagtcgagccggccgtcgtcggacacgacgcagtacgagttggggccgcagaaaccgtccaggccacgggtccccatgctacagccgtcgccggggaacatgccggcgacggcccacgacgcgttggcggtggtggtggaagtggagctcgtcgggctccttcgccggacgtacacgcggacgacgccgtccgggtcgagcgtcgcgcgctggtagtagttcgccttcgccatgggagttgtcaggtcgtgcaccgtcccgtccttgacctggtaatagacgcgccccggcgaggcgaagaagagagtggtgttgccgtcctgggtgttgccgggctggttggtgccggtcgcccagtacgcgttgtacgggtcgacgttgccggcggcgaggttgaggtacaggacgacgttgccgtcggcctgcacgtacaggctgaagcggccagccgagaagtcggcatcggagcgcttggacacaagcgtagctccggctccggtggccatggactggccagggaggagcgtgtcggccgggtccctgaagctctcccacaccacggcgcggccaccggcggcgaggaactggaggttgccagagtcgagcagcacgagcacggagccgtactgctggcccgggttcgcgttcgtccagacgttgctgccggcggtgtcggcgagcgacagctggccggcgagggtgacgctgaacacagactgcgccgtggccgtcaccgccgacccggagcccgggtccctcgcgtaccataccaccgccttctcctgtacggcgtcgttgaaccaaacggcgaggagaaaccagccatccgggcggccggagccgagggcgcggaagccgaaggcgaagtcgccggacgggctggtgatgtagtgaggaggcctcagagtcgatcctgccgtcaggttttctgcttcaacttgaagcagacaggatgattgatgcagcagcagtgcgatcagaagcagcgggacgaacgagaatgacttcatttctgctcaataagctgctattgcagctggtcacaccaattttgtgattgtgattatagtggtgccagtgccagctttcttcatagtcatgtagtagtaacttgcattgattggccgaattttacatctccggacgtcctgtttcatcgtacttaaaaaaaatgtttctcccttcgtccacaaaagttacacgtattacttttgacaccaagaccagagagaaattaaatcaccttagatgttacaaaattaaagaatgaatgcaagcatgcaaccaatgagtatttagatgactccttcagttctaataaaatatttaatttatctcttcatttaagtcttgaatgtataaagactaaaaaaagaaacgacttatttagaaaaactttaatgtgaaataggtgtaactttgtggatggatagagtagtacgtactctctatcttaaaatataaagaattttaaatggaagtgacatattctaagattattaatctaaatagttttattataaaataatgttttcaataaaatcggatgcgcgtgatagttcatttgttcaatatacacgttagctgataaaaaaaatttgcatcggacggcggtttcgtcgtttgtatacgtggtctcatgtggttgtcaaggtcaagcatcacaattcacacccttggactccctctgtttcttttttaataattgctttttaatttgatcgcacgtttaactattcgtcatattcaaaaattttatacaaatacatcaaatataaatcatgcctaaattatatttagtacgaaaacaactcacaataaaataaaagataattacataatttttttataagataaatgatcaaatatgtgtccagaagttaacagtgtcacctattaaaaatagaggtggtataaaggccctctttgtttaggcttataagccaacttataagtcgaaaaatctaagtctaaacaaacaagtgacttttttgtttggctattttgaagctataaaccactctaacactattaagccaaaagctaggttagagaagcttttttgacttatgtgagatatatgcatgactccaccattaaacttacgacattaaatccaccggcttataaatcatataagccaacaagtaacttaaaatgctaagccaataagtctaagcgtaaataaagagagccaaagtatagacataaatataggcttaattggttattgctatttcctctgttttctaatacaggatgtcgttcattttttaacatatgtttagctattcgtctcatttaaagtaaattatgtaattatcatttattttgttgtaacttgatttatcactaaatactatttacacaatgattaaatgtatgttaaaaagttaatgacatcatatattaaaaaatagagatgatggtataatgcaaacttgcaatgcaattttactgtgcactcctcgactccctttataggaaactattttgattactctgattactcgagaggatgttccctcgttgtttacatcatgtcactcaagtggttatgaaaaaaattgaaaaaaatgagaagatgtattaacacggggtcaacgctataacaacgcttccaaggagaggaacgacgccgaaaggcgccgccgtcgtcaagccggccaacggcccggcaaagctttcgccagtgattccccattcaaatccacacaacccgcacaagaaggaacgtcgcaagccacatcaactcttcatcaatcagccctaggccaccgccacagatccgcccgaccggccgaccctgccgccaactcaagcaaggggggcaggacggagggggcggacggcacggcggccaggacagcgtcgccccatccaccgttgcactgtagagtcgccgacgccccccgccaacgacagcacggctccatgtcgggcgacgccttgcgcgccgcttgcgtgcaccggtgcacgcatcgacctcgcgagccgtctccgccgccatccatgccgcctccaatcgcgctgcgccacagcgccggccgcttcggccagatccggcttggaccaggccagatacggcgacggcagctgtggatccgtcgccgttttgctcagagagctcgccgccaccactccccgccgccggtgttcaccgcctcccccgcgccaagaggagatgctaccgcaggagaaggccccgccgccaccctcctagctcaccggcaggctttccggcggcggctggtgggggaaggggggcggcactaggtttcgccccccgtgtcacctgcgagtgggcgacgcgggggtcacgggagttctaatatgtgggctactggtaatcgtatgtagtaggtagtacttttaatttcgctggagcatatagtaaaagtagtccctcagtcccaaaaataagcgcatctatgagtttccgtgtccaactttgatcgtctattttatttgaattttttttatgattagtatttttattgttattagattacaaaacatgaatagtactttatgcgtgactaatgtctttttagtttttcaaaataattttaaataagacggacaattaaagttggatgtggaaactcttggttgcgtttattttgggatggagggagtataatagtagccttatcaggatggtttaagatattgttgatgctccaactaactctgaacctggaaagggacgcctggcttccattgttatacttgcgtaggctaaagaaaacttctgggtcattagacacaaacacaacgtaattaatgctaactaggacagttgtcttatatataaacatacacaggcatctaaacagaatggaacatggaagtaataattgtagcaatggaaacttcctaacagttgacacaaagaaccctataaggtctgttctccacatcttataaggaacataaacatagtagcaaactagcaaacaagaaatacaacagactatagtaaacttcagactcattcactcactcgatctggagaccaagacccgtggtgttgttgtgaacttgtgataggttccgctaccgccgtggaggtggagtaatgccgaaaagtcaggaggcctagataaggctggcagaggggcaacatccatgagcatgtgcaccacctcgcgtattgttggcctcatagatgggtccacctgtatgcaccatatacgccacacgtgcgtacctctcggcgctatcagccatgctcgagcctaacaccatgggtgccccggccctctctcttcttcccccacgagttgagacttcagacattctcccgtcctcgataaggctctcaacccagtttagcagcggcaccattgtgccgatcctatgattatcgggaggaagcctcccgcagcatattatctccacgaaccactcaggcgctgcgtagcccttggtgcccatgatcttggtgatggtgtagtgcacctgctggttgttaaggagcttggcgattcccaaagtcagtgatcttcggattctccatgtgatccatgagtatgttgtcgggcttgatgtcacagtggatgatcgggaaggtgcacccatagtgtaggtactctagccccttggcaattcctattgctgtctccgctcgccacctccatggaggcatctccggctggtcgaatatgaagctgccaagggagcctcctgggatgaactcaaacaccaatattctatgatttccctccttgcagtacccaatcattcgaactaggtttcggtggtggattggaccgatggattgtagttcgtttatgaactcctcttccttaaactcaccagggtggtcactggtcgagtaccttcactgcaatttcaggaggtcccagtgaatgcacaatccctttgaacactttgccaaaaccaccatgccccagcagctctgtaaacccgtttgttgctttggagagttccttgtgagtgaagactctcacgccaagcaaggttattttgggtttcatagaaaagtggcagcacaggatgatgctgatagagtttatgttgaatatgtaaacgtagtcggttatagtttaggacttggagttgtactaggtataggattagagtaagagtcagactctatcctaggatctctcataaatagaggggtgtacctgttgtaaccgtattgcgacttagcatagcgagagggagcggctgccagcggcgaccggccgtgagtcattgtaactctgatacgctgtaatatgctggatcggggaggagcgcccgtaatcagtcccccggagatgtaggcctcggctgaactccattatcaaatatcatgcctcggtgtcgtcaccgtgtttggatctcctatgacgttttcttccgagtttggtttccaatgtgatttcaagactagttttttaacaagtggtatcagagcttgcgggagatccatggtagaggtgcgagggaggtgctccacgccacgaaaactacacaggatgtccagggacggacaaggacgcaaggtagagcacgacagcggtcaacggaatttgatcggtggaatcggacacttcaggcagcggtttgaaccgttcgattgctgctttcaacagagagatgaccagacgtggtgctcgggttgatggcggcggaagcgattggcgattcaatcggtaggtcggacacttcaggcgggtgtcttgaactttccggtgagccactttcaacaaggagacatgaggcctcacgctcgggattgattgaagctggaggcgatcggtgttctcggtcgatggattcgaacactctaggcagggtggcctgggcctttcgatgagctgcgttcgatggggagatggctagacgtgacgctcgggtcgttcggtggctgggaagatggcatgcgacttgtcggcttcggctctcgactagattgatggcgttcaatcggaagtcggagcgggcggatccttggtactgatggagatgtgttgacgacaaggtggtgcacgatggatggctacaacaacggcgtacaatctacaagttctatattgttataggcacgagtcagatcgatgtcgttcgttgtcgatggaattgactggagctgctggacaatatattttaatttacaaacttctaatccctatatgttatttgggaaagatcaaattttttgaagtgatgttcaatttttgtccttaatgattacaacattataaataatgattactcttggaattgaatgaattttgtgtgtatatgtgatgtataggtgttattcttacataaatggtgtataagcgataattattcaatgtattaagtgaattttgtgttttaggagttgagtgcatattgttatgctcaaatatagtacttatgagtgatgtacatatgcataatgtgatgaatatatatctaattcctatatgttttcttgggaaagatcttttttttgaagtgatgttttgtgccgccgccgatatggttgcccatggccatgggctagggcaagcgtactgaaagccactgcggagcttcatcctcgccatcacacggaggagagcgagcgaaggatggaaagcagaggagacgcgagaggagggatggaggcgagacggcacgcgatggaggcgaggcagagcagatgagtcgtgggctcgcatccggtggtggtgggggggggggtaaaactgaaatttcacaccctcctggccatttgggcaacgtgggctgtgccatgcccactgttggccgagtagcctccatctgtgtcttcagactttgcaggtgcgaatttaagtcccatgtattgtggttcaagtgtcttttggtgttccttagtccagttggtagtccaggtgtagcaattttcaggacgcattgtgagtgccctaagaagcaggtacaataacttgactcggcgagctgcaaaactattccacatcatcatattgcagcctggcgatagcgatttttgtaagtcggtatcgctcgtttgcagctgctcccggtttactgctgaattaagttcgatttatattttggaataggttcagctctcctctaaaattaagacgaatgaatcagctggtttcaagttttcaactaatacaggaactttttcactttaggaaggcaataattcgagaaaactagcagcagtagcgatcggcagaaaatcagtgcattctgatacatttctcctccggatcatcacacaccaaatttgactctttaccacatcaatgatcaatccgctgtacatataatccccttcttccactccaaatcaaacgaaaatcaaatcagaatataatcacagcacagaatcagcaaaacagaaatggcatgcatggccaacgccaccgtcgtcttcttcttcctcgccgccgccgccgtcattagctgtcacgcagcacgcgcgggcaactccaccgccaccgccgccgccgccggcgactgcaagctgtcggacatcaccgtcacggcggcgaggacggggaaggtggtggaggggcagccggagtacgaggtggccgtgtccaacgggtgcgcgtgcccgcagaacggcgtcagggtgagctgccccggcggcggcggcggcggcgtgccgagcgtcgagccggtggacgagagcaagatccgcgccgacgaagccgggctctgcctcgtcaacgacgggatgccggtggcgaagggctcgccggtgacgttcgtctacgcgtggaagcagccgctggagttcgccgccgcgcaggcgacgccgcggtgctcgtgattggctgccccgtcgtcgccggcgatcgaggaggataggtccacgggtggggaatatgagtggtggcgggaaataacagggtttgattgttattcagagtttcagaccaccatacatcaagtgattgtttttgtttaatttcttttgtatcaatcacatttttcaatccatatatcatcgtgcattttcagtttttgttcttaatgtgagacaaatatgtttcaactcaaatacatgtctagaaatatttaaaacctccaccaatatgaatagagatacagcctggagaagcataaaaccccatttggacgaacccatgaaagcataaacaaaagcgaacaaaaagttagatttgctaattatagattatgtattgacttgtaagtaggaaaatttcagacggagtttgtaaggaattacacaacactctcttggtcctatgtactcccatatccccagtccactgaagaatcacatttcagaagcaattgaagtgcacgacaaggaacattatcatctgattttatacagacatgtctcaggtcgtaagacagcttgaaggcgatcgcggtgactaagtaacaaaaatgagatacagaaggcaaaatagcgatgatgtacgataagaacattcgtgtatccattggtcttcagttaatgccggacagacaagggcgaaggacagacatttggtatgcaacttcttgtccagcaatttaccacttccacaagaatatgaacgacatatatgcctaaatctcaaacctattccagtaataccgaataaatcgagttatgtagttctaaaataaggctgaaatatcacccgctgatgttgcctagccagaagagcatgggaaattgcacaaccgcgaggaaaagaagaaagtagtgattccggctggggtgtctctcatagctccttggtgcgcccagaagaaccctcttcatcgtcttgacaaggaaaactccggtgcagattgagaaccatggcagtacaaaataatatgacgggctccagaagacgcggacaagcattgcaagtgatgtaccagcaaatccatacccagcataggccacaatgtccagcaatggcgcttcaccacttcccagcgtgtacagtagaactctgatcaggattacttgcagaaaccagccaagtaatccttttgtgaactgtagagtgagtgcctctggggtaaacctgcaatcagcaaaaatgtgtttcatgcatgcatcactgaatcaagaatatcatgagtaaatgaatattatttaacacttgggcacttggttgaactagaaatatgtttcaagaattcatcattcaagaaaaacagtgcaccacagaagttaatttctagatactcccacgctttagcatttgtccattctccacacatccttctcttctcaaattctcaacataactactgttcttaccgtcactcaacacactatgcatagcgttctttctttactactaaagaagaagcaagtcagcactacaaagttgaatgagactaaatatgtcgttacctcccaagaacacccaaagcatatccagcaattacaacatacgtcccaaaagccatcagaggaatgtaaagatctggagcattgatatcttgaattggaggtttgtatgacaaccttcctcccaccggttcagttatccttgtccagtgcccctgaaggaagtaaattggtaaatggcttgtaagaaatttcacaataagcatataatacctacaaaaaggtggataaatcttacccggtgcaggaaagggaacaagatcaccttcaacttgtttctcacatactgactgttgacttgaaagtagtactgaggattggacagatactgagtgatctgtccatgtgatgaagcaaagttaagattcaatgtctccggggaaaacacgtgtgttgatgacaacgtggtacacaaaatatagaaagcatacatttgccttgatgaaattttaccaatgacttacattgctttgcataaactcagagcttgaacctaaaaacttctcgccgtatgctcctaacccacttcggatgagtccaggtccagctccatataaagcactttcaaaaggattagcttgtgaagtagcaggtctgcctcccagtcctcccagatcattgttcatcgctgccatgctaactgcataaacaaaaacgaactaaaaaaagactcaaaaaataatgtatcaatgttcaggtcagctcaaacgtcttatgtctacaaccttaacaaatatcccctacggtggctctcagaaacaaacggaaaataacatgctgaggaaccaattactaatgtcctatccattagatagacatattcaagctaccaactgagcatgatatgctgaggagaagatgtatcataaacatatacttgaataaggggaaattagcatagtaccataaccttcaccaagtgccattgccataaaataaaacaaaactagcaaatgcttttggagaaccaacgtggatttgcatatccatagtctactgaaataatggcaaatccagtgtcaattgaaacaacagcaggtcaaaaatgtttctgcactaccaccaaagcaaaatttttatcacgctgaccaaatcttcaaccaaaatatggcatctagccctaggtacggataaacggcaagtgaaatacctccttcaatgtaacactgagaacacgattattgataccactggacacagttgattaaaaaaaaaggcttagacacatgatgatcaacaggtagcctagaattgtactcaaaatagtaacacgtctaacatttaacattttcaatagacaactggagtggtgagatgtaccttctgaatgaatgtcattcaggacagtagctactaatgcactagactttcttggattaggattcaaaaatagcacaataatgcttgcctcttggggttgggaatgtaatgggaaaaatccaaaaaaacaaaagcaggaagaactattcccgttgcaattcgctccctctccaaatgatccttccatttgagctgtaagatcaatcactgcatccccaaccattctgagaccttcctgcgctttcctcacggcccaagattccgaccaaaacatctggaactcgctcaccgaccagatctgggaccgcatcccctcccccccccccctcccctcccccgaatctcggatggcaccggcgatcttggccggcctccctcgagaagaccgcgaccttgcgcacacgcagcaaagctcgcatcggccacgaaaccctcacgccgtcgcggcagtttactgctcgctcggccctcacgcgcactaggggatgatccccgcatttgggaccaatacctacggggagggcaaactaggtggacgaagagaagaaaccctcacctgcggcggcgcaccggcggcgtcgcggcgccgctgggattcgtcggcggcagcagtagagggaggcagcgcgtcgcagcgaagaggagcaaatcccacgtcgagtcgagcgaaccgacgaagacgacgctactcgggccggatggatatttctcgtgatgggcctaactataatgggcctgaaatgttagcggcccaaacattatgatgggtctaaaggatcgcaaccattgaatacgatccaaaattactgtgggcctttttggatctctttcttggatgagaactcgagcagttccaacgttgggctcagccctcgtcggcccgccgcgcccgcgccacggcccacgacgcgtgcgcgctctagcccatggtgttcgtcaggtgagagtgagcggcgacctactccatgatcctctcaggaggaggaagctgccgggcgcgcgagtccacgcgacttttatcccttgaccaacctcattttccaagaattttagtgagtagaaagtctcacctgcttggctgattcgcctccaggaatcatttctttttaccgcaaaaccgcgtgttaatccggcataaaaagctcgaaggcagagcacgccatggcgacgaccaccagcacagcagccaagaagaagaagagaactagagaagagaagcatctccggcgatgagcggcgggaggaagcgggagtggatacggaggaaggtggcggcggcggcggcggggagcgggtcgccgcggtggtcgcggcgtgtccgggcggtgtccacggcagtgctgcaccggaggcggcggcttgggctcgggctcgggcttgggcttgggcttgggcttggggtccgagtgtacgagaatgtggtgttctacgtgctgtgggtggtggagtcggtcgtcgtcctcgccaacctctgcttcttcttcctgcgcttcggttttcgcttgtgatcacaccaagggtccaagatgtgtagttggtgataccacagaggaacatctgctaaatcttctcaatttttttctctctcccccctttgaagaaatgtaaatcatatgtcctcagcttctaacagactgttatgcccagttgctgacttgtcagcaatggagattgacagacgcaaaagcttgaatctatcgtacaaaagcttttcaattaggatacaattttgacagaaaattatgatacaagaaaggcctgttcactttgataaaaaaaaaaccttttggcatagttaccaaaattttagtaggatttcttatatagctaccaaaatttggcagtaaactaaatatagccatttttttggtaattgtactaaaatttggtaaggttgaaaatgacatcaaagtgaacagtcccgaactcttaggctgggttcatctccacttctccacacataaaacggtgttgttcattaacatgtgattaattaagtattagctaaaaaactttaaaaatagattaatataatttttaaagcaactttcctatagaaaaacttttaaaaaacgcaccatttagtagtttgaaaaacgtgcatgtggaaaaagagaaaggtgagtcaggaaataatggggaagaacacatccaaaggtcataccagcaactaccacgaaagcttaagtaacactgagcatggagcatccaatttttgtcttcttccaacatcacaatcaaattgtccttcaagaagaaaagaaacatcccgcaccactatcgggatgcttacaactgtatggagcatcccttttttttttcccagacgagttgcaatgaaaatatgtcttcgatcgttttacaatttacagcacactgacaaagctgacatcgctgggactagggtgcacaacctcgacctgatgggctgcgctatgcgcgctcgctgggtctggtcagcccgcacagcggctgagaaaccgtggcaaggtctgtccatggcggtctctcaacgtgaaaaggaataagttcactttgggtctctttatttgtcgtccagtccgattttcgtcccttgaccataaaaccgggtacgacccatcccccaactttcgaaaaccgggcaaacgagatccttcggcggttttgaaggtggttttggctgacgtggcgtctacgtggcttgtttgactagttatccgtcccacgtggcattgatgtggcgctgacgtggcaattatatattggaaaaacattaaaaatcgtgggcccacatgtcagccacagaaaaaaaataatttaaaaatggtgggtcccacatgtcagctaaaaaaataaatatggtggggcccacgtgggcctcacatgccattctcaaatgaccaaatccaatcctcttcttcctcctctctccggctctccccatctctcctccctcctctcgccaggcggcgtccagcacggcaggcgacggcggaccacggcagcggcgggcggcgcggagatggacagcgcatggccagcggcgggcgacggcgcgcgaggcgtgtggggtggcggcggccatctctctcttgcgcgccactcgcctagccgtccgccgcccttctccccggtggtgaggcctacgccgttcgccgcgctctcagcctccacgtgcccgatggcgatggcctgcttcgccgcctccaccgccgtgtccccgccctcgccgtttggagatgaaaaggcccatgatcttgataccgacctactactacatccacggcagcaagctactccagccagcaacactagcaggctgcaacagccattgacttcgagttgctacggacaaacgagcgagccagacatcacctcggcaccaaactgttagcgtgatatatgtacatgtgtagtttccggcttccttcctatcctcccgattctgttgctataagtcggttgagtagatatggttggttatacctatatatgtacccactccgtgattaattcaatctattgcgttgagtcatttcttctcacatggtatcagattccatctagcttccgcacacttcctctctcccggcgtttctcatggcgccgcccaccctcctccctgactccgctcgcgcggccctcgacgacgccgtccaagccgtcgccgacgccgtccgcacgtcctttactccccgtgaaggcagcgccgtcgaccctgccaccgggtcctccgttgccaacctcgctgcaaaccgggcctccaaggcagcgcatgccgctctctccgacgccctcaccgcgtttgtcctctccaccaacatcgatggatcgccgatatctgcttcctcctcggcgtctacctccgatacggtgctctcttccttgacttcatcctcgacctcgacgtcggctccggtttcttcctcgactccgcccgccccggcagttcctcctccaacttcatcatcaccggatcctgcggtgttgctcctgccggccctggaagccatcctcgacccggtgcggtttcctggcactcctcaacagccttcacggtgcccacctgctgcgccggcgctcggccccgacgccctcgcggccctccatgcgcaggccgtctcagtcctcaacatcaaggccctagttcccatcaccctcgacgtcgctaccgccaacttcacgcgctggcgcggcctcttcctcatcgccctcggcaagtatgcgttgacggcacacgttctttccgacgagcgccgccccgacctcgctgaatggatccagatggactgcgtggtgctaggttggctctatggcaccatctcctccgatctgcttcaagaggtcatgtcgcacgacgccaccgcccgctcggtatggcgcgcccttgagctacagtttctcggctactgtgagcagcgcgccctcaacctcaccacggagttccggaccttccaccaaggcgacctttccgtcaacgactactgccggcgcatgaagacgatggcggactcacttggtgaccttggcgatcctctcaccgaccgtgctctggttcttgctactctcaatggtttgaatgaaaagtttgataccttgcgtagcctcgtaaccatgcagcgtcctttcccgtccttcgccgacgttcgctcgcaactcttgttagaagaactcaccaaggccagtcgcccctccgggcagtccaccgtcctcctcgccggcgcttctagaggcaagccgccatcgacgcccaaccctgcccacgtcaccggctacggcgcgggcgcgtccggcggctccggcaacagctccaacaacaagaatcgccgtcgtcgcggcggcggcagtggcaacagcggcggcgggacgaacaccggcggcggcggcggcggcggcaacacaccatgcggccccaagactccagcgcaaggctgtcacgcccagaaatttaccccaaatttccagaccattttgcgtattaaatccctgtccaggaccagccagggtacacaaaacgacaagtaatatacagttccaaacgtaaataaagcgtaaaatacttacagaagaggcacttagtcctcacacagaaacaaaagcagcaacagcggaaaaaggcgatcctagcggggcttcagctccactccacaggcaaaactcaactggggtctgagccttggtcctctaacttcgtcttcagctcagaagcactacacttctgaaaaggggggataatagcaaggctgagtacaaccaccgtacttagcaagccacaccaacgatgcagacgtgcaaggggatacaaggaggggtttgtggctatttgcataaaggcggttgtaaaatattttgttgagcaaaacagtaacactgttgaataattaaggtaaattagatctccactgatcaacgctacaccacgttgaacaggcccaaccaacccacctatactacagtgcattgggtcgatttattaagtgtgagactaatcacggtgaatctggtcaatcgcccataaccgcgggcacggctattcgaatagttttactctggccagaggtgcacaactgtacccacaagacacaacccaccgacatgtcaccgcgtcatcatgtgcccatgatgcacacgtcaccatgtcgagtgattgtgacgagacccttcgcataaccctcccctaaccatccacaccacgctaaggtttcacccccacccctcaaaaggcagtgggcggtcccctcttgcgccgcggtgaatccggcagctggacaaccggacaccccggccgacccaactccatcacgcccaccctcgccaccggtgcctaggaaagggtcgagctatacttcagatcaagcagtttacccactcccgcttgtggcaagcgctgtaagtcttccagggtttcccgtgaaccggtccttaattgccatgggtgcgactcacaaaaccatgcacccacagcccaccatttagtcgcattttagttggataattacgaccataaaacatggctagatgtctcgagcacgcggctcaacaagatactagaatgtctaatactgcaattatcccatcgactgagctagtggtaattaagcatggctaagcatatagttctagctaggtcatcaaagtaacacaagctaggcgatttattacccacggttgacaaaggacagatatcaagtaaacatggcacaagcgagcagataggtaaaccctgatcccatgtaattagcaaaacatgcatatttatttgcaaacggtaaaacatttataaattgggaacaacatgctcaaggggaatgtgtgacttgccttgcttcttcacttggattttctgaactcttttcctcgcgaccgcgatcttctgaaaggacggattctacacgctggcacgcaaaacgaggaaaaactctaataaaaaccaaggaaacagtacataaaaagtaaacaaacatgtagagctcaattttagatgaattttgcaagttgaatggctcaattcggagttcgaatgaattagatatgaattttagaaggttttgagccattaaattaatatctataattattaccgaattattgcgcaattattaaatattttcacaaaggaaaaggactgccgctgacgtcagcaagagagggggccggcgccgacaagcgggtcccaccggtcagcgacacaagggcgccggtccaccatggaccgggaccaccgaggcggtccaccgccggtccacgggaaccgacggtccggatcggcccaagccgatcgggcggccaggggcggcgcgactgggcacagcacggcacaaagccagctggccaaacgacggcgcgcggcggcgcggccacccgcggcgacggccggcaacagctcccgtgggcgaaagcggcgcacgcgagagagcagcggcgcggcgcggcaagggggaggcgacaccaccggcaacggcgcgggcacggagcgccggagcgcggcggcagcgacccggtcggacggccaccggcggcggcagcgcgtcgcgaggacgcccgggaggcggccgacgaaggggaggaaaagggagagggaggggagtgctcaccgagatgcacgacggcgaaggagcggccgacggcaaggaacggtggcgacggggctcctcaggaagacgacgcgacggagctccggcgacgggcgtcgctcgggatggggcggacgggctcggcctcgatctgaggtagataaaggaggggttagagaggggaggactggtgcgtggtgaccggtaacgactgccgaccgcgacaatatgagaaggatctcaccggcgaccgaggaaggaggagctccggcggatttccggcgaagaggggcggcggccgaggtcctcctcgtccttgcggagctgagggaggcaacggcgcgggtcggcgtcgaccgaggcggcggcgcgacgcggctggagtcggcggcggcggcggagagaggtggttcgcgtggctacggcgctacggaggtggaggggggaaatggagcggtggccgagcttgcccgggcggtggcaaagctggcggtggcggcggagcagtgtggcggcgaccctagcgacgggaaacggcggccggagttcgccgaagtgtggcggcgcgcgggagcggcgtggggagagcgagggagagagtgccgggctcgggaaacaaggggaaatggacgaggggagcacgggggtgcttgttatgggctcgggaaggcgggatcgaggctggacgtggcggaatcggccggcgaagtggggcgccgacgtggggtggtggaggggttaaccggcgccgattttcgcggggagagtggggggaaaggtggaggaggtggaggggatcgatttcacgcgctcgtggggcggggtggggcgcgggagccgcggcgtcgtggggcgaatccggcggccatggcggcggttggggcgacgggaggttggggaagaagatgacaggtggggcctcgggtcccacctgtcggggagagagagaggggaaaacgggcgagggaggtaaagcagacttgagggagagagagagccgagcgggccgagggagaaggccggcccgagagggagagaaaaggggcgcgcgggccgcgggagagaaggaagacttgggccgaaaatggcccaaagagaggaagggggattttatttgttttctttttattttaattgatgcaatgatctttgtgctattaaaactatttctcgagctccgaaaattcacggaaaattccggagagtacattagggcacaaagaatattacaaaatattcccggccaatgatttttaaagggaaaattttaattctcccaataattcacttggataaattgcttaactttttatttaatttctaggaaatgcattattaaatgatttttaattccgaacgaaaatcggggcgttacaaaggcgcaccgggccaggccggctggcccactcccgcgaacccctgggccggcactatccacatgtggccgggtccagcggggcgcggactgctcggcccacgaccacaaggcgctccttttgctggcgcggcgttcaatgggccgccgaacggcccaatcggcgtgacgccggttgcctaccaagccaccttcccgcaggcccagctccaagtcggcctgtcttcctcaagccagccgagcacacctcacgggccggcgcagcccatgggttggtttcctggtgcaccaacacaatgggaccaattcctatcctcccgattctgttgctataagtcggttgagtagatatggttggttatgcctatatatgtacgcactccgtgattaattcaatctattgcgttgagtcatatcttctcacacaaacaataatgcaccccgatggatagcaacggatacaattcgatgacgcgcaataatggcggcaacgacgtcccgccgtgtcgtcaggtcgccgcaggcgaccagacgatgtccttgagcgccggccggagctcttcgctgcaaaacgactggtactccatggcgtcgccgccatccctcttgacgtccaccaggaccaccacgagcaacgacggcgccatgctgaagacgtcgatcggccgccacggcgagccgcaccccgcgcgcgccgctcctcgtcacgcgcgtgggcgtggcgccgcccgttgtgagcgcatccagccgcgcgaccacgccgcttgccgcctcccgtgtcgcgaaccgcgtgccgcccgcgcgcgccgtggctcgccctggcaacgcggcggggtcatgctcgaacagcggcgacaggtcgaagccctcggacagggagatcaggtggaaccgcgtgcagacctcgggtggcattgccatgtgtgtaccggcgtcggcacgaggtcggcgatgatggggcgtaggacgggcgccgtcttccagaaccacggcgtctcgaagaggccagggatggtgatgcgggtgcccgggttgggatcgagcagcatcttgatgagcttttgccgtagcgctggctgccggacctccccagatctgccttcacgcggaccagtggcgctccggtcagggggcagcgtcgaccatgccctccgccaccgccggagctcgcctgctccgccgcccacctgcaccgtccgctgcccgggaaggggagagagagaggggaaagggaagaagaaaaagagggagagggaagaagagaggagtgtggctgacatgtggggccacatgggccccactattttaaaattatttttttacagctgacatgtggggccacgctttttattatttttccgagatataattgccacgtaagcgccacgtcaatgccacgtgagatgaagacctagtcaaacaagccacgtagatgccacgtcagccaaaaccgccttcaaaaccgccgaggaaccacgtttaacagattttcgtaagttgggggatgggtcatacccggttttgcggtcaagggacaaaaatcggactggacgacaaatagagggacctaaagtgaacttattccacgtgaaaaagatctggttgcagcctcaaccccttttctgggaagatcactggttgggaggaacaagcatcagatcgatcgcgccgtcgatttacgacatggttcccaagaggattcgccgtcaaatatcggtggctgatgctttgcgacacagaagttgggttcgctacggattgagggggcagattcttggaatacctgcacttatggtctgccgtctcaaccacgaccctgatcgtcaatcagccagataagttaatttggacttggacaaccacaggatgttacacggctcgatcggcgtatctggcaatgttcattcattggaagagaaaaattcccagtgaacttggtctggaggaacaaaacgccgcaccgctgccgatacttcatgtggcttgtggctcatcgtcgttgctggacagcggatcgactgaggccgcgaggcttgccttcctcacccggcgaggtgtgtgctttgcgaccagcacgacgaaacgattgaccacatcctgatcttctgcccggaatccgcacaattctgttggattgtgatgaatgccattgggcgcccggatctcttccccgcttcttgtcccagtctggaccttctttccgctgaaactgctcctccagcgcttgatggcatccaaacaagatgaatgtctcaagtgatacaagaagaccactccagggcagtgacctcaactgacggcactgatcgatcttcagaaaacgaagcgagcaaaagtcatccatatcatgaagctgcaacagatcagagcaatcaataacatacagctttgtaagggaaacaagatcacacaacccttccatagatgataggccaatgcaagatcataggttcagttccttcaacgttgtctggtggccagatgttgcatcacctgagggcagtggtacaaatctaatttctgaagtcatggcatgccacctagatctggtatgaagcagcttccaatttccgttcgagtgcatcttctccccgtcgactctagataaactctcccattttgcatatggaatcattcatgaaaacagaattgctgaacccgacaaatgttttcacgagcaccagaacctctttctgaaaattgacaagagaacaaaaaataattaaagcagagacatggaatcatggagaggaagatgctaaacacttaaactgagcacatagcatgaccttacacaggatgacaggaatcataagattaacctgtgcattgtattttgcagctgggagcctgcacttttttgcagatcactagatcaaaagcaacatggcaaaaaatgtacagggatattacacaacagtaatgagccaaatataatttctgtgaatggcagacaataggcatgttgagaattagccatccctctagcaatccagcacatattgtacattagttcgtacagacagtatggttaaaaaggccatctcatgtttgaatctctggtgtatttaactagtcagaaaaatacatatgatgtaatgcatacccgattatccatctgatttcaaacaaaaaatacatactcagttctttccaaaaaaaaataaaagaaactccaccagaaccatggtcctgatgttcaaaggtgcacatacattgcatcctgtggaagagtacaaactgtaagcaatgactgatgaatgttctgcagctcataaagagtagtttaggagcgaaaatgcacaaacctcataataaattggcctggttaaaatggaacgcataaatgaattttatgacagcttatctgcacagttaatgcccagccatgggcaagcacaagctgactaacagcaccggtgcgcagtgtgcccagtggccaagttgcaatcaatgccacaagtgctagattcccagataactcactgaagaaaactggaagagcttgctgcagaatcagttggatgcagtagactggtctggattgaccactcgatcatatcattctcgcgaagtacttcctcagctatatctgcaaaaggttggcactaacacgaatcagtcggttacttggttgtggtaatatttagcaacaaacaaatttctagatttatcctcatcaaaattgtagtggtgatggattaccttcagtatcttccatcgatttatcagcatagaaacatgacggcaacatggcatacttctcccactcaatgccatgttgccattcaaactgctcctctagcaatggatgacatccgctcaaatacaaaaagttaagggtcagaggaagaccgtcttcaggtaaagaaacaagttcagggcaattgtgtatgatcatgactctaagggagaagaagtcaaccatctcaggcagaaccactaacttcaggcaatttctgatctccagtttggtgaggaaagaaaggtttttcaggctcctcagtgataccagtttgttgcagtgctctataagcacctgtgtcaaggttgttaggtttccatcctcaggtagttccttcaattcggggcaattatttatgatcaagttctggagagcaggaaaacaaccaaagtccggtaacaatgttaagttggggcagcttataaattccattccagttatcctcagaaatgtgctaggagaatcagagaatccagggatatacggtccctttgggaggttgtgccttcgatctctaagcccatcgtttgatatgcctgctccatcaaagctgatgtctgcagattccatagattccagataatgaagacgtaaatccaaaaggccggttaagctaatctctcgagtaacacatgtgtccaagcgatgatcagtatgccacatgcaaatgatggattcgagcactttcaattttacaggtggagggaagactggtggcagctctttcagctttgggcacctcctgatgaatacaacctgaagaacaggaaaagcataatcgactgaacaccaatctgccagttctggcaattgtgttaattgtagtgtttccagggagggaaaaccaacatccccatagaaagatgtgtctatacactccaatgcgttcattgtatcaatatgaagctccttgagacatggtagctgacctaaaggtggaagcaacttccaacatgtgcaatcatggatgttaatgtgttccaatctagatagccagttgaactctagccaagacggagatttataacctgggtatccatcaacagtcagttccttaaggccagggtgaggtcttaaagcattgaacacatcatactctttatctgacttgctatctgcattagaagaatcccattgcagcttcaatctagatatttgactcttgttggctaactgagcattagctgcctcatccttgttattcacattctcaagagacgaaattacaagaaattcctggagttcattcatgtcctttagaatctctaatccctgcactttcgctttttcaacacaaaattctccgactgcccgaagaaatggtatattccccgcagaagccaaatcaacaagaaggtccgtatgaatatcaatataaaatatgctgctgaggttatccagattttttgggaagatgacaggtcctgtatccataaaacatgaatgtgggtgtacggataacatttgcaaatgataaagactgcagagtgattcaggtagaggatggttagtgtatgggagaattaagcacctaaggtgtatcatatgatttaagtcaggtgaatgtcttaagcagcaacctgtcaaatccaataatctcaagctcttgaactctttgaaaaaatttgcttccacacaaactcgtgggcaaaaacacctgtctttattccagattattagtgtgcgcagcctttgcaacttacaggtgcaaagtaggtcaattctttcagccagtatggacagatgccgaactgctggcgggatctcttcaggttcatcaacatctaatctgtagcactcaccattggatgtgtggaaagcaagatcgttcatgaggtcatgcataacataatgtactgtacctccgtactgaagtgcctggaaaaatgatctagaaaacaactcatcaaaataacttctcccggtgcttctcaaacttccataggtgtgtccatgatcctgaataaattcatgagctatccacatattcaccaatatgccaggctcaaaataatagccttttgggaacaaaccacagaatgaaaaacattgctgaaggtgctctggcaagcattcatagcttagacgtaaaattgtcataatatctttctcatttgataaaccattttttagaactcgattccattcatcatagttgaagtttaaactaagatgcccagcaacggcctttattgctaatgctgagccattcaacttttgcacaatgcattcacctatagacttcatttcttgatgttcatttggatctctagtgctgaatgcacatcttctgaaaagttcccagctatcttcactctctagaccactcaaagagaacggagtggtacagcctaatgtatttgcaacaatatccattcgagttgtaactaaaatcttgactcctttcaccccatgccgtaaaggagcaaataattctctccatctatcagcatttataggccctccaaccttttcatcataccaaacgtcatccaacacaagtaaaaacttcttcatttttactttgttcttgagttcttcttggagcatgctaaaattgaaatttgttaggtcaatggtcttatcaatagatgttagaatttctttggtgattctgaccttatcaaagacatgtgagacacatatccatgccctcatatcataattattctctattcgtttatcattgtaaataagttgagttaaagtagtttttcaattccaccagtaccgactatggttattacctctggtgatactgatattgctccttcagttcttgacttacgtatgtctgcttgttccaacaatcggttcactagttcatctcgctccttctgacgaccgaccacaaactcatcaattgaaaatgagctggtaatacgccattggagtggttctggcaacatgtgtgaactacagttttctggtccaatcactctgacaagcatttcagcacattcctttaccctaatcaagcttttaagcatctttcttaacttggacctaaacttgtcatggccaaccaaacgcttagcaatggaaatagaactggagcctaagcttctaaggtttcgcttttcagcattttctttcagaagcatgtagtcaaattcatccaagatgtcctcagcatcatagacagcatctttcagttggtggagtaaagtttgctgattgcaatcaagtgttctccgcctttctgcagtgcccaccaccaataaaatttcagttaaaatagtctcgagctttttaaggtcatcctccaaattggactgccacttgtactgggttgatatatatgactggaccttctcaaccataagcttgatgacaggagaaactacccatccaactcctgtggctagtgataaagtggccatgctgctcaatatactgtcttggctcttcaatttctccttacagctttcaactgatgtacctaatatgcattggtaagataattatttaaaggtaacaacataaggagaacatgtagaagtgaggcatattggtgcccattagtataattaatactcgaaagcatgtaagatcattgtcatagacaactatagaaattccccattattccttgatttgttgaaccagtacacataaaaaaattcacttaaccaggccggcctaagacagttatctttgatgaagtaacttcagtcccaaaactatcccaaaaaggaagccttttgacaatttgtcatacatgtattcaaattattggacctacaaaccgatatctcccgtcctaataattaattagataatatatgccttccatggatacggatcaaactgtggattatgcctcgatgctgctccaaataatcagtctcggaaacttcgttgatccaagcacaaaaatatccttaattcctcacagaaaagaaaaacacaaagcgtacaaaaaagacccaatccctgcagcaagatcgagttcttaggcgcgatttcgccgcacagcgacgagttctaggataaactagtgaagataggtcgtcgtacgcacagtcgcacacaggcatgaggtgaaggagcatgtctgcctgattggtattatgagagcacacagctaggaagctatcaacctaggtcgcaggtaaacaaacgtttagggtaactagtaaaaagtataaaacgacggtagtgaatgaacacctaccttattggtaggatcagtactccaatctcctccaagaagaagacgctcccaaaatatcttcttgtttatcaagctgcctttgtcgtgagaccagagcccggaggagaaaccggaaacagagctggatcaaaggggacgaacagaacacggaaggttctggctttcgactcttccaaatcttgaagaaccggagacatatagtgctggtttgtggtatgatattgcctaccaaaatttgacagggtcaagttgacatgtgtgatttgataaaaaaaaacaaatttgatgtactcctacaagatatataaatatatgggtaatactaaaagaatttatgaaatggtattgttttttttgttgtttatggtgtgtttagttggccacaaactacttaaaagaattttaacttttttttacactgtttgacaactcgtcttatttaaaaaatttgtacaaaaaacaaaagttatccttaaagtactttggataataaagtaagtcacagataaaataaataataattgtttgaataaaacaaatgatcaaacagtgtaagaaaaagttaaaatcccttatattatgggatggtatattatgggatggagggagtagaattttggtaaggtcggacggacggagggagtagaattttggtaaggtcagaccaagctagcccgtataaaacagaagagcggaagccagtgagatcagcaaatttttttcactaatattagaaaaaaaaggaaaatttgccattgtgaagccctcgagtaattggaacgaagtactaaaacttaccttgttgaactagactacggcggagggacgacgacaaacaggccatcgccgtcgccggggaggataacatgccgccgtatgcagcggataaggccgctcgcttcaccgccggccaggtgccaggtggggtgaactggagcgccccgattctacttcccgcgcgcttccgggactcccggccggcgagtgtcaccagcgacagcgagcatccagcgccgccgcctcccccattctggcttggaaaaagtacaccgaaggtccctcaacttgtcctcgagttacaaaatcgtccccttaccgcaaaacaggatataacgcatccaccgaagatccctcagcggttttgaccccggtttgtctgacgtggcggctgagtcagcgtaggacccacgtgggccccatacgtcaggatgccacgtcagcgaccagcctctcccttcctctcctttcctcccttctctctctcccactcttctctctggattgggcaggccggccggcggtggggaggtcgttgccggggcgaggaggtccgacggccggccgcgacgtggcggcggcggccgggacgaggacgttcttcttcacgggcatccccctaaagctcccgacccagcgcaaggcccccgatttgcgcgcacgccgagaacgccgcagcggcggcgacggtgtcgatgcacacgccgctatcatccgccatgaccgtacaagaaacgacgtcccggccagccggcggggaatccgtcgaagagcgcccacgcggaggcgagctcgacgcgcgcgaggtagagctcgacgagcccatcgcggacggcgaggcggtggtcgaggccgagcttggccgcgtgtgcgtgcacggccgacgcagcctcgtcgtggtcggcgaccaagcccttgataagggccctgaggcaaagcggcggcagtggcgctccggcgagctcctcgccggtgcccttatgcgagctgcggtagctgtactagattaacttcttgcttttttttttgcctaattgtgatttgccagtagaatgacactgattttctatggcctcttagttggatgagataagaagagatgagtatgatgagatggcatttgtagcacgagattaatttcttgcctgtttctgctggatgccaaaattgcaagctttgattcccgatttaatggctgcgatggccgtagataaatcccagctggtggatcccttgatgtgtctcgatcgagttccgggaggcagcagcagcaatgtccggcgccgccaacgcgacctcgttggccgccggcgctggcacgccgcggtcgcggctgccgcggtggacgcggcacaagacgctggtgttgcttgccggccgccagcgctggcacgccgttgtggacgcggcacaagacgctggtgttgctcctccgtgctcccgccgccgccgcccttcccttctgggtcgccgccgcctcattgccggccggccgtcggacctccatgccccggcgacctcgtccccaccgccggccgtccaaagccccacagaggagtgagagagagagagaggaggaagggagagaataggggaaatagagaagaggctgacgtggcatgctgacatatgggtccacgtgggtcccatgccgattcagccgccacgtagggtcaaaccgggatcaaaaccgaatttattgtgactgattttgattagttaagagacgtcggatatcttatttgcaggacgtttttgtaactcgatgacaagttcagggaccttcggtgtactttttccttctggcttccccgccggccagacgaactgcttcgccgtggaagtgtgcctagcccagtcacggcccaagtagagcccaaaccaactgttctctctctctctctctctctctctcacaacaatttcgctgacgtaaatcatcagatatttccatttcattgacaaagcatcttttggagtagttaatttcaaaggatatggtcataaaatctctacatttttttctgtaaaataaaattcacttgttccaaattgattcctaaattgtccggtctaaaatcaactctctatagataagggaagaccaaatcgtatcaaatcataacgatattaatatatctcggatacaatttcatactatatccgaacatgaaaataatgttctcagtttctttttattttcttttttttttcaaggaagagagagcttcattgataggtaacaaagttattacaatcgttgagaacaaagccttgtacgcaagtaggaacatgttcccgccaaactgcacaatacttcgttttgctagccagtggtgctaactcatgagctaccctgttgcctcatcttacctcatcttacaacatgacaaatcttcacctctgaaagcaactcctttgtacattgcacatcaatgataatatgacatcatttagatcgattctctttatgagaatttagtgcataactacggataaacaatctgtttctagcactactggcatatgaacccattcagtggccagagctaaacctccacgacaagccaatagtttcaattcttctgctgatgctccatgtcgaatgtacttccaggatgataacaagactgagccgaagttatcacgaataattatgccaatacctgcactgcctgagcctgcacaaaatacaaaatgttctcaatttcttatacatgaaagaattatatttaaaaaaatcagccatcagctgggaatcaaaagcaagggtgagcagatcactccccaaaacatgagagcactgcaacatattactacctccttttcattatttatcatattataagtagttttgttttttttcctagtcaaactttttaaatttaatcaagtttacagaaaaatataataatattttcaacacaaaacaaacttactaccaaaacatattaaataatatataaaatgttagttttaatgaaacattgttgctaaatttttttataagcttcatcaaaatgacttataattaatatataacggagagagtacgcattatactatttcagatctttttaactagtagcatagacttcaactcagaaatcagaatacatacaagagaattcaactgggaagcagcttccaattttccgttcaagggtatcttctcgtcgtcaactctagctgaactctcccaatatggaaacattcagcaaacagaattgctgaattggcccatgttttcacgagcacaaaatttccttctttttgtccctgaaattgcgcagagaataaaaaaattaagcaaagacattgagaagaagatgctaaacacagaaactgagcacatagcacgaccttacacaggaatcatgggatcaacctgtccattgtatttgtagaaccccagatacaaagctaataacatcccaaagaatgtacagtctacaaaattacatctaatgagcctaacgtatcttctgtaaatgacaaacagtaggcagtcgagaactagccatcactctagcaatctagtagcatacactaatattgtacacgtacagacagtatggttaaaaaggccatgtcctgtttatgggtatttacccgattatcgatctgatttctagaaaaaatacatacccgattgtttcagaaaaaaaaaaactccacaagaaccatgctcctgatgttcaaaggagcacatggctacattgcatcctacggcaagggtacaaactgtaagcaatgaccggtgaatgttctgtagtgctctaagagtaggtttagatgcgaaaatgcacagacctcatgataagttggcccgattaaaatggaatatgcaaatgaatttcatgccagggtggctgagctgcacaggcatgaatggccagccgtggccagctggccaacagcgtcggtgcgcggtgtgcccaatggccatgccgaagtcttgatcaatgcagataattcactgaagaaaactggaagagcttgctgcagaatcagttggatgcagtagactggtctgggttgaccactcaatcatatcattttcaagaagtatttcgtcagctatatctgcaaaaggacatgagttagtatgttgcggtaatattattgcaacaaatcaatttctaaacttatcctcatcaaaattcaagtcgtgatgggttaccttcagtatcttccatcgatttaccagcatagaagcatgacggcagcacggcatacttctcccactcaacaccatgttgccattcaaactgctcctctagcaatggatggcatccgctcaaatacaaaaagttaagggtcataggaagaccgtcttctggtaaacaaacaagttcagggcaatcttgtatgatcatgactctgagggagaagaagttaaccatttctggcaaagccactaacttcaggcaatgttttatctccagtttggagaggaaagaaaggtttctcaggctcctcagtgatactagtccgtagcaggactctataagcacctttgttaatgttgtcaggttgccattatcaggtagttccttcaatttggggcaatcccttatgatcaaattctggagggcaggaaaacacccaaagtccaccaatgatgttacattggggcaatctacaatttccatttcatttaacctcacaaatgcatggtgaaaatcagaacaccagccaataaatggtccttcaagggatggaagattggggcttgaatctctaagcccattgttcaacatgtttgctctgtcaaagctggtgtctgcgatttcctcagaatccaagtgccaaagatggaaaatacccacaaggctagttaaactaaccttttgaataatgcatgtgtccaagcgatgatcagtatgctgtgtgcaaacaatgttggatgaaagcactttcatttctacaggtggaggaaagactagtggaagttctttcagctttgggcaactgatgaatacatcacgaagaacaggaaaagcataatcgacagaagaccaatatactagttctggcaactgtgtcaattctagtgtttccagggagggaaaaccagcaatcccatagaaagatgtgtctatacattctaatgcatccattctatcaatatgaagtttcttgagagatggtatctggcctaaaggaggaaggaacttccaacatgtgcagttgtgaatgctgatgtgtcgcaatctagatagccactcggactccagccaagacggagatgaacaacctgggtatccatcaacagtcaattcctcaaggccagggtgaggtattaaagaattaagcacattctgttcatctgacttgctatctgcattacaagagccccattgcagcttcaacctagatatttgactcttgttgactagctgagcattagttgcttcatccttgtttttcacattctcgagagatgtaattgtaaggaacccctggagttcattcatgtcctttagcacctctagtccctgcatttttgtgtttccaacacagaattttccagctgcccaaagatatggcatattccccacagaagctaaatcaacaaaaaggtccttatgaacatcaatatgaaaaatacagctgaggttatccagattttttgggaagataataggtcttgtatccataaagcatgaatgtgggtgtacagataacattcgtaaatgatgaagactacagagtgaatcagatagtggatggttagtatttgggagagttaagcatcgaaggtgtatcatgtgatttaagtcaggtgaatgtcttaagcagcaaccagtcaaatccaatagtctcaagcccttcaactccttgaaaagatctgcatccacacaaactcgtgggcaaaaacacctgactttattccagattattagtgtgcggagcctttgcaacttacagacgcaaagtaggtcaactctttcagccagtatggacagatgtcgaactgctggcgggatctcttcaggttcatcaacatctaatctgtagcactcaccattggatgtgtggacagcaagatcgttcatgaggtcatgcataacgtaatgtactgtacctccatactgaagcgcctggaaaaatgatctagataacaactcatcaaaataacttcttccagtgcttttaagacttccataggtgtgcctaccatcctgaataaattcatgagctatccacatgttcaccaatacatcaggctcgaaataataaccttttgggaacaaaccacagaaagaaaaacattgttgaaggtgctctggcaagcattcatagcttaggcgtaaaattgtcatgatatctttctcatttgatagacccttatttagaactcgattccattcttgattgttgaagtttgaactaagatgaccaccaactgcttttatagctaatgctgagccattcaacctttgcacaatgtgttcacctatagactttaattccagatgttcttttggatctctagtgttaaatgcacatcttctgaaaagttcccagctatcttcactctctagaccactcaaagggaacggagtggtacagcctaatgtatttgcaacaatatccattcgagttgtaactaaaatcttgactcctttcaccccatgccataaaggagcaaataattctctccatctatcagcatttatagaccctccaaccttttcatcataccaaacgtcatccaacacaagtaaaaacttcttcatttttactttgttcttgagttcttcttggagcatgctaaaattgaaatttgttaggtcaatggtcttatcaatagatgttagaatttctttggtgattctgaccttatcaaagacatgtgagacacatatccatgccctcaaatcataattatcctctattcgtttatcattgtaaataagttgagctaaagtagtttttccaattccaccagtaccgactatggttattacctctgatgatgttggtattgctccttcgcttcttgacttaggtatgcctacctgttctaacaattggttcactagttcatctcgctccttctgacgaccgaccacaaactcatcaattgaaaatgagctggtaatacgccattggagcggctcaggcaacatgtgtgaactacagttttctggtccaatcactctgacaagcatgtcagcacattcttttaccctactcaagcttttaagcatctttcttaacttggatctaaacttatcatggccaaccaaacgcttagcaatggaaatagaactggagcctaagcttctaagatttcgcttttcagcattttctttcagaagcatgtagtcaaattcatccaagatgtcctcagcatcatagacagcatctttcagctggtggagcaaagcttgctgattgaaatcaagtgttctccgcctttctgcagtgcccaccaccaataaagtttcagttaaaatagtctcgagctttttaaggccatcatccaagttggactgccatctgtactgggttgatatatatgattggaccttctcaaacataagcttgatgacaggagaaaccacccatccaactccagtggctagtggtatagtggccatgttgctcaatatagtgtttaaggctcttcagtttctccgtgtagctttcaactgatctacctatcatgtattggtcagatcaattatccaaagagaaaaacataacgtgaacatgtagaagtggaacatattggtgctggttcatatagttgatagcacaattcagaaataaccttcgcattactcaaatgcatgtaagattactgccagagatactagaactataagtacataaatttcccattatgctctgattctgctgctttgttttatcagatcattaggcccctaggcaaaataagggtaggagtacaaatgatgtaactatctcgtttttttcccggttaaagaggctaaaagacaaatatccaaacagagaagaaacttaagttctttgggtggggggggtgggggggggttgataatttgtcatacacgcatccaaaattatttgcctccaaactggtaggagttccattcctaattagagcagatccctctccgaaatccaaataagcatcaactggagtatctctccatggcccatgctgccccagataaactaagttctcaaaaacttcgttgcttcatgtatgaagtactatcccgaaaacccgaagtatctgtatttcctccgaaaaatttaaaaaaaaatagaggatattataaggactgaatcctgcgccactggagtacctaagcacgatttcgcggcggcgc

SEQ ID NO: 73848 - DNA, 67769 bp, Oryza sativa
  unsure (1)..(67769): unsure at all n locations
ttcctgcagcccttcaacaagtaagtaatcaagctcattttcattaggatcaggaagttcagcgctgatgtatgtatccacaacagatggtgtggcgtctgtgcttggtgcatcacgccaccagtatatgcacgtggggaaggcccctcttctgaaattccacgctataaagtactacaaacatatcataggcaaaacaaccaaataaaaatcaataaaacaatagaccataaagagcacagctaagttaagggcaaaaaaaagagcactaaccagcacgcacacgaccaaatggaacaccagccataatatcagaaaccatctcatcaagtttcattttaaaaactctacaaacaatgtcagaacgatctgtcgaacgctgccctggctcaaagcgcaatgcttcttcaatctcaggccatttcggattacaagtaaaagtggtaaacacatcaggggcgccatacacacgacaaatagcaaccgcatcctgataattttggtacatatatcttctcccgccagtgaagcttgcagggagaattcgtcgcttaccaacactattaccgtctaaacaacctttggcgactgcatctgcaatgccttgaacgtgttcgcatctaaaatcgccctggtgttcatctataaatgtcaatctaccctcgtcaacacacgcaaaaccatcaacttgactttgggaggacaaacgaccgcaacataaatatgggttgaactggtctcgacgatagtggcaacagtaacaataatgttcttgcatggaagccttagtacgtatatcagtgcgatttaaatcaacccccctcaaatttataccaagctgaaaaccacgttcaccatatgggaataacagtgggtattgtaaggccatgtaagcaggatgcaagctagatacatgatggagtggaccaggaatgctctgcacaattatatcacgttttgcattttccaatgaaaaatcacctacaattaacccagctagttcatcggctgttggtaattcatactgaacaggcccttcctcctacaatcttaattgctaattgttcatcaccgtgttcagccagccgatctctcgcgagcctaaactgcttaaccaaaggattacaattgtctagcatgtctagcaattcagcagctatctcaggatctagatcacagctaccattctcttcaccaagaacagcaagcattctgttttggacctcattttgagtatcataaatatacagctgagcaaattttggtggattatcttcattaggcaagagcgaacctatacggtgatagacctggccatttattttaaagacataaggaccaccaccctggtttaaactatcgtcaatatctgcacccatcgaagtgaaagtaaacagcgaattgtactgacgtatatgctgcaaaaaatgtttacttcgagcatctccatcaaatttaagaagtgaattcaaaggttctggtggctgcgcaaatggagggacaaaaattttcccacctttgcaacaaaggttgtaacagacacggcgcttggtaatagcagaatctttcttgcaccgttcctggtaccagaactgagcagcgcacaaacggcagcgatactcaggagggccataatcacacctatcctttgaagtctctgtgcaagcattcaaaaaaagaaatttatgtttaaacccagcatgctggcattgcaaacaagggaatggaaacgaatcagagatgaaagcaacctctcaaaaacttggcataatcactgtcaaacttgttgcaagagacaggagcaatacggcaaggttttttgcctatagggaaggagacataacgtccatgtaagccatgtcagcaagaacatatgcagaaaaccaaagatccaatggaaaaacctgcagccaccaatcgtttcatggccaatttttttgaacgcatttgccgtctttttgaagaataccatgcagggtagatagggaaaaatccatcgtctaccaaagcgagaaaaatatatgagcaacgactacataaatataaacaagccacaacaacagtcgcacacagatcagtaaatcacataccctgacggggtggagcaacagtctcccaaacatattcgctggcagctgaattagaggaagatgctaaacaagcaacagacgatttaatctttccacccaggaaaagatataaaatctaaagcgtctaaaaaaacaaaccgcaacaaaccatacatctaagagaagcgctgctacgctctagcaatcggcgatcccgtcgacgagcaggcctaaccacacaacccccttccatataggaactaaacgcacagaaaaacagaaatgtcgtgcacacatatagaacatataacccacaaggaaaagcgcagctcgaataatgtatagatagctgaagcaacagaggccaattgttataccttagccgacatgtacgggcacagaagatgtggtccgcaacctgcagggaataagaatgtaatttaagctggatatcagataaaagaaagaacatacaccaaaccacaaggcacaaataaactacaaaacaaaaaggatgtcagccccaaagaaatagcaaagaaacaaagctcacctgaacaggagctgatggtaaagggaacagcagcacaacagtaacgaacgtatcgcacggacctgaccgcgacaataagcacctgcgccaaaaaaaaatcgatatgaagggaaaaaaaacatgtaaacgtacagagatgcacttaaggaaagactcaaaaatacaaatgaaccacatggttctgcacgaaaagaaaacaccacgggacacactctgaatggcgaaacatgatccaataatgaatcagaaccaggaaaaaaaagcaatgatatttgtcattaactaacgaccgtgtgcttcatctatgtaatagccaccatctatttactgaaagaagtatatactgaaagaagaacaacaaagataagcaatgatccactgtcaaaagggaaacatgaacacggggaaaatcgcctaaaacctaaaaactctgtgacagtaaatcccgtgcaacaaacaggccagtacatggctacctgagatgcaccaagcctaatcacaggataaaaaggaaacacacggcacagacagaaaggaaggcagctaggccagatacagaaaacccaccagcacacgcgttcaccccccagggtccatgatcaaacgaagaaagcacaacagcggagaatgggctagaacagacgacaagaagaacagcgaacgggcaccaaaaggcaatgcaaaggaaatggtgaaaaagcagaagggaaagagaagattggcaggcaatgagctacttatactggtaaacaaaacaaaaaaatatgtaacataaaaaacaacatactcagaggctgtcaataggaccccacagatgacagggccatcggtcaaccacagcatacgacgtaacacatcagtgctctgacggaggccatcctcgagctctccgtgttcgcctcgaacgccgagcagtaacactgcgccggacaaagggcacatcggcggagcctactacagcggccaactgcaattggcatggaccacgactacgtggggcccgaacagcagcggagcatgattggctatagccgtgggaccgaccactcgccggaacacgcacagacaccaccaaccacctcgcagccccgacgaccggctgccattgaccaggcatgctcgagctctccgtcccgccctcgaacgacgagtggtggtgagtgcacctgacactggccgcactggcgggatcctcccgcagcgacgagactcgactggcatacaccacaatggcccaatcagagcatcttgagtggtgtgagcgggcaccctgaacgatttgtaccatgctctgatatgcagcgacaagtgaggaagaacaacaagcaaacatccaacaccaattaactggccatccattaccagggagaaaatgtataaggaggaagaaatcacaccaggcatgcagattcggcactgagataaaaagagcatcgactcaataccaaatcaggggggcaaaacaatggagccgctgatatcggagcaaaaatcgcacggaatggcgcggccaacgacgaagaggaaatgcgagtgcatccagaaaatgccacgtcgtccccttccttctttaccacggatgaaccgcccaagctgccacggacacactcaaagacacgtgccttcacatgcaccaataaacgcagcccgtacacatgaaacgcgaccaccgtttctgaacagcgcgaacaaactaaatttgccgcagccagcgtggacccccacctctgtggggaggaaatgaccccatcgaccgtcgtcgtcgtcgccaccgccgccgccgccgcatcatgggggaggtaggcggggtaagcagggggaccggaggcaggcggggtgagaaagggatagcaaggagcggcagcggtggcgctcggcgacggcgatggcggtggcggaggtggagacggctgcactcggtgacggcggcagcggcggcggcggcgggagaagaagagggagagggtgagatggcaggcactcggtggcggcgcgggacaaggagagcggcggcggcgctctgcggcggcagcaggagtggaggcggcggcgcgagggggcggaggcggcgctcggcgacgtggacggggcgagggggagggggaggcggaggcggcgcgtgagggggcggcgcggcgctcggcgacgtggacggggcgagggggagggggggcggaggcggcggcgcgagggtaggcgcaggcggcgggagtggaggcggcggcggcgctcggcgacgtggacggngcgagggggagggggaggcggaggcggcggcggcgcgagggtaggcgcaggcggcggcggcgcgggaggggggcgggagagggagaggcggcagctagggctttggggggtatgcgttagtggatgctgttttgcggaaaagcccctcttcttccacatatcacaaaaaagcccctttccgcgattattcctcttcaaacacaggacgctagggacctatacattattacgaaaaatcggagggctttttcacataatttccaccccgcgcgtactgtagctactgtagcaaaatccgacgtggacgcagcgagcgagcgcccatcccgccgtccttaatattctccaattactttgtcataaagaatatatttttcatttaaaaaaactaatctcatactgacatatattagcgtgcatggtccccttaaaagttaggtttaatcaaaaaatgcgttaaggtggctgcaaggtctctgctgccctaaccgaatggctaggagtaaaatttggatctacgattcacctcagctaagttaggccctctttgtttaggcttagacttttaagtcagcttattggcttatatgatttataagccggtagatttaatgtcctaagtttagtggtggagtcatacatcaacctcacataagccaaaaaagcttctccaatctagcttttggcttaatagtgttagagtggcttatggctttaaaaaaagccaaacaaataagttgcttgtttgtttaggcttagacttttcggcttataagttggcttataagcctgaacaaatagggccttactatattttacaagactacaattacagtttctggtgcatttgccaagcactattcaggaggatattagtttttttgtggtcctggtatatgtacatatgggataaatgcatggtggatgcaccgaacagaaacacaccaacatgcccacgtcaataacccaaccattgatattttggtgcttatttaggatgtttgcatgaattagtagtactagattgcaaccaggtcaacgctcttactgaaaacagccatttgaatggacagaagtctaacagtagtggtagtcaaatcgatcatcaaccttttgaggttatatatttttcatctgcttctgcataaaatacatcaaatgctagacttccgagtgaacttgatcgaaatgcttgcagaacatatgtgtgtgcagaaattggattaaaacaattatttttttctccacgagcttcacattcatgtgtcctacagaaacatactactaactgaagcatctgttcagtttgtcacgttaatgacaaaaaatcgaaatcacctactgagaattaatttgtttatgcaggcatttattacagtccatgatgcccacacgcaggacttgtcttcagcactgtccaggcattaattttgaacatgaccaggtaacgtcccctctggctttcgtacatgaaccaaaggtaacaacagttagttatatacttttcaggaaataattttgaacatgagcagatagacgtaaaattatataccctaagagcatatgatgacaatgtagctaactactaaatttggaccatgctgaatattataagatggaacatcttggtagttagtaatattatgctgaatagttcgtatatatccggttggatgtagaggccgggtaaaaaaatacccttctctaaaaaaataaaaaaaatatgctgaatagttagtggctttgattaatctctctgtcttcttgcatggagtagcacaattatataaccagctgggtacttggtaccttgttgccaccctaaaaaaatgatggcaccatacataaatttgcttgtgttaaaatgtattgccatcatagcgttgtaacttataccttgccttcatggaagatagtagtttattttaaatggaagacagtaatatgctttgttcaaattgatcttccagatgcataggtttatgaaatgctatgatctagatgaataggtttcctgactattgttattcatttaaaatagaaccaaatatgctgaaactattcatcactgaaaaaagtcaaatagaattatactgtcacaccgcactttcataagtttctattgatactggattttattctctttatgttccttcagtattttatcttatatatcagaattaaatagtttacaagaatatgagtgagaattatattattattgatccgtttctgttgtttgccactgtaccacctatgcatgcttgcctattctcttgaaccacatcgtatcgttcttaattttcctgaaatgttgcatgcattctttgtttttttcggactgctttctgtggtgcctagttgttggtagtgtgcaatattgatgatttacgcgtcctgtgtattcgtagggtataatgaaatttgatctgaacatatgaaatttgacacatgcatttccatgatccgaaaagtttatctgcagatttaacaaaatattcatgttcattttacctttttcaactcatttacatgaacaaaattggagccatgtaaaagcctatatatttactttgatacatatttttgctttaatagaatccgggatattttgccaaatattttgggagttaaattactactgctaagtgatgaatatgtctttataagcgtgtgcctcgtggtaggcaaacacactgtcttcaatatggtgcttctactgatatgcgttcgatagagaagttcatgtggcttcttgaggtgctctataaggaggaaggtgaccagtgaggagtagaagctgcagaatgtttccaggcgatgcatgtattgaaaaaatagcacctgtagaacttgcaggtgatatttgtatctatattttacttctaaacattgtgttttgaaatgttaaaatattgtagaactctattcatggtcaactttgggaagttattaacagtataataatattcatgagaacaatacaaatatctctatcgttattttattcctgaatcttaaatattaccttttggtttttgcattatcaattatcaccattgcgttagcacgggcatattactagtgttcgttaattctcccgtgatcgggagactttggaagcgctccatggcgtttggaaaggaacctccagcgctctcaccgccgtgcagaatcgccgaattttgttcatttttaatttttttaatatttacagaaatactataccggtgaaaatatttacagaaatagaccctgcaacccttcctgagggtggcaggatgatgcgtgtgagcaggcgctagaggccgctgagcgggcatgcgaattttgcatgcggcaaaaaatgcatttcacccccttgccgcccttacagaaggcggcaagggacctcagcgcaaaacgtgcacacaacgccgtgtgccacgtcaccttgcgactctccacttgggcgacaggtttattttttaaatatttttgccggtataatattttttaaatattttaaaaaataaaatctactactacttaaaaaataagaggtgcttccatcgtccgtcaaaaaaaccgggtgaaaaaaaaccgggcagaaaaaaccaagtttgtccgatcaaaaaaaccggacgaaaaaaaaagtccgatccaaaaaaaaagtgaaaaaaaaaccgggcgaaaaaaacacccgtccctggcaaaaaaacacccgatcccttaaaaagggaaaaaaaagtccgagagacaaaccgtttaatgaataaaaaaagcgaaaaaaaaagagtccgattccctggagaaaaaaaatctgatttccctggaagagatccgatctgtattggattggagaaaagaaaaaaaacacttctctaggtgcttctgtcgtccgtcaaaaaacgggagaaaaaaaccgagcgaaaaaaaaagaaaagtccgataaaaaaacctggcgaaaaaaaaccgggcggaaaaaaaacaaatatgtccgacaaaaaaaaggaaaaaaaaggaaaaaataccgaaacgaatccgactacatcgacgcggtaaaaagagtttaaaaaaataaaaagaaaactgtcctattccaaagaaaaatgaattatatgtatcgtggagcaaaaaaaaaaaaaaagaaaagtccgataaaaaaacctgggcggaaaaaaaccgggtggaaaaaaaacaaatctgtccgacaaaaaagaaagcaaaaaaaggaaaaaaatcgaaacgaatccgactacatcgacgcggtaaaaagagtttaaaaaaaataaaaagaaaactgtcctattccaaagaaaaaggaattatatatatcgtggtaaaaaaatcgaccgggcgaaaaaagaaaaaaatagtccgatccgaaaaaaacaggagaaaaaaaatgggcaaaaaaaaaatttgtccgataaaagaaaaggaaaaagctgaaaagaatctgactccatcgacgcggtaaaaaaaggcgaaaaaaaactttccgataaaaaaaaggaattatatgtgacgcggtaaaaaaaataaaaaaaccaggcgaaaaaaaagataaaagtccgataaaaaaacggggcgaaaaaaaaacaaatatgtcctatccaaaaaaagccaaaaaggggaaaaatcaaaacgaatccgactccgtcgacgtggtgaaaacagggcgaaaaaattccaaagtaaagggagaaaaaaaatcaaaacgaatccgactccgtcgacgcggtaaaaaaagggcgaaaaaaatccaaagtaaaaggaattatatgtgacgcggtaaaaaaaatcgatcgggcgaaataaaccggacaaaaaaatatctgtccgatccaaaaaaaaggggaaaaaatcaaaacgattccgactccgttgacgcgataaaaaagggcgaaaaaattgtctgtttctaaagaaaaaggaattatacgtgatgcggtaaaaaaaatcgaatcctattatatctagaaaggtttgacactatgtgaaagtggtgaaaaaaacccttcgtaaaagaaatgcacgagaaaaaaaattaaaaggacggaaaaaagcgcggaggaaaaaagtcaaatttatattcgtcgttttttagtccatttatatatcttctttatctctaatgtaatctaatctaactataaaaagagaagtttctacagaatattaaaaaaggaaaaaatgcgcgagaaaataaaaacggtttaaaaaaacacgtgagggaaaaatgtcagaaaaaagcacaaaagaaaacgcgctagaaaataaaatttcgtagttctaattttctgattgttatcgacatggttatgcatgaaaaacgtatattatcattacgttttttcacccgttgcaacgcacgggcatatttgctagtgaaaaaaaaatccagaatcgcctctcgtgcaatgctcgagtgggccggccttctgccgtgacggcccgttttgttcggacgcccacacggcccaccgccgttcgggcccaaaactcccagcttcccaagtcgacggctacgcgcagtagcgctgtcgcagtttccgaacggctgtacgcgtcggaattctctgtagccctacagcaccgtggaagtctggggtcctcaatttcggcacacgttagtgtttagatcttttggatctaaacttctaaccttttttatcacatcaatctgtcatacacacataatttcagtcatatcgtatcaatttcaacctaaatttttaactttaaaagaaactaaacacagccctttgtttgttgggacttgggagagtcggcaccggcctgatccggtccggggctttctttcggggaaaggaggaaaagctgatcatggaagaatgtgttgatgactggagcgtgattagtcaggtcaaaataggtcgtagatgttgccagatgccaaccgcatcaccgttgctacttgttgcattttgttcggcgatgatcccctgacacatagtattttgtagcataacatgattaccgttccatgatactccctctgttttagattataatttgttttaagtttggttaaagttaaactactttaataagtttatagataaatatagtaatacttacaataccaacttagcttcattaaaccaatattgaatatgttttcataataaaattattttaggttgaatatgttataactttttttctacaaacttgattaaactgaaagcaaattgactttaatcaaaattgaaacgacttataatataaaatggagggagcatcgaccctattgtttcgctgaatatttgcaaacgaaaactaatttgtgaagaaaacttttatatacatgttcttaacgatctaaaaagcaaaggctgaaaaatgaactttgataaaaaaaattgaaaattcaaaatttggctggtaagtataaacatgagcaaaaagatagggctgcatatgtcagttatcttaaacttttatgaaaggatgttgttagttcttttggctgggtggtggccattagggcaaggatgtgtcatggtttcggagtggaggatttttttaagtaacttttaggagtttaataagttcgtgtgaaaattttgtaaattctttcgatccaaagtagcctatgagagataagtgttccaacactaattctcagcttgcattttatgtttattaccggcttcccttttgcctttaacttgtcccccatcgtcctgatttctcctcgtctgaaacaactgggatgtatctatacggtggttctcttttatgctatatcatgataaaatccacatattgaagtgtgcgacaaagtttaaaggtgcacttgcgtagttgctaaacaatacgtttcatgttgctaaataatacatttcacgcaaaaaatttctatatataagttactttaaaatattaaataaatatatttttaaaatttaaaataattaaaaccaattaatcatgtgctaataattttttcgtttcatgtgcccacacataattagggctgtcaacgagccgagctcgagcaagctcatatgcttaggctcgagcttgacacagactcgagccggctcgagtcaagcctgttctaacattcgagtttcatggtaggcttgagttcggctcgaccgagcctcgagcttgcctgttgttagcttcgcaagtcacggggaagaaaaatgaaggacataagctttcgttgggagggatgagtgatggagaaagatgaaggcatttagtgtgccatgcagcattttgctgtttgatgtgagaggagcggccgctagctattctcctgtgggaaagcttggaggaaaatttggatgagacaactaagggcctgtttagttctttagtcagtgaaataaaaatttttgggtgtcacatcagatgtttgatcaaatatcggaaagggtttttggacacgaatgaaaaaactaatttcataacttgcctggaaactgcgagacaaaacttttgagtctaattaagccgtcattagcacatgtgggttactgtagtacttatggctaatcattgactaatcaggctcaaaagattcgtctcgcaatttacatacaaactgtgcaattagtttttctttttatctatatttaatgctccatatatgtgtccgaaaatttgatgtgatgttttcacgaaaagtttttgggaactaaacaagccctaacagattagcataagggatggcaaattgtacgtaagcccagcagcaaaagctcgtcgagctatttgagctcggctcgagaagcttgcgagcttcgtgataggctcgagctcagtttaataataaaacgagccgagcttgaatcaagcctaaagcgagccgaactcgagtagcttgcgagtctcgagcttttttgacagctctacacacaatttttatctaccgctatctcaaacccagcttgccaattgttttgactggttacttcataaaatcatatattcatgaaaagcttaagccagcatggaacctccacatagaaagcatggtaaacagctaataggcatgatatatttagctttccttcaaaattaaataacctttacctaaaaagatgctagcatggaacaatcataaatatttttttctgagagggaacaatactatttctgaagtcaacaaaagcaacaataggagtatcagaatttcagcatcatgggttttatttagttaacaaaacaagagtttcttgtgaggacaaaatgggaaagataacaacactacatagcccaacagtgacaaaatgggatggacaacagtggcacagttggaagttcaaaccgtttcccaccaactgcggttaggaaaaagggtgtgtttagttgattggctaatttttttttaagtatatgaacacatattaaacgtagattaataataaaataaattatagattccgcctgtaaactgcgggacgaatttattaaatctaattaatttgtcattagcaaatgtttattgtagcatcacattgttaaatcatggtgtaattaggttcaaaaggttcgtctcgcaatttacatataaactgtgcaattaatttttcgttcacatttaatgttccatacatgtgtccaaatattcgatgtgatgtttttggaaaaaaaaaatctaaacacggcaagggtccgacggaaatttgcacgagtatttttcaaaacaacccaacacagccgaaatattcacacataattcgaagacgtgtttaactagcaaagggaactggactgtaaacaattactcattaattcgagggacttgtacgcaaaaaagctaaaaaattgaactaaccatagttagctaacctcgccttccacagaacaaaccagggttgcgcggacgcgaacaccaccagaccagaccacctcctcctcgagcttcccctcctccccctctttccaaatttccccaatctcgcgtcgcttcttccccgaattccccaacctcgcatcccgattcctcccgcggatcgtgcggcgacctcgcccaaaatcccccgccggattggcctcgccgatggcttaattggcgatttcgactctgcaatggaggcgcagtggctcgccgagtacccgcaccagggcgccgacaagcggccgcggaagcggccccgcctcgcctgggatgtcgcgcccccgctgttccagccccccaaggtataatccatgcgctatgtgctgcgtcgatccggtctctctcgggcgtgtgggttgcggtggtagtttttggctagatctagtcgtggtttcgctagatttagagcggggcggttcgatctgggtgtgcatatttgggaattggggatatgctgcgctgttgcagaggatcatcgatgtgatattgtgaatttgtgggataggatcggagccagttgctgatcgaaagaacaatatggagaaaaggggcaatctcacgacctccatgtgcctaagtgctgccaaatttatggaacttgctaataaagtttgatattctgtcattatttttgctaatcgatattgttctcttttggtgggacacaaccgttacttgaggtatttgtccattcagtgctgtcaaacatatgggttacccggtgtacttctctatttaggactatcaaacaaaacagatagataactttaatggtgctaagtggggtgtaaatatcattgaactttgaaaacacaggagatcagtatgcagttgtttctattcatttagaatttatatgcttgttaccaattttgatgtatatggttaatagtaatttacgtggctaattatttttgtaggcaattcctatgctatattgcgggcaggaactaatcaatggaaattttgcgaccgcttttctgccaccgccaccaatctattatacaggaccaccacgcaatctttcgcctccctggaggccagatgacaaggatggacactatgttttcgcagttggggagaaccttacaccaagatgtatttttccacaactcagtattatttattgcatagggttattgtttttgtttgcatttctgatcgcttgcttggttagactgttaaactgtttttcttctggagtaagtttatcttgccacaattgttgaaatactggacacagaactttcattttgtttgatatttgggacttatgtagctgtttaatgattgtcagttactggttaaatgcaacaccgtgtttcaaccacctaattatgggttgaatggcatttcaagcctcattaaataaccattcattatttacagtcaattaaatcagggtaaaatgtttgcatacctttgttcgttgcccaaataacttctgacattgtgtaatggtcgtgcattcttgatatctattgccgttgtgttgtcaactgccctgcatctctaccagctgtactgaacttatgttttgttggcgatgcttcttttggttgagataattctgaggtttaacctttgttcttgtctatggctttgcagatagaatacttagcaagatgggtgaaggtcagtgtgctcctccttttctaaatttcaacatttcattttataaggaatagttcaggataaatgcttatgctgcaaaagttttgccctttgtacatgttaccaacaactacctttcttaatttgtgttgcagggacttttggacaagtcttagagtgctgggacttggaacaccaagagacagtggctatcaaaattgtgcgctcccttcagaaatatcgagaggctgctatgattgaaattgatgtgcttcagaggcttgggaagcatgattttactggtagccggtaagcaaactactttcgtcattgctaagtcttgactctttattgagttgatggatttgcatgaatggttctatgcctgcagctgtgtgcaaatacggaattggtttgactatcgtaatcatatatgtatagtaagtacatgtgcatcaagaaggcttcctttcatgttttggatggtcagaatttaatattgaattactaactttgtcaggtatttgagaggctcggaccaagcttatatgacttcctccgaaagaatagttatcgtgcatttccgatcgaccttgttcgggaatttgccagacaaatattagagtctgttgcatgtgggtattcagttaatttctgctgtttgttggttatgcaaattaacgttttgttttatcttgcccctaacagtattattctaatgtttattttattgtaatatttgcagttatgcatgacctgcgacttattcacacagatctgaaacctgagaacattctccttgtttcatcagaatctatccgggtgcctgattataaggtggcttcaatactaaattttgtcattcgaactataatcttttgcaattttatccgttaacacttgtggttgccattacattatgtcaattagtacgagcatacatttattttttactgatttttatattgttttccataaaggttacaatacggcccccaaaggatggttccttttttaagaatcttccaaaatctagtgctatcaagctgattgattttggaagtacaacattcgaacaccaagaccacaattatgtggtatcaacaaggcattatcgtgcccctgaagttatccttggtattaacatcatatccttttccatttcccccctataaagtggaacacataattatattactgtgttttgtttatggtacctttgtttagttatttcctttctctgttttcatttgcaggtcttgggtggaattattcatgtgatttgtggagtgtgggatgcattttagttgaactctgctcggttagttcacactatctatacctgagtagttccttgattttctctatagcccagtgccggctccgcgaatttgcagtgcttcctattgatatgttgcctctttgattttctctactagggtgaagctctctttcaaacacatgaaaatttggagcatttggctatgatggagagagttctaggtccccttccaaaacatatgattgtcagagctgagtatgtatacaaggtcttcgttatagtttcatgatttattataatctaagataagatggtttacatctaggcttaggttgctgctgagtttcatctgaagttctttcaaattatcaatcacttgcatgtacttgttacttcttttttacagtcgccgtgctgaaaagtatttcagacgtggattaaggttggactggccagagggggctgcctcacgggaaagcctgaaggcagtctggaaattgcctcgtctgcaggtactttgttatctgatgtagtcagtatgttcctcttagcattttcccctctttgccaagtgtcgctcataggtggtatcctcttgacactcgaattgtgctaactcatgcagaatctggtaatgcaacatgttgatcattctgctggagatcttatagatcttcttcaaggccttcttcggtatgatcctgatgcgcgcctaaaggcacgtgaagctcttcaacacccgttctttacaagatgccacagaagatgtggttactgagactatactgagattaaaatgctcaatgctgtatttcttcattttgatgtgtaagaaccacccaaaaaaaagtgaagatgttccacaaaaatgaaatgtgctaactcgcattctgttcgatgatgtgcaaggtaactgttgtatatagacagagttctacgactgccgatttattttaactgggagatatttttcaattcttacaagttcctgtctttaaacctcacattttacttcatactaatttttgcaagactgcccagtactagcaggtagcatgcagaaatctcaacttggtggagtcaattgaggatagagggaatgccagtggctctcatgaaagattggtacactgtatttgatggtgagctggtgatataaggtgagcattgcattctgaccatgtcctgtttggtgtggagataggcttatcaatataattttatgtgcatttaggatctcagtatttctcgtgaaaattggtgatggcctgttcacttgaccttcatgtccattctattttaccttgaaatgcatgattagccctggaaactaaccggacgttaaagttacaccctggtgagttttgcttgtgactggtcatatttcttaaaacaagtctcgggtgttggataaaagtttggtaattaactgagcttttgagtctgacacttggcttggaaaggtttgcgacaactttgaaattgtggacagtagtctaaatctcaagatgtgctcaactttgaaatattgtcaactgtgactaaagtccagaatccttgatagcagctgatatatatctaatttacctgaatataccgtaaagtactggctttaaaatcttactggttcccatattactagcagccaccaagctcttggattggagatgtttgttagataaatccttgtgggttttgagcttaaaactatactcaacctgtgtctatcgtttgcgccaggtgagcttgttcttaatatcttacaaaagtcatttcctttatcaaactttagtgatgtgatgattgtattcatctattgcttgtttcttctttctataaaggctcattactcaaaagttatcttctggcaaaaaaaaagactgttatttggtctgataacatcttattggctgctacaatatcttctttgacaaactgagtatttgaaatctgctggaaaatgttttacaactatatttaagcaaggacgagtattttttttaatttatcgttttcatttttgcaattgagtgaaactaccgttgaaggtaatttatcaacatcgagtgtcaacactagtgaaacaaaattagtccggcttgttttgttgattaaagatgaaatcattctataggcaagatagactaaccccagaatgctggtagtttaggctcgttttggacatgcgaaagattttactcatcgaaggtggatttggagagctgctgcttcctactgtgaatggatgagcagctggtaaatgttttactcattgggctacgtgacgtcagcccaaagatcgcctccaaagctgtagcagcgggtcaattgtacaagagcctgtaactctgtaaggtatgatatactaacccttcggaacgggcgccaacgcttccatcgtcatgttacatgagatcgcgttcgaagacggcgagcagcaggtttgatcacaggtttcgaacctggcattctcgtatagtcgtatttgcttcgatcatcatatgttacagagatcgcgtttgtttgaagacggcgagcagcggttttgatcacaggtttcgaaccaacaaccctgtactaatatatactactgcatgtgttctttcagcgaggtaggttcttttttctcttgttgaccgatttattgacgtgactcccattctcccaccaaacccgagaccctcaattttttgtttcttatgatcttcaattatttggttgcctccgtgtccctgatgagtccctttctccctgagctcccccgtcaatatgtggaatatactaaatcgtgatgaacgttattcgccaggttcctgcctttccattcggagggttcacgtctcccgcgacgaatgagccaggatcattacaccggcaaacgtgcacattccgacgaagagacgtttatccatcggtagcaaggcgctgctccggctgcctggttgctgctgcttgtagacggtcgtgggccaagcagggacaacgactcctcctgtggattacaggattgtggtagctcatgcaccccggtggcgataagaccgtgctcgcgcggtgaaaaaaacggcctgatcggcacggccaggacgactccggctgctcccgcccacttatcccagcggcgaggcgaggcagcgtcatgcgatgatgcgatctgctttcccgtcccaaccgtgtggctctctgttgcatcattcgctctgccactgcctccccatgcgtacgtggctctctggtgccaggtgcgtgcgtcgtttgtgtggaagaaacacgaggacgatatggtccacttcgcttccagtttcgacatctttttgttggaagtacacgcacctagccgctatccccgggagacgaaagctacggcgatctcgacgcgggaggtgactccgaccacaccgcgcgcttgtttcacgtttgcaagtgggcgcacgcgccgccccgatcagtcataactagcgactctcttcttgaccccaaatgcacttgagctctatagttgtttttctcgaaagttcatcttaaccgagtaatcatgttctcctacataggctcgcaccagccgtgtcatcagctatcaagccaggagccccgtccacgtttacaactgttcgtcgcttcatcagtgcaacttggcaagacagcaaaatcagtgagaggggttgctgtgactgtgagagggattaaatggatctggtaaaggatggcaaataagtagttaaaatcccccgcaatcagcatcggccattttcctgatatgtgtacgggggacagagagaggcaatcaggcgaatgcgtttttaaaccggagaagggggccacatttcctactgcgctgaaccggatcctctcggtatcacctcgcgccacgcaaccgcggggatccgtatcctctcaaattgtgcaccctccacctgtccgtcctcctccgtaggccaagtgcaccgccgtccttgtcaaaccaaagaccgcggcgatcgactatgtacgtggaaaacaattttaatcacttatatgtatattgtatgtcataaatagttataaaagaatttatttaaaaaatcaaaataaattgacatataatatgtcactccaccgatatacaagtttaaactcgactctataagttatgaaagcataaaaaattaagctctaattaattaatcttttgtagaagttaaattttacaagtttaaactcgactctataagttatgaaaagttatgaaagcataaagaattaagctttaattaataaatttttatagatgttaaatttaaactcgtatgtatatcgaatgatatatttcatatcaattgatttttattttaaaaaaatgtatataataatttaattgacatgtgtaataaacgggctcgacagccaccgagacatggagtgattataatcaatctcccgcggtgtatgggctcggcgcacgcggcctaaccctccccttcctttcattccctccccccgccgccctcttgaccctcctctttaatcacgagacccgcactctttttttgcgtcgctcgagcgcccgcgttccccgcttcgccgaaactaccaaccgcctcgccgttctcctctccccgtggcgccgccgcgccgcacggcgggagggcaactgaccgagggagactgcccaccagcgtgccgcgcgccgtcgcctccggctccctggttcgtggaataatggcggcggcggtcgcgggcggtggggaggagggggaggagctgctcctgctctccgccgtcgaggccggttccttcggcggcggtggcgacggtggcggcgcgggcgcagcggcggagaagtcgtggcgcctcaacttcgacggcttccgaccgccggaggtgcagcaggagaggcggccgccccgcgggctccaccaccactgcctcggcgtcctatgtacgatctctctccaactcgccgtcgcgcgcttgctacccttgtaccgtgtgatgtttatggtcttatggatatattgttgtgttcgtatgcttggttgcttgatctaggctttcattcgtttgccttttctcgtgtgttggcaacatggttcatttgtttcggtagttgccttttgcaatagatatctactaaagtaacttatttttatctgctttctataaaagcagttccgtttaggcctttataatataaaaaggcagtaactccttttatttttcgtttcagcaactagcaagagctcagctgtgctagtatagatggggattggattaggatgttgacggtagtggtaggctagattcttcgtgtgcaacctttggcagataagaataggaatggggaatgttatattggtggaatgaggaatttgttgtttctagctttctgatattgcctagttgcctatactatcgtgctcatctggggcagggcaggacggtcctcacgtgagctgctctgttcttggagtgcacgtgaacagagttctaagaaaacttttttttttatcagcgggggtggttagcactgagccgagttgtaaagactggggcactgggtgtgggtgactgacagcgtgagaagggcaccaggtgtcttagcgttcatgtattgtcacaattattttacccttttatgcaattttagaggttttgttctggttaacaaagttgcattgggcacaaaaagttgaattaataacccaatcatgtcatttggccgcactcaacatttggggtttggatatctagtagtcgtttctctcccgtattgtcaatcactgctttcccatggctatagaagtagggagtccttgtgggcttaaagtcgtggtctattggtggttgaattcaaggccccacaatcctagtactagtagtactatttaaatcagaattgacatttttatcctgtacatttcaatagctgtagcattttattcagtggttctacatgtgatataatcaatagatgaaatataattaattagatatcagagttatcaggttcactgagaagtggtataattcagtagaacatgtgaagcatacatgcctgcttgctccactaatgtcactatctttcttcatgctggacataattttctgtgattgatgtacgattctatcttcagctcaaggtcctgaggacgtagttgctgaatactaccaacagcaagtggaaatgctagagggctttaatgaaatggatacacttactgatcgtggttttcttccaggaatgtccaaggtatgtttgataagcttttctgttgtaacagtagggaagacaaattgtttaacaactgcattgcaacactgaacataaatttatttgcctgtaggaagagcgtgagaaggttgctaggagtgagactttagccatccggctatcgaacatagcaaacatggttctttttgctgcgaaagtgtatgcttctgtgagaagtggttcacttgctattattgcttcgactttggattctcttcttgacttgttgtcaggatttatcttgtggtttactgccttctctatgcaaacaccaaatccctacagataccctattggtaaaaagcgtatgcagccactggtgagtcctatcacaagattaccttcatgtttgccatgcttattcttcttactgtaatttatgcaattgattccaagggactcaactctcggctattcatgatgcatagccagttactccctgtgatgttcttttttccgcaaaatgaaaagaaaaagtggaaatgctccaggaatgaaaagaaactaaactattgcaaacattcctggcagatggaccatagtaacatgcggaattttgtgttttgaggattttcatagttactagaaatcacgttcccaatttcccccagatatctcttgctcttaggtcaatgctactgtatcaatatctttgctactccggcagcagacaatttatgcatggaaatatttatgataagtccttcagtctaatttcactaaatgatcgagtttatcgcttctcttttcacttagtattatcagtcatacacttttaagttccaaatttcaatatgttgactgttccatcacaatatcttcttcagggaatacttgtctttgcctctgttatggcgacacttggccttcagatcatcctagaatcagtacgctcgttgttgtctgatgtaagtctgctgatgttttgttggccttgaactcctactctcattttgcttttgaccagaaactttgcctgaggatttcttttctagaacgataagtgtctttgatgtttgttggctttgaaattctgttgtagcttgccatatacctttctgattgctgaacttattgtcttgttctccagggggatgagttcagcttgacaaaagagcaagaaaagtgggttgtggacatcatgcttgcagtgacattagtgaaacttgcccttgttttatattgccggacattcacaaatgaaatagtgaaggcttatgcacaggatcatttttttgatgtcatcacaaatatgattggtcttgttgctgcactactagcgacttatatcgaaggttggatcgacccagttggtgcaatcatcgtaagtaccaaaaagttttctcctgttccattgcagtagtgtaaaactagagttcaagtaaatgctatatttgatctaatcgttaatttggagctaggcacatcatcctgattgggaattgactgggaaaagtaactagtttctgccaattttccatgtatcatgatatattctttcaaaaaaggaaaacataccatgatgaaaagatcagctatgactttattgtaaccagagatgcaaatcctggcagtaccagttactgccatttatccacgagctggtttgttcgtactggccagaacaacttaaattttaatttggaatacacattttgtacaaccatgcatagtcatattcatatgttttatgaacaactacacattagctatatcaaaagtttgaatccaaagttttgaactaaaaaaccggctcgatttgttatggatgttacaggtttttgaattagtgtttgattttgctcttttgtccggtaaaaaccagtaactggcagttaccggtttcttaaagggaccaatatttttttttccttcaaaactggtgtccataaccttgacagtgacttggtttaaaagagagaatatttctagtctgcctgactaaattcctctactgaaagtctgatgaaatagcttccagtggtttccatcgtcctgggtgtgtagtcctttgcaacgtccaaacgtttcaaacatgagaattactcaagaatcttgtattccaaacgtttccttaggtttttgttaagaaaaacacgctgtatttcagagactactttctgttttctcgtttgcagctagcaatctacacgatcagaacatggtcgatgacggtgctcgagaacgtccactccctggtcgggcagtcagcctcgccggaataccttcagaagctgacctacctatgctggaaccaccacaaggccgtgaggcacatagacacggtgcgggcgtacacgtttggctcccattacttcgtcgaggtggacatcgtgctgccgtcaagcatgccgctgcaagaggcgcacgacatcggcgaggccctgcaggagaaactggaacgcctgcctgagatcgagcgagcgttcgtgcacctcgactacgagttcacccatcggcccgagcacgctctgtcccatgaaaaatagccagacgcaggttgcaagttcgcaaccactggtattaagtttagcagcagcaattagtttcagaatttctggtgctcgtcaggaaacctgcgggtgtatgagattttaattctgtatactggattggcgggtgtgacagtgccaaagccgtagattgtgatttgtaactacttgttgtagactataggattcttgactgttaaatccgtcatctcgatcatctcgtgtagtacaatttatactcaaagtctagagagacatatgcctggtaattacaggctcacagccactttacattaatatacggtcttctgctccttcggctacgaatcatgagatctgtttactcggtctatatatatgctactctactgtagaatccattaatctgcacgcatgtgtgcttgtgcgagtgtggtgtttgtttgtttgtttgttctactgcttagcaatcggttgattatttcagtttccatgcatggatgcaagttaggcgggagtaacatgcatatgcataaatacatttatcacacgtatcatacttgctagtactctagaagaatgagcagttcattactccactcccgaactatgcaagcagatcataacaccagcattaatgatgctactctgttctgcttataaatggaacgagaggggaattacttgatctcatattgttgattttgttggattcgatcgagatggcagggtgccgtggccacggattcggacgaggccttgcagtggccgtggcggcaacagtgctgctgctgctgccgctgccaagcatctcctccctgcagctgcaggccgtagcttcgtcttctgctgctccggcaacgacggccacggccacggcgacggacaagagtaagctgccgttcatgcccgtcccgacggaaccattcccaccttcgccgcctcacggccaccgcctcccggttgtgccgccgcctaagcccaagtcggcgaacagggaggcagcagcagcagccgccgccttgacatctactccttgatctactccgatatcgcccttatatatgttcatatatatcatcgattgtctctttctccttgtaccaataaatcaataatatcgcgtttactgtaataaatctctctaatccgtagtggacttattcttgatcattaacgcacttatcttgcagcaaatatcgttgaagacacgcatttccgcaagaacagtaggaaaaacgtaagcacgtacgctgggccggaatgaatagatggccagtttcttacatcagatggcctggccttaggcccttagcccagtactcctacctaagtgttgcattaaaaagcctgtatagtcctactactttttttaattgaaaagaggggggggggggggggggcaatctatcattaatcggattgttcactttcagggtcgaatgcatctgtgcatggttccgccacagatctttaaaccgtgcatggttgaagagcgccgtaaagataaacggatttgttataaaactatcgccagaattttttttacagaaactttcggggtgggtcatcagatgagtgttaagatttgtgctagggcatggataaaagaatttcacaccacatgcgtgaagtgggaatagacctagggatctcatggagatggaagcctactagtcacctaccttttcatgtttgtttcataacgagttacatataattacattgcagttacacctcccttcaactgacgcattatgtcgaggggaggcatagttaaacctgagataatacagtgtggtaagaaataataacggtgtgataaatggcatgagtgcatgacaatagctacagagcatacgatgatgcatgtctagccccaaaacgattaattatgcttttttttaggacacggttaattatgcttgggcggtatataagttgcctagggcacactgggcaaaaggttgatcacgattgctatacacaagaacacatagaagcttaagtagctccagacttatttgcacaagcacttgaccacttgtaaactatgatatggattggaatcctaacaaccaggttaaaacactcacatcattagtccgtacgctgatgggctgatagatcagtcctagtggaaataaggtctatttggaagcctaacattatgacaggaagcagctgatgagaattttgaaaaactatgatttccgatttgtatttgggttcactttcatgattctacaactacaaatttttagaatctagattaaaatctggatattttttcttggagagctgtagattttaggagaagcctgctaagctcccaaacagggtcttaatcaagcagaaaatgttgcaaatgtacggagtactcctaccttaggtcctttttagtactacatcgatccatctcaaaatatagctatttctagcacaatatcttgtcccaaaataaagctattttttcgtctacctcctcctctcaaccaatcacaatcattatctttcatttactttatttctccaaccatacccatccactttctttatactcgtgtcaacctaaaaaatacttactcccttcgtcccctaatataagggattttgatattttgcttgcactgtttgaccattcgtcttatttaaaaatttttggaattattatttttttggcttactttattatccaatgtattttaagcataacttttcgttttctatatttgtagagcataacttttcgttttctatatttatacaatttttttaataaaacgagtggtcaaatagtacaaacaaaatatcaaaatctcttatattatgggacagagggagtacattttaaaacagaggaaatacgtataagcatgtgaagcacgcacgtcaaaacgtcgcgcgcggccgacagatcgaccaatcgacctaccttcctaccgatacgcggtagggcctgacaaaacaaacaccacagcgcgtacgtacgcatacgcgtacgtgtggtgcaccgcagccgacggcactagcacgcaacagtacgtacgtagacttgcacgtctacaccaaaccggcggccaccaatcgatcaccgcgcgcgcgcacgtacgtccacacacgcgcgctatacacgacctagctactgctagcttgcgctgcttcgccactctctcgacgcacgtgtgtcctcgaccccatggcgactccacgcgcggtccagtagctatagtagtactactagctactccttctatctcctaaaataaagaattttaatattttacttgtactgttttatcattcattttattttaaaatttttagaattattatttattttatttgtgacttactttattatccaaagtactttaagacgagtaatcaaacagtgctagcaaaatgacaaaatctcttatattatgagacggagggagtagtattaagagcaaatttaatagtatacccatctactgactttaaatcatctatagtcaattcatacaatagttacttataaaaatatgctacataattaatacatgatcctacctgtcatacacacatatattttgaagtccgtactatagtaattctgtagcccgctgtttttctctatactattttatctttgtcgaaatatgtttatagttgttttatagtctgctactaatgtacctgcgtatacctgtgttgtgtggccaacgcggcacgcgtctcgctctcgctctcgctccccctcggtacaactcccaagtggctgacgacgatcgctcgcccgtgcgtgtcgcgctcgcggtcgatcgagtacgtacgccaataataatgcgcgcggtgtgtacgatccggaggagagaaaaaaaacccagccagatcgcctgtactctgacgacgcgcacaatttcaccttacgtttgcatcaaggcctttgggagaagcacaactcctcgtccaggaaattatacatacatggactgcatcttttacctacaatatatataaaccatgccaaaatttattataaaaatatatttaattattaatttaataaaactaatttggtattatatttgtctataaacttagtcaaacttgaagcagtttaactttaaccaaaatcaaaaacatattataacctgaaacggagggagtagtaccaaattgatctttgtgtaccttgataactcccttaatttttgaacacacgtttaactatttcttttatttagaaaattttgataattattacttactttattgtaatttattttatcatttaaaaatacttaagcatgatatatcctacgtatatgtataaatattttgaataagatgaatgtgaaataaataacggcgtcatttacttaaaaaatcgaccgagagagatccatcgatctttttactgacagcaacaaggtagctaggcactcgaatgtgaatatatgtgtacacacgtacgtcatcttccggatgcatgcaacaccaccggctgaactagacgatggctagctgcgaatccgaatcttaattattttcggggcaaaacgtacataataacggctacattactactatacgctatgtactatgaacagctagatgtaagacagtacgaggtactacgacttgatggatatcctactgtacaagtagccccctctctcgtgggtgccatgcatgcacctagtcgtcgtctccgcctgatctcttggaaccagcagcttcctgtgaagaactactgctcttgctctccgctggttcctctccttggcccttcttgtacgtggcgaagaactcgctgttctccttctcaagctccttccacactgctcacagacagcataatcaagaaaaaatattgaaaaattctcgacgaatgagcagatatcgtcatatagaatacggagtattcatcttatattcgtatttcaaggggaaaaaaagagacatgggagtttttctccgatggccaaacaaattaactaaacgcatgcagcgtgcacaatgtaatgcattaattgatgaaagccacagcttctgcatgtgcatatgcaccgcacagttgcaatgcaagtaataaactcctaggtaaatagtacttaaaaagaaaggtactaaacatgtttagccatttatgcaaatgtggcgtgaagctataaatagcgaattaccggtggaggtgatgacgggcttgatgttggcgtgcttctccagcgtctccatgcattcctccttgttcatgttgtagcagatgcacttctcgatcagatgctgcacctgcgtgcaaattaatcagcatacatctatacattcatcagaatgaggcatacatgcatctcgcaggccacaatccagatcaagctagcagaccacgtacgccgtactaatagagacgccacaatagacgtaccaatctgatgtacgaagccggcgacgagtcgccgccgccgccgccgccgccgtcgtccatggccgcacaccacgcaccactcaccggtcgatcgatcagctcgatcaacgaccaaactctcggatcgattgaggcttgcctactcggaagatttataagcgagagagccttgcagctcgctaatggcggatcgaccggtcgacgacggcgagtagctagcgatcgatcgatggatcgatggagtgatcgaccaacgagagcgtgacaagcagcggggtggaggaggtagaaatagggggggatcgacgatcgagtggggacatgtcagcatgtggggcttgctcacgtgggtgccgcctccccattcgcggagaggcggtggcgggggattttgccgggcccacccgccgcactcaccttacccagtcccctgcttttctatgtggcctgattttgatctcgctccctgacggtcagttcgcgaggtaattaattatgcacgctcgttaatttcaggccgtccgatgcatgtggatggtgacttgctagccagaagtacattggaattggaattcaccgtgatcaataggcatacgtacatagacatgcatgactatcaccgatgtatcttccggttcaaacagtggatgtagctaacgtgtacactgcaggatgagatagtaccaaaatagtagtgacctagtagcatcaaattaacaagctgcatatactaataatcaagaagcgactccggttcggacgcccgatgggactgggagggggttaaaattgggccatgacgtcagcgtcacgcatgcgtacaaaactattttaaatttatttttctcttaaattatttatccaaatcatgacccgattgcaccattaaatttgttgcaattaaatcttcaaaacaagaccatgtgtattctgatgaaaaaaatttagcttattattgaattatttttaaatgttgcacgatgttccaccaggtatatcggaattgtttcactaagtagatcgaaaatatttcacttgtttaaatcggatgttgtttcaccttatataaaaacaatatttcagcaaatagtaaaagtatgtttcagttcactgcaacattagatctatacatagtgaaacattatgagtgcactaggtaaaacattttttgtggaacaaattataaaacaaattctcttaatagagggttcccaaaatatgtgggtgatttgttgcaatggagtattttagttcactgcaacattagatctatacatagtgaaacattgtgagtgcactatatgaaacatttttggtggaacaaaaaataaaccaaattcccttaatagagggtttccaaaatatgtggatgatttgttgcaatggaatatatggtggagatacatggtggggccaggaggagacattgcgcgtgaggagggggaagcgcccgatccggctccccccgcgccggtcgcccggcgttgagcatttacgcaataaccatataatatctttgtttttaatatatgacaccgtgacttttttgacaaacgtttgaccatttgtcttattcaaacttttttgtgcaaatataaaataatttaagttaggctttagaatatttaacgataaatcaaatcataaaaaataaatgataattttatattttttaataaaataaatggtcaaacgtatcttaaaaagttaacgacatcatgtattaaaaaattgaggaaacatatagcttcttcattgctactaatccgtacgtgaccaagcccggtacaactcctgctgatagtctccatttcaagagagaaaacgtagatgaacagctttggggacagctatgtcgtaccaacttacaggtaggagtatactgtctacgtactaaaattcttcatcgtttacccactaaagaggaatagaataagcacaatttggttgcgcttcgctgaatttcctaacaaaaccggaattacggtaagtattgcaatcattcacctgtcgaagatggcaataccgtaacattcagtaaatctatataaaaatcacaaatactcatcacatcatacactgtactactgtagcgtatgccactatgcatcgatatctataatagtaatatgtagtatatatgaggtgcaaatcgagcacacacatataaacactgtagcacgcactgttgataattaattgtccacgatttgattatacaactctccggaaaatttgggccaaatgtggccgagatttaaggttaagctgctcccggaatatgggagtgcgccaggtcagccgtgcgtgctagtcttcatctagcttgtcagtgagatcgtgagccacgtgtcctccatccattggctgcccaaattgcatcgtagtacgaattgatcggccggccatccggcggcccacgcccataccgatacagtgtaccggcacggtgcgatcaaattggtacccgttttgtctgtcttgattcagccataattttccgagcccaattttgatcgtccgtcttattcgaaactttttttaaaaaattaaaaatataagtcacgagaaaagtactatttatgttttatcatctcataataataaaaatattaattataaaaaattaaacaaaatgaacaataaaagttgggtgcaaaaactgatggttgcacttaaaatgagacggagggagtatcaaacggaccaatagcgaaatatttcctctgttccatagtaaaattaactcctttcgtttatttcaaaataaatttatttttaaagtaatcattgcatcggagtttgtgaaagtagaaaataattgtattgtgaataaataaagtgaagaataattgtattgagatttgataaagtagaggtattgtaatattttggttttatattggttatatgaaacaggtaaaaaatgaatttggatagtacctctctcttcgattccccatcgatcagaaaaactaaagacaaaagagaccaacctccctagcttcctcgatcaccgggcgcagatgcaataatcatcgaatccgtgacacgaaaagctacaaatggccaaatcatgcaaagcatggcccatctactatgctcgacggaacgccacataaaatgtgtcgccgcggcgagaaaaatatatatcgacggcgactaaagagcaaagaggacttgtcacctactgtgtgagatatttcgagctccccctatccacaacggaagatggcgagcatcacagctcgcaaaaaccgatcaaatgtggatcacaggttctcgatggattcaccagctaagacgcgcgcctcgcggtctcgagtgcaatgctgcgactgccagcgaggtgcagtgcacctggaacgtcgcaggtacgtttctgccggaattttggcgttgatgagcaaccacttgacctgatgaccacaaaagttaattttggcagggccgtgcgcgagcaacaaggcgtacgtgtgcagcctgtgtgatgccgatcgggcagggtgtcgcgttgcagggtgaattggtgtcatggcgtgcgtcatttccctcttggggcttcgacgacgttgttttcgccgtgatctgactgaaccacggcaatacgtgaggctaagcctccagtagccgagtgctgcctagtaatctctagcggtatagtgatggtcagaaattagcaaaatatatctatatcgtctattgacaaatttcagggcatttcgctctacgattcaatgaatgtaggaatgatcaagaatcgacatggaaatgtcattattatacggaagaaaaagcaggggccagcaaacagcgacgctggaacggacgcaccgatgtgcccctctgcataaaacacgtcctcaaaacctcaacgcagatgaggcgcaaagatgccttcgcatcgccgcggaaaaattttggataaacccaatcaaatagggagtataataccaaccacatttcaaagaataagatgataagcagctggttaatgaaaaaaatcgacagatgacaaacggaatctggaactaattagcatgggaaaccaaaatacacgataattcatatgcaatctactcagcaaggagtaatgtgaacaagcaatatgccgaaatcaagttttcctctagaggttggcgggagtacagagttcggattctacatttccgcataaatcaatccagtgccctaaagaagtcttcgcactttagtaccaagttatcagagatccagcggaatgactaaggacaaatacatcgtcgtacagcaagagatcttaggtgatgtatctttcctgctgctcctgaaggagacgcgccgacgatttagcatccaagtacagaccactgacttcctcaagatcggcctggtaaaggtcatgagttcaccgtgtgtaagatagtaagaataatatcacaatataagtgcaggtagcagctctaggagcgaagaggcgaagaggatgttacaatatatcctgatgaaatgtcaatacataccttgctgatcttttctctcccattagcctttgcaactacgctggcaggtgatagcagctgaatagcatgcctgcaagagattcaagatatacagtcgttcatcagtagcaatctcaattaaaaatgcttatagtagaacactgaaactggaaggtaagaccggtccactcaacatattccctttactcaacgtttcagcttaactatcttttgcaaatttgtgggcatagccaggaggaacaataacaaccaaaaagcagcagtgtggtgagcacaaagcgacctattcttttaccttttacaataacaactaagggtgtgttcgggagtgaggggtgggaaccctcaccccctagcacccaaaacgaagcagcgtttggtgcatgatcaattaagttttagctaaaataaatttgaaaaatggattaacatgatttttttaaagtaactttcacatagaaaatttttgcaaaagacataccgtttagcagtttgaaaagcgtgcgcgtggaaaacgagggaagtgagttgggaaagtggagataataactcagcctaagaatcatacctcaaagatgtctgttgtccgatctctcctaaaaatgcaagactttcttcatcgatctcaatctcttctacctgtgctctaatagcaagaatctgcaaacggcgatgagcaagaatcacacacatttctagacagaaaaagcctaactgatataagacccaaaatcaaacctggatcatctcagtgggaccgtatgtttctgttcgaataatcaccaatcgatctagaagatcaactggtataccatgcggacttgtcatatcagttcctctggacacattcacacaagtatataaaagacttgttaactttaaggagcatagtaatagacaaactgatagacgcagtattactctggtactgcaatgtgacagagtgcttcgagcggtaaatcaaaccgtttaccttacattacatattcctctatttgtcgcaagtatcacaattggtgataatgggctctccagagcacgattaagataagagaagcattcaatatctagcatgtggacctgcaattaaagttcctaacaataataagtaattaaatcaaacaacattaagacatatttctaccatatagtagaacaatagtaataaataagttatacagcatggcactgcttcacaaggacaagacactgtatgcttcacaacatataaacacaccatcattcatatttgtactttctgactccaaaattagcccactgagagcagtaaactttcaatcatacggataaaataagaagatacctcatcaatgaacagaacaccaggtacaagctctgcaattccttcatcaatatatctgttgaccacctactaaaatgcaatataaagattaaagatcatacatcgatcctggaatgttcattaaatttaatccagtttcaaagaatgggtgccgctcaatcagaaactgaaaaaccttattgatttcttgccgaagcttgtcagtgatttcagtctttcgtggcttcatcatttgccccataagggacaaaatatcttggcctccttgtggttgagcatttgcagcgtcaaggtcatgaagtgtaacatcctgtacataaatgacaggagaagttttcctatattcattaacttccatataacttaagagccataagcagaaagattgaatgcactaacactgcatatgagaacaaattttcttatacagcagtaaaagaatataatgtttgagagataatagataaaaaggcaaatcatacagcttgacctttgtcagatgtaacaataattaatcaaacctaatgactccaaggattataatacgtcttagtaagacatcaagtcatggatttgataaaatcttagtgtttgtttgttaacctaatgactccaaggattataatacgtcttagtaagacatcaagtcatggatttgataaaatcttagtgtttgtttgttaaccttatgaaattatttaccaatggaggtacaattacaaatgtagacagttaggtgaataagacaaaatcttatttatttttgtttagcagggatgtaagttcaattctccataaaggtgtcagacttggtcgtaatcccctctattcagacaaggtgtgatggccacaaaatgcaccatagctctactttcaatcttctaaacgtcgacatttgacactgtacttcaaatttattaaacacgaatacacgatacatttatttcttcgattatcaacaacattaattaatggatagcacaatgcaaagaagagttgactgtgcaaaatgtatgggcaaaaatccttaagacaaagattcatcaaattacctgcactatttcctttttcttatggacctctcctttgggaatcggaacatactcctcagcttcaagatcgtattctgtagcaaaagaatcacatctaccaactcttttcactgcaccactattagcttcaatgtatataacatcacccactgccacctgcatcccacagatagctgatgataaatatgaaacatcttgtgcagaaaatggaagtaacagaaatgaatctcagtaccgagggatctaatcagctccagtccaaagtgataagttatgagttcttacacagtagagtatctgaagtcaatcatgcaaatttctacaagtaacattctccaaagtttgtacgatatattaaatattcaacagaaggcattcttttgaataagaaacaaacaaactcaaatttcaaaacatgaaagaaatgtatttttaaagtctagcacacgacataaggatgaggatcaggaagtaaaccttttcctttattaaagcatcgtaaattgtaggatctaacttcagctgcttagtcccttttacagtcttcagacctatgattacatggctaatgctttttccatatccacttgttgtactctcagcttcttctggcgaaagttcagtaacctaaaaggcaatgaagcacagttttatattattttagaaacagacaatgggaataccgtatcagttatgaatgagtgtgaaaacgtaattcaagaacactatccttgcacaaacttaaaaaactagctaaaactatgtgcttacctctccttcataaacctctttattttcttttatacgcaagcctatagctcgacggaaattttccatcagcacctcagttttcttgacctctgaggaatacacttctgatcccaccataggacagaaggggacctgtgttatgaaataacaagacaacatatcaaccattagatacattggaacttttaccaaaactgaagtagatgtagggcatcaaacaaaaaactcataactattacagacaaaatttatcatatagttcttaggaataaaacaaacaaaatgtacaggtatccaataagttgacatcttatgccagtgatccacaataatttagcctcagaaatcttagcacaaatattttcaaggaataaggaacttttcaccaacaggcgaaaaggcactataacatattgaaccagctagcaacaaacatccaaatctcaaaaaatgctgaaaggcaaaaacatagaccataacacaagtttaattaggtgaatctaaaatctaattgaatcatcctatcaaagttcaatttagaaaatgacaaggcatggatctcaaatacctgaagctcaatataaacacctttgtggagctagatgagcccttgtgaatgcagaattacttatttacactagctaattgaagaatgaaaaaaatcaaacatttcaagaaggcttattatcaagtgtccaccagtaatcctcattgaacttgataaatgggattcatctgagcagctagatgatttaactcattcttcagtgaagagaactaggaaactgaataagacctcttaaactaagcatgtcgtatcagaggtaggaaatttatcccccgtcacacatcataattgtaagtgaaattcggacccagtttggttggtttgcaacctttcgaacctaccattttaccccaggaggatcctcaatctcttcactagcagacaagcgaaattgcaaacttctgccttggaataagcttgcagtaagcatccgttgtaaataacagtgtgtgttcactatggagcctaaatctaacatcctagtttgtagcgtcgagtacaaatctagcgcagtcctcaacggtacgaaatacagcggagaaagtgtagcattgtgcatttcagaagcaaacatttatctccatcaatccaaataccccaacaataatacagtttgtccgaggagaataagttgaagcaccaaccttactacctagctcctgagagatgccgagagcgagggccgtcttgccggtggcgggcgggccggcgaggagcagcgcgcggccggccatcttcttctggcggatcatgtcgaccaccaggccggccgcctcccgcgccgccgcctgccccacgaaccccgaagccagccctatcgccgccccattggcctgctcgatgaaaccaaaccaacaagccaaaccgtcagaaaaaagaacaaaaaaaacacggagatctacgcgaatcaccccgaggctaaaaccctaggagaaaacccccccgcgttgcacggagaagcgcggaagatgagcacgcacgtcgaggccgaggcccttgatgtgggtgtgggtggcgatgcgctgcttcttcgccgccgactgcacctcctcgatcctcatcgccgccgccgagcacgcgccgccgccgccgctgcttgtctctccgaccctctcccgccgcaacaaatttgggaacggcggggagcgctgcggggcagagcgcagctgaagaggttttatcccgatttttttatttgtgataattagttatgcctaaattaaatatttagtaattatgggatgggatttactatataggaaggacgctcttgactctagcgtccaggattggacgctgtagctatgtgcgtccaggtcgggatgttgcttgtaaaaacgtccataacctggttcgcatgcgtcatgtgtccagccaaaatggatcgcgtatttggggtctctgggtgccgaagtctacgctgttggctactagaagtcagtgagtttcctctccattcacctatcactgaaaaaaagatcggcgattgacgttttgtgtccttaattattttctgcgcccctgtatttagctattgaagtgcaaatagctttgccttcatccctttctctaacagactgtatacgttatcaattttgtcaatgtgatgcaatcatttgctctagcttgttactcctattagcgtctagaaggctgcacagaagaatacatatatgctacgggttcagcaattgtgttggctcagacgattcaaaaaaatattcaaatgatatcaccacatatcagaatacaataagttctgaccacataaaaaatgaagcgatatcctttcaatccaatcaaatgttacagcagtattttttagcagattgtgacaattaactagatagtggtatgaatggaattcactaatatttgaaagtagagcactgtaagtacagaccttgagcacacaaataattttacaaaataaatagcaatgtctagttttcggatagttttgatatattgaatgaccaaggcatccataacacatcattagcggccggtttttccaacctgcaaacaaatttatcaagatcgatcaccaatccaaacattgggcccgaggagagggaagccggtgatggcgtttcttcgcgtgccgtggcaaatggttgtggagagcaccgaagagcatccgaaccgagcaggatgaggtgcaccaggttggacgccgcccagaacagcgtccacctttggacgctcttcgaaagtgtgtccaagtctagacgctatagggaaccgcgtccatcctattttcacaaatttaatctgagatttatttatttaatttaaggatcattaattactatgaataaaaaattcggggttttatcactagtcgctgcacagtggggccagaataaaatttagtctgaattgtacgcaaaccatcactgaatgcgtattatttagtttacgtaaattgtctacagaagcggagattatgtgataaagaactaatgatcgacattgccccggacaggagagcaaacacccgcacgcttttgcacagcagatcatttcatgcttctactacgtgctactactacagactggtcgtgttattgtgttgactgttgagtgggagtcgttgagatccaaagtggagcagtttagcataagaccaactccatgtcgcctcttgattacctaaaccttaattttgacagcttaaacaagcacacctcacaaaaaaaccacacctccaaactcccaagcctcgtctacgagtcaaaactgcgcgccgagatgcaagcacaaactcgtcgtcgcatcctcgcccaatcctgcgttgcactcgcgctcctgctgaccacggtacacacggcagccggccgccggccggcgagcaacaaacccacgctcccctcccatggctccgaccagaccatgacgctctacaccaccgtagccacgccggcagaagctgccggcgttccttcgtcgcaacaccccgtcttcgccggccacggcccaatcggccaccactccggcggctggctgcgcgtcttgacgcggccgggagcgctccagcccggcgcggcggccgtcgtcgacgagaggttccacggcaagaaagagttcgggatgccactggctgggaagcttcagggagttctcgtcaccggcctggaggatgacgacgatagccgtattgtggcagtgacggccttgttttccggcgacggcgaggaggatagcatcaggttcttcggggtccatcgcgacgaccaggaagagtctcacatcgcggtggtcggagggacaggacggtacgacggcgccaccggtttcgccgttgtcagagcagctgacgcacataaagctggcagaaatgtcagctcgaactcagttcttagtttcagagtgcatttgaagtagagtagaagaggagagcttgcagagatgcataccatatgatgtaaattaagatgagaatgctcacaggtgtcaagactaaagtactgtactatgttaagcttgctgtactacaatagattggcagttgaacattagtgaactaaggaacatgattgaactgaagagcaaaaaagcgaactcgtctgaatatatttcacttgaatcaaatattcgtattacaattaggagctagatgaaaatttgaaaccaataacagctcctgatatacaaacctatacttctcacaagacttactaagattcacaatgtggacaaataattaactaattctgttctgtctcaccaagatacaaaaaaatcaagtaattctacaacatttatcgtgtatgcagtaaataacgttgtactgcgtgatccagcaggtgaagtgctactgactatatttgcagcatcatatagaatccagatgagtaaacacacattgttttgattactcatccaaaattctttgacggaagtccttcaccattaagggaagaccttccctgagagagacctttggctcccaacgtagcaggtgcttggccttggtaatatctggctttctcatgtgaggatcatcagctgtgttgggtttgaattcaattgttgccattgggtcaattgtttccttcacaacctggagaaggcaaaatgtttgtttatgcaccaattcaagaaaaaaaatctgtaaaacaaattgtgtacaaacctgtgcaagttccaacatggtgaattctcctgggtttcccaggttgaaagggccaatgtgatcaccctccatcagagccatcagtccagcaacctaaaaaataccacaaaagattttggaactttaagactttgcaataggaacataatatcctgcagtcatcgttcaccatttatctgctggagataggaggagctgaacatatgattgaaagcacaacagaattgtcgcacagagggaaaaagagtgcaaatactataagctggtgatttcctgaggctcaagaatatgtcctaatttttcaagtttttccaatgaagtccggactgaatgccttttggttaaaataagctataacagaattctgtgcataaaacacttcatttcatttaggatcacagtatgcaagtaatctgcaaaagaatgctgcctggagaacatacttgaaaagagtggacaacatctgtaactaatgagtaaacacacacacagaaagcacaataagaatactgtttattgcttaccagatcagaaacatactgaaaacttctagtttgttttccatcaccataaactgtcataggctgtctacgcaatgcctacaatgataatcatgtataaactcagaatttcatattgacagcgcaaatgtgtaaccaaaagttaataaaatagcggtacgtgttaaacgaacctgggcaacaaaattgctaaccacacggccatcatctagacacattcgagggccatatgtattgaaaatgcgagcaatgcgcacctgcataataagtcagttagcaaaagatcgtagaatagctatagttactaagatgttgaagtcacataatgctacaatacgaactacagtattgcagcaattctactctatttcatcctaagagttagtgaacaagattatatgttggacacgttaatgtaattgttactttaaccattttttcagtttcatgaataatatagactgaataaaaagtaatgaactaactaaaaaatgacaactaataaagatcatcatcgccccctcccccccaacacacacacccaccctgcaatagactgtccaaaacaaaagaaaaaaaatatctttcaggactaaatggtaaaatgaaacagatctgtcataatacctaaatccatgtaaatgaaaatattagaaccccaaaagtccgcatacaatcgtcatctcaatatgttgtaaacccagcatggaatataagtgggacatatttagattattacctcaacaccaccacctctgtgatagtccatggttaaagtctctgctgttcttttcccctcgtcataacagctcctaacacctgaacaagggagagaagtcagggcttagttaattggaggtccaaatgcaaaggactgaccagaaccaaaagattatataatgtggtaccaataggattaacatgcccccagtaagtctccttctgtggatgttcaagtggatctccataaacttcacttgtgctagttagcaagaaccttgcaccaattcgctttgccagacccaacatattcaaggttcccatgacattggtcttgtaataattgttaagaaacccagatttgataatatacagatgcaacacatgattatattgtaaatagtgaaaataacataataagttgcaaaaaaacatgattggtcaaatatccaggtaaaagacataacggttttatatttaactataaaacttcaactatatattgagttacgatagagcacataaaaagcctttttaagaaaaaaaataaatgtaccttataaaaattcaggtgatctcttttcctaattctcgtacaacagaagctggtttgtgctatatctatatggcatttcaatgaacaaactaatcgaatcctgccaaggattgttcatggaagtatgtttagaaaatgggttagaacccggcctctacatccaaaacggatgtacacagccattgttcatggacgtatggaacaactactactctctgttaaaatcctgtagataaatggcactacagtagaaccggctaccccacatttaccacctgtgcatcacaactaacaaatctatcgcgtcttcctaagatctcaacagaacaaccacttgatattgaaaaaaggaggcaaatttaggatccagggttcacttgaatccaaaccaaccaccaaaagtttcagcatacgagcttgatctggaccacttatgtgctagtttgcttcaagcatatctcccacccaccaacccaataaaaaaaaataaaggagaagatcaaatcaagtcgacatgaatgtaagcaaatcaaaggtatgtgcagatccgggacgagaaggatatgatcgtcttgatggggttgtacttgtagtgcacaggggacgcggggcacgcgaggtgatagatccggtccacctcgagcaggatgggctcgacgacatcgtggcggagcagctcgaacctggggttccggaggtggtgcgcgacgttgtccttcctcccggtgaagaagttgtccaccacgatcacgctgtccccttgctccagcagcctgtcgacgaggtggctgccaacgaacccggcccctccggtgacgacgacgcggcgcggcggcgggcggaacccggggggcacgcccgacgccgacgaggtgtgcgaggcgaaggagaagagcgggcggcggtcggggacgtgggaggacggggagagggagaagaggtaggggcggaggaggaagaaggaggaggcgatcagggcgccgaggaggacgaagaggaggcgctgctcgcggaggaggtagccgacccaggatcggggcccggggcgggacgccttggacgccttggacgccggggcgtgcgccgccgccggcgcgtgggtgggggacgacttgtggagctgcttcatggcgggagagcggcgcggcggaggaggttggtggtggtggcgtgggttgggggaaaggggggtggggggtaggagaagaaacaagccgaggtgtgcgagggtaatttggggttttcgttttgctccgcgattgttgcgaattgaccctccaacagttcgccctttgttagaaaagcaccgcatttcatgcaggaagtgaggaagaagaccctcttgtttgatggttttcatcccccccccccttttaccggttatattgtcaaataatactctcttgactatgttcgtcagggtgagattgagtgagaaaacgcatcgttttccacgcgcacgtttcctaaactattaaatggtatgttttttttaaaatttttttatgtgaaagttgctttaaaaaatcatattaatccatttttgaaatttaaaattgttaatacttaattaatcatgcgctaatagctcatctcgttttacgtatcttccctatcttctcaatccccttctccttaaactcgtcgcttgttctcgatgcaattggctgcttaaccaaccatatccttagtacattggtgatgaggcatcgtgtcaaaaaaatccaacgacaaaagcgatatagcttcaacagagttgtggttgtagcagcttaggttatttgtaaatgagagaaagatctgaactttcaaccaataccgttgaagctggatatagctaccaaagatgatagcaaaagaggatgcgccctagtggcttgctggcgttgtactttggtaaatttcggatcgtagaagtagctccataggctgtatacatattacaagagataacccgtttaaaactgtcttttctttttgttacatgtaaactacctcttaaaagcttaatgcgatgatatacttcgtgtttattatcgaaaaagggattgtgattggctgcaaatatctaaacttgtttttttttgtcaattaaccatgtgtattaatattttttttatggtcaccttgactcaaaccctgttggatggatcgccacatcactaatgcttccagacaagaattttcatataaaccatgtttgacccaatataaatagttgtatcatatatatagtagtactacatataacgaactcttctccatataactaagtactattttatcgtcatgttataatcaaagagggcaataaccatatccgtgcactaatgttgctatattattgtgctcacccaaatagccatgcttccatgaacattgatgacgagtgttacgtgcgttgatcatgtttttgctttttcttttaaaaaagtgcacgctgctttcgaaataacctctctgaaagataatacagtacagggtgccaaacgcaaatagacccgcgcaacatggaggattcgttggacgcttgacttggaagggttcagaatctctctccccatccagatctggcccacggacggcccgggcagtaggtgcactgttagattcgtgcttgcgtgcctttgagattcggatccgcgagtctgttaaaccgaggctgtcgcgcgtcatcgaacgacgacgatctgttctgaatttctgatcggagacggcgcgtccctctccctcgtggccgcctcgtcttttcgtcaaatcgaagcaatcacgcaaactgccgctccttttcctgtctccttttcaagacaaacaacaaccctttggtggttagcaaatgcacgtcaaaccttcggtttaatttagcgacaccaactccaatcaaccaatcatcatccagtctaaagtttaaccgattaccagtacaaaaatcttctgtcagcaatgtgatctgttccaagctctctgcattctgcatttctctagtgcgcaattcctgatcggaacgagttatttattcagaacaagtttcagtatatcgttttcggtaggacaaatttacagcggacaagcacagggaaactgcaatggcacatgattgacatctctcagaaagtttcaggaacactgcctgcacaatccgacctttcgtccagccaggagatgatgtcagaatagacacgctcgacatcgtcaggaagctcagccgtcagagcatgccacatcccagggtaaagcttgaaagttttgtccctgcctgatgcttcttcgaacagcagcttgctcaccgaaggatcggtcacgatgtcgtctccgccgtgtaggaccaagaacggcagtgtcacctgccaactgaaaatgttaagcagaatagcagtgtccagggagttactgcacatttgcatcagttgcatgtcgtgtgcagctcgaatcgagaaaataaacatggcatatattgaaatacgctgttctaatgatgatacatgctttttttgcttccaattaggaatagagagaaaataaaaccattttcacctcatgcaggttcttctcaatgtctaggctgaccatcaggagttcatgacaggtcttcagtgggagctttcccctgtatatgtacggatttgagcgaacctaaacgcagttaccaacaaagacaagttcagtaaactctgcctttttcttccggccatgcaactaacacatgttagctatacctgctttctcatctctggatctttacaaactttgtcaattatgtccggtgtgggtatgattctccaactaggagccacagcgcacaccattttcagagcgctgaccgcgatcgggtgaggccgcatgtcatcaggaatctgacatcataaggtagcaaacaatcatacgaaaatcgtttagaaaaagggaaatttaggaagaaaatcatgaggtggtataagtaaaaataaagaactctacaggtttcagaggaaagagagctcgttgtcgagccatttcgccatgaacggaccttgcacataggagcaagcaagacggcgccatcccagtaggttggctccttcctgtggaggagaagcgccacgcctccacccatggagatgccgtacaggaacctcttcttctccctgttctccggcttctctgaaaccagcaaccataatttcagagttttgccatccccaaactgcgtgttcgatgcgtttgatttataccgcaaatactcgtgaaaaagtttgcgcagtctgagacgatgtcaccgaagtttggtatgtagcatctctgaccagatgatctaccgtggccttcatgatcaatcccgtaaacggcatatccggctcgcaccaatcgagcggcggtgtctgaatatttgtgcagctgtcagtatttcagtcaggcaagaataaatgaataatcgaaggatggtgttgatacctctcatcgatacgccgcactctgctgcgattcctggagaagaataatcaaggtgaaaatgatcagtttgtctaatcgcttctttgaatcgatttaacacaaaagggaaatcttgttagtagcagtaccatgacagataaagatcagagcttttggttcttgtttatgcggtgtccatctgcaggtgaacagcttgttgtcacgggagttcacaaaaaactcctgtgaaaatcgagttagaaaaagggctggcgatcagaaactatgaaggctaccacggtgggatcgcttatcaggattaactaacctcgtcatacttgatattctcactgtactgatcctgccaagagaaaaaaaaaacaggttgaggaactcagcctgaatcatgatccgtgatacgcaaatgaatatctgaactggtgtagggtgttactgaacgtaccatggccatatgcgtctatgtcttcagatgctttcggaactagcaaacttaacacgattggtgcctacatcgactatgcatatgtatatatactgcttcccaaaaaaaaaaaaaaacgagcaccgcaaaatcgtgagacctgggaagttacaaccaagcaaccatgggaaatctctgcatttttctttccttaacatagccaatgacacgcaacagttttatacatgtgtgtgtaaaagagtggattccttaacatcagaagattaaaaatgcaactcgtctaaatggaactccagagaccataaaaacaacgcgcatgcagatgaatgtctgcggacgcaggtcagaatcatgtggcattatcagttgattcctcatgttgatcttatactactagtacagtatattccatctggattgcaggacagtggcatcggatccacaagtttgatgaatataatatacggtagcttcagaattaagagtttcagacatctgaagtcccatttcgcaatatccatcgtactttgagagtttttacagtccttgaagaaaggaggtaccaaatccaagtcgtccattacgcaccatccaacggttgcaaaggcttggtacctcgcggtaccgcgtctctaggaaagcaggtaccgagtaattttcaacggtggaagggcagagtagtactttcgcatatgaattggaggggaacatcgcactgcttgctatcgtcgccacaaatcgagcaacccgatgcggcagtcggcctcccggcggcggtgaccacgggggaggtggtcctatatggggatgcgggcagagtactaccctatctcctccctcgtcctcagcgctagtacagcggaggcggcggccatgggagtggacgacggtggcggagacctctcggatggtggccgttgttcctcattgtgctaagaggccgatgcagaccgaggcaccgagctgagcttcgccgccgcagcaactgttgcagttgtgcatggaagaggaggtggacgctgcccctgcatcatggtatgaagccaaggccaccagcaggcagcagctacgcgtccagggcaagacgatggagccatagttttttttttaagactggtgatggagccatgggtgaaaacaacgttctgaataattgaaatttctagttgatagataaattggcttattgaacaggaaacatgcatacatactatatctatatcaatatcaagaacttcagatgttgggtttctctcatccagatttttcaacaaggatgaacacttaggcagatttgcccaggttaaattcattggtgaagttattgtggaaacagaacatcacggagctgcaaagaaggagctccaagcaccagccagctcgagtgcaccgacggacagaggttgaagaatcggagcgagctcgacgggccggcggacaagcttgatgatttagagcgatctcgagggcggtgaattggaacgagaacagagcgggcgagagctggcggcgagggcacaggcatgaaggtcacgaaccctgcggacattcccgggggtggcctcgatgcgacggcggcggcgcggcagcctagatgtgcgacggcggcgcggcgcagatggccagcacaaacgacgtgatgcggcagatggaagaggggagaagagggcggctcagaggatgtcgctattttgttagcccaatcatacccctgctaaaccaacggttagattagattggtacctcataataactcgtacctcatagtacctcgtggtaactcttcaaggatgggaaatatgctctcgtacttatcagaaatactgttaccgtaattactatagtaataaattagtaattgactaattgtggatactttatttgatttatttacttcaagtggactgtgtggtatttttactactattttcattacagttgttcatgtgtcaagcagtagtgtcagcaggagcagaatcagtttcctcttcgaggcaagtgtcttccggcagcggaactggctgccagccggtgaagcactccagtagctccttgagcgccattgacgccggctgaacggaacaagactggtagaaatccaattcctgaatcttgaagtcccacagctcatctgccgcagcttctgaatcctgagcagtgcactcctctgcaccgttcaggaacaggtcgccttcagaccggatgaacccagttgaactctggtctctgtctgccgcctgttgcaatcaccatttcaccaatgcaaagcatttttagaagtatctaagttaaaacgttttatccaccattacgtggcgtaacataatttaggataagatactgaactagtacagggttctgaaacgaggaaaatgacctgttctatcatgtacttgaagactttcttcttctcccctgcctcgtaaatgttgcactgggatacaatctgcagcagtaatcaacttcaggttaaattcgtacaattccccgaaaaaaaaaatctcgtacaatgaagttccagcttgatctgatttttttttcaggtgtgctctctccggccaaaaaaaccaatctagtattagatgtgatactttctaaaacaacaaatcagacatacttatgtataaaaaacgtcttatttaatactaggttgggattttgggatggagggagtagttacctgtgactcgacactggcgcagacagcgtaaatgccccagcccctggtgtagttgttgtagaggtgcaccctgccgaagcggacgcgcgggtgcctctgccgcgtgccgtcgaagaggcagtggtggatggtcacccggatggcacggtcctcgacgtggccggcgctgccgccgatcagcacggccttgtcgtgcgccgagaagcggcacctggacacggtcacgtccgtgctgccccgggtgacgtcgaggaggccgtcgccgcagccgcggaggccgcaccggtcgatccacacgtgccgcgacccgggcttcaccgccacggcgtcggcgtcgtggccgcggcacccttccacctccaggttgcagacgatcacatgctcgcactcccgcagctggagccccttgccggacagtgtcacacgctgcccgcggccgtcgatggtcttgtacgacgacacgcgcagtcccgtcgagaggtggatggtgcccgacacgtcgaagacgatccatagcggctcgcgcctccggcaaccctcccggagcgacccgtccccgtcgtctggagatcgagacccatttgctacgttgttagatgcagggagatggaatatgaataggcttgtgtgtgttagtgtacgtgccctcgagggtcgtgacgtggtagacgtcgccgtggaggccgccgatggcgtggcggccgaagccctcggcctgaccggccatgacgcgcagcgaggagtccgcggtggcgtacggcatgaacacgactccctccacggatgccggtggctcgcccccgcactggccgtcgagttgaggaggctccatggctaccgactacgaggaggttttcgcgtcgctatttgttgagtcgcgcgcggggaaacgcctgctgtagtgctgtttactgctggaatttgttgcgaccgggccgtttggcccgtttccgcttttgcagcggcgcgcgcgtttcgggccggcccagacaagccgccaaccggaagtccggaagggattaacacaggtcaaacagagcgttttaggagtttgcagggtcgttgcattgcatccagcacgagctcgttactatctgcatgacgttacgagcattcgatttcaaactatcattcaatctcgatcgtgatgtttttacctcccattgcccggaaacgtcagtgcatttaagcttgtccctaacataagttttcgctgttagatcgtttaatgttcataacatcacatgagactaatcttgaatgaaaaatcagttgggaaactctccccctttgatcaatcttagctaaaaacatcacatcggaatatcctctttgcctgaaaaccctctctaatcttctaggccaaaaaggcaaaaaatcggtcatggcccttcccatttttgtactgtttgatgaaagttttaagtaatatcatcgtgcgagacatccgacagtgcgaagtttggtgtgtcgttgtcacgtaaccttccctcgtttcctcatattcctaccgccggttgcgggtcgtctttttctcgcccgtttcatgggctccctttcatgtcagcatcggattgcgtccgaacaaagtccactcaaactctcaaaggaagatcctgaatggtctccgatcgaagctgtattggctatctgcgaagtgtcattgccggctcagtggatacacacacaggacacgaatgtacaatcactaaccacgcagcaggtacgcaataaccagcgttagtttaagcaaaaaaagggtcgtcgattacgtataatttccgctcgatagagccaaaaccgaacgtgcccataatccccccgtgcgtggatttacgtgacgcgcgacagcgcaattctctcccacttccgatctcttcttccgcttggactcatcgccgtgacgtcgacgttccacgaggaaaaggacggcgtcgaagccaccgggcaacttctcactcccgctcgcgtctctgacaagtgggccccacgcctcgctttcttccccccacctcccgcccggctgatggcccaaaccccaacaaaacctcctccgcgaaagctacaatccaaagggagtcgttaccgtctcgccattgtcctcctcctcctccgcccccacctctctttcctcgtgccttcctctttcgccgccggccgtgcgcctcttaaagccgctccccgcccgaaaccctacctcgggaaccctaccgcgcggctttgacccagggataatcccactactggctactgcattcgcttatctcgctcgcgatgtcgctcgaaatccatgaaggtgagtgatgggaatgtttggacaggtttggtggagtgtgcgtgctcgaggcgctgatttggtttgtttttggttgtttgggcgcagaggagggaggaggtacggcggcggcggcggcggtgaaggtgatgacggtgtcggggagcgggaagcgggggcggtacgtgcggcaggtgacggggcggcacaacgacaccgacctgcacgtggcggcccgcggaggggacgccggggcgctgcgccgcgcgctggacgaggcggcggcggccgtggccaccggggaggggagggaggcgctggaggaggtgcggcgggccgtggcggcggagcccaacgaggccggggagacgccgctcgtcgccgcggcggagagggggcacctggaggtggtaagggagctgctcaggcacctcgacgccgagggggtcgccgcgaagaacaggtcggggtacgacgcgctgcacgtcgcggcgagagaaggccgtcatggtgagatgacacatttagagcaactgttgccatatgtttatctgctgggcaagattttgagcattgacgtatgcacggaactgggactcgatgcaaaagtctgattgatctgtaaattccaaaacttcgagatttcttatgataaaaatttatggtataacttccactgcaattagcaagtccatagagagagggagggataaattccaattaaaaacagtaacagtgtgtgtttcgtaacactaattattgctaggacctgagtttgctagatacaatattgtttctataatctttagacacaaactcatgtctaactgactaccacatattaatcggtgcttcttcttgctgatttttcccccatctgtccatgaatattagttgttcactttcctctgaggtcagtgtacttatgtaaattgttgtgattcaaaaaatatgttagcctgttatttcattgttagcatggcaacttgtaaccttgaatttctggatattgggtttgtagcagaaaactgtgcataattccataatcaaattaaaagttttggtcttttatgtgttctacacattctgaattttgaacaaacctatcactttctcatttatacatgttaacagcgaagccaatatatgcagtcgttcattttctcttcatacataggaacaactaggataatgtaactaatgtctttctccagttcagtgtatcttgatgttatcccttatgtatatagtatgcaaacctctgagcaaacatttttttcttgcagctgttgtgcaggaaatgttacttcacaataggttgcttgccaagacctttgggcctgcgaatactagtccacttatttcagcagctacgaggggtcacaccgaagttgtcaaattgttactagaactagatgattttggattggtggaaatggctaaagataatgggaaaaattccttgcattttgctgctcgacaagggcacgttgaaattgttaaagcattactcgagaaagatcctcagctagcaagaagaaatgacaagaaaggtcaaacagccttgcatatggctgtaaaaggaacaaactgtgatgtgcttagagcacttgtcgacgctgatccagcaattgtaatgctgccagacaaaaatggaaacaccgccttgcatgtagcaacaaggaaaaagcgagcagaggtaattaatcatatttctcaatgttttcattttgaataattttatgtcttcccttgtgcactggcattctttttcagttctgaaggaacatcatacagaaaacaattactaacactatggaatgtttatctttcatatgattacttcatatctagaaaactacaatgtaaaaagaacatggaactctacctgatggttatatcttgttaattgaatgatcaaatatccattaagatttactcttcttctggaaacattaatgtacagtttaaatgaaatcaaataggtgatgccatgtgttttcaccttctaagaaataccttgattagctatgttgttaccccttttagtatgggcatcatccaatcaaatttattaaaaccaagttattctcctagctaatcaaattatcttgtatgaacaaatgctttcttaggatgcgctaagtgatatttgtgcattttttggttcaccagaatagatagtcattagttccttttgtattaataaatataatctaaaataatcaaataagtcattaatttcttttttcttatcttctacagatagttgctgttctcttgcgattaccagatacccatgtcaatgcactaaccagagaccacaagactgcgtatgatatagctgaagccttgccactctgtgaggagtcttctgaaataaaggatattttatctcagcatggcgcactcagatctagggagctgaatcagcctcgagatgagctccgaaaaacagtgacagagatcaagaaagatgtccacacacagctggaacagacaagaaaaacgaacaaaaatgtgcatgggattgctaaggaactcagaaagttgcacagagaaggcatcaataatgcaacgaactctgtaactgttgttgcagtactttttgccacggtagcctttgcagccatattcactgtgcctggtggaaatgccaacaatggagttgcggttgttgttcaggcagcctcctttagaattttcttcatcttcaatgctatagctctgtttacatcattggcggtggtcgtagttcagataacggttgtcaggggagaaactaagtctgagaggaaggttgttgaggtgatcaacaagcttatgtggctggcatcagtttgcactaccatttctttcattgcctcttgctatattgtgctaggccgccatttccaatgggcagcactactagttagtttgataggtggcatcacaatggctggtgttctgggtacaatgacatactatgtggtgaaatcaaagcgcatgaggaagataagaaaaaaagagaagatgtcaagaagaagtggatctagctcctggtatgataatactgagctctcagagactgagcttaaccaagtgtatgccttgtaagagaaaaggtctcctagattcagtctctgtctctgggattgatatgtacatgaaaattccagatatacacattaacagataacatagctcacagtatttcttgatttttacaattccttcctgtatcaaccaaaccactcagaactaaatggaataccaattgtccaattgtgcaaggctccttcagctgcagaattttatggcaccaaacgagctcaacctattgtacagtgagttgcatgtttttttgtttttgattttcattctattgccaactttcatgagaaaggatttttttttcttattctttctgtgcctacttatagtttgtgatgcgctcttcagttttcataatgtaacaacagaacctgacacgttttagttccctttatgctattggtcatcttattcttacaatgttgccctttgatgtaatttttacaatactgattttatgttgtttcataaataaaattttactgtggatctaaattatgtggctgtaagtctgtaactttgcctttctattttcccggaccttttcaatcttctattgaatctataacgtttctagcaaaactagtaagggtattcctggatcttatcagtaggtttctagcaaaattacctagtgtaatgaatgaagcaatactcacctcgctacatcgtatatttacttgtggcaatgattcttctgtactttggggggggggggggggtgcttttttttttttttggaaaaaatgacccagatacataagcctaaaggtatgattggtgcagacagaaatggtctctgatatgcctgtgccctggttacactccattacaggtgtcactcactggggaaaagactgatttgcttcaccactcaccagaataacttacgattgttttgctcactaattaggaaatggacagtacaagtcagggaagcaatcctagaacactttaaattctgaaaagcacaattgtgcagcttatgtcatgcaaactacacagaccaatgtgctcataaacaatggaaaacatttggctaactatgggttagggttatatagaagcagggaggcataaagtaggccctgttacatgcgtactatcctaacacagcccaacatcatcaatgtggtcggtaactctgcttaactttggcttcaatgctgccctgccttttatcgacacacacttttagtttaaggcttatttgtcttcacttggtcatttatttaccagatgttctgttttgaagccaagaaacacaatattcccttgagtggattttttttctttcaatttatgatagactttagtaaggagtgttatatattattacccaaccttctgtatttcttaaaaaaggaaagatgatcttctgtagtttcatcactttatgcttaaatgaagaaaccaaccagttggaaatttagtacttcagaaatgaagctgatcttttccgtcatgctgcagttctcctgatgccaaatgggaatggccaaattggacgattgcctttgttttgtgctttaattggtggcgtggtatattggtatatgtccttggcatgctttgttgattgaacctcctgttcttattgcaattgcttggtcaatgacatctcttgaaaacttttttgagcactaaagatgatgctaataacatcaatggaactatagcacaatcaatccctgatatttattatgcaaattctgagaaattttgtcacatccaatggcctatatcttaatctgtcttcgaatacagatcaggatacccaggcagtcatcaagtgtgaacataaagctcttgcctccattgttttcacattttcccttctttttcatttaattttgttgccttatcatattcttccttcccttgtgattcacagctttagagttgggcattatgtgactataagcagatgtttctaataagcactacaatggattttttttatgtatatacaactagaaagggattttgtccttttggatttcatgttttaagtgtgtcggccaccagtgctgtgtatttcccaatcaaggtacttgccatagtacaggtgtgttccttggttaacttagagccatgatagttgcattcagaacccctgaaataataaatattataatacagaagtgcaaagctcaagatgcagattaaattattaataccaaggtgccagaaaagctttttgtgcataagctggactcccttgagttaatgtagtggcgcactttgcccattgttacatacataagtaaggcccctccgcccatgccgattgttaatattcaagctgcacaataagaacttcattgtcttgctttatctgggcatgcatttgaaaaaacagccttctgagagtaaatatgtgtcttgtatagtgaatatgaaagggcatgtagcctagtggttatagtgacctgagtagtaccccaaggtcctgagttcaaatctcctatggagcgaatttcagattgggttgtttgcggggctaagttccctattttcaatggccgtatatatccggttggatgtagaggccgggtaaaaaatacccttctctaaaaataaaatgtgtcttgtattgtgtttaagaaacaagcaactaagatctaatcaggaattggttgcatgtggagacagttacacacacagaaacagaataaagcgacaggtccacccaaaaagtaattggccctctttggttaattatgctccattttctcttaattgtgatgtttgtttatattacttctttttttttcttagtagcctactgcacatgcacctgcaatagggatggttatgagagaaacttttacttcagtttagtttgttgatgggaaatctgcactctggtattagacagtcattccaagtgcttacactatttggtgttaaagattagaattagaaatttgaaactatttgttcttacacaaattacacaagctacttgaatttttctgaaggacattataagatcatgtctgcaggtatctgaagatcaaaagtgtacagaattagcaaaagtgtttaaatttgtacataaacacttcatcgtccgcaaatctcaattatatcatctggatcttcagactctgcagctatccttgacgctgatgatgacatgaaacggaaacctgcatcgcttgcactctttctcaccgaggccagttgctgtgaccttttgcagtatgctattgctccctggattggattgtccatctctgagcttgcactgctgctcctcctgagcactggccccacaccagagtcagtggagcttagtatggaggaggatgaatttgatgaagagcatgacgatgatgacgctgaggatgtcttgtttgatgatgagtatcgaataatgacgctggagaaggacctcctgtggccgcactcatcttctttaagcctccctccaagtgtgacactgttgctgataggcgaggctatgtacctgttgcttctgatctggccaaatgggttcttcctccaagacttgaactgcgcattggagagctcatttgcactaggtgtaccagtcttgccatctggattgcctgctttagtggcaaatattgtcttgatataagcttttgatgccttgagcttgaggccaaggttgagatgcctgatgaacttgagcttcttggaccatggcttcttttcgcaggcggcggcctcctcagcagcaccaataccagctgatgtgcactcgtggaagtaatgctcagcattgagctctccactgacataacatgaatttgccggtgatgcattgcacgactggtatggcgttgctggggcagtgctcgcggagaggaggcccttctcagctgcactctcgaggagcttctcgaccatctggatgcgtggtggaaggtggagcggcagtagcttgcccttgtagaagagctcatcggctggtgatgccgcgggctcccacttgtcaaccggagccgacatgtggaactcgaactcccttgagttttgtggggaggctgccatggctgtgctgtagcagagcaagcttgctctggcactggcagtcaccgcctctgccgctgcaggtgagctcaggtccatgtctatgtagtcctcttcttggagtggttggtcatggctttgagggccatgtctcgccattgttgttgctaccttgtcttgtgtgtttggtgtgtgtttctggtttggttttggcagagatagtggttgtgttttaggaaggaagtggaaggagtttcggcatgctttaaagcaggatgcctgtagctaaagagtcttattaattggcttatactagtactacttatgagggacctacccttaaaccctatgatctgccttttgttagcatcctaatcctctttctgtcacggcaatatgcaatgcagtactactatggtaccagtatggtgcatatttactgtcgtgctctattattgccctattttttggctgcagtgcatttggtgattaggctattttagttgtttcgtccttcgcatgcttctcttctcatgacttaagctatatgtttgtttaaacgtgtaggtttacaaggtatccattaagagctaggccaacgaggtgcgcactttaaccaaagatttacaaactgcttggtaccttctgataatgtatggttgcaatgggaagcctcattttccttcaagcaagatagtgtagacagaggttttgtgatggttggatcgcttgatggtagccctgaattatttgtttgtggaggagtggaaggtgcaggatggttaaatcatcccggcaaaaactacctgacctgggaagacctttgaacaattggaaggtttttctggagtgaacttgcttccaaggtaaacatcttattagctcttgcttgacctttcctgttcaagtctatcattgtaaattttaaaggacgagcgcatgccctcaaaacatggatcaacatgctatttgtttatttcatcttcatgtcaacctgaggaagtgtgagagtgacatcagtggaagagctcaggccccttgtttaagttccctgtccaaactgggcgtgcgcagctagacgttgtttcttggcattttctctccctaatcttcttatctagcaaccactgtcccttcctgggctggcatccaatgtcaactttgtctctttgctgtaattattgatcactgggcgtgcattagctctcatcgagtcctttgtgcatggttaagagctactcccggcattacaaggcactttggatttattctaagtcagatatctttaagtttgactaaatctataaaagaatattaatatctacaataaaattagtttcattgaatacattttgcttgtatttttattgtgttagaaacattactatatttttctataaacttgattaaacttaaatgaggtttaacttaggacacgtacaaagtgacttataatataggaaaaagtccaaataaccccctaaactttgggtggaagtctatctagcaccctaaactttgaaaccggacattcaacccctctaaactttaccataccgtttatataaccccctaagttagttttgcatagtggtttttatctaatttgtatataagttgaatgagtttgatcacatgtcatacactttggacatatatattaaagttttgatttaaatatttcattttgctccttattagctctcactcataaacaagtcccaacctaataataggatggtctcactcacaaacaaatatattatattaattattcaaccttattcgtttaagcttccaaaatatgcaaaaccatcatctaaaaccatcttaggagataacatggatggtatggtaaagtttagggggttggatgtccgatttttaaaactcaaggtgctagacaaacttccatgtaaagtttagggaggtatttggactttttcctataatataaattggagggagtagcagatttttccatacaattctgtgcggtgattttaatagtacaattaggtttggtatatgaccgttcctttattttttataaattcaattgtattttgcatacaactttatcgaccaacttagcaccattataatttagactcactgatgaaacagtgcgtttctttttttcttttttttttctcctccacgtgataatttacgttttgaacacgatggattttttttaccctatcttaataagcacttatcctaaggtggacatggtttaagctcatgttatctcgttctgatctgagctgatatttctcttttgtttgtagaagttattcacccccttttctaatatacatatctttcttgattcttagaacataagggttaattgcccctgaagaagttctgaggtaaaagaaccttggcagctcgtggatttcggcagaggtatttgttccctatacatatctatatacaaattcgttaggttgtcatttgctatccgttaaattaaagcccttgactttatgatattcttctgaacccttctttatatctgctagtaccccaagcaccagcttgagcactaagcaacgttccacaaatggcttaaagatctaattataataacaccaggtccccagccctaatccatgacataattatatctaaactaacacccattgacaaactgcaggccaggcctgcaccttttgcaggtgatagtgctgattagaaagtggtctcaattaggttaggtgttgatcgagtgcctaacaccctactaaattccacatattggtttatatcaaaatatcgtcgtagaaaagtctgcaactctgaacagttaatcccctgaattgcaggtctaaaggtgaatgttttgcaggcactgttacttggttagtgttggttggaacttgaaaaagattcaagtttgcccccctacagattcataggcactcggaaatattatagaaacggtgaacaacccatgcaaaacttcataaccacctttcttacggacatggtgacatgattgtacctgaaaatgcatggcgcctgaggtgacagtataaaccctaaacgattaaattatggtagagttagtttttttttcctgtacagtaatctaacacgctgcatagtgttttaactgtatgtctgtttttttaaacccatgcgagggcagcgaggccagagctgccggacatttcttggtgggagtccaatattttttgccctgtaagaagagaggagggccctctgaaagttctcaaagctcgaggtgttctttgccgcttctccaaacttggaaccaagcaaaagcttctgatcttgcagcaattctggggtatctgatcatctaaaggcagaaagttcatgaagaattttgactgcttaaatctccaggtaccgatcctaatgattactccgtattacatatggcactaagcagtcatcttctctgctttaatctgcataactagattcgcactgccaaaaatgtttgaaaagaatcccagccaatgaacagtgatactcgcaagaaacaccaggttcctttcaactgtacacatttgctgtgatgtgactgaactagttgtttggaagataacctattttagacgaatggaacaaacatcctttatcaaggaaaattgcttatcttatggaaaagttgcagttgtgacgacttctttatcggaatttatgctgtgtgtgttgtacatgcacctacaacctgtttcgcactgaaggcgctagtcctgtttctgcaaatgcattgcatgtagtacaataatacatacagatgtttcagcttatgctatttattactagctccgtctcaatatatagcaatttaaaatgagatcagattcatcttaaaactacgaacctcagtggcggatccaccgtggggtctctaccccactacccgtattgtaactatgggagaccccatgaagaccccactaaaatgttctgtcatacatttattagaagagggggctataattttatatagtttgttcagacccttctgttaatctttgttggatccgcccctgacgaaccctatatccagattggtagtttagatccaacctagattactacattttaggatacattttaggatggagagtattattttgctcgtttcttttgtaaaagcctaacactgttgtagacgggctagctgtcaagatgggtgcaggagaattgatacgttgaacactgacaaaagctcatgcaaatccaagaggaaaggcaacgtggctcaagaaggccgaaatggaaaaatgcgcttgtagatcaccctccgtgcagagttccaggccttgagcgctttaaggcaaagataagaacgatgtgattgctcaagaacagcgtgatagggttgtccatgatatgatggtcagtaaacataatacgttaatcgaaagacatcttgaaccttggctccctgcgccaaggagcagaagaagaaataccatgggctgaatacctcatcaagcagttgacctgtgtgtttttctttctgacctcgatttctcgtgacactttcttcagaactgtaacctgcaagaatcgtggcctgtcagcctgagagcgttcgctctacctggccaattcctattttctggaggcccaaacaaactaaggtcgcgacttgcaagtgctattggcccagccagaagtccctgtctatcttaaccgtaagcccaaacacataatagttaatctgcaggccccgagcctctccaaccggcccaccgcaccgctttaggtacctcaagacggtataattttttattttttaattttatttattacatttttaaagtatttttttcgttttaaagttttacaaatctacatcctactgccctttgagaggacgcttttcttccgaagagccttttttatgacataacacatgcccgttagtgtgtaacggtcatgcggagggagaatggacagggactgcatgtaaaatgtgatctacgatattttgcaagcggtcaccttgtagtcctctaggactagggtggcaagggggctgtctgtaaatgactagctcagttattttgcaggtgcttcttgcagctttctgggagggtgataaggaggttgcctgaaaaatagccgatcgtgattgttagcatacgtcaaccgatgtgtgccataccataaaaacgccctttgtaagggattttttttaagaaacacccttccgcagaaaattaagggtgtagatttgtaaaactctgaaaccaaaaaatatttgagtaaatttcataaaactacagatactttgcacaatctatcacaaaactacagattttagaactagtttcacaaaactacagatttaatgtctttgtttatcacaaaattacaggtactttgaataatatatcacaaaactacagatttatgaacttgtttcacaaaagtacaggtttaatatcttcatttatcacaaaactacaaatctagtgtcccattgggacactaaatctgtagttttgtgataaatgaagacactaaatgtgtagcactgtgataaacgaatacaccaaatctatatttgtgtgaaacaagttcttaaatctgtagttttgtgatagattgtacaaagtacctgtagttttgtgataaacgaagacactaaatctgtagttttgtaaaaacaagctcttaaatccgtagttttgtgataaattgtgcaaaatatctgtagttttgtgaaatttactcaaaatattttattaaatatttcaataaataaaactcatgcatgagggaggagggagaggaagctagaaagatgaagagaggggagggaggggggggaagagttgtcctatgacatacgggatccatgtgagtctcactcgttacattagccaaaaccaatcattgtattaccgagggattaaggttg

SEQ ID NO: 73849 - DNA, 4854 bp, Oryza sativa
taattattcggtgtgtgatgaacatatatatggatcggtagaaagatgagaaagaaatggtgagggtattgccctctgaccacacttaattaattaccatgtaccacgatgccaaggcttccgaggccgaggaagagcatgaaaatggcgctgcacttcatgttgtgtggtttgcgaagtttgtggtatgtaactatgaactattgtatttgtgtgtgatgactgctgaattggacctttgttttgtgtgctgatggaatgcaatgggtcctaggtaatttatagatgacgaaattgctggcttagtttagaagcttatctttaccaaagggagaaaccccatccataatttgttgggtttgattggatgcttattataaaccccgagagattaattaggagcgtatctttgatttgctaaggatagcaatgtgtaattacgaggattatgactggattggattgcatatccaataggttataatagtatttattattaccttactatactaaaagactagtgcaatatatgggcctgaaaaaaaatcatattaggcctttaaaaatgaataagtccactctaactttctcaattataggaccaatctaattcgtatccctcaaccgtaatactaagggcatgtttagttggtgaaatgaaaattttttggtatcacatcgaacgtttgaccgtatatcggaaggggttttcggacacaaatgaaaaaactaatttcataactcgcctggaaaccgcgagatgaatcttttgggtctaattaagccatcattagcacatgtgggttactgtagcacttatggctaatcatggactaattaggcttaaaagattcatctcgcaatttacatgcaaactgtacaattagtttttctttttatctatatttaatgctctacacatgtgtccaaagattcgatgggatgtttttgcgaaaagtttttagggaacctaacaaggcctaaatatcttgacccttcaactattaaaaccagagtaatttgactttttcgagtacttttagatggttttcactaacgtggctcattgatctggtccagtcagcatgtacttttacatatcttacatatcagtgcccctttctttctcctcccctccccctccctagtgcccatatcgccccacaagcaaggaggtagtcaatgacgaagtgactacgggtagcaatgatgagcaactggcgcgctctccgcgtcggccctgccgtgctaggagtagccgagccaccggcaacgcaccagctggtgagcatcaaggacgctacatacgacgagtcgctcgtgaagggtgcaccacccacccagcgacgtcatcatcgcgtacctacgtacccaggctaagcggcatcagctacgcaaggtgcttgacacagtagaggcgcaatgagatttcaccatggagaaaatgaatcggtagtatgtggggctcaccgtgctgatcgagcaggtgtggataccagcaaagcgacaggtaggcggagtggtgacaacccgcggtgaggttaggggcggctaagacatgtttaaatgggactaaaacttttaagtgcctatcacatcggatgtttgataactaattataaatattaaacgtagactattaataaaacccatccataatcttggactaattcacgagacaaatctactgagcctatttaatccatgattagcctatgtgatgctacagtaaacattctctaattatggactaattaggcttaaaaaatttgtctcacaaattagctttcatttatataattagttttgtaagtagtctatatttattactctaaattagtgtctaaatatagagactaaaattaagtccctagatccaaacaccacctaagcaaggtgcccaggtccttgaggttgccgccaatttgcattgcttcccgcagtaatccttctacgtacgcgaaatctatttcaagagcgctctcagtttaattctatagcgcgacgcatctcagagccgtctaattgtgcacgtcgtcatgatgtccacccacgttggtgtctttttcctttcaaataaagttcacgtgggtgtctttttcctattcaaataaagtttcctctcaaattacttatccgatctacaatccgattataccattgtgttcgttacaattaaatcttaacaacaagatcttacatgattatgttccggtgtaaaagtatttatatttgtaaattacttttattatatacataagttacttttatcatatatatatatatatatatatatatatatatatatatataaaagttacttttagatttgactaaattacttcttagacatataaaagtaaattcaataaaatctaaaagtaatttacatatattctaaaagtaacttaaaatacaacagaagtaactttgtcacgacattagaagtaaattcgttgtaggggataaaatatgactttttagttaattccataatttgtgctgattaatttaatttctagatagagtcatgtttttatctctacaacagatttacttcaaatgacatgtcaaagttaccttcgttttgttctaagttacttctataatatatataaattacttttatacttactgaatttacttttatagtttaagaagtaacttagtgaaatctaaaagtaatttagacatatcataaaagtaatttgtgatttttcatcaaaagataatcatgtgagatcttgttgtaaagatttaattacaacgaacacaacggtataatcggattataaatcggataagtaatttaagagaaatttctctaagaaggaaaaaaatacatagatattgagtgtactagtagctttttttttttaaagaagggtgtctctctctagcactatccagctagcactctcggtgtagttgtgtccttctacataacgctttagagactaatctttcatttgagaatgttgtggcttcaatgtgtaccttcacgacggagatggtaaccataagcccaataactgatatgtaggtcccatatgttgacttagtcgattggattaggtcaatgagcatgttatagaaaccatctaaaaagcagctgaggtagtcaaattacacgggttttaatagtttggggaataaaatacctggtattgtggttgagagatacttcctccgtttcacagtgtaagtcattctagcataaatatagaaaatgctagaatgacttatattgtgaaacggagtaagtaattagattgaacatatattgagggagtaaagtgaatttatttattcccttgaaaaatgtgcttggatgggctggtaacccactagagctactgtgctcaaagggaccacctatacatttatcgacaaattttcttctaaaaatttgacaaatataattatagtacaatcgtagtgtaattacactgtaacttgtatataattacactgtaatttgtatgtaactacagtgtaacttgtatataagtttcacgtaattttgaatcgttagatgtattacaaaatttgttctggtgaggaagaaaaaaaaatcacatcacacacatatgtgaaagaatttgttctcacaacccccctttcccgaaataaatgttatggagagatttttgaaagttacaaaaatgttacatcatagttacagtgtaattatatgcaagttacagtgtaattaccctacgattgtactataattatatctgtcaaattttgggtgaaaaatttatcgacaaatatatagcaaattcggtgctcaaattgggccgtttcacctagaaacttaaaaaggaaaatctcctcggtcagccatatttttttttccaacgactatcgaaatttctatcgggctcgcgatctcgctcgctccgctacctcagtaaggttcttctggttgctttgctgcaatccagattgttgtccttgccatcttgctccctcacaagctcacccgattgatgccacattcctggtctcggatcggcgccgcttccgttccactagaaagcccgcgttgcgtcgatcctctcctccaccactgcaacgaaatttccctactgcaacgtccctcgcctcgatccatagcacattagcaccacctttgctgccacctcgcttgcatatgcctctgttgtcttgctggcattcatatgtgccaggggcattgtcccgactcctgaggccgtgtgtgcttcgaatttgttgccggtttctactgcttggtccatgagtccatctattttaatttttagtctgcaaatttcatgcattattgacactctttcgtcaattgatattgagactttaatcccccaacgctcacaagtataatgctccataatctcttgatttctggataatgtttagtattacccttctcccaaatggtcagtgtagtagggacttttacttcactggtaacttagggtaacagtaaattatcgaatcatgcaaacaggctgtaggggtgaaaacggtcggaatcggtagcatctctttggaaacgatactcgaccagccggtaattgatcatatttatcatttaaactaggaaaaggtatgaattaccccccctaactatcgcggtcgtctgaattaccccctgaaccacaaaaccggacatttttcaccctcaactatacaaaccggatgaattacccccctcaacccaatacccggtaggtttggtccacgtggcgtatgcgtggcagtccagtcagcattatatatatatatgtgtgtgtgtgacccacccgtcatacactcttcctctctctctctcaatcttccccctctctcacggtcatcggcatgcgg

SEQ ID NO: 73850 - DNA, 4463 bp, Oryza sativa
gcgagagagaaatcggagttcatcgtcttcaaccggtacagtgcggatgttctccgccgccgcgctcgcctcgcccgtccccgcagcgctctcctcgcccgtcccagccgcgcccgcctccgcctcccatccccgcgaggtccgcctccgccgtagaccgccggtcgcccgagggagactgggagagagagggatatatatatatatatatatatatatatatatatatatatatatatatatatatatatatatatatatatatatatatatatagcccagggcagtgactaggggtctagtcaccagatatgaggataggaatgcttatctatatgcaatctttgatgtgagattagtatgtgacaattggatggcaatccaggttgttaaattttttttttaatattattatgcaaacataaatgcagtactggaaataaagatgtaaatacaaattatgtacaagatataaaattagatatttagaacataataggtttatatagaacggtccaggtgttcattcatataccttgataggttgaaggtagttccttctgaagattacaccaaggacttggtacaacacgttcgtaattatacaggtacaggactctcacaaagactcttacatagactctcacacttagactctcatgagtcttttatttaggttatactatagtactaacactttgatggagtggagtggagtgtgatggctggtggagcggtgagaggaacggttgagtgagatgtgttgtgtgtggaatgcgatgcctctgagccccttatatagcgctcggtagagaatcttcatgatatctcttcttgacttcaaagagttcatgatatccctttagacttcatggagagaatctttgatgatgacgcttttgaccttcaataaagatgtcataatatcgccttttgaccatagacttatcttatctagaatagtgtagattccttatcttgaatagtgatctttgtcggggatgacaagatctttattcattatcttcgttgattatcatgggtgctgattgcaccgtgtcgatctctgatggctctgttttctgaaaccactgagccaggcttctgtagtaacttttcttggagcattcatttccaaaatccggtttaattatgtgccctgctcccttgaagtattcataactttggttgtagaatttgctgataaaaatccttgtgatcttgttttggaaaaccagctgatattcataatctgtggtgatagcttcttcaatttctgcagcttcagaaaataatctccaattttcatgattagcaattgttgtatatatttcttcctcttcatccgatagtttgctaggaccgtcttcttgaaaattaaattgtctattcatgatatatatataatgaattgctggacgaacaggtggtgtgaattttggtggtattgaggagaagataattctgtatcttccatgtccaagtctcctgcagatatctttcacagcgtttcctaaatcagattgaaggatctgatcgagggttgcatagatggaattcacaagaccatgatctataatggtttggagagatatttcttcatggttgtatgtgggtaggttccggaatctttgaagatttatctcagctttgagaaccaggaatctataggatgggtcagagattgcctgatcatctagccttaagagagggagcatatatatgattactcgtatggctgggtttctttctctcccttctaagagatcaaagaaataatcttggagtccaaggaatattttcatttgtctctccttaaacttgtgccaaacaagatcgaggatgtcttgcccaaagcaggataaggtttgctccgttttgaagcttaatctgggctggagattttcgtatgtagtactcatgggattttggcttttaagtttcttttggcaagaatctttgtaggcacaagatctacatggtgcttttggctgggtccggagtatatattgtggaaggaatgaattgggatgattatgcagtatgtatggtgtttggggaatggtatcatgcctttttgtggatgatgatggtttattatgtggaaaagattgcaataggttattgatatttatgtggaaagcaaccatgctcgaagcaggatctgttgagatcaaaatcttatctgagaataccttggtattcttatctgttgccatagattgttcaacttccatgggaagtttatcttggccatcacgggatttttcctcgcgataatctagtaacatctcctcatgatgagggatatcttgtattttagcccttttttctgttatcttttgatctgagggcacgaaatttttgaaataatatgccaggccatttaaggcatgagctttttcttttttgttttttgtctgccacaagaggtttaataacccttgttgtagctctgttactctgaagttgtgattaaatcgttctccatggcctctgggcagttggggcagtctccatgaactcatattcgtgagccattcagacttctgtgaagccatttccctgcatatatattcaaaatctttagtagcttttaataaatatctatcttcccatgacgtcttacctggcaagtccatagattttggaagatatgatgggaaagaattgtcatgtaaatatattgtattcacaacttgttctctcttggtctgaataagctggtcaagaatctcatctgtgttagacgaaaatcttaggctcacctgtttgtccattatcttaaattgaatatcttcgttcgtgacaaggaaaggacgaataagtgataaaaatggtgttcctaaaataacatcttgcttaagatttttaacgagtaggaaagatgttttaatgcaaacttcagatatgcaaatatagatttcagggatttgatattctactgttaaaagccttccatctgccccacgaattctgtgggcggctttatagaaatatttatgagggataataccttctcgaatgcaactgacatcagcaccagaatcaattaaagtaatatgctggaagtaggatccgtctataaaacgatacataacttctgtgtaccatttttgcttcatatatttttgaatggttccaacaacatgatcatcttcttgaattggttcgtccttttcttccatatggaatccttcttttgattctaacatgtatagacgctttcttatttcttctaaatcttgtttcataattttttggtcttcgaataggctgatcaaatctggttgctcattcttctttttctgttcatctaaccttttaaacacttcatcaatagagaggaatttgctcttttgaatatccttttttagtttatccttatcagttttgactcttgaaaggaatttttcgaggactcttcttttttcttctggatcttgaatggtttcaaaagtatcgagaacaaattcttctaaactggttaaaacgagtatattttcatcagactcttcttctgaattatctggctcacaacaagagcaaccactgtcttggcaacaattaatttctgcatttttttcttcatctgaacttaagtcattgtctatattatttagtattgcttcaagtttttctttaacgtcttctgattctgaatctaacaaggcttggatctcttttttaactttggatttgaaacatctgttagctatgtgtcctttcaagccacatttgtaacaaatggtttctttgctttcagtgtcttgtgttcttatattcttattgtaaattctttttggtttccttttggtagcttgaaagctcatcttgcttttatcatttggttttgtcatgggtttggaatgggtttttctttttctatagacataaggatcttgaaaaccaaactgatagcaaaaatctcccatttctcttttaccaagaatcctttgttttttgagttgatctttgatttttaggtcattgcaaagctcagcccctactaattgtatcttttgtgtgatttttccaatatctagatagtgataatttatactccctcccccttcttttcttagggaatttctaaccttttcagcaaataaaggaggtaaaccagaaatatatttttctttccaaaagtcttgattaggttctggtagggtatatagttttgacaagaaagtatctttataccatctaaaatctgacattgttttacattttaaatttatcaattgttctctatttttttcatagatatcatgatagtttccagcaaagtgataaattatgttatagattagagtggctaaggcatcagaaatgttaccggttggattcccattaccatctctatcaggtaatggccttccttgatcatccctcttaactgggcaaagaatctcctgtctttgagtttcatttaaataattattccaccatccttttaattg

SEQ ID NO: 73851 - DNA, 7465 bp, Oryza sativa
ttgccacgttggcgccacgtgtgcaagcttaaaccaaaaccacttagaatagtgctcaggggggtaattcgtccgatataaatacttaaaggtgtaaaatgtccggttttgtttttcatggggtaatttagacgaccgcgatagttcggggggtaattactttaaactactcaatgtcaaaattaatacgatatagaaagaaagttagaaaaaacaaaaattataaatagccaaaaaggatacagtcggaaacggtagcccttacacggaaacgatggtagcccttacacggaaacggctatcagtcgatcaggaatttcctaaccgtataatttatacatctctgtgttcgctcacgaggcttagaaaattttacattaatatttaaaccattgattgtggatgttccaaatcgatcataacggtattgattaaacaaaagagcccacataaaaaataatttataaatagccaaattcagactaaaaaatgccaagggagattcacgtaaaacacaatacaaaattaattgaaatttggagtaaaaaataaaataaaacgagcaattcatttccaaaacaaattccacggttataatccacaaatcactaaattcggaatataataaaatagtgagaaaaagaagagaccatattaaagcggccatgttaattctaattcgtgacaaaacataaaataaaattagaacttcaatatcatataaattccaaacttaattaaaccgaaaacacccgggcatgactctacccactaaggttcaaatcttaatgcgcacaaatattacgtatatgcaagttgagcattaacacaattttagtgagatatgtgccactgatttctacattagagcgtgtgttagcggacgcatttgctgtggcggatccaggtatattcggtggggttggctgaccccatagtttgtacaccctacaaaccttttcaggtataaattcaaaatattttgagaaatgatcccacttaaatacaaattactagtaattgatcccacgggattaaattcgcagctccgccaccgcgcatttgtggggatctaagtgtgatgttacgtgtgtgtatgcaagtgtgctatgtaaaagaataaaaataaaaaaaacatgtactcatcaaacatttaaaaaggtgtgcatttccgtatagctaggttttggtgctatgagagcaggtataatagtactgactcagccggcgataagaaccaccacatcagtattatcatacgtggaggagggagaaagcatgagagagagtgaagcgagagcttctgcaagcgccggacgataacacgacaaattaggcaagatgaaatattttattcgctttgtgggtctatagttcagttacttgatcttatatgcatatgcatactgtgtggtttcaagtactagtttagttttaatcacctgtacatgcaacaattaaacatattcttgcttccgtaaaaccaatatagaaccaatcttttatataaacaatctacagtattaactttagatgacctgatgtactaccgccgactgggtactttcactgttagccttgctctgaaatgggtttgttggttggcttgaaggccgatatttcgtggggaagcagcttgacccagccacgccacgcgcccacgcgaacttacattatactcgtatctacatgctcccacatactcggaggcacgtactagcttagtttgctggaggaagaagaaaccagatgattccacgaaaagatctctgtacacgttgatttcgcccgtcggtcgccgcgtctccatcgcatctcgccatctcggagaacatcagagaaaggcacaatgctctcgtgttcgtccaatggccgctccaccgctccgttgaaaacagtcgtaactgacacgtgctcccgcccttttcttttttgtccatccaacaaagatgaaaattcgccatcgccacctttgtcaaacagcacatgccaaattccctataaaaatggttacgcatacgatctgattctccaactcacatacgactgaatttatcatttatcatcggttgtaaacggctacacactgtgtgtatgagcatagtttttttattaatttatggttttgcagggatgaatccagtgtggtagcggcggggctcgagcgtctactactagcatgaggatcgtaggagacccatgaaacctctacaaaacttttttttttataaatttcttttaccatacttcgatggaaattgtctcgctatttctttctgatccgttaggccctgtttagttcccacgcaaaaactttttaccatgtcacatcaaatgtttaaacacatgtatggaatattaaatatagataaaaaaatactaattacacagattgtgtgtaaattgtgagacgaatcttttaagtctaatttcaccatgatttgataatatggtgctacagtaaacattggctaatgctaaaataattaggcttaataaatttatctctcagtttaccagataaatcaatttattttgttattaaactatttcgaatgaatgtattgatgacacgtcaaaacttgaaacggcgccttattcttagtcagtgcgagtatccgacccgacgccacgcggggcgccgcgcccacaggatcgagaatctcacgggggtgcagagtgcagactgcagaggctggcacgggggccccgcgcgcccaccggcccacggcgcgagagccacagaacccgggccgcacaaaaatatctctccccctttgcctccgcttttatcccacccgacgatgcatcggacgctcgcgaacgttcccgacgccagatatttcccgcgcgccgcgtcgcgccgcgcaactcttcccgccttccagcttggcttcgcaacgcttcggctatcctcttctcttcttttggttgacacgatcaaagatattttccggcgtccgcgcccatatatatgcacgcgccaccctccgcgtttcgcgaggcctctcctcgacgtcgcccgtacattctccagccgcgccatcgttctttcacttcacccccaatgttgttctagcccccgcgccacccaagatagatagattcatcgcgatcgatcgagcgggaggtagagactagagagggatagtgtgtgctgctgctgctgcgtcggagtaggatatcgcgatcgatcggtcgatcgggcggatgcagcagggaagggggaggaggaggataatccagggatcgtcgtactacgccgtgctcggcgttcaccccggcgcgtccgccgccgagatacgcgccgcgtaccaccgcctcgccatggtgagtgcgattctgcaacacacccggtctggttttcctgtggtttggtttcgccggagttggaagcagagcatctgagcatatatggcgctgacgtgatttgggatttggtgcgtgcagaagtggcacccggacaagatcaccagcggccgcgtggatgcggaggaagccaagagcaggttccagcaggtgcacgaggcgtaccaaggtaatcaaaaagcacaaatcctctgtttctcgtgcgtgtcctctgcaatctgcatcatcttcttcggacgaatttctgaatacgaattttttttttgtctgtcgcgtgcgaatgcagtgttgtctgacgagaagaggagggcgctctacgactcaggcatgtacgacccgctcgacgacgaccaggaggaggacgtcgaggtaatccactaagcatcaaacttttctcatgcgtgctttgcttctttttcttttttttttttgatattgcgatggtttttgtgatctaacttgctgatttgcttaccttgcgacaccaccagggcttccacgacttcctccaggagatggtgtccctcatggccacggtaggaagagaggtaattaaatttgatgaccgatttaagccgacacgagcgattcgatcacaaatcagctatactctagacccaaatgcagcgaaaagagaaaaattcaaattacaaaaatttccgatgcgtctaaaacctgtgttaatccacttcgtgcaggagcccgtgtactgcctggacgagctccgctccatgctggacgggatgatgcaggatttcgcctcgtccgaattgccttcgcccagcggcggcttcttcgccggcgcgccctcctcgccgttcgccgacaccggcgccgcgcagcagcagcgcggggtcggctccgcctccgcgcgcgcgcacgctcatccccaggtggtcggcaactctgcctgcctcagccggatggccttctccagctactgagatcaatttttgccagcggccgcaacatcatcacctgcatagattagctagcctcgtcgacatcgagtgagagtgagtagtcggcggcggtgcggcgccgccccctgctgccgatgaggcgcgtcagcgtcgtgatctcatgaaggtgcatgcagaaaggtggcaaggcagggcactggaacaaagtatttctgtttattttcttgtcttgtttcgatgggatgggctctgcagcgagaactgtctatactgttccgagtgtaccgtgacaatgtgatatcacgggactgtttgcctttgtacagtttcatgataaacaatctgaagtagtagtaatgaactagtgacaatgatgatgatgatcgtcgttgttccgttctgttaggatgatgggacgatccctttggtgtgaaactgcactcgtgtttcgctttttttttaaaaaaaaaaaaaacgtgcaccttatcttcctctacaggagtaaaccgtagaagactagtccagagaaatgaagttttttttaaaaaaaatacagagattgatcaatactgatatatatctccagaaacatgtaattttgaattgaatttaaacaaacaaaaatgttattttttttctacttagtaattgaacttgattctctcttcgtttcaggttataagacgttttaattttagccaaagttaaactattttaaatttgattaagtttatgtacaaatatagtagtatttataataccaaattagtttcattaaatcaataattgaatatattttcataataaatgtgtgttgagttgaaaatataattattttttctataaatttagtcaaatttaaagcagtttgattttgaccaaattcaaaatgtcttataacctaaaattgagaaattgagggagtatttatctgaaatcatatactattttaatattagttgttcggtgatatgcagaaacaggaagacgtcccacaaatacacttccccgactggcactagttgttttggacttgttcacctgtggccaaggtgcacggaattgaatgacaatagaatgaagcttgaagttacatctagaaccgaatatattatacttcagcaccaaaaagagaaaaagaaccactaatcaatcctgttcggggcatgctctcccgtaaccagagcacttaaagtcttaaaccccccgagatattagcggtagttccacgctcctaccagaaacacaataagaaaaggaaaagaatacacgtcacgtacaccagcacatctaacccagtcccagttcatatatatatcacattcatgtccaatgcattcctgaatcacagttaaatcttaatcctaccactaatcctatgcaaaaagaaaaaaaaaacatgaggaatccaagccaaatgctgcgactgctgctgctgcgggtggcaatcctcgccgccgttctcgcgacaccgtcgctgggccgagtgatagggggcagcaagtgcaagtgcctcatgtgcgtctgcgacgtggacccgcacccgctcccgccgtcgcgccaccacccgccgccgccggaggagccggagccggagccgacgccggtgaaccaccactaccctccgccgacgacgcccgcgtactccctcccgccgccggcgcagccgtacgggcagtacccgtacccgtacccgtcgcaggggcaggccggggcggcgtactggccgccgtcgacgccggcggagatgtacccgcaggtcagggggtacatccggtccgccgccgctcaccgtcggcgtcccggccacggcgggctctcgtcgcgcttggtcgtcgtctccgtcttgctcgtgtccggcctaatgccactgctcgtgtagtcgtgtgatcgtgtctcctgtgttttcgtttagtacggccgggccgaccgcgccgaagtttcgcggcctgcgactttgcgaccgcagcatatgttgcggctgtcacgtttactgatttggcatgtaaataagattacaactgtatcgcgtcaacacgtttcaagttccattatacgtgagaaaatttaaggcttgtttaccttataggcattttcaacttttcaaaaattttaacaatccccaaaacttgataagattacaaactaaacatatcattacagtacaacttcaccaaaatttgataatttcataaccttcttctactctcaaaacttttaccgaaattttgaaaaacatcaaaccaaacatggccaaaccttattgttaatgctaaaatttggcgttacgaaaaattaggaggtatattttagcaatgaagttagcatgccttttaattccgatttgaaatgtgataaactcaattccgatttgaagaaaggtatagagttcgtgaatttttcacaggaatgccagcgcaaacgaaacacagtgatgaataaatttggtcgaacactcgagaaacaggtgcatcgacactgtcacggctgcggcttcactgttccattgttgtgtttctatccgtgttccgtaccacgtggagggcattcgtttgtcgattctttttgtgtggccccaccataaacggagattacaggattattctctccgtcaatcaccagattacgcagttagcgattaatcctaattagcgtggccctccagggaaacaaaggcgccaaataaaaattaaggcgccaaaccattagacagtttttcagaaaatagattaagctttacatatggcacattattatcggatcacaatcatcttcttcgcaacaacaatggcctctctatctaatcttccaaggtcaatcaaggtcaccgattcactgcatgaacaagtgacaaccatgccgacggaaccagctgcctctgctggaatgtttgtactgcatcatccagggacaagctttcatggtaacctagaaggggaattagagacggtaagacttcataatgttttcactttcttttattagtaatcattgagacttgatcactacaagcacatcatatctccgttcagtaaatctcatagaagttttgcttcttttctattagcccttttttttctgtaagtttcatgaaagtttttcttcttttctaatttgtctcagataaaaaaacaggtatattaatcaggatcctagtaaaattgaagctactc

SEQ ID NO: 73852 - DNA, 16549 bp, Oryza sativa
ctctagatactactgagagcaaatagattgaaccagataaatttattcgagaaatgaaatgaaatttatttgtgaacagataaaatttagtttggttagtagttactgggaattgtattactgtgtgaaactattgaattggaaaacagtgtttgcctatttttgtgtctatccataaacgtcaaccttacttcataaattctcgttttatccaaactactaaaaagttgcagagatacaaatgtaggacaaattgatactacggtcatcaaggaaatttgcaaattgcaatgcatgacacacattgaaagccttgtttggcatcaatttcaccaaatttcttgagctttacaatatttcattctcagataatacgtcattgcttttctcttagagagttcttaaaactattcactgaacttgatttgttaattgacatcatgagttcttgattctttatcatctttgtttgtttcacccctctaaagcagacctcaagtcactgccagagatgcgtttcctacctgacccacctcccacgccaacaatttctccaggtaaacgttattcagcttgttcacttatcctgtgaccttttggccactgactccattcgtgagataatcctcatccgtatcatcctgtacttcgcctctgctcacatgttgttttgtctcaattttggggtatgtgcagctataaaactatgatagtagaaatttgaacttagtaataccacgaaaagaatcacatacgtaattgtgcgatcatggtatactgttacttgcagcatctcttctgttgagttgtaagacttgtaactgttactaccatttccagcatggagtgtcctgctgatgctatactatatgtataatcttctcatctttcagttgtaacagtactttttagctcctgtatgaccatgatcatatcgtctatttcatcgtttaatcacagtcacggcaacgcctatgtggactcgctaatctgttgtgaatgcctgtgcagctgccgtcccaggatcaatgcccccgacgacggaggagcgttcgacgcccgtgcctgtgccgccacaggaccggtctggatcggagacctcaactcccagccggaatttccttgtggtgttgttagccctaacagcagcagcagcggcagatttgatccagctgtagttctgatatgtcattgcccatgcccagtactcacgctcctgacgaacttatgcctgttgcgtctttcctctgtcggtcggctttggactcaaatcaggtggtgccgtgtgttgtacagatgcaggggaggatgatctctgagaaattttgtccggaatggtgatgttttctcttttggtgtgctccgatagtccgatccatggtatgtcagtacaagtgtgctgcttctggctatgtcatgcaccattgacaacattcatagggtacggatagaatatggtttatattctcccatagtcttcatgtcactggaagccaaagaagagcatttctgcagtcacacggtcatgcagcatccgcactcaatcgatgtagtaatatagagtccagtcgcgcacaagtcaaacagttaaacaaaacccgtttggctcaccttgtcaaaatgttggccatgcctgacgtcttcttctacaacctggccagctgggccgtttggttcggctcctcgcacctgattcacatatccagcttaattcctttaggattatttattctattttttaaaaaaaaatacatcctgtcaagaaaaatattctagtatttgcttagaccacttgtcttaaatagtttgttaaatttatttatcacaacatttaatttatccctattaaaaagtagataatctacaaaaaaacagtccatccaatattttctaaacaaagccttaagttgaacgattagcgaatggctggtgcaacaaaatcaacgtagctgcttccccatttacgttccaagatggccagcctatgtgctaactgctactaccttcatcgccacaagtcaactggaagtaggcatcagggttaccttctgcagaggcaacccagtctagtcaagcccagcaacttgcacaacttgaccaagaaggcaagaacacacacaccctcgcttgcttaaattctagctgaattccattcgattctagtctcactctcatgtaaagccacagattgttcaaacctctgcattacatatacccaagaattctcagaattacagatttgcaaactgcaacatccactgtggatcataggaggcgaaattgtgcaaacatatttggagttaattaattctagcaagcacgtagtgacgaaagtgcaatacgcacgcatggaaggatcgattggtgccaaggtgtgccggagcgtccggtcatgctgggctcaccggtggacgaggagctaccggcggctggcgccggcgccggcgacaccgaggcggcggcctgcggcggcggcggcggtcggcggaaggatcaggctgggcaggcggccggcggcggcggtggcgtggtggaggttctcgcagctacgtgcggacacgcggtggtggtggccgtcgtcgtcgtcgtcgccgtcgccgctgcagctgctgggtcgcgtcgtgggggagtacctcagctccgtgcgacgacggcggcggatgatgctggaggaacccgcgagctcggacgacgacgcgtcgtcggcggcggcggcggcggcgccgacggcgaggcttcggcgtgccgcgtcgaggcagtacggcggccgggtcgacgggagaggggtggtgctgaacctgtgcgtggcggaggcgctgctgctccggcggagctcgtcggtgaccaggaggtcgccgctccgggcgaggaaggctgcacgtacagggcgagcctcagcttagctcactgatctcaaaaaacaatcgatgatgcgctaccgcctaccgtgcgatactgcgatgcatcgatatcgttcgtcagctcaagtagcttcaatctacaacaactacaagactataaccgcacgatgcgaaccttgggagctgttcctgcaaagtgttttacatgatgacaggaggaattttgggaacaaaaagaatactcccttggttttatattacaaatcgctttaacattcttttttaaaaactttttaagtttaattaagtttataaaaaaatatagtaacatcttccaccgaaaactaacatattatgaatatatattaaatgttacatgtaactaaactaatttaatctcgtagatgtagctagattttttttataaaccaaatttaaagaagtttgaatagaaaaaaattaaaacaactataatatgaaatggatggagtaatttaatatgagcttcattggtgcaacagtggtgtgtcattttttttttacaaaagaaaatttgtttatgcccccaacaaattcgatctcacgtgcagtcctatttacagaggggaaaatgagcatataaaatagcaaaagcgtgtagcgcgcggctgcaaatcccgcgcacatgacgcgctgatgagtgatgacacgcgacagcgaatccggccgcaccactgtttccgaccggagatcgttaggtgcgatgcgaaccgatgcggtcgcagagattcacatctcgcgggtggagcccactcacattcttcaggaagaggggaatcgggaatcccatgtggtggggccgggctgtgggccccaccaccccgtcctccaccttaaaaagctttgtcgctgccatggcatatggcgtcggagtcgaaatccccccccaaatagttggtggtagcgatcagtaggcaggagaggattaggagggatcggagaccgacatggcggaggaagggcagcgcggcggctacagccggctcgccggcgatgaggaggtggctacggcgagcggcggcggcggcggcgactacgacgagcggaagctgaggctgctcggctacgagccgcagctcaagcgcaacctctcgtacgtaccccctcctcctcatcatccgccatactcatctcgttcgcgctcgctgcgatccgcgcggtcgtcgatccgtttcgattctcgtggccggatcatccttctgaacttgcggttgatcgaggcgctgagatgattggatttggtcgtgttttatgtcgttgtttacgtgtttattaattgtggtttcgtgttgacgcgcgatgggtagctagtagtacttgcttgcgggctttgtgcgcttcgctccctattccccaattatgaagacacgcacactttctaatgctggcaaatggaggaatttaagttcaaattgtgaaactactaagggcttctttaaaacatacgaatttcattgtattttcgtaggaatcagttcagtttctgtaaagtttctctaaacatcctcaattcgtaaggagacttaagaaaaaaaaaagaaaggatacttaagaatatcccctttttttttgctgtcactaggatgcagagttgcagactgtccttccccaatctattggagttttatacattatatatttgcttagagatcaccctatcccattagccaaacactgcctatatattttcttagagatcacagtagtatagtacacatagagttgttgatctttagtgagcccaaagtagttgaggcctagatttcaaactcgtccaacagggcctatctaaaaccaggccttctggcccatccccttcggcccatcagaaaacagacccctttttttcagttttttttaagaagaagggcactttttatatatagtatatacagcctttttaaattgtgatcttaattcatataaccactagactacattttctttcacagatctttttatatgctttttttgcatttcattttttttaaaaaaaaaagagggaggaaaagaaatgaacaaaggaaacagggaatcagcgaaaggtgtcactactgacaatttttggcgtgcaggctgctgtccaacttcgcggtgtcgttctcgatcgtgtcggtgctgacggggatcacgacgctgttcgggacggggctgcagttcggcgggccggcgacgatggtgtacggctggcccatcgccggcgccatgacgctcgtcgtcggcctcgccatggccgagatctgctccgcctacccgacctccggtggcctctacttctggagcgcgaggctctgcagccaccgccgctggggccccttcgcttcatggctcaccggctggtaagtatcagagtacctccctttctgcgtgtttgtttactaagcactccatagtaatttattatcaatgtactactgataatgtagtagtacttcgtaggttgatcacatattcctgtgagtaaatgtcaacaaaattaatctaatcatgctgctttagttgattaacacaagttttattattacgcttatgcttattcttataaatccaaatttaaattttaaattttaaaacttaattttaaggttgattttgtggtttttttttatcgcagaattttataccatttgcttttgaatcactaacacgtatataaaagttgagctttatatacaaatactttcttttaagatagtgaaaatggattatacctcctgcctatacccataaacagatctacagccaaaagccaaaaaaatctcagatgcaacgcctgcgtacgtgccataggttggtcaacgtgagtacgtgagtccttgctgtccgtggattacagagtacggagtcggagtagttaaaattgcaagtgtgggagcaaaaggcaaccgagccatgaacacgttctgtacgaatcagtcggccgcggaaggaagagccgcacttctctttttttttttcctccgtcttggtggcgcacgcacgtaaaaagatgtcggcctcgcgctcgcctgcttggtacgtgtcgtggctgcgcgtgcggcctctcgtccaccggcgtaggggtgaggcgaggtttttgcgagcggcggcacgtgcgtcatgcgatcgcgatcgacgcacgtacagacagagccatcgacgtccgataaacaggaggatatgggcgaaaagtcaatcccgaatcttttgattgcgcaaagtgcaaagtgcaaaaaaaagaaagaaaaaatattagttcttttggcatctctagcactccacggctaggcccataagagcacccgcaatggtaaagtaaggtgatatctataaaatatgtacatctcagcaatagactagattaataataaaccacttcaatgatatgtctacatgggtatctatagctctctaatcaattgtctcgtttttctctatagactatatccaggttagtagatagctttgctctttctcttcatttaatctcttccaagcaataaaatatgctgacatagatatcttgtagatagtttatagataatcattacgggtgccctaataattaagtctagttgagtgagtacgtacgttaatttgcacgtacgcccggctagcgaatccacacgtctctacggctcgtttaataaacacgagacaggttgcaatcaggacaaagcaaagagaggaaatggcgtgccaggctatatatgctcggttgttaatttcgtgttgtgtgccgacttcgaatcccgacatcccgtagacacgatccggcaatataagagcaggtacaatcaataacatgctataagatagctgtaaatatattttaaaaaattaaatgaggagagagaagagcaacggactacagatttatagccagctgtagcacggactctaagacgcagtatgcgtatgacaggtgggaccatgtattaatagtgtagtatgtagctattgtatgaatgagctattagaatggctatagataaattggagctagtagttggctatactattaaacttgctctaaggggaaccgttgacaatttaagatgtatacatgtctgtctattccaacctttcattctctcagtcatcttcaaagtctgtttcttaggtgcataatataggctctgcatctttcctatgagtctgaaatcattaatttcaaggaatggttaaattcaaacaacattttcttgtcagatactactcccaaccacactaatttccggttgttactgaccgagctatgttaggcggtgtttggttggagggattaaagtggtgctaaactttagtccctctcacaaaaatataagttcttaccatagggacttatacttttgtgagagggactaaatttagtccctagttcccaaacacccccttaaaatggttacagacaaaaaaaaataaaataaaaaaagaaacatagaaatggaaacgaaaacgatttgctttgccgcgtatcgatcatttctgaattttaccatgtccttacggaaattatttttttctatattgtggtaattatcgtatttctattttatacttcaatgtttccgttcgacatcaatatgtttatgtctatataatttcgtttttatgatatttctgatactgtttttattttcggtttcatcgttttcgattttatttccaagatatatactctatccatcttaaaattaaagaatctagtattgagtatgttatatcctaatactatgaatctaatattaatctaatattatgaatctgtacaaatccttcttacgaggaaaatatccacaatagtaggatggcagaaaaaaaagaaattgcctctttgtctcgtggttgactgaaaaacaatccatatcctgccaacccgtacgctagtactcctctgataatctgaattgaccgtaacctgatcctttgcagcacccaaaaaaggggtgtgtttagtttacactaaaattaaaagtttggttgaaatttaaatgatgtgacggaaaagttagaggtttgtgtgtgtacgaaagttttgatgtgatgaaaaagttggaagtttgaagaattattttagaactaaacacggtgaagatctagctggtgagtcatgtcgtagataagaatataaaaggttcttttacatttctttccataaagtgtcaaatataatttgctacttggtgtgcagatgatgaatcacgtttgcagactcgcatgtaacagaacctgttatttttataagcattttatatgccacctgacctgcgtacgcagcgcgcgtgctgtgcgtgcacattttcaccgaatcccatcctgcggtcctgccatctctgatgcacgcgactttatttttttttctgaggacttctacacgtactaaaacttttttacaaaacatttgcaaacaaaattttcaaccgtttaatttaatttcatggaagttaaaataatcttgatttactcacaatatgccacgtcagagttactacgtagagagcattttgtaagaaaaaaattagtatgtattatatactgtactttccttttttttcttattatatcccttgattgggtttcgtgttaaaattgagacatctacagtctgtgtcgtatgattcgaattcccatggggttggggtggcccgtacactagacgcccgaatccaaagttgcaaacctttactttagtttagtaggaacactttactttatgaaactataaaaaagagattacgcgtgttcatgccatctacttaaaaaatatatatctagcacgaacaccaaatagtaggagtactaagagcaagtttaatgaggcacaatcagcagacgataagagtgccacatcatctaaattcattcgtggaggagagagaaagatagagggagagggcaacaggcgcttctgcaagcgccgagctacagcacaagaaactatgcatattataggaaccaatgcaaaatcaatattgtggttgtttttctccaatagcatagctatggccccattagcagaacacacgggataggatagagagtagcaagttagattaaaaaatagaaaaagttaactacctagagaagtgtgtaggtagattagcagcctgctattgtacgtatcatctttattttctacctccggatgacatgtacatttttatcaccagttgatggcggtactattaaacttgctctaacttatttctgttcgtggcggctatcaatagtttaaagagcagcaccatgctgacaggcaaaagaagatattagtttagggagattcgcactcaccaggaagctcaatcaaaatagcaaaatagcatgactaaaacgtagtattttagtttttctttttcgttgtttgttatttatctcaattatgagattagtattgtatgcactcgtgtacttttgattgtgtatatttactagtggatatgacaattttttatccaatatctaaaacatatgctgacagccaaaagaagaagataatagggagattcggattctcgtcaggaaagctctatcaaaaatagcaaaacggatctccacccctcgtgggcaaatggggtctcgtctcctctttttttaggcaggagggagcaaggctagattcctcaccccaacactgtcgcagatcccaccatcttacctggcagattcggtatcagcgcgtgccagtccgcccggcgcccggaggtaaagcaaccaaccaaacaaaccatcacaaaccccgcactttcgatcgtgtacgtttgaccccgcaccccctctcccccgcccgcctctcggcttcggccttcggcgcgcttcgcctacaagtagtagccgcgcgcgcagcacaccacaccaccacaccacacacggtcacacgtctcactcgccgcgacctcccctccaactccaacctcgcccttctcctctcccccgcgcgcgcgcaagcgagcgagcgaagcgccgcaatgacctggaacaaggccccggctgcggacgccgaagccggcggcggcggcgacaccggccacgcgcgcctccgggagctcggctacaagcaggagctcaagcgcgacctctcgtacgtcgccacactgcccctctctctctctctctctcgtcccttttcgcccttttcttggctgactttaaaccggttcacgcgcgcgacggcggcgtgcagagtgctgtccaacttcgccttctcgttctccatcatctcggtgctgacggggatcacgacgctgtacaacacggggctcagcttcggcgggccggccaccatgacgttcggctggttcgtcgccggcgccttcaccatgaccgtcggcctctccatggccgagatctgctcctccttccccacctccggtggcctctactactggagcgcccgcctctccggcaagcgttgggcgcccttcgcctcctggatcaccggatggtacaaccgccattcttttttttactaatccatagcggttaattttttttgaccccccattttttaattactttactactgtcgtttgcctgatttcttgccttggttcggatcatgtgaattgggggcgcacgagaaggatcatgatacttgcatgtgaacggggtttgttgatttactaattgttaggccagtttttctcttttttttttctgtttcttgttgggagttcaagatatatatggataatgggaacattgtcaaaaagcttgattgtttttctttctcatgttcccttccgtttccttgttttctttctggagtgacatcaaagcggcatcttcaaaagctctgcaatcttctctccttcttttcctgctgaacaaaatcttttttgttccgcccaattagatggagagagagagagagagagagagagagagaagtgctgctaattcgtactactactttgcactgttctgatgtcgtattcaatgatgtggtcctattaatccaagtaggaatttttgtttcatgcgttttagtcaatgttccattctttgaccttgtgcagggagagcattgggcaaagtttagaaattttggttttgatgacgactgacgatatagtgtttgatcagggttaatcattgaagcccagtagcagtagttcaactgagtatatatattgtgctcatatcaacttcttaatactaaacatttagttctaagtagctctgggaggggatatgggtttacttcgcattcattggaaatctgtcacactgtcagcatatcccttctcggacaagtcctccatttctattcccagcaacaaactctcatttgagtactgatgatggtacttattggtcgtgcagacatagtcttcattctgataccactgaaacatgacatcaatcaattatgttcctttcaacctgtcaccataatgaattgggtatgatttgattccaaaacagttactttcagcatctaatcctctgttgttttttgcttgtttgtttctgtcacctgcaggtttaacattgtcggacaggtaaaccgaaccaaaccatcccttctctgaactttcagttcttatctgaatatctgaactttcttctgctttgcagtgggcggtgacgaccagcgtggacttctcactggcccagctgattcaggtgatcatcctgctcagcactgggggcaacaacggaggagggtacatggcgtccaagtacgtcgtgatcgccttccacgccgccatcctgttgagccacgccgccatcaacagcctccccatcacctggctttccttctttgggcagttcgcggctgcctggaacatgctaggtgacacctccctctctttgacctgacaattcgcataaattgaaggattcagtgattcgttctacagagacagacagtgaccagtatttctgaaggagatttgtgtggttttctgcaatattcaggtgtctttgtcctcatgattgctgtgccgacggttgctaccgagagggccagtgccaagtttgtgttcacccatttcaacactgaaaacaacgctgggattcacagtaacttttacatcttcgtgctggggctcctgatgagccagtacacgctgacaggatatgacgcgtctgcgcatatggtaagggcgaaaaaatgaacagctcaagagctaacagacaatgttgttgtgccaagaaatgtttctggccaatctgacattatggttcttttgctcatgattcagaccgaggagacgaagaatgctgacaggaatggcccgatcggcatcatcagcgcgattgggatatcgataatagtaggatggggatacattcttggcatcacctttgcagtgaaggacataccttacctgctgaaccccgagaacgatgctggagggtatgccattgctgaggtgttctacctcgccttcaagagccggtacgggagcggcatcggcgggatcatctgcctagggatcgtcgccgtcgcgatatacttctgtggcatgagctcggtaacaagcaactcaaggtaaaaaaaaaaacaaatgaatgactgaatcacaatggatgacattctagtgttctaacttttgtcggtagagcaacagttcactcactcactgctatatgtatccatattgttcttctgattatttttcgcgaacgtgatttttttttcgcgaacgctgttcttctgattaggatggcgtacgcgttctcgagagacggcgcgatgccattgtcgtccgtctggcacaaggtcaacaagcacgaggtgccgatcaacgccgtctggctctcggccctcatctccctctgcatggcattgccggtaagttcctgacaatcttgttcacatctcagaaagtttcagaaaacgcaacgaaacattgacaaattgattcttgctcaaaattctcaaatactgataataacaacaacaacaaaaaaaaactatgggaaatgcagtcgctggggagcttggtggcgttccaggcgatggtgtcgatcgcgacgatcgggctgtacgtggcgtacgcgctgccgatcctgttcagggtgacgctggcgcggaagcacttcgtgccggggcccttcaacctggggcggtgcggcgtcgccgtcggctgggcggcggtgctgtgggtggccaccatcaccgtgctcttctcgctgccggtgtcgtacccggtcaccaaggacaccctcaactacacccccgtcgccgtcggcggcctcttcctcctcgtcctctcctcctggctcctcagcgccaggcactggttcaaaggccccatcaccaacctcgatggctagctaagccaagattgaggttttggttttggttttcgccggtggatatggaaatgcagtgggagatggaagaatcgtcgtcgatgatcggaggcgtttcaggtgggaggagaagtataactgaagaacaggtaagaagatgatctggaagggaaacgggagcatatcatgtcatggtggtggtgttgtgattagttgttgatttgttcagcgaaattatattacgtggaaggggattatacattttatacactggttgtagattgacaatatgtactaagaaattgacgattcaattgaaggctaaaagcagctgaaacagttgtggaattttgagtgtgtgattgcgttattacgttgcaagtaaatgttcgcagatgtaaaaaatattaaaatattactactacatatttaatccatccatcttataaaaaaccaaccagtatctaacacatcctagtttcataaaaaaccaacctaatatagtactatgaatttggactagtttttttattagacggaggaagtacacccctgaggctttctgaaaagacgatctttatgacgcatggttgttgacacatgctaaacaactatcttaagaaggatcgactattttacaggtaaccttatcgttattttctacaaaatgatcggagatgccttcttacaaaggccccttatcgcctttctaaggctgagtttaggagatggcgctgagaacttcacctcccccacacggaaaacaacattacccattaacatgtgattagttaaatagtagcttaaaaaatctaaaaaaatagattaatataattttttaaaattaacttttttataacaaacttttttaaaaaaatacagtgtaacagtttaaaaaacgcgttcgtgaaaaaaaaagtgagttaggaaataacgggaaaaaaaaacacagagcagatcagcggccgccggagccaaaaccctctgaatcttcccgcggaagggaacgtgtagtaattcaggttcagaaatccacagaacttcagtactccaatacaaacccacccccaaattcaaatccgcttccaaaatccagcggcgcggcgcggcgcttccctccaattctccaaacccaaagccacccccccccccccccgcgcgcccaaaccatctcatctccgacggcgagcgagcgggaggaagagatcccatctcatccaggttgcgcctcctgattccgatggtacgtacgctctctcctcctcctcctccggttcgattcgcggcggtgctgaagtgtggctggattttgcggttggtggatgcaggcggcgggtgcggaggcggaggcggatgaggaggagctggagccgctcttcgactactcccgcgtgcagcccaccatggccttcagcttcgacggtacgcgtcgctgcggcggcggctgcggccatcgcatcgcttcggttctatcgggctagggtttttctcgcgtggggggattcgcttagggatttgtctctgttttttttttctccccgatgcgcagataccgacattgagaagtccgacatcttcgtccactgcaacaagcggcgcaaggtggccgacggcgacggcgacgccaatgccgacgtgagtgcgctcgaattcaattccagttttacggtgggggaaaaatgtttgacgcgctggtatgtgttttttttccttaggagaagggggataagggtgagcagaaggccgcgaaggctgccgcggtagtcgacttgggagaggaggattggctgccgccgccgccaccccccaagcccaagtccactgtcacggacgaatcagagcagagcagcgtattgaaggagctgaggtataaacctgtgcatggttccattctgtaagtttacctggtgatgccgtatgctgattgctgctttctagtatcatatcgggatccatacttggtactccctccgtcccaaaataagccaacctcgtactagtacgtgacacatcctagtacgaggttggcttattttgggacggagggagtatgtattagatgatgcggtgagcttaagaaagtcataccgtatcaaggtgtacagctgtgtttcttttatcaactttagaatgagcaactatattatattttgctattgatgaggaaagcattgttaaacaggtattgttgtttgatgcgagattattgaagtcaagacgttccaatttaaaagctgctttattaaatttcgcatcattgaacctaaagtgcttgtcttgtatagattaataagagtggaaggtagactgtactgttgttttcaccatcatttttccaagtcatggacagagctgtgcaacattttttttagatgatgcagatttagtgcatataaggcgaatgcactgctgtttatcgaagcactcagtgccataacaactcatgtttcatatggccagagtaccctttgcttttctgacagattagtgaccaaaatcggaataccctactgcatatgacatagccagcatgttatcccaatgagtggtgaaatcgattgtttctgacaatttccctagggaaaatagtctgcgacctaaagtttctggctgtagtctgcttgacggatttcgatcaggtgcagttggtaggtgcagttggtactgtgactgcaacttatgcagtccactgccacctgttagatccgaatctaacggtccacatgcacctggatactgtagatcactgtagcaaaaatattcggtattttgcgttgatactgtagctgatgatctggtccattcatcaccaaaatgaatggctgtaatcgcgtgcagtagttaacttgcagtcgctgttcatactgcaggtgatcccaatccctgctggacatccaaatatatctggaagttgaaatggaagtcctgtatatactatgattcttgcagtgatgttgtgtacggatttggaagcagtgctttgtttgttttgttttttaattaccgattcctagagatgtgaatttatgatcatctgatttctgcttacgtattatgcagattacagaagcaagcaatggcgaaatttgctgaatcagctgatgattttctggagaagttggctcaaactgctaggcaaaaggttgaggccagaataccaactgaacatatagatctagacaagtcacctgaacgacacgaagcaagagaaaaggtggtcgtaacagttcaggacaaagctggacatcaccagtttcggttatacaaggttggttttctaatggagtagcactgcttatattaccaaacctatatgatgttcttagacatttttaggcagttcgaattttctaacagatggttgtgaacttgtgataatttggcatgctcttctttaa

SEQ ID NO: 73853 - DNA, 6525 bp, Oryza sativa
agtaaagattcgtaacaacaaccgggattaaaggtcttatctttaatcccggttgttgttacgaaccgggagtaaagatatctttactcccggttcttctcaccaaccgggagtaaagatatttttccgctatttccaaattcttttttaaacccggttaggattaagaaccgggactaaagttaatagcactgaatattgaatttcgttgcatatgtgtttctaaaatagtaaataatgcattaaaaattctaattaacatatgtaaatcccacatgcatgtcgtgaccgagaaaattgccttttcccgaacgctagtgtattaatcccagtcccaggaaaagccggggtacaccacacaaacatgatacaaaaggcacatctttattatatcgataatatttacattattacaaaggcacttcaggcctgacaaacaaaaataaacagcagcggactagcgggcctacggctccatcttcacaggcgctcaactggggtataagccaggactccacctaggacttcttctccaaagcttcttttactgaagggaggaaagatagagcaagaatgagtacaaccacagtactcagcaagtcacaccgggagatgcatgattaatgcaagggagtacaaggggtaataatataggggttaagtttggcagtaaacagcatttaaaagtcacttagttgcccaaagctattttataaatacgatcctagagctacatagtattattaatcaaggccgtggacccacacgaacctgccttaacccaaggcctacgatgattcagaccgaactggcaacccgacctgggtcccaactcgtcccaagccaacccaggccaacctttccacattttagttgttaagaaaattttaagaattaaaccactaacttgggtacattgctaggcttgcccatatccaagggcacggctattcgaatagatttactctgatcagaggtgtacatctttacccacaagacacatctttactccgcattccatggccttggaacccgtcgtaaacatgtgacataacccttcacccatcctagccgtgaataaaagtaccgacccaaccctgcctacggtcgatatcccgggacaggcaggccaggattgagcccctagcaacaggatctagaccgggtgcgccacacgcataggggtgagaccacccgcgtactagtccagtgccatggcatctcgactaacgggcaccgacccgtgtagtcttcatttgcctagacatctcgattaccgagccgcagctcgtgtagccttcatttgcctcagagatatccatcgtcgcaacgacttcatccatctctatccgtgtccttttgtttaggactagactgagcaccgatttaagccttacccattagacatgtggttagtacggtagtgctttgcaacagagacccgagcttaatccttatattggccggggtgctacttcccataactggcatgcacccaaaccccaccggaaaacatgttttaggggttttgaaagaggaagagaggggtatgtccaattccaccataagccaaccattccatagtatccaagtgatatgagaattcccaaagtctaaagttataaaaccacctaatgttgcctaattaatcagcgaagaatctacctaaattcatactagtggaaccatgaatagagtacccactagttggggttttgttttcctagggtgaacaaggtgataataaacaatagcaataataataaggtcataacaaaggattaataggaagtgctaaataaaacagtgataacgcgggaatttaaataaagcggtaatgcagtaatttaaatcaaaataattttataaactgggattcaatatgctcaagggagatgcgacttgccttgctcagagagaatggccttccgaaccttcggcgacgaccgcaaaccacgcttcgagaacctccggaacgacagaagctacgcgaagcacacaagcaaagctacaagcctataaaaaagcaataacaatacataaaaagaaagcacacggttctttaggttataacaaacattaggagacttgaacgggtcgattcggagttcgtatgatcaagatatgatcatccgaagtttaatgctgttacatggagatttacggattattgtgattaggttttgcaattataaaatatgtataagcgctagcctggaaaagacaggaaggctgcgccgttgacatacggactccacatgtcaacctaagggaccacggtggaccgggtacacagagacggtccacgggtcgacagaagcagatcccgtgtgtcaaccgaggcgagtggccgacaaacggactccactagacaccacacgggctgcacacttggaaaccacgcggctaccgagcggacacactatcacggtcaccacacgcacaagcgaacgactaccgacaccggtacacgggtaccggggtcgacaaccgcacaacgggcacggggcgacacaaaaagaatgaggacggggcagcgaaggagagatccttaccaccacgcgacgaggcgagggaacgacaacgacgaacgggcgcggcggagacggccgggaacgacggagacgaaaggcgaggggacgacttcggcggtgatccttggacgaaggcgagacgcggccggcgtaacgcttggcgacgcggaggcgaggacgaagacgatgacggggctgcggcacttgacggagcgaggacgacgaacgagaacggcttgacggagggacgaacgccacgacgaccgggaacgacgggaggactacgacgacgatgaccggggctggcaaggaggcgacgtgggcagccggcagcggctgcacggagacgaggacggagtggaacacgccgctgtgatgccgacgacggaggcggtgccgcgagacgacgagtcggcgaggaggaatgaccgaccggaggagtcgtcgacgaggacgaacggagatgacgataacgaacaccggcggggttcagatggaggggaggcgaggccgagggcaaccttgacgctgtgatgccggaggtggtggttgcgcggccgacggcgcacgggtggaggaagggccgactggggaaattccggcaaggcggatggagaggccggcgcggcacggcggtgttccggcgaaaccgagggcaggccggggtggagggtgacgccgcaatgtcgacgaaggatacggcgacgtcggccgacgctcgggcgcggcgatcggggcgactgaaggcggtacagtggcggcaacgccactgttttgctggcgaggacgcgtctccaggggtctccgcgcgaaacggagggcaggccgggggagaggaggctgctgtgacgacggggaaggcaacggcacagccggccggcgcgctgacgcggcggcagggcggctggaggcggccggcgcgggggaaagagaagggcgaccgcggggaggggtgatacgaccacggtgaggctcgggatgaggctaaaacgatagaatggaggatggggattccattttatagcggagggaagcgagccgagcacgggaggagcggggaaaggcggcggaaaaggcgcccggcggccatggaaggcggccatgaatggcgcagccgttccggtcaaaatagtgcacgatcaaaggggagattaggggaaatagggagaggaaggaaaggggattaattccccccaattaattttggaatccaacgcttaaatcgcgcagatttgagggaggaacgaactagggttttcacgggagagagagaggagctgtgcgggaggaggacgacgaccgggcgggtgggacccacgtggccaggcgcgcggtcagcgcacgcatgtgcgcggcacgggcgggagggcgccgctcggcttgtgcccggaggcggcccacgaggagaggagggagaggcagcccgggagggagagggaggaggagggagctgggccgaggggaaggagggagggcggcccaagagagagagggaaggaaaaagagagggaggaagagaggactttggccgcgggccgagagagagagaggactttgggccagacttggcccaaaggaggaaggaggattatttttaggtttttctttttattaaactttgatcatagttgttgttgcttaataaatattttcggtgctctgaaaatttaagtaaaatttgagtgctctttttagaccaaggagaatttaacgaaaattctccgggccacattcgaaattttcttgtacgcattttaatgtttgccaatttctttttgaattttaattaattctattattccttttagaaaatgatttttatttcaggatgaatttatcaggacgtgacaatgcatgatttaaaacttttaaaaattctaataatcatatataattagcatatgcatgatattaaattgttaaaaattctaactaacatatgtaaatcccacatgcatgatttaaaacttttaaaaattctaataatcgtatataattagcatatgcatgatattaaattgttaaaaattctaactaacatatgtaaatcccacatgcatgatttaaaacttttaaaaattctaataatcgtatataattagcatatgcatgatattaaattgttaaaaattctaactaacatatgtaaatcccacatgcatgatttaaaacttataaaaattctaataatagtatataattagcatatgcatgatattaaattgttaaaaattgtaattaacatatgtaaatcccacatgcatgatttaaaacttttaaaaattctaataatcgtatataattagcatatgcatgatattaaattgttaaaaattgtaattaatcatatataactagcatattcaatacatccaaaatagtttacaacaattacggcaatagatcggcggtgacggttgtccgcacgtactttctcctcactattgttccttccttgtgatcgctacgtgagtaaggggtatcttcgtttgataggaggatgctagggtcaaccgtcaccgtgaaagggggttgcccatcaaactgatcgtaatcctcgtcagtcttgtcgtctactccaacgattttttttgcctgggagaaccacgtggcgcttcggctcgtcaggccctttgcccttctttcctttgctagacatgtccttcacgtaaaaaacttgcgttacatcattggcaaggacaaaaggttcgtccgagtatccaaccttgttaaggtcaaccgttgtgatcccactgtcatcaatcgttacgcctacaccagtcaacctaacccattgccaccgaaacagagggaccttgagaggtccatagtcaagttcccatatctcctcgatggcaccgtaatacgtgctagttgtaccatcgtgtcccatggcatcgatacgaacatcactgttctggttcgtgcttttcatgtcttgggctcttgtgtagaatgtgcacccattgatctcatatccctagaatgtcgcgatcgagccagatggacccctcgccaggaaggccagttgctggttaatcgtctcgttacccatgagatgttgtcgcagccatgcggggaaagtatcaatgtgatgccgtgtaatccatgcatcggacttaccaatgtttctggcacgaactagagccaagtgctcctcgatgtaaggagctaccaatgaaaatgtgtcattatattgaaaaatgaaggtggaaatatcaactcaaacctgacaagacattgcaacacatcattctgaagggcttctaacctatccggatcgatgaccttctgcgaaattgcgttcatgaaagaacatagctttgttattgttgcccggacattgtctaggaagccaagaaggtttacgcaaaggttcttagtgaggtgcatcacgtcgattgcgtggcggacgtccaagaattcccaatagggtaactcccaaaatatggagttttttttccacatcgccgcatgaccatcttcgcactctataggctggctgccaggcccctttccaaacactactttaagatctttcaccatagcaaacactgttttcccgctgtgatgtttaggcttcgtacggtggtccgtcttatgttcaaagtgcttgcctttcttccatactgggtggtttgcagcaagaaatcgacgataacccatgtacataaccttcctacagtgcttaagatacgtactttctgtttcatccatacagtgagtgcaagccttgtaccccttgtttgactgcccggataagatgctaagtgcaggccaatcgttgatggttacgaacagcagcgctcgtaggttaaactcctcctgtttgtcctcgtcccacatgaggacaccttccttcttccacaacagtttaagatcttcgaccagtggtcttaggaacacatcgatgtcgttaccaggttgcttggggccttgaataataatcggcatcattatgtacttcctcttcatacataacctagggggg

SEQ ID NO: 73854 - DNA, 7289 bp, Oryza sativa
agtgtcacatcaacacagacgcggggatcaaccctccgtgcccccggttggtggtgtcggctgtagagcctttgtggcgagccttcggaacgtccgttggcccccaaggttccggcccaccatcgccgaaaaatatgacgggagcgtcaaccccgccgagtttctccaggtctacacgaccgggatcgaggccgccgggggtgacgacagggtcatggcgaatttctttcccatggccctgaagggacaggcacggggttggataatgaacttgccacccgcgtccttccactcttgggaggatttgtgccaacagttcaccatgaactttcaaggcacatatccgcgcccaggtgaagaagcggacctgcacgcagtacagcgaagggatgatgagtcacttcgctcgtacattcagcggttctgtcaagtccgcaacaccataccatgcatccctgcacacgcggtgatctacgcgttcagggggggtgtgcggcacaaccgcatgctcgaaaagatcgcctccaaagagccccagactaccgcggagctttttcagctcgcggaccgagtggctcgcaaggaggaggcctggacttggaacctctccggttccggtgtggcggcttcggccgcccccgggtccgccgctcgatcagggcggcgggacaggaggaggaagaagaggtcggcccattccgacgacgagggtcatgtcctcgccgtcgaaggcgtttcgctggccacccgaaaggggaggcctgtgagcgacaaaaggaaggaagccgacgctccctgacctcggctacttggaggagcgaaggtggcgcgcggcccttcgagccgcgcgctaccagcagagcctgcggcgctaccatcagcgccacgtccgggcccgatcactctgcgtcgatgacctcgtcctacgccgcgtccaaacgcgtgctggattgagcaagctctcaccaatgtgggagggtccgtatcgagtgatcggcgtcccccggccgggctccgttcggctggccacgggcgacggcacagagctgcctaacccgtggaacatcgaacaccttcgtcgcttctacccctagtgggggtcgggtgtcaggtcttgggctcgggccaaccccgcacccccccgggcgtgcagggttggccgggggcttatcttttttctcttctgtatttcaataaaagcattttcgatttcctaaaggctgtatctgtgctgttgtttccttttaaaggatcttgacttgaaataggtcactcgtgttcaatcctgctctcgggggctcgggtcggctaaaatcgccaaacggggcccagaaccgagccgtgccccggggcgtgatgaactccgggggggaatcggcaaaaacccacaatcgggtcacccataaccctcggtcaccacgctcccggcctggccagtctcgacatgtggatctccccaggcactagccccgacccgagccatttgaggactaggacctgggcacgagcccttgttcaagccaagacacaaaaggaccgtggcacaggcatcgtcgtctcatacacacaacaaatagaattgacacaaaaaatttcctctttatttgattgcagattaaattagtctatacaagaagggggcccgaaggcctcggaacaagaaggaaaagctattaagattggcggaggcctgggggctcactccgacgcgcccgggtagccggcctcgccgtcgctgtcgtccgcaccgtcgtcaccgcactcctcgtcggagttgaaggcaaacgcgagccgaggggccgctcattattgtcggtcggttttcccttgctgatgcgcgcgatttgcgaccgccgggattctgcccgaagagagagagagcagggaggagaggcccccgagtcgaacggcggcccaaggccccagacggccggagctggccctccgcctgcttgtccgacggtgccaggcgcccccgacccccaggatggccccgaggccactgcgggaaggccgcgcctgtcgtcctccgaccccgaggtcgtcggcacagaagacgagtgcaccccgcgaggccgcttggacaaagagcgccccagggatgtggcccctagcgaagaggatcggccccaccgaaaggtgcagcggcccgtctactttgttagtgaggccctccgggacgccaagacccgataccctcaggcccagaagatgctttacgctattctgatggcttcgaggaaactgcgccattatttccaagcgcatcgggtcacggtggttacgtcttatcccctcggccaaatcttgtataaccgagagggtactggacggatggtgaaatgggcaatcgaactctctgaattcgatttgcgctttgaaccacgccacgcgatcaagagccaggccctcgccgactttgtggcggagtggaccccagctcccgagctcgtctccgcccccgaggccagctcgggcccatcgcagctgcctcacaccgccctctgggtgatgtagttcgacggcacctgtaggaaccggccccacctatcaccaggccttagaagtggcgtcacgcccgaccgcttccctcggggagggcgatcgccctggcataacgccgggggctactgtcggtgacatgggaccgggagtatcatgacttagagacttgaggcagacacgatcacccacatggcctaaccccctcggggggggtcgggcccgagggtgatacggccgcccttctctttgtctccccgaggggtcggaccgctcccgtctcggccccgagggccgaggcgccccgaccccttgtgggttttgcgccgcgtatatggggtaggtgagcatagcggggctcacctaaccacatttattgcggtttggacgagcgcgtcacgccgcatgtaacgcagtgcagcgcgctcgtttattcggtctgtgaccagtcacagaccgatcagatcgtgggttaggtggcgacaggcggtctgacgcacgcctcgccccatcccgtcaggacgagagcctccaagcactcgtccctagccggagccggcgtgttagctcctggagatggcacattggttccggtcagatatatgccaggctttatcctaaccattacaggcaagatattgtatgaagaagggcgaacatgcagattgttaaactgacacgtggtggacaagaatgaccgatttgtgaccggtctgacaatggtcatgtcgtcagcagacagccatgttcccacgtcgcgcctgcttccggcggaagtggaggtaggtatgggccgtcccatcagaaggtcattcggacggcagccatacaaatctccgtccattaatgaagagaagtcaagttggagggaagagaggatgagtccccacacaaaagaaagagagggagagatggtgcatgtggtatccccttgagatataaaaggaggaccttgcccacttagaaagaaaaaaaagaaaaagaaagaagaacgatcccagaacgatcgggggctggctggcactttgtagcttcttcatacacagatccaccaaaacacaggagtagggtattacgtttctcagcggcccgaacctgtatacatcgcccgtgtcttgtgtgtttccactctcgcgaaccttccacacatagactaggagcttagaatctcacccagggcccccggccgaaccggcaaaggggggcctgcgcggtctcccggtgaggagccccaagctccgtcaaatatctacagccgatcgaatagatttagttctttattatctatttacaaccaccgatcgatttacatatgacatcggctcaaagataaatgagatgtcatcggcacctagccgatcggctatcgtttataggtttaaccgcggtttctttgtttttatttcttgtggattacaggatcaaatcaactggcacgctagcatacccgaaggcgagttttggacctgtactggagttaaccagatctcccaggcctcgtattttacgtcaacagcggggtgtataggagtatagttctagagccgccgacgtttgacgggacttctaggaaataaaaaaatgaattctaacaatagctatgtttgatttttagaatcacaatgaccataaagagtaggcggcggacgggctatagagaagcatagtggcatcgtttgatgagacttctaaaaattataaaaaataaaacctcacaagacaataaactctaaaaactacaaggtccaatttttaaaggttcggaatttctaaaaagtaaaaaaaaaatgataatcatgttcgattttaaaatctcaatgacaataaagaagggaggcagcgggcgagccctagagaagttcaatggcaaagtcgctgatggtttggcaggacttttagaaagtaaaattgaacccaaacgataattatgttcgatttttaaaatctcaatgacaataaagaaaagagataatggacaggccatagaggagtataatggcaacgtttgacgggacgtctagaaattataaaaacgaaatccaacgtgacaataaactctataaactataagatccaatttttaaaggttctaaggagaatgatagaaatagtggtagatcgagcaagcaaataaagaaggaaatgacataatgggtagcaactggtgtgacttttaaataactatataattaaaaacacggggatgataagttttggtctttcaaagtcttaagacaatgagatagctatttaataaattttaattaaaatcatactaaaaatatatgattttgtttggatgctagccgcgcaattgcgcgggccacccatctagttttatttaagctagtgaatatttgttcaaattctagtatactactaaatacctgagtttttttttctttttctgaattttatgaaatttttatctaaccgaaatgaatgcaaactatctaaagtaaaaaattttaggttgacaatctatctaagggcctgttcactttgatgccaaaaaaaccttaccaaattttggcaaatgccaaaattttggcaactggtaggatttcttatataattaccaaaatttggcagcaaattaaatgtagccacttttttagtaactttaccaaaatttggtaaggttgaaaatggcatcaaattaaacagacctaaagtaaccaggttgacaaattcaatgaatgccatgtaggatgaatttgtcaacctgagttcattacagtacattgagtttattatttccaaattttatctaagctagtgaatattattttctttttcttgttcaaactatctaaagtaaccagtaaccaggttgacaaattcaagttttatccaaccgttttgaatttgtcaaccttgttactttagatatatagcttgccatgtaggatgaaggttcataatatagaagtgatgcaatggtggattttaacaaccagcctgctctgaagcatagcattgattcaagattggaaattggagatcatgccttttcattttaggtaatatcgaaaaggtcatgttgattcaagatttcatttttacggtcctcttttgacctctttaacattcaaaagcaacctatattgaatcttctttggcttcttggctgatacatattgggaaaaatattgggtaatcataatttttctctcaatttaaataattgtaagtgcaataagaaaaatattaactggccaatctatttagggccatattttatatgccaatagtaatatatcttttaatcacgggatgctcattccgacgatttcagcatcaattctagtgcatttgcatttgttcggcattcattgtgttgcggtgtatcatgggctctaccttgtctcatttggaaccggaggcatcaagttctgcacttcagccttccgggctgatcagtttgatcttgctgacctactagagacgaataaaaagtgctcatcactaattcttcaactgctactacttcttgatcaacatcggatcccagctatcagcaattgtgcttctctaggcgtgggacaacattggttggggggtcagattctgatgagtctctgtatcgcagtgttcgtggccggtagaagggtgtacaagtgaaataaacctgatgaagaaagtctagtgaaaagtgattcccgatgatttttgcgtctgtaagaaattgacatctgcaactatctgatgatagctcaaccctccatgagttaccgttaactacagaatcaaatttcaagacccatcatactagtgaattcaggtacttgaattgtcaccaaatacaagctgctgcatgttggtaataagaaagtttccaattttgaaattttgttttcttgttgtgagatgtttgttttgcaaagtataggtcctgccattacttaaaatatagtccgtatatgcatcgccactccaacatgagtagtgttgcacacatccatggagtagctttctacaatagctatggtctactcggcattgctcgaatcaaagcactttgccggccacagccaatgcaatgagcatcatgtggaatgctccatcctgcctcaacctcagcgccgccaagttgttcgactgcattggcatgattgaattgttctatatatgaccagtccccagacaccatgaagagcctaagctttgtgcttgggcagctcggcattgcagctgggaactatctcaactccagcatcctcagcattgttgtggtaatgacacgtcgcatgatggggctcgcctgggtggttcccatccaacctaaggcttcttttggttgagttgggaacccatccctccggtacagaaaacgaagcagtccattagcacatgattaattaattatttgctaattttttttaaaaaatggatcaatataatttttttaagcaactttcgtatataaactttttgcaaaaaacacaccatttagcagtttgaaaagcgtgcgcgcaaaaaatgagatgggggagttgggaactccaggaaacgaacagagcctaaatgaagtgcacctagactactgctgctactgttataagactttttagcattatccatatctatttatttatctatctattatatactaaaagtccattaaacttgctataaacgctcctaaaccgccacgtagcaatctaaaatcgctctcaaactatcacatagcattaatatctatctcttgatttttagttaatatggtgggtccaatattctaaaccgttagatttgattgagatgtaaaacatagagcccaaacg

SEQ ID NO: 73855 - DNA, 45916 bp, Oryza sativa
  unsure (1)..(45916): unsure at all n locations
catcatcaatagctgtaccctctgtaagttagagatgattccccccccctcattctttgatgtaatgttgcatctaccaatccatttagcctaggaagctattgctggtgaacctgtccagtatcggtggatgtatcccattgaaaggtttttgcgaaggttgaagtcatttgtaaaaaacaaagctcgccctgaaggatcgatagctgaggcatatattttgcaagaatgtgtaaatttttgttctatgtacctgcaaggggttgaaacaagaatcaatcgaccaaatcgaaacgaggatgtgcagagtgacaacagcagtacaaaatttcagatatttggtactgttggcaggccactccttggtaacaaatactgccagatggatatgaatgagttggagaaagctcggatatatgtactaaagaattgcgaagaaatatcagaatacgcagagtaaacaactactacttactctcattttctaatatgtaaatgctgtcaaaatttaacatacatgtgcatgtcttgcaacattcacaaagaccaacttagcatccagaacagtaaaggtgtggaaaagcgccatgacaaagaattttttgtatggttcaagaatcctgtatgtacacgccaaaataaaagtatttttttttacattttacaactatttataacctatataaacattcttccagatatttgagaaacattccaaaggatctccagatatatcagaagagttgtttgctctagcaagaggtcctgatgctcgagtaacccattacacaagttatatgattaatggatggagatttaacaccagggaccgagacatgttggttcaatcacaaaacagtggagtctttgttaaaggtgatgaagccagtggaagcaaagactattttggtgtcttgacagatgtttgttagcttgataatatctgtcaagacaccaaggtactttcagtgtcatattgtttaaatgtgaatggtgggatgtacacactaaaagggtagtaaaagaggacaagcatagatttaccttaattaatacttcccgtacattgccaattgatgagccatatattttggcaacacaagctgagcaagtatattatgtcaaagatactagagaccctaaatggtttgttgtagtcaagacgaagccacgtgatttgtatgactttcctcctaagaagaagaagaaaatgatccaactttatcaaataagtctagttctgaagcatgccaagagaatgagcatatcacggctgcattgaattacactacaattgatgatggtgacttccctacggttctcagtaaagatggagtcgaatgtgaacccattgaagcagaaccagtaacacattctgaagatgatatgtttgaagaggaagaagaagaggaagattctgaaagtgatggcgctgagtatacagatacagatgatgaaagtgacatccaaagtgaagaagatgtagatgacagttaatttataaactatattcatgttactgcaaatttacacacaaacacagcaaaaatatgttggcctgaaatacaattctttgatattgaggacattaattgcctatatgtttaatacaatatactaagtaaattaatttcttgcagattatgaaatgtaactaatccatattgagccctatttgactgattagtagaaactagcatgtactactaagtattgggccctgttgctactctgtaagtcacggtcagatatataatccatactccttgaccaactgaccatgctggataatagcttttttcagataaagaggatagggatctggagacatctgtatatccatctgctcaggagtatttctcccacgttcctcaccttaccccatgtttccctctcggtttccccttttggttttttgactgaactgactcccactcgaatctgttgttttggcttggctcacacagatccagccaatccatggtactaatcaacaaagcatcaagatatagtagccggcagcaccaagcagatgaaatggaacttaccacttctggttctgccgtcagtaagcccggggtgctccgatcgtgccgcgtcctgctaccactgctcaacctccctctgaaggtttggattgaactcgacgcaactcgaatgcaggatggatctcgccgcgaccccgccgcgccgtatcaagttcgccgtgctcccgccgttggatcgaggtcgcagagctcctgtagccaccattacggggcctgatgttgcagcagctctacctctaatagcagcctcagcgtcttggcctgcaatccttccgtcgtgccgaggctcacgccttcggccgccgggtgctgctgcctgctctgtgtgagcctgactgttgaataggcaaagcggtagagagggatgaaaaggaggttagtgatggtgtactgtactactagaaccaaacagtgaatacatttattcatcacaggtacttgtctcaacgatacaactttgttgccacaaggtatctgcaagatagcgagagcactctaattcatcaccattcactcctcacgattgatatgattagtgattacagggtagtttatcactaatttttaatatacaatagtgaccagacctgaaattctcacaactgggtcatcactgtttacatcttttgtgataaaaacacattttctcactagtaataggtgaaattgtgatggcagaacagtttgtcactagatatccgtccaatggtgacagcaaaataatttgtcactatacaaccacttactagtgagagaagtgagggtttcatcactagagttcatcactgaaagcctaatcccttgtagtggacaaatatacagatatgcaagtacttaataggatgtaattttacgggtcacctagtattttatatgtacaagatacacacttaattatttcattggcagtacaattattaagagcataagtacgtacataagtaggctcaatatgttttttctgctcaggtacataagttatcttgaaatcgcgaagaccccatatctaacagcacacatatataccaaccccatatatatatctggcagtacatacatatactatgggcgctgttctgatctttttgaagatgcattgtgttacactggcatttacgcacagctcgaagaaatgtgagtaactggacacacatttaggtcagagcatttagcagcaacaagaccgggcgactcctgcatatcaagatctttgtgcaacattccatcgggcagattccaatcaaaatggtagagaagattagccaaggcaaattccatgttggcccacccaagatttatcccaggacatattctacgaccagagccaaatggaagaaacttaaaattactccctttaagttctatatcattatcttcaaatctctctggcttgaactcctcggcattcttccaatacatactatccctgcatattgcccacacattcacaaatacagatgtacctttgggtacatcatagcccatgatcttacatgtctcacggcacttgcgaggggacaatagcggcactgggcaatgtaatcgaaacgattcctttaataccatctttagatagcttagttgggcaagatcatcttcagttatggtgtttttcccttggaaggcttgccgcatctcagcctgcacctttgccattactcttggggagcgcatgagctctgccatggtccaaatcagtgttgtagacgacgtatccgtgccagccccaaacatgtcctggaatgatggtttttgtaattaataatttactaatcaccagaaatcttttttatccattaccacctaaacttgcacaatacgcgcctgaacatacagcctaaacctgctgtacaaagcatgatgccattttttcagtaaaacattactatctttttgtatacaatattgttatatgtatgctttcttatttaatctcataggaggtcttgacccttattcgaggctatttatgtaaataaaactttatggttgggtttattctaaatagagaggttaggatgtaatcatcttgcttattttcttttaaaaaagctaactatgttttgtaggcgtaggttctctgtctatcttcatactacgagctcacaatgctccatcttacctcaggtaagtaagagctaaaaaatcaatcttgagcattgaactatttctttgtttcattgattttttttactcttaatacataaacgacagcaatgaaacgacgatgatgatgaggacaagggagggcgaggtgagtgtggaggaagatgggcctaagggcatgcacaatggagaccactgcaggcaccagtgatctcaagacgccacataggatagaaccacacaaaggtcacactactcacagcggaaaccactccaaaacgtattttgcattcagccactatctatttatatgtcagctctgatagtgtatcttattataaaacctattaaaactttatattttggtccttataacaattaaaagaagtatatatgcacccctaaacaccatatggacccactgtcagcctctccccctctcttttttattctctctcccgagccttctcgtcttctccatagaaaccatctattttattctctctccctctctctgctgagcattctcgtattcttcttctccaaagaaaccggcgctctccttcttctcctagtccaccttgccgaccagacccctcccctaccccgtgagctcgccggtgagacctattccctccttgtccctcacgccgccgcgagatccccatctcccctttccttctctctaggtgagcagagggcgacgggatcggcggcgctcgagctcgagctctccgacaacgagagagagttgggcagcgcggatacagcctcgtgctcgctggatctggcgacacaagccacaacagcagcggatttgccggcgagcggcgacgagaccacaacgacgacggcagttcctctccccctccgttcttcgcaagcgtcggcgacggtgcttctccgaccatgagctcaccggatctggcggcggatctggtgagcagcgacgcgaccacaatggcggcggtgagtggcgacgacaaccacagcgagatggggatttggggcaggtgcacgcggggaccgaccggacgaagcgatacgtggggctccgactcctccaatgctagtcttcgagtcgtggcttagcggctcccgagcctaggtgcggcgcttcaagcgttccctctgcaagcgcgcttccggcctgtggaacctcgttcggctacgagctcggctcggctctgacgtgggctcagctctgacgtgggagccgtgagaccacaggtcagagtggagcgttgtacatggcctatggacggcatggatgtggagcccgaggacgaggtcctggtcacggtgtgaaggcgaggtgccagagtgtggccggccagggcaactgaggcacagtaggtggggggccagagtgagaggctgtggagctgcaagacgaggtggaggccaccgaccagctgggaggggccgccggcacaagcggaggaagacgtaaagccacggcccatggccccgcctcctagcacgtactcctggatgggccagctgctagggccatgacaccagaccggcccaggcagtatgtaatttagggataaagttttgatttttaatatattgccatgttttatatgctagtaaatctttcgttcaaattaaaatatatgttaaatcttttgttgcaagtaataattccctccatcctaataaaatataagtacaactatatatattttttcaatgtttcaaaatacatggcgtgcgtgcaggcatgcatgcaagcaattaactagcacacccactcttctaaatccgtcgtttttaaaatccttcaccctcaagatttaatcccatcgggtgtacttattgtatttattgctgtgatgaaaatgagtaggagatagtaattcttttttggcctttgcattagtggttgttgcacgtcttatagtttgggatggaaggagtatatgttaaaactaaatatttaacccaaattaatatatgctgaatctaatctcttataatatggtatctagagtagtttacaagtggacgcatagaaattagtcttctcaatgacatgtggtctcaactggttttactttttattcaaaagtttatagaaattttgtacgaaggccgattgtgattaacaaaattccagagtgacccttactataattccttcaatttggttaggtcaataactccttcaactaataaatttaatactatgtattctcacaaatgtcatgatatctagcaagctaaggtcacatggtacgcatggtaacaatagagagtgacccttgtaatgaaagtattttaaggataaagatacctaaccaaaatgaagcacatgtagtaagtaccacatagataagtttttttaccttaatcagaatccatgtgaattctctatgaaattcatttttatcttagaattacatgcacatggagcctgcataattaggttgtccacctacgcaaatatttctaaatatttatggacaagcaagcccaccaatgcatgcaaccagcggtgcgcatctgcctctataaagtgtttccacggttggttgctaagtcattcgcatacgaaaagatttttaacttatagctgtatttcaaaagaagctgcatgcaaaaatcatttagacataataaatcgaccagagtggttcagtgatttaagtctaggagtagtattctatccgaaataaccagcaccaccatggttacccgctagatccacgagctccaccccggttgtccacttgctctgccaacgccgccattccctgcaagatctccactcatcctacttttcccatacgcctccggcaaaggtgatgcatccgcatctaagtgacaacctcctgcgggatgtcccaccataaccacaaaacatcctggtacattgtccttacactgctatcgacggctatcgtcggagatttaagcttgcttgtgtataatgacagttgcttgctttgttgcttatttgaacactgccgagggtgatttcatctggtggcatttagggtgttaatagatctactcggtctcttgcttctctagttgtatatattggatgcatgggaggtatagggaaattacagagaaatcagccataggaaaaattgcctgcgacaacaagcattagtgcttcatctatttttttcggagcagagccttttcacaatcttttcttatgtccatgttcccaacctcactctctcgtttaccacgcgcacgcttttcaaattgctaaacggtgtgtgttttgcaaaagttttttaaaaagattgctttaaaaaatcatattaattcatttttgaagtttttttaagctaattattaattaatcacgcattcatccattgctccgttttctgtgtcaaatgtgagggttcccaaccctcacctaagaaaccagccttagaagtgtagtggatcggtatgttgatgcaaaacaaagtgcttaattagctatatgcattgattcatattgagcaaatgtttagagaagacagcgtagatagaatttatgctatatatatatctcatgcgagccagatgtatagattggatttgtatgacttaaaactatcattnncnngnggggttttgcatccaaagtggatatggataatatatatatatatatatatatatatatatatatatatatatatatatatatatatatatatatatatatatatatatatatatatgatcaacacaagtgtcacaatctataatgttcagttaatgtgaatgtggttaagaatttgtaatgtgattgacgtgaatatattctgacaagagatctcccaatggtttgtatgggctcgccgtgctacatggcagctagattttttttttgtgccggcggtttttctgaactgaaccgcctgcaaaaacttgtatccacaggtggccaccatatataagaaatcatcatttgtaaatgtattttgctgatgggaacataagatatacgtctgtctaaatccattttcacgtgtggttctttcatgagcctgcaaatgtacttcctttgttcaagccctcacaaggtgggtcaagaaacacccgtgaaaacatgttataagccacctagaaacatattttctgcacttgtgtcaatgacccataacaactctttctacatttcaatgacgcatccaagtaatgtgcaaaacaaatataatacttgcaagagaaataaatggttattttaaaaccacatattttaattaggtgtaagaaataaaattaaaatatttttggaattttaaaatatttcaatttaccataaccattaaactgaatatagtataacattgatgttctatgttaaacataatttctactccctccgtcccataatataaggtattttgaggttttttgcttgtaacgtttgaccactcgtcttattcaaaattttttgaaattattatttagtttatttgtgacttactttattatctaccgtactttaagcacaacttttcgttttctatatttgcaaaaaaaattgaataagacgagtggtcaaacgttgcaatcaaaaattcaaaatctcttatattgtgggacggagagagtagcaaatttcatacatattactccctccgtttcacaatgtaagactttcaagcattgtccacttatatatagatgttaatgaatatatatatatatatatattgtctagattcattaacatctaaatgaatgtggacaatactagaaagtcttacattgtgaaacggaggaagtagcacttaccgtaattttcattcccctattaatgttgtttctcatgattgaacattgcccctaatctaccatgaatacatagattgaatgagtatgcacatattaaagggaaagtttactcaattaatttaccaggttgttgttcccatatcttgttaaaaacacaatttcatggggcaagttttaaatggaaggatgtgttgggttcatttaagttaagttaaaacttaacttaagcatgtgttgggtttgttgaatggggtggattggacaagtcgaaacctcaaaactctttttgagggtgtttggcttggaacagttagactgtattcattcctaaaagggaatgtgtcactaagatctggatcaaccatatccctcaaaacctgacggactaatccaacccactttttttcttgtcactcatatgcgaatcataccatccatctcaaaaaaaaaaaaaaaaggtccatcccttaaaaaaaatggatagtctaacctataaataacaccctgttcctaaaccaaagacgacatgctaaatgattaaaaaacagtgatgtgaagcttactcacccataaaagaacggtgataacttggtttgtaattggaattggcgtgccgccttccttctggagcctgagcaacacgtcgagagagcatgacttgctctccaccgccgccttatcgccaacgtcgtcgttgccgctcatcatgtccgtttcgatttggttcttccgttcttggatgatctcctctatgatgcgctccactttgttgcggttcgcgagaacgttccgtggccctgtcgcgaccatcgacgcgagcttggaggacgggaagaggtcggcgacgctgagcgccgacgtctggtgtagtatggcgtgcagcgcggccaggaactcttcacggtacttgcaccggctcccgacggagcaccggagcacggtgtcgttgaccaacctgttcaccatgtcggtaaggttcacggtggcgccggacgctgcggcggccgacaggtcgcgcacgagccgcgccacctcctcttcgcggacgcgccggaatgaccgcacccgcgccacggtcagcagctcctgcgtgagcagcttgcggaggtggcgccaccgctcgccgtactgggccatcaccacgtccgtgccaccgaaggtgatagccgccgtggtgctggtcaagtggcggtcggcgaagatgaggtcgtggtccctgaggatctcctgcgccgcctccggcgacgacgcgaccaccgtgggcacctcgcctaaccagagctgcatgacggggccgtgctcccgggccagcttcccgatgacgctgtgcacgctctcgctccaggacacgaggtggtgggcgctgccgatcagcggcagcgtccatggccccggcggcaggttcagtctcggcttcttggcatatgatgatatcagcttggacaggaagaccaacacaagggatgcgcccacagcgagcaacaccttgtcctccatgcccgtaggatcgatgtgctgtactagtaggctggtagccactagtataaatagcgatgctgagccaaagccacagcatttctagtgtgagagtttgccgagattttttgagagattcgattgttgtggcgtgataacagtattggcgagacgccgtcacttctacggcatatacgacagtgaccgatggtggctagcatgcccaccacggaactctagggctatgttcacactaggggctaatgttctaaattaaccgtcaacctctcatcatatatgctgggctctaaacccaacgtagttagcggttcttaattagtggaatcaatgagcactattggagaaccgatcttcgctcgatcggccaaaatcgtaaatatctcggatgtaaaacgaatcggtgctaaaaatgatatttattactggttaaaatacccaacggcactttaaaatctttagccagttctaaaaatcatttttaggcccccgtgatattaattatgtattggctggtgtactaaagttcaacaccaactagtattaaaggtcatatcctttttataggtattcttgctcctccagctcaagcgattgctacaaagtgaaaggaggaggaatggatgtgctaccaaatttttttgtgaaaatattttgatgtatggttagcatattacatttctagctatatttttatacgtcttctctcttaaataagtttatggaaaaagagaaaataagagagatctaaaagatctaaaagtagtatttggaaaaaggatctgacagctaacctatagcacgtgaagatggttgttgacggtcattatagactaatttagaccatcaatatacttaaaataaagaagaagtagctatgcttgcaatgcatatttattttagaataatatttttccacttgtacttggagtattatttgtttgcagagattagcacataaattaatggagaagaaaaaaaaggaaaaactcactcttaagcaagctcaaggatagagaggcccacatgcaggtgaaaccatcctagaaaccgccataactgtcacaaccgtcatgagtacccatctgtcagcccttgtacaaagtttggaggcctgctgggccgctcaggttcggctgaaccaggggttcagccaaaccctggcaatgtcggttcagcctggccttacacgtggatgtccaggattgcttgctgatggccgttgcgggccatttccgacatttcgcatactctacaaccgtcatacctgcctatttaaggaggagctcattcacactccaacacacactcaagcaagaagctttgatctctctctcaagtttagttagtgctctagtgctaagtggaatggaataggatagttctcggagtcctcgagtctttggaagatttcggtatggctctagtagtttttccttccttttttgtaagaccctcggaattaatggaatattcttctttgtatacctacggtactttgcattgtctgagtactggttttactttatgtttgtgtcaatatagttgaatgactagcccaccagagaggtgcaatagtttgggtttaatgttcatgcaaatgattgctctatgttattctagaggacatagagtagtatttgataatgtatatatgctgcgagacagtagattattaaatatcattaattaggcatatatgctgcgagacagtagaggtggactattgatggtaacagttcagtacgtgtattcctacacgttagtatatatttctaagacaatttcctggggacggcactcctccgtatttaccccggttggacggccatgacagattgtcataagaaacttgacaacctagggtggtctctcgaagcaccaggagggcactgttacggggtattggtcagtacaactgtatactaacagatgtaaacgaaagttgagtctgtattagaattatatgaatgattacttttctatttcttcttccacattagtctagaattatttaagtgagagaatctaagtctttctgctctgtgtcactccacccatatgattaaagtaacccctgcatagactttgacatatatatatatatatatagatatatataacatatataagatattggcagagttctctcttttataaatcttcccttgggatcaaataaatatgatacattggaatacttctgggtgaaatgctacaatagtatattcatgcgcttgcggattacttctgtaaccataaatatatcagtgctattctgtgccattgctaggaattcgtatttttagtaatgtcattaagaaataccaacaatggtcacgttgcgatatggaagaagaagtttgtttttggagagttaccctattagaaagtcttagagatccgccatggaatcgacgtgatgcacttgactaagaacctgtgcatcaacctgcttgtattcctatgtgtatacgggaaatcgaaagatagacttgaaacacgtaatgatctcaagtatatgaatcaacgcgacggccttcatccggagccgaaggagaaaggaaaccattacttaagtccaaccagctatactttgagctaaggaaagaaggaacaaaccaagccggattacaggggataactcacatgcgataacagaataacaacctacacgctaatagcaacagaatgaatccttatcccatgtgagcagaaccgtgaatactcctaatccgaacctgcacattatctaacacgatcaatccttcaactggagtagtgtactcccgcgacagccgacgcaagaatgctcatcgacttcgtatcttcctgactgtgactggaccttgtttgaactttgaatgtttgatccaaattatttttattttgttaaaacataaagatgtttatttcatcgaccctagacatgtctactaggtatagagataggaaatatgattttggtgctgaaaagcgtaagggacaaatactagaaatacctcctctatttcacattataagtttgggtttttaatagatttatgtatggatgtgtgtttcatatatatgtctaaattaaatttagataaatattagtgaatctaaacgaaaatatagagttcaaagtgtcttataatatgaaagagagggagcaacatattagacatataatttagaaattttagacgcacaacttatatttcgcactagggcctcaaattcctgaagatggccctggagcttagatctggagttagtgaccaatgtacccagccccctcatcaccgacgtttgccctcccttccgccagcctggacgtggcgacagcgaggctaacaaggatgtcatcctggggttcgtcagggcggagctgacggccatgcatgccgcgctacgggacctcaccgacctgaccccagcgcagctcgacgagcaggccaaggctggggccagccacgccacgtcgaggacgccgtcgacgctttcatggtttggagcctagaatttatttatcaaattgtactatactcgattgatcaggcattctgttatttatcaattccctattttcaaatttatttctctaaaaaatgttttagctagtggttctctttagcttgccactagagaaattaaatcattttttttttgctagcggttgccgcgtcttaacctgtcacctacggaacttgtttttcactggcgtaaaatgcattattttcattagcgttaggtcgttggccgcacctctagccgctagcgagaacctatttttgtcatcggcgaaaattatttttttatagtgacatctcggtccctttttacgtactccctccgtcctaaaaaaaggcaaaccctgagtttgcgtgtccaactttgactgtccgtcttatatgaaatttttttataattcgtatttttattgttgttagatgataaaacatgattaatattttatgcgtgacttgtttttttattttttttataatttttttaaataagacggacggttaaatgttgggcacggaaaccaggatttgtcttttttttttttttttacggagggagtactctgctcgttctagcttgtctgtagtcaacggttaaggtcgccgggagtatggcaggcagtgaccttggaacgttcctatctttatccttttttttaccgagattgattgacaacttaaacaaatgatacgtttccataaaaagtcaagtcgacacgttttgtttttactaccacacatggactaataatttacataccacgaagaagattaaggccttctttagatttcaacttttttcttcaaatttccaacttttccatcatattgttctaatttttttcaaactttcaattttgacatggtactaaacacagcctaaatgaagtttgagctgtcaattttgtcaattgtttcttagcatgtgttgcatgcattgtcatttttttttctaacacgagcagagaaaacagaggcccagctgtattgtctttttagtagaactaggcaagtagcccgcgcacatgcgcaggcactttgtctaaagtggtatttaaatatttaattttagtttactattaattaaaattaggaaggtagcccgcgcattcacacggatatgtatcgtacgctaagtatgagacatttataagagcgaaatattaaccggagatcaattgtcacgatttctccataaattgttttcgtcggtattaattgcttatataatttttaacctattacttttatgttatataatatttaagtaatatctataagcaattatttataatcttcttcattatttgaaaagaatagtcttattttctatagaaaacatgtcaacgaaagtaaaaataatgtgttttctttttttaattgcatatatattatcatggtttgttagaggataaattgggtgggacatgaggcttcactaaatgtatgggtttatatagcctaatatgattgatgtaatttgagaggtgatccatccatgaacattttcatttagagtgggtcagaggatcacacaacctaacatgaatacaataatgacaaaatataattgcgtagtaatattttttaaatgtgatgtcccatgaatacacgctgttttttctatataacatagatctaacggttagaaataataatggttccaccagtttaaaagacatagtagtattccaaaaatgtagcttgaaaattatggttgtttcaatgtctaatattattacgaagtgagtgtagctcaactggttatgttccttgtgatggaacatgcctgcccggatttaagtcctagatttgacatgggtgctcgcatttatggttaactattatttcagtgttgacatacccattggtagcgaggcgctcgtggtgatttcgtcaatctcaaaaatatatcggcccagtctttagaagatactcataggggtaggatgtgcgtgtgtgtgtttataagggtgagtatgcatgcgttgtgagcgcctgcgtttgtatggtgtatcttaaacaaatacgcaattttatagattgtttctctatgtgtgttcttataagggtgagtgtgcgcgtactcaaagtgcatgtgttgtacggtgtttctaaaaaaaattgaatattattgattgtttcccttttagtataatagctaaaaaaaatagggaggggatggacgatgttttgtgcatgtgagggtgaggaggaggtggaggagattttattcttctattttttctatattatttaagtgaaagccggtgatggggtgtttcatttgtttctaagaatttcaatgattatttcctttttataggaggtgacacatggcgacttaagattttcataaaaatagatctaatagttaaaaataatggatacaagaatttaattggatttttttagaaatttaggacatgatacacggtgagtaatgagcattctggagggtgtttattgatttttgttatgtacaatgatttagtacagcatgatacatatttcaattatttttttgttgttatttagttgcaatgcaaattatagtgtctaccttcaaacgatgtattttttcttttatatagtaaaatatagctaatgtgatcttgatttatttatttagttataaaataaaacaatagctatgactgtttttatattatgttagttaaaaaaatagaagatgggataatttaattagagaggagaggatgggagagtcagagagggaaggtcggaggtatatgtaaggcaagaggatatgagagattattgtttttcaggatagatcgaatgatcctgtaaatacaattcatcttagggctattagaaataactttttctaatttaagtggatgttattaatcagaagggttaaaaatctatttgattttttcttaaaaatatatggatatgtggacaatagctagtccgtagaatatatgtcacaaaataatgaatttctataataatattagctatatgattttaataatattagttatttcaattttaaaatattttattttaaataatctaatggagtgcaccaataaaaaattagctatatgatttagataatatagttgtttaaaatttgttatcaaaaaaatattttttttccatctatctagaagaagaaaataggagagaaaggaaatagatagggaggtatgcacatatgtactggacgggaggggatgtgatatgcgagctttttctttatccttttctatttgactaaataaatctaatgacaaaaagataataggaaaataggagaaaaaggaaatacgtggtatgtactggatgggaggagttaggaatatgtgggcctttttatccttttttacttggataaataaatttaatgttagaaaacaatgggtctactgtatattagtgaaaatcgatgtatattagtgaaaatcgatggctaaatgtttagtttactcttaatttttttgtgaattttttaatttattaaaatgtcatgcgacggcgtaggagcatttgtaggagtgctacgtggtggcttaagtgtgttattattcggcttataagtgatggagatggttggagctaagcatgtggaagcgtttggtgattcggaattggtggtgcaacaagttgccggagtttacaaatgcttggacggaccactaaataagtatcttgactcatacttggatattattgtcaattttgataattntgctattagacatatngctaagcatgataattctaaaacaaatgatttggcacaataagcatctgcctataatgtgaaaaagggattattttttatattaaaagagtcggtcttgattttaaatctttgtgcgaaattgacaaaattgcagaccatgggcggtctgactggcgttgcgcggccggtctgaccggttaccaggggcggtatgaccggccacatgccgctggtctgacgggccaccccaggcggtctgaccggctgtatggccggtctgaccggttctagacagagcgctggggggcatgccacaatatataatatacgatattaaaaggcagcgggctaatgtaaaggtataaaataacggatcattaatttaaatgaaaatcgatagtgaaattatatagtgccacgtgatggtctaagagtgcttatacaagcaccacgtgactatatttgtggagcaataaattttatttttatagtacagaagatcctattttaaaaataccgtctatatttttttcgtcggttataacttcgtacgtatatttatcgtgcgttcaccgtacatacgtatgttcctttgtatttttccatccaagtgaactaatatttatcgtacatacgtacgttctttgtttcttctgtaataagcagtacctaaagatatactccatcatatacgtatgtaaatattttcatacgtatacgtatgtaagtatttccagtaaatggattctctagcacaaactttttaaatagatccaatctaacggtgtaaaataggcccaccaatttaaataaaaatcgatggtgggattatggaatgcccactacgccagatcctcacacctctgacgggatacctacgacgggcaaatgatttggtcactgatgaccgtcacctttgacgggtcatacgggatgtcgtcatcggtgaggcattctgccgcggcccgtcataggtatcctgttacctgtgataggccgaaaggaaaagctgtcacatgtgaggcagtgacgggtttttcttccaactcgtcaccggtatcccctcacctgtgacgggccgtcacaggtgatgggcagccacctgtgatggatttgttttccggcccatcacaggtgaggggataccagtgacgggcaactcaattgaagcccaccaaaggtatgaccaacacctttgacggactttttttacctaacctgtttgaggtgtgttgggtctataaataccccccaaaccgccaacggctttccatgccgaccagttcattgttcacaaatcggttgggggtcaaggggggcgaatttttgctaaaattcaaggtaaaaaacacattattcttcccttcattctcaatatatcgatcatcatatatttttcttcctatgttattgatttcagatgaatcgtagttggatgtaccatgttcatcgttcatctacagagtatagagagggggtcactgaatttgtcacatttgcggagaatgacagaaaaagtaggatgagcatatacatattgtgtccatgtagggactgtaagaatgaaaagatgatccttgatagctgagaagagcattctcatttaataacaaaaggattcataaagaaatatacttgctggaccaagcattgagcgcaagaggcgcctgatgccgcagctgaagaagtgttggatcagaatgtagagaacaccgccgcagctcgtgaaggcatgtttgtaccttctccgttaggtggagagaccatagatttggacactcaatgtctatctactatgttgcatgacattgaagacgcagaggacaatgacagagattttgagaagtttagtaagttggtataagattgtcagatgcccttgtatggtggatgcaagtcgaaccacaacaagttgtcatgcgtgttggaactcatgaagtttcaggctagtaatggctggtccgacaagagttttacataacttcttgagctgttaaaggacctgttgccagaggggaacaatttaccgcagacgacatatgaagcgaagcaagtattatgtccgttgagcctggaggtcagaggaattcatgcttgtccgaacgactgtattttgtactacaaggaatacgctgacttggatgtctgccctgtctgtggggcatctagatacaaacgagcaaagagcgaaaggtgaaggaagtaagtcaaataggggaggccccgcaaaggtggtgtggtatctcctaattgcggagcgtatgaagagaatgtttacgaataaggaacaagctaagctagtgcgctggcatgctgaagaacggaaagtagatagtatgcttaggtacctagctgattcagtacagtggaggacaatcaataggatttaccaggaattcttaaaggacccaagaaacatgcgtttcgcaatgtgtacggacggcattaatccatttggtgatttgagcagtcgtcacagtagatggccagttctgcttgttaactataacattcctccctagttgtgctttaaaagaaagtatattatgcttgctatgctcattcaaggaccgagacaacctggcaacgatatcgatgtgttccttgaaccgataatcgatgacttcgaaaggctatggaatgagggcacacgaacatgggacgcatatgcacaagagtatttcaatctccatatatgttaatgaatctaggcacacatatatgtctagattcattaacatatatatgaatgtaggcaatgctagaaagtcttataatatgaaatggaggaagtactctatacctgtgcacccaacatagagcaactgataaatcagatattaaacccgcaccattacacctctctggtagcctacccaaacaattaacataaagcagatataaagtaagaccagtactcgaactaaacaaagtaccgaagatatataaagaagagtatttcattaatttggaaggtattactgaagaggctacaaaaactgctagagtcataccaaaaactcttccgaggacttccgaacactattctatactactccacttagcactatgttgacggtcgttagcgatcattttcgcccgtcaatactacctaaataaaggagaactagttatgcttgcaatgcatatttatgctaaataataaatattctactagcactaggattactaacctcttgcagggaatgaacacaaaatggaggagaatcgatagcaatacggacgatcaatcaatcgaacgctgtcgagaattagacttgcggacaagtgggctgaaaacaccaaatcgacacgaccaaaacaacccaaaattcacaagtctacataaaggagcggaagaggaggccaccagctgaaaatgggccaggaaggcccatcccacggttcggccgaaccctccctggcgccgttggatacaagccttcttctgtacggcttggatcactccccaatggtgtttggagggaatttccgaccattctaaccatctcaaccatcattgaaaggctataaaaggacttcactctctctatttctccacacacctcaagcaagaagttcatttcatctcttaagtttagtatagtttctagagtatagtggaatagaaatataatagaatctcccccgcaaaaaaaatgaaatacaatagaatcttcagtcctcgagtcttcggaagaattcgggtatggctctactatattttccttctttttgtaagacttgtacttttattagaatactcctctttatactactttgatattatattattttgcgagtatatgaataccaactttattatatgtctatattcgttatgatgctagcttatctaggagattcaatggtgtgggtataatgatcgtatttacaatgactatatgttatgatgatgatattagagtagtatttggtaatttaagcgtggtgtttagattattggatatcattatttggggttatatgctgcggaagcgaggtgggccgctgatgatgacagctcagtacgggtattcctccgcgctatatagtcctatgttaattttctagggatggtactcctccaaatttagccccagttgtatggtcatgacggattgtcgtaaggaactcggcaatcaggggtggcttctcaaagcaccaagaggccattggaaagagggtattagctaagtaatgatataattaggatgtatgtataatatgtatgtatactaaaagtataggaataggatctttctatattctttccacttaatttgatatcatgagtaagcggatgaatgcttctgcttagtgtcaccctaccctttgaattgtattaacccttgcttagacttcgtttattacaagtaatatataaatttttagtacggttctctctattattatcttcccacgggattaaacaaatacgataccattcgaatactctcgggtgaaatgctataatggtatatccgtgcgcttgcggataaactctattaccataatataccaggagtatttttgcgccatggctaggaattatatttctagtaatgtcgttatgaaataccaataagcattcctggcgccgttgccggggaagatttataaaagagatcaccattactaatactttatatttacctctatataatcactgtcctttgcaggctggccttggttgttttcacatttattgtggaaaaagggtagtgcatgactggttttaacttttcggaaaatttcaaagaaaatctagaagttttctttcggagtgtcaagtcgcgagtcgttgctccgaagaaaactcttccaacacagaaaccagccattccagcgccaccaaccttcgagacttggctgataagaccctctgcaaattcgctgctcccttcgctgacaacatggccactgggccacaaatcaacatggaagacgtggatttcgatctgaagtccagcctcattacaatggcataggctagcccattctgtggcaagtcaaataaggatgccaacacacatctgcaatagttcctggagatctgcaacacatacacaatgaagggtgtcacgccagacgtcgtcaggctgtggctgtttccgttttccctccttgggaaagcgaaacaatggttttatgccaaccgtgccacgatcaacacctgggacaaatgctctaaggcattcctgtcaaacttcttcccgatgggtaagaccaacacccttcgcgaaagaatttcaagcttccagcagacaagggacgagtccattcctaagggatgggaacaacttcgggaatatatggccgcatgtcctcatcatgagatggatgattggctgatcccgcagaacttttacaatggactcactcccacgtcatgcgaccatctggacgcggcgactggaggtgcctttttcccaaaaactgttcgaggagccgtcgacttgatagaaaaaatggtctccagtatgggctagagcaaggaacgattctagacccgtcagcaaggcgtgcacaccgtcatggagacggagatgcttgctgccaagcaggatctcctcatgaaacgtttggacgatcacgagaagaggtcacaaggcaccgtcaaggccttggactcacacgttacgtgtgaagtctgcggcagcatgggtcattctggagcgactgcccagaaatccgtgaagaggcgatgtacatgggcaacaacaacgacggattctatccacaaggaggtcagtggtggaaccagccacgcccatatttccaaggaggcaataataacggtaacttttctaaccaaccctccttgaaagatcttgtctttgcgcaggctaaaaccatagatgctcttagcaaaaagctagctgctaatgacaaaatcttagaaaacataaatcttaagctagatggctttgcttctgcattccaaatgacaagatcttgtctttgctatgtagtgacagccatgactcccgtcctagtaatcctccacattcggatacatcatagagctatagccagaaccacgctggcagaccagtaggggtcggtgcccgaaacaacttattggaaattacctttacttagcttagataattaaaacacatagaaagtcctctctagcctagctagtctgccagtagttgttgtccttgtatagtcttaaccttatgaagattacacacgttccctaagttcgatatccttttggggtcacatgaaggtgaagtgctacagcggaatgtattccgtgcacttgcggatttatctgtggttgtaagaaataccaacagccagccttcttcggggtggaggagggtagaggagagtggaagggagttgggcccgaggggaagaaaaataaaaggaggcccatttgaacagtgacatttctaattttctctggaattttgaggaaacttggaaggatttgaatttgaattttgacctagagtttgacaataatttgagggggtttctttaagggaggatttgagatctaatttggcacaaaatcaagtaagcaccaaatttaaactccagatttttaaatgacagattttttaaataaacgaaaaattcaagggtgctacattaagactgcctatctattggtataaatatggtagaggtgttgaggtttctacatatcgattttgtgataattgagtttaaaggaaaattaaggtttcgggtttagtcgagatttgtgagaggagtgctgttattacactttgtaaacacgaatggaggcaataaagtttaatgcactttcaagagttcttcgatttatgttttctcaagttcgacggtcacaccagtaaatacatggcagttagacccaatcagaccgatagcatttcagcggttggatcggtgaaggtgacaggcgacggtggctcaacggactgttagactggagcttctacaccagtcagactagaggcatccatgcggtcagactggcgcatcaactccggtcaaaccgatccttatcaattcgagggtatttttaattacgtaagaagttttggtttttagtgatccaaccatttacctctctctggttggggttctatcctactcactactcacagaaatatttctccatggacgactgtatttctccatggacgactgacttagcgtctgtgtaaataccttatttatgtcgacattgcttgcatgtaggagtgaaaatggggccggtatttcccgaccatccgcccgacccgaggctagtaggaggaatatgggagaaaaaataggatacccaatactatctgagttcgaatccgaattcgttagaaaatagggttaattggatccatgccactgcaactttaccaaattaaaaaaataccactactattcatcatatcggttacatgccactgaaaatttctaaaattgaaacaatgccactgccgtcccttttcccatccacctctctcacgccgtcctcatcccgcttcctccttgttccatcgtccatccatccatggccgctggaggtcgttgcgaggaggtcagcgcgatggtggcagtggaggaggacgcgcgcacgggctgccgttcccggtgctcgcgcgtgcggcgttcagggtgcgcagcgcgcacttgccggcggtcatccgcgcgctcgtcagctgcgggtggttctgcatcgagtcctggatcggtggccgcgcaacatggtggcgccggcaaacgcgctcgtcagcatgagcccgcggaagttcacgttcgccaaggggcgctggtcactgcgttgcttggcatcgccttccagccatggcggctgctcagctcctgcgagagcttcgtctacacatggccgttcgagctctcctccgccgcccgtggccgctgcgctccccggcgacctacaactccgacgaccgcgagggcgaggtcgtgcacctgcatcgtcgaggacggcggcggcggcagctcccgagaccgagctcgcccggcgcatcgtcgagcacggcggtgtcgccatgtgcgacggcggcggcgccacgctgcgccggccgggcacgtagcagctgcggcgtgacgggggcggggggatgtcggcgaccagaaagtcgccgtcctcatcatcatcgcggatctccaggggaaggaactctcgtcaccgtcgtcatcgtcgtcgtctccggcgaattcgaaggtggcttacggccagcgttggccgtcggcccgcgacttccactccccgacgctctcctgccgcggtggagcatgaggagtgagcccggggggaggtggcggctgtcacgcccggaaattcactagtaatttccgaactaatttgtgcataaaaccctcgtccaggaatcagccgaggtacacaaactgacaatttaatatacaaatccatcataataataacgttacatacttacaaaagaaaagaaaaaaaaaacagcagcggaattaacggtctagcgatggcttcagctccactcccataggcagctcaactggggtataagccaaacgtcttctccttctggatcctttatcttcaactgaggtttgattattattgcaagaatgagcatatgacatactcaacaagccacacagcaaatatgcaagtgcacaaggataccaaaggatggcataatataggctcatttgcaaaagcagcatttagcaaagatttaagataagtaaaacagtagagtaattaattagaaattttaatcaacactgaacagcacacccatgctgtacaggcccaaccatcctgaacaaccatacccggctgtacagatctaactccaaaccaggagctaaacaaattattaccaattataacatccataattattgtgaaaggtgtgagactaatcacgaaaaacattgctcaacccgcctataaccgcgggcacggctattcgaatagttttactctggccagaggtgtaccactgtacccacaagacacgatttcgcacatgttgccatgccccgaaataccaccacggcattgcaaagggggaaaatcgtgacaataccctttgcacaacacaactcaaaacagtgcaccgttcctggatcataatcacccccttataaaacaaggcatggactccccagcgacccccacggacttctcgccgcttctcagtctggcacactataatgaaccatgctatacaaaaggtaaagtcgttgcccacgctggcttgtggttggcacggtaaatgtttcacaacagtagctcgcgaaccggtccttaattgtcatgagcacaaccatcaaaaccatatgctcacaacccaccttaaccaggttttaattatcaattaattaacatcacacgattaaccatcgtgagcgaccattaaatataaccataaataataatgtagtatatatgattcatcccattaatgagctaatgtttctaagctttgctaagcaattatatctaacatttagctgaaccaaaccaatacataaggttcaagctaatcaatttattacccaaggtatcaaggaatagagtattcaatgcaaattggccataacaaaggaataggttcacaccacccggtgacattcgaaaataaatgcacagttgaaataaatagagaatttaaatataggatcaacatgctcaaaggattgtgcttaggatctgtgtgacttgccttgcaataatcgatcttcaattaatcttcttgatcactttcgacgcactcacgaaccttcgcaacgacggaaacgacaagctaacacgcaaaacgaagaaaaagactaataaaaaccaaataaacagtacataaaaagtaaacaaacatgtagatcatgattttaaatgaattatgagacttgaacggccttattccgacttcaaatgaatttattatgaattttacaagattaaatctaattaaagcccatttaaaaagaattaaataaatttaattaaatttatggacaattttaatatatagatctttattttagaaaaatttagcaacttgaaccacctaaaacggatctacggttatttagttatgattttccgaagatttaatctattagaaaaaaggagaaaaggaaggatgatgacgtgagcatgacgtcacccacggaggccggctagggttggcaagctcgccggagatagagaccttggccgggtgattggaggacacctacgcgtagaggacgacgaggcgaacccaacggtactcaccacaacgtctaccgatgaccgacgacggccggcgacgaagaagacggcagcggcggctcggcttgcacggtgacggcgagctacggcggccggcgacgaaggaggaggtgcggccgggcttctcttcaccttggcgcacctaaagacggcggcggcaagcggcggcgacggctagggcgatggcgcggcgcgactggagatcgccggcgacggctagcggctagggcaacgtggcggcagcgctacgggcgacgagggagctcgggacttggggcaaacggaagaggacgactaggggatgctttatataagcttggattgaagagatcgaactccaaacgagaggaatcgactcgggaaaaatccaaactcggtttttagggataaactcgaaacgaactcgattcggagagaatactcaacggattgctccgtttcttgaggggaaagatagaggagaacgagaggatcaaaacccctcaaaaacccggaggaatcggggtcggattggagcggatttgagaggagaaggaggcggctcgggcgacggcttcactcggccggccggctgctagaggaagaagaagggcctgacatgtgggccccacatgtcagtgcctagagggaaagggtttttgaactttttcaattaaaataatcacttaaatgatctttgaattgttaaaaatacttccaatgctcaaataatttcaagaaaaatcctgaaaatacttggacactcaaagtacttaacaaaattataattagaccatttaatgattaatttaatatttaaataattgctgaacttctctttgtatgattaaaattaataattgagctccgaaaaatccgagaatattccagagagtataattaaccatggagaatttaataaaaattaaatccatccatgctttatatttagaaaattttatttcccacatttaacttcacttgtaaattaacgaacatttaatataaattctaataataatttattaaataatttataaatcctgaaacaaaaatcaggatgtgacagcggccgccggcgtcggcctcctcgccgaagaagaggaacgaatggtcggccggcggatgcagaggctgccgaagctcccggtggatgccgatgccgcctcgcggtcccgcacctctgcgacctcctccgctccctcctccactcccccacgggcgtcgccgtcttcctctccgacctcctcagcccgtgagcgctcgccgtggccgccgagttcgcaggaagaaagagggaaatggcgtgagatgacgccacatctgacggggaaacgagacggcgtgagataggagatggaaaaaaggacggcagtggcatggctccaattttaaaatttttcagtggcatgtagtcgatatgatgaatagtagtggcatttttttaatttggcaaagttgcagtggcatggatctaattaaccctagaaaatatgggttaggaaagggaagacatgtattcgcccgtatgtcccatattttaaaaatatgtatgaaaaactattataaatcgacctacaaacatgataaaagattggttaataagtattttacgagcttacatgtaatattgtatattttttctcttgatgtatctcttttagtactttaattactttattatatttattgtctatgaattatagatacaaatagatatctgttttcgaatctgattcgaagaaaataatatgggataggatacgggatgagtgatatattatccggcactaaccatacgtacccgactcctaatttagaggacaatataggttaggatatgggaataccataatccgaccgtatccgtctgttttcatccctacttgcgtgtagttcggaaaaatgtatatttgttaacggtttatgcgtcgcttgaacataatgttttctgtgccggtttatctgaggatctcaaaccaatatggacacgacttctgtggctacagagaaagtaaactgttctactataaaagacaaacgactgaggtttttttctcggctcgtgctagaaatggatgcatgcaaaacacatagtcagaaaatgacagctcgatctttgtttattctggtgcttgatcaacaaagttttccgagtgcttatctatcgacttggcgtatacggatcttaattttttttccgagtgcgcatcaatcgacttggcgtgtacggatcttaattttttgatgctacacctagagatcaggagggtgttgaaacttttagtctaaggtggtgttcttttctcattaagatgaagattaagatgaatattaagttttttacgcaaacgaggtggtattaacgtatgattgattgagttttaattattacaaacttgaaaaatagattaatgtgatattttagaacaacttttatatagaaagttttcgcacgaaacgcactatttaacagtttgaaaagcgtgccacgaaaatcttaatgtttatccaactcttggttggagaaaagaacgggacctaaaagcatgctgtcttgacttttatccaaatgagactttacaaaacgttgaataatttgaatggcttttctatgtttgttttcataatagttttttaattagtgattgatatttcgttttacagaatcttaatttatattaattaatatatatcgttcagggcagagattaaaaaagactcgccttgttagtttcaattgttaatcaatctcggtgagagaaataaaaatgagacaatgaaggttccaaggtctcactgcccctttctcggcgatcatcaccgttgactatgacaagcctccaaggaagcgagatgtgtcgcaagcagtagtcgctttcgtcctggtgaacactagtttcaaccgttactgatatatgagataatccaaaaaataccattgacaaacatacaaatctaagaaatagcatagataagtatgagatttaagaaatatcatcgtacaaatgattttgtccaaaaatacaatcgtcattagggtttcgtccattccaattagttaaatacattattgttcatcttatatcacttaacaacgcgaaatggacggatccctagcggtaatggcatttctaggacaaagtcgtttgtacgatgatatttcttgaaacttacacttgtcggtggtatttattggatttgaatgcttggcaatagtatttcttggattatctctagatattactaccggtacttacattttatctactgtggtatatctatgacctttctatacccactattcactcaaacagtcgcaatagtgctaaaaattaagttggaaagtctaaaactagagctcattatcgtgctgttaatatataaaataaactaagtatccagaaatattgaatggacaacagttttatgtctattattttctgtttaacaatactagaaaatagactacgactaaaacaactaaaatcaactctaaaccttagttttaaaattcaaattttaaccaagctgatatacaaataacgagaggactcatgaaaaagataaaatggcaatacccgagatctgtggcatgcgctgagtccttgacttgtttaattcacaaaagaaaaattgtgaaatcattgtcatgattaacatttgtgatgaacaattggctatgcaaatgatttaatcaaagaattggtttgagaatttgtgtgaatgttggtgtgagtgcgtgtgactaatgtgggtcaggttgtgatatctgtgcccagaaacggttgttttgtctgattgtgtgcaggtgacttgaggccagccttggtcaatggtgaggaccgggactatgttcagggaggaacagaggtctagtgcggtcgggataccatgtgagaagttgactagagtcaggattcttggaggtcaacttcggtcaacggtggggatcgggactagactcaggcaggagttgaggtccagacggtcaaggataccgggtgacgaagttggatacaagatggcacacggtggatggacatcgtgtgggagagatctccgcaacgggcttaacgaggtgtgcgtgcaagcgtcggtgttcgcgaggaggaatgagagaagatagagatgttcatgtacggtggagtacatggttgctacagtactcgatgtactgtagcgtgtagtttgcatgtacgtgatgtgcatgtgtgctgtgtgcatcagtgcatgccgatgcttggtctgggaggagcagcaacggcggctcggttggaaggcaagatgggccatgacgaggagacggcccatgcgtgaagaatcagtagaggaggaggcttacgtgtgttgacaggaaacggagatcgacgggcagtcggtttcgcgcaggagttcgattggtttaggatcggaaggccggctgtggttttgaagaaaaaggaaattgaggaattgagtcctattgaaaataggagttctacgcctactttgagtagggggtttttatggtataaatagagagggggcatgagccttcccgatatcgcttttcgatatcacttttgagagcaattgagttgctagtttagttagggtttcgagtttagttgagatttttgtaaggagtgctgttgttgcactttgtaaacacagagagaagcaataaagttgtcatctactttgagagttcttcgatttgtgtttcatcgggttcggcggtctaccgatgacataccgacggttcaaccggcgacaagacggcggttcgaccggcggcgtgcaagcggttcgactggcggcgtgcgagcggtccgacctgcggtggcgacaggactacgtcgagatttccatcgatttgagggtaacttttatttccgctaaaagtttttgggtttttggttttccctaccatttacccccctctggtaggcttggtttcttgtgttcgatcctacaagtagtatcagagccacatttgctctttttgatctttaccgatcttgagtttttccaatggctaaaacaatttcaaccaagccgcatgtttttgatggaattgattttcatgtttggaaagataagatggaacacttagttttttcatcgagttcttatttggattctttgtcaatgtttgctttgcccgctttaatggccacgtccaatgatcaactcgagaaaatctcagaagaggacttggctttgcttacgaacaaattttctctagctttgaataatgtgagaaacaggaagagagataatcaggtgtgtgcaagtgacattgattcggaatcggaggatgaagacgagagcaaaagcaaaggtaagcaagttgttgatctatcttttattgctcgtaatgcatgttctgatgttgatgaatctgatgatgataatgaagaaaagcttagttatgatcaattagaatatgctgcttacaaatttgctaagaaacttcaaacatattctattgtgcttgatgagaaagatcacactattgagattctaaatgctgaaattgatagattaaaatcttcgattcctgatgatgataattgtcaatcttgtgaagttttattttctaaacttaatgctttgcgagatgtcaattttgttaattgcaaaaaattggaatttgagattgaaaaatctaaaaagttggaatcttcttttgctcttggatttgctttacatgctcgtgttgttgatgagttgattttgacaaagaacgttttgaaaaaatacaaagttgctttttgtgcaagttctttagtcaatgcatcatgtgcaaataaggcaaaacaaaacaatggtgctttgatttctcaagattgttcaaagtgtgttttgaatgagttgaggttgaaagatgctttagagcgtgttaaacacatggaagagattgttaaacaagataaggtgttttcttgctcaactcgtagaaaacaaaaaggtcttttggatgcttgcaaaaattgtgctattcttactcaggaggtatcttatttgaaaagttctttgcaaaaattttctgatggtaaaaagaacctcaacataattcttgatcaatctaaagttagcacacacaatcgtggtttatgttttgatttttatgcttatcatgctagacatcctcctattgttttgggtgctgctaggagaggtgaaattttgatcgaaactgagcctaagagcactgtgtttcaatctgctgacatcatgtcttctttgaatgcatcttcttcggaatcaaatgttgtgaatgcaaaatcttatgttgttgtaaaaccatcaatttcaaaaccatctacttcacaaacttgtcgtgagaagtacacttgttcttttttggaaaagatggacatttggttggtttttgttttcgacttgcccacaaacagaaaaaggaaagataaattgcttttgcgaaacgacggtggcaaaaatcaggtttttgttcgaggagcacggttagaccgcagttgaacgggcggtcagaccggcctcagggaaactttgcacgtaattcaaatcggacttttgtgaaacgacgaggtaagttttcaggtaagtctagtactgattttgttagtgcatatgtaccttctggttctacaggtcgtgtgactcagtgttggattccaaaatttcttatttctaaccccaacacagaggcctcgacatcttctcgtacgtaggtatttttggtggcatactccccatgtgcattcaatgttgagatgacgattgcttttcatggtaacatcaatttacttttagattgacatatttttggttctactctctcgattattagcttttcatatgctagtgtttgaggtagtagtttttgttaatacaagtggttacatgtcaagtcatgagaaccttggtgatatcattggcaattggatgtaattttcaaaatctttaatttcttcttgatttttcttcggggagaattggaggttaattcgagggggagtctgtgctttttcatgcattcatgtttatttttatgcatttgctctaattctgaaaataaataaaaatgagaaaaagaagagctttgttttatacatctagtatattcttgtgcatgctagcaaaataattgatgtatatttgttactatgttagcttgtgtgtattttagtctttatatgaagcttagatattgcttttaagtgagatgatgcatgacactaattcttttacttgagttaagaaaatatgcaatattgatgctagcatatggtttgatttataaatgcttatgtatatgctttattgaattgttattcatcaaatagctttgtaattgctcattgtacaaagagaataaaaaatatgaaaaaaatgaataccgaatccttggaaacagtcttgacgacaatgacgtattcgatgtgagcaaaataatgggtgccgaatccttggaaacagtcttgacgacaagaacgtacccggaataattgagagaaaaaaatttagcaaaaaggctcaaataaaagttaaaaaattctcttgattgttttgtgctaaagctaatttgagaaagaatgataaatgcagtaggtatatatgtatagtgtttgtttttcaacctatgtgcctgtgaatatattgcattataaatcatttgaaatcatgaatctttattgttgatttgagattaattgtaatatttttgattcatgtttatactatgatgcatgcttgataactagttgatgaatttatctcctctattgtgcaacacatgatcatgaattgctttaggtacatttcaaagctctcgaaaataaaataaaataaaaattggttattacaagtgacaatcatgatatcattgcatttgtgctttattggttattatttctcttttgcattcttgatgaaatcattgtcaaagggggagaaatatacaaaattcatacttcttgaaagggggagaatcgttgaattgtttcgattttacaaatagtcgattttaaaaagggggagagtttttctttttcacttttgtgatttttgtttttatttttcaaaaacataaaattgcattttggagatgttgccaatgtgttcatcaaggggaagattgtgaaatcattgtcatgattaacatttgtgatgaacaattggctatgcaaatgatttaatcaaagaattggtttgagaatttgtgtgaatgttggtgtgagtgtgtgtgactaatgtgggtcaggttatgatatctgtgcccagaaacggttgttttgtctgattgtgggcaggggacttgaggccagccttggtcaatggtgaggaccgggactatgttcagggaggaacagaggtctagtgcggtcgggataccatgtgagaaggtgactagagtcaggattcttggaggtcaacttccgtcaacggtggggatcgggactagactcagggaggagttgaggtccagacggtcaaggataccggatgacgaagttggatacgagatggcacagggtagatggacaccgtgtaggagagatcttcgcaacgggcttcacgaggtgtgcgtgcaagcgtcggtgttcgcgaggaggaatgagagaagatagagatgttcatgtacggtggagtacatggttgctacagtactcgatgtactgtagcgtgtagtttgcatgtacgtgatgtgcatgtgtgctgtgtgcatcagtgcatgccgatgcttggtctgggaggagcagcaacggcggctcggttggaaggcaagatgggccatgacgaggagacgacccatgcgtgaagaatcagtagaggaggaggctcacgtgtgttgacaggaaacggagatcgacgggcagtcggtttcgcgcaggagttcgattggtttaggaagtccggctgtggttttgaagaaaaaggaaattgaggaattgagtcctattagaaataggagttctacatctactttgagtaggggtttttgtggtataaatagagagggagcgtgaggcttcccgatatcgcttttcgatatcgcttttgagagcaattgagttgctagtttagttagggtttcaagtttagttgagatttttgtaaggagtgctgttgttgcactttgtaaacacagagagaagtaataaagttgtcatctactttgagagttgtttgatttgtgtttcatcgggttcggcggtctaccggtgacataccgacggttcaacaggcgacaagacggcggttcaaccggcggcgtgcaagcggttcgactggcggcgtgcgagcggtccgaccggcggcggcggcgataggactacgtcgagatttccatcgatttgagggtaacttttatttccgctaaaagtttttgggtttttggttttccctgccattcaccccccctctggtatgcttggtttcttgtgttcgatcctaaaaaaaagacagaattaactaaattaatacacgctaaaatccggagaaagagcaatggccagtgttctagttattcgaggactatagatgaaaattgcttatactgattaaagaggaaaagtatggcacgaataatacacagattcgttgactgctacgagtaatttagatcacagccttgtaaaggacaactcaaaacggctacgtacttcataagcatgttttactgtcgaatattctcattagttatggaaagataagggacatcaaataaaattagagaagcccctcaactaattggctggtttttagggtaaaaaaaaactctttacgatcattcaattggtattagagttgtttacatccaaatttggcacctaggcttaaaataggaattattgccaaaatttgaaagtctaccggtttccttcgaggtaggccggtctgaccgccatgtgttaggcggtcagaccgccggttggaggccggtcagaccggcggtatgtggccggtctgaccagcaggcccgagtccgattctgttgcgtcgggtttcgaggtttccttgctcgggaaggcatgtttcgggtttcctttggtttctatcccgagttggacgtggagaagggcctgtagagggcaagaccaacccctatataagggacaaggccggttcattgcaaaaatcaatctactatcaatcaatcgaatcttccgttttgcccacgagacaggtagttatctagaaatcggctccgctagccggtttagttatcaaaacccatctaggtttagctccttgctagatcgaggtggttggcgactctagaatcaccgcaaggcttgaggtgctgcgatcgtgcttgtcaacttgtcacaaaaagttgccaacacgatttttggcgactccgctggggaagagatccgttcatcgtcaactcgacttcgacttcgccatgacgaagccatcatccaagacggaggtggagccatctcatatgataccggtcacattagatgactttgaaggtgaggatcgcaaagccatggaggagtacatcaacgagctcacacgggaggcgttgatgagagcaactactaggactcgtcaaggcgtgatcatcaagcccgggccacgtcccaagctcgctcccgacgtggtaagtaatgacgaggtatcgcaatctatcaaccaacaaattgcatctacaatagattcatctatgcctaattttaaagatagattagatgtaatgtttaaggaaagggttgatgggtttttaaggaataggctaggttctcttatggatgattacatattaaaggataaagcctataccactgctaatcaacatcctatagatctaatagggtctaaaaccgacggagcggcgttcatggccggtccgaccgggcctgacggccggtcagaccgcgacacagctgtcggtccgaccggccagatggccggtcagaccgggtgttatcccaccggtcagaccggctttcaggccggtccgaccgcgcaacctgacgccggtcagaccgggccctgggccggtcagactggcgcaattgtcccgatacagggaattgatccaacgaccaatgctagttatttgtatcactttagaacatttgatcctcctgtatctactgttaccactaatcctcaaattcccccacatattcctaacgtttataatgatgtttctaggggatatcctcccaatactaggcaaggccaatataatcatattgcgccacaaactcaacctattaggccaccaaacccaccaccaaatccacaagggcctaataacatggaggatgtgattagtgatattatgaggaatagattcaggattgaaactaggaatcgtgctagagcttacaaaaagctatatcccgattattataataatgtgccgtttcctagaaattatagagttcccgaatttgccaagtttagtggtgaggatggtaagaccacatgggaacatgtaggtcaatttttagcgcaatgtggtgaggctaatactgatacttttaaattgcgcttattttctttatctttatccggtaatgcttttacatggtttacttctttaccggcaaattctattcatacttgggctcaattagaagagcaatttcatgattatttctatactggagaaactgagtttaggttatgtgatttaacatcggttaagtaaaagtataatgaatctgttgttgattatattaagaggttaagagatgttagaaaccgatgttatactttgaatataactgatagagatttggccgggctttcttttaatggtttagttgctcctcttagagagaaactagatggccaacaatttcttgatgttagtcaacttatgcaaagggctctggttcaagaaagctgggttaaagataaaaaatttgctagaccattcgacaaaaagcctaatgttaatgtagttgattactctgatgctagtgatagtgaggaagagggtgatcatgatatttatgttgccgaatggtcatggactaacaaaaataaaccttttgtttgttctaacttaatgccgactcctcgtaaagatcggcaaagtgaggttaagtatagttttgatgtagccaagtgtgataagatttttgattatcttttgcaagaaaagcaaattagatttcttaaaggccatgtcataccatcacaagaagagttgaaacgtcgagcatattgtaaatggcatgattctcattctcactctactaatgattgcaatgtgtttcgacgaaaggttcaatcggccatagatgagggacgattgaaattcaccgatggctctaagatgaagcttgaccatgatccttttccggtgaatacaattaatttcaataataagaaggtgttgattcggtcggagcaatccgaatctactaaaggaaaggaagtggtcattggtgagccaagacctaagatgatggtgccaaagaagccggaagttggtgtttggaaggaaaataagggtgaagcttcaacttctaaggcccctaggaagaccaaggtgacttttgatatgcttttggaaaagtatgagaagcaaggtggtgagaagattcgcaacaaagggaaaagaccaagatcaccccctagggagcgatttggtcattcaccaagacgatcgcattcaccttcatatcatcatccacaagacatgtcatggggtccatatccaatggcgccgccgggttatccttatccttacttcatgccatgggggcaacgccgccaatgtacaatcatatgccgccaatgagatgcaaccaagggtggggaggaccacggaggccaattcatgagcgtttgtcttcatcaaacaaaagtcgattttatggtaaaaatcgggttaatgaagagaagagggaaggaaagcgcgtcaagatagaagagaggacttcagaggtgattactatcaaaatagggtcccatgatgtgcctgtaccttctggagatggagttggaaagtccccaagcaaaaaatccgaagccggtaccagctcttcgcagtcggccggtctgaccaggcctccaggctggtctgaccgcagccatgcggtcggtctgaccgggccatcaggccggtctgaccgccaaccagacagcggtccgaccgaggcttcaggccggtctgaccgtgtacccgctgtcggtctgaccggcgcgtctggccggtctgaccggtggtctgcgaccggtctgaccgggctccagcgccagtttgataagagggctgcaaagggtgatgtgggggctccatcgtcttcaaataaggttaatagaggacattatttacctcctggaacagagccgaatcctaggtggatgcctaaggatttgacggctactcaaaagaaaaggttgcaacgtcttcgggcccaagaactaagggagaaaagggccgaagaacaaagagataaaatgttcaatgagttgcgaccaccaccagtatggaggcctaaatccatagagaaggcaaaaccgattgatgtagaggagaaggaagaacaatcggttgacaaagataaatcgtctccaaaggaagacatagatatcaacatggtgtgtatgttgcctatggagttttgtgctatggatgaagccgaagttgcccaattctcattaggtcctaaagacgcggtttttgagaagcccgatgagtcaaaccgtcacatgaagcctctttatctcaaaggccatgttgatgggaaaccggtctctaggatgctagtggatggaggtgccgccgtgaacttgatgccgtattcgctattcaagaagttggggcgtaaggatgatgagttgaagaagaccaacatgatcctcaatggcttcaatggtgaaccaacggaggcgaggggtatcttttcggcggagctcaccgtgggaaacaagacgctaccaaccgctttcttcatcgtcgatgtgcaaggtaactacaatgttattttgggtcgttgttggattcatgcaaattgttgtgtgccttctaccttgcatcaatgtttaatccaatgggacggcgatgatgttgaaattgttcaagcggatacatcggccgaggttgcaatggccgatgctacttttgagtggcgtcatgggaatatccaatgcttatcggggagggatctttctagctatgattttattagtatctccgatggcaaatttgtacctatctctgtaaagccggctagtgtagcacggctaagccatataaatttgtataacgagtaaataggctagtttagagtggttacaaaagagggtgcaagaatatcggtctacaaagaacgatattggagaaaccgttgaagattttgatgaagttgagaagcttggacaagggtttacatcggccgatccattagaggaagtagacataggtgatggaactaaaccaaggccgacttttgtaaacaaaaacattaaagccgattataaggttaaggtaatcgagctacttaaagagtatgttgattgctttgcatgggaataccatgagatgccgggtctcagccgtgagcttgttgagcatcggcttccaattaaaccgggttttaggccttataaacaaccacctcatcgttttaatcctttattatatgaccgagtcaaagaggagattgatcggttgttgaaggcggggtttattaggctatgtcgttatgcggagtgggtttctagcatagttccggtggaaaagaaggggagtggtaagattagagtttgcatagattttagagatttaaataaagctactcgtaaagatgagtatcctatgtctatagccgacatgatgattaatgatgcctcgggtcataaggtgattagttttttagatggtaatgccggctacaatcaaatctttatggcggaagaggatatgtacaagacggcttttaggtgcccggggtttgttggtttgtttgagtgggttgtcatgacttttgggttgaagaatgccggtgcaacatatcaaagggcagtgaatttgatctttcatgatttgctaggtattatcttaaaaatttatattgatgatattgttgtcaaatcggatggtatggaaggccatatagccgatttgagattagcttttgagaggatgcgccggtatggtttgaagatgaacccacttaaatgtgcttttggtgtgtcggcggggaagttcttaggatttatggtgcatgagagaggagttgagattgatcctaagaagatagaaaaaattcgtgatttcaaagcgccgacatgcaagaaagaagtccaaaagttgctaggtaaggtgaattttttgaggaggtttattactaacctagcgggtaaaatcgatgcttttgttcctatacttcgcttgaaaaaagaagccgattttacttggggggcaaaacaacaagaggcgtttgaagagttgaaaagatacttgtctactccacccgttgtgtgagcgcctaaagccggaaagccttttcggttatatattgcctccgaagacaaagtcattggtgccgttttgacgcaagaggaagatggcaaggaatatatcattacatatttgagccgccgtcttttggatgccgaaacgaggtatgtttttatagagagactttgtctatgcttatactatgcttgtaccaaattgatgtattatttgttatgtagtacatacatagttacttgtcaagccgatgttattaaacacatgttgcaaaggccaattctaagtgggagaattggcaagtgggcatatgctttgatagaatatgatttggcttatgaaccattgaaaactataaaaggccaaattgtatgtgattttatagtggaccatcatatagatgttgcttatgagggagaggtttgcttagttgaagttataccttggaagatttattttgatggttcttcttgcaaagaaggtcaaggcataggggtagttttgatttcacctaatggcatgtgttatgaggcatcggttcgtttggaatattattgcacaaataatcaagccgaatacaatgctttattgttcggcttacaagtaatggagatgattggagctaaatatgtggaggcctttggtgattcggaattggtggtgcaacaagtcgccgggatctacaagtgcttggatggatcactaaataggtatctcgattcatgtttagatattattgccaattttgataattttgctattagacatattgctaggtgtgataattctagagcaaatgacttggcacaacaagcatctggttataatgtaaagagggggttatttctgatattagaagagccggtgcttgattttaaatttttgtgcgaaattggcaaagttggggaccagaggcggtctggccggcgttgcacggccggtctgaccggtgaccaggggcggtctgaccggctgcatgccgccggtctgaccggcgtccccgagcagtctgaccggccctgtgtggccggtctgaccggttctaggcaggatgctggggacacgtttcaagtaattttgaggccgaattaattgtgaattcggatatttgtgcccaggatacagaagaggattggagaattcctttgattcaatatttgaaagatcccacacttaaggttgatcgaaagattcggcgacaagcattcaaatatacattgcttgatggagatttgtatcgccgaaacatagatggtgtcttgttgaagtgcttagatgaagatcaatctaaagtggctatgggagaagtacatgaaggaatttgtggaactcattaatcggcccacaagatgaattggttgcttagaagagcggggttttattggccaaggatgattgatgattgcttcaaatattatagaggatgcgaggcttgtcaacagttcggcaatgttcaattggcgcccgccgccgtgttgaaccctataatcaaaccatggccgttctagggatgggctttggatttcattggtcaaatttatccttcgtcatcaaaagggcataggttcgtgctagtcgctacggattacttcaccaagtgggccgaagccgtgcctttgaagaatatgactcataaggaggtaattgactttatttcgaagcatattattcatagattcggtattccgcaaacattaactacggaccaaggcgcttcttttatgtctaaggaagtaaagagttttaccgaatcttatggcattaaattattgagttcttctccttactacgctcaggctaatggacaagccgagtcgagtaataagacattgttaaagctagtaaaaaagaagattgaggaacacccgaagaggtggcatgaggtgctttccgaagcattgtgggcgcataggatatctaaacatggtgcccctaaagtcactccttttgagttggtttatggtcaagaagccgttttaccggtagaggtaaatcttggttctcttcgttatatcaagcaagatgatttgtcaagtgaagattacaagacgttgatgggaggcaaccttgatgaagtcatcgacaaacgcttcaaggcattaaaagagatagagaaagagaagaagagggtggccaaggcgtacaacaagagggtgaaggcaaaattgtttccagttggagacttggtttggaagacaattttgcctttgggtactcgatccaaggagttcggtaagtggtctcctagttgggaaggtccttatcgagtttgcggcattgttcgagggaacgtatactttttggagacactacaaggggagcgttttcagcgagcaatcaatgggaaatacttgaagaaatactttccgagtgtttggcaagacgcttaggaagaactatggccggtaattggattatcgtcctaagatcaaaaacatgttctatgcttttagattcacgtcgttcatcaaaaaggcagggggcatatgtttacacctaaatttggcacctaggcttaaaatatgaattattgccaaaatttggaagtctaccggtttccttcgaggtaggccggtctgaccgccgtgtgttgggcggtcagaccgccggttggaggccggtcagacc

SEQ ID NO: 73856 - DNA, 5569 bp, Oryza sativa
ttgttcttatcctcatctccgatactgatataaccaaatttggttgttaacacccgcccgctgcttctcctttttattgtcattgagattttaaaaatcaaatatgattatcaatggggtttatttttttactttctagaagtcccggccaccgccttgttcatttgcttcacggcctgcttatcgtccctccttttaatcgtcattacgattctatttggtgttttattaacagtttttatatgtcgtatcaaccgccaccactctactcctttatagttatgttgcttaatttatctcgtcatgtgttttagatggtcttttctttcagtagtctttatgtttatcaaaaattttagttatttataaattgtattcctaattgaaatcttatttttctttttctaatttcagaatttattttttcaaattttaattaatatcgtattgtgttcttttaatattcttattttttattttcaatttcatttgttttaaaattgtatttctacttgaactctcttttagtttttctaattttggatactattttatttttattttaaattttaattaatctcgtattgggttcttatatggattcttcttttaatattgctttttttaattcttaatttcagctaattttaaattgtattcctacttgaactcttattttattttcttttgctaatttcggatttatttatttttattccgaattttaattaatctcgtattggactcttattttaatatttcttattttttaattccgaatttcagttatttttaaattgtattcctacttggactctcatttccttttctaattttgtattttattttatttttatttcaaattttgattaatctcgtattgggttcttatatagaaacttatttcaatattccttatttttaattccgaatttcagctatttttaaattgtatttctacttggactctcctttcctttgctaattttggattttattttatttttattttgaattttgattaatctcatattgggttcttatatggaaacttctcccaatattgcttatttttaattccgaatttcagctatttttatattgtacttctacttggactctcctttttctttttttttctttttctccgattaatgtgggaatttctaccccccacagcgaatgtggtacctcctttcaaagctgttttaataatataactagctgggtggcccgcgcaattgcgcggctaagcacctaaacacaattataaattttttggtataattttgcttaaaatttattaaatagctatcttgttgtcgtaagactttaaaagaccaaatcttatcatctccgtatttccaactatatattaaaatttattaaatagctatcttgttgtcataggactttgaaagaccaaatcttatcatctccgtatttccaactatatagttcttaaaagtcagaccagctgctacctcttacttctgtcatatccttctttatttgcttagatctaccactatttctattcattctccttgaaacctttaaaaattggatcttatagtttcgtttttataatttctagaagtcccgtcaaacgctgtcattatgctcttctacggtccgtccactgtcttttctctttattgtcattggaattttaaaaatcaaacataattactgttcgggttcatttttttactttctagaagtcccaccaaactgtcaggggctttgctattgtactcctctatggctcgtccgctgcctcccttctttattgtcattgagattttaaaatcgaccatgattatcattgtttttttactttttagaagttacgaaccttaaaaattggtagtttttagagcttattgtcttattgggtttcattttttatagtttttaaaagtcccatcaaacgatgccactatactcctcgaaggcccatctgccgcctactctttattgccattgggattctaaaaatcgaacaaaactatcgttagaatttactttttattttctagaagtcccaccaaccattggcagctctgtaactatactcatatacaccccgcccgctgcttctcctttttattgtcattgaaaatttaaaaatcgaatatggtatcaatcgggtttatttttttactttctagaagtcccggcaaccgccttgcctatttgcttcacggcctgcctatcgtccctccttttaatcatcattaggattcgatttggtgttttattaacagtttttatatgtcgtattaactgccaccactctactcctttgtaggcctgctacttaatttatctcgtcaaatgttttagatggtcttatacatgcatagatcatactggcgaagatattgtaccttaaattttatttgccatgtcttataaaatacgaatatgtttaggccagggtgaccgacgggggtggagcaggatcgagcgctccccccctccccgtgcgcacgttccctggccccaccacgtgtctcaaaaaaatatttcacctggtgtactcataatgttttactatctatagatttaatgttgcagtgaattaaaatattattttgtaacaaatcacccacatattttggaaaccctctattaagaaaagtcgtttcatttatttgttccactaaaaatgtttcacctagtgtactcacaatgtttcactacgtatagatctaatgttgcagtaaacaaaacttcttttgcaacaaatcacccacatattttgaaaattctctattaagggaatttgtttttttgttccacaaaaaatgttccaccaagtgtactcacaatgtttcactatgtatagatctaatgttacagtgaactgaaacattcttccgctatttgctaaaatattgtttttatataaggtgaaataacgccggatttgataataagctaaaaaaatttcgtcggaatatatccatgtgtggtcttgttttgaatatttaattgcaacgaatttaatggtgtaatcggatcatgatttggataaataatttaagagaaaaaagagtttaaagtggttttgcacgcatgcatggctctgacgttatgctgacgttagcgtccgattttttcacgcttggatggggcgcccgatcggtagtctcatcctataaaataatgtatatctatgttgatttcttcgtagcatacttgctttgcttctagatcgattgtgggctatctccgcccaatgtctctgctatcttggcatgtgcatacggcatgacatgcatgcagtgttctccctctttactatcaatggccatatatatatggcacgtatattttccagccacatatgaaacgtggatcactatagttcaatttgcactctaattaccatctaaacatagattaatgtaatttgtctgattactgtccataagaccatagcatccatactcagacaacctgtccgactcctaatcaatcaacatgtccgacttctattcattcaacatgtccgactcccatatttcctattagatcaaagttgctttctatttagactcaatattgtcatgaataatctacaccactaaaatctagtacaactacgatttaacggtgtaaatatttatccttttatccgattaatgtgggaatttctaacccccacagcgaacgtggtgccttctttcaaggctgttttaataatataatagataatagatttggaactttcagccagtagaccatccaaccagtaaccatcataaacccaaaatttttggtccgaaattgtgaatccttgttatacttagagatgcaggatcacaattcacatcaaggtgatataatagcacctggcgagaggctggtgatgaatcagaggcctctgatcatctgctgcatccattatggcctcactgctaaagcctacaatcttaatattttggtacgtaaaccaacaatgctaagtaactcgtgacgaaggaattacacacatcccgatgtacttgtcaagcatctcctataatcatcgttctcaaagctctaaatggtactaagaaagcacctttgttgtacatgttatggagggcgtggtatgtccgaaatgaccagattcatagcaaaaggcatggcaaaaaacctgggtctgtagcctttcttgtcgattatgaaaacacattgttgccgatccgacaactaatgatgacaaagggaaatgaaagatgtatgttgaacaaactgagaatgtagggcatggtatctctgaaatgatcagattcatatcaaaggcatgaccaaaatcagcttgtgcagaatgagaaatggcaatgccaccagaaggacatgcgaaggttaacatggatgtcactttcaagaaagaaactagtgaatcaagtggtggaattaattatcgtgagagatagcaggggtctggtgttgctggcaactagcccttgcaattatgcagctctgtggtgctggctgaggcactagcctgcttagagtgactccgggtggcaatggaatggattcatacgccgcagcttctccacgccccctttgtcggttcaggcatgcagctcatgttgcgccagccatgaaaatgatggtcttgttcttagcgtctgatgagctcgcagacgccgtattcgtgaatcgtgatggagtaggcagccatggaggtgaggcagggcaaagctagggcacacaacgagagacgggggcgatgtcattggaagtgttggcacgtgctttgctcaaccaagagcgtgggggcagcagccaacctttggcctcgtacattacatcaactagatgatgccccgcgctttgctgcgggatatatgttagataatggagaaataatgaaatgatttggattgaaatattatgaaaatgatttgagaatgatgatctagcatgtgtatgtttagttttagaatgaagtaatttgttgggctttgtgtgcttaatgggttgatgcagcatgcttgaatttaggttttataagtgctaataaatacaatgcttccatgttgagctttaggtgtttataattagtaggcattagcttcatagaaagaagaggttagaaatttacatggatgccacaaatctattttccagatatacccttgtactacacctactacaccaactttcagctctagtagaaataatctaatggatggctcatccaagggtactttacaaaatccaataatttagtttcctcaacagcagtagtcctctggtcatccatctacagaacatcatctaactatatcatataaccaagattaattatccactcctaccaaaaagcgagagattaacttattcactgacaagcaggccgaggcattagataggagcaggtcgttgtctccatttccccatctgtgttaaaagcaattgaaatcccctactaatccccatcacgaccatctccaccaaatctgccccaaatccaaatggaagaattagaattcgtcacctctccagccacttcgcttactttgaacagtagcagcagcagcgcagagaaaaataaaaaatc

SEQ ID NO: 73857 - DNA, 24525 bp, Oryza sativa
ttttccttttgccaactcttcttttctcttggctttgtgaatctatcacgagcgtgactgcttttattgaatgtgtgcgtccaattgtttgtactctgtaaagaaagatagtatccctctacattatctaattcctttaaaattgggtctgtttgaggaaattttgacagctatagcttttctcagaatcagaagtttttttcaaacagtttaactttttattcagattctgagatgctacaagctagaagctaagtttaccaactagttgttttttaagaatattaaactccctcaaataatccctttatttccttggagctatcgaaaggtactactaatattctccatgttttggaatcatacatggttctattgtgcatctctgtatttttttttctattcccgtgttcgcaaaatcatgtgttaaaaagtagcacttgcattgaattctaccatcctcttagttatcttacgttcataaatcgatctcttcaatttttgttgcctactcccatcccaaaatgtgcaatttttaggttggtacggatattaagaaagtagattggaataattggaggaagtatatgattggttgagaagagaaattaggtgaaagaaaatggttgtgattggttgaggggagaagataggtgaaaaaaaaactttattttagatttattttggaataaggtattgtgttagaaatatctacattttaaaacatagacaatatctgctcactaataactgtttccctgagcattttaggacttccatttagaacaaaggaaatatgaaagaattttggattggtcccaaaagtttcgtatgaaaaatcttatgaaatgagccattacattggaattttggagaaaaacaaacatgatggatgtgtttgttatagctactttgctaagctctcaccaacacgcaaaccgctgtggataattagcataaaattaattaagtattaactaataaacctgaaaacagatttatttatttctttaaaacaacttcgatattttttttaaaaaaatattcaacaattaaaaagcgtgctgatattaaatgagagcagctccttcaaatcccaaaaccgagcgcatgtttgctccagaccatgagttgagtcagtagctaatccaaaagaaaaagaaaagatcttcatattcttatcagctaatcaggatactccctagtcactagctgcttctagattcattcaccagctggccaacgccctcgaactgggcctttagattcgaaccatgaaaacgggtacgagaaagataagacgatgcatcacaacacataaggaaaaagactaacagactttgtaacttatgatcagtacaaatcagagacatgttgagagttacagcacgccaacaaacatttctacagagttacaaacttcagaagctaatagagcagcatacacggtacaactgaagacaaccacaaaacacaaaccaggttagttcttgcacccaaagcggttcaagattttttttttttgttagctaccctcttttgtcatgtggtcacctggagcaagtcatttccagagcttgacaaacctatcatggcttactgaggcaaccttgcctgttgcgctcgatgctgctagcgctgcaactaaaccatcatgagcactgtggaccgtcatggcgttcttctccctaatgtcccagagttccaaagactgcacgacataaataaacaaacgtacactattaatcaaatgcactcacaaaataactgaactatgccaaacaagataagagacttgcctcgtagcatccaattactagcaaatatgggtaagaggggtgaaaaacgcatgactggaacttgttcccgctgcaactcaactcattcacaaattcaccgtcatgtccaggagcaaacgaccatattctgacactatcttcactgacagaagccagattgtcaccggtagaatcccaacaaagtgagtgaatattctttgtgtgcccctacagagtacagataccaataaaactttcaatggaacttgaacctaaagatacttgcaattgccataataaaaatattgtcatataaagcaagtcatatcaatcgagcaatgatctctaacatgtaactatttatattggagtaggtatatagcaaagaaggcattaatctgagtgcacagaagtacagaacagggctcaatcttgcagcttatatatacatcttattatgggaattgccattgtgggtttcttctgcaatactcctaccaggccagacagaaaaaccaatggaaatttgtccaaaagtaaactaaattatacctcaaacctaaagaaatttcattatcataaaacctactcatgaaatttttgcaagagttttcccccaaaatttagaactaagaaccaaaggatttgtaaatcaaatgtaatgggcttaaaaaaaaatccagaactgctaaaaaatcaaggatataagaatattcattggtttaatcacttttctgaacatccaagtcctaacaaacctatttatgatgcactgtaccaagtgaatgatcaagaatggcaaccacaatttggtacgagtaactagtggtagtggcggaggcatggtgccgcataaacagcaatgcagttaattacaagggctaagtgaatgcttccttatacacattctgaatgggtaaatgctaacagacctgcagagggtttctacaagcaagttgtgtctctccatcaagtatgtagatggccttctctgaggcagctgcaagatattttcccttttgaggttgaaatcgcatctgagtagcacctccctgttgggacaaaaatgattggaaacagagacaagcatcagaagttgaatgttaaagcagaagataccatgaaacacatgaagttgcattgcataccttaaagaccttaacaaaggtcaggcagctaccattatttatgctccagctgcggacttcaccatcaccatcacaggagcaaatcatatcttctttgttcggatggaagtcaagtgacataacagatgctgaatgacccgtgaaagtacggagtgaataacttgtctgcacataatcaaatgattagtcactacatggttttaggttatggaacatcttgcaatcactatcgcaatagtttttttttgaattgatatcacaataagctattagcaccctaataggataactttgcaataaaatataggaaaatgtccattttacaaaattgaactcaagaaaaaagtcttgaaatgatcacctcaaactacaacactagacattttctagctcaaacatccaaacagtttgctttacagttgtccggttgggtttgtagttgatggttgattcccaaacttaaaagttcaatgttgtaaagtggagcttttttttttcttaaaaatatatatggtgaaaaggagtatacattgtcagcatcccaaacccgcacggttttgtcaaaggaagatgtagcaagccgtgacatgcttggactaaatcgaacatccgtaatcaatgccgaatgttcttctaatgaagatgtaggctttagagcaggctctgtacaccataaaagaacctgcgcagagtaagaggcatgcgttaaagattttcatgcactaagaaatcaaaatatattgtgttaacaactgcacctttttatcatgtccaccagtagcgagcagtttgccatcagaggagaagtgacaacaggtaactttggttgcacttgcacgtgccttcgcaacttcagcaaaaccaaaccctgtataaacagatcaatcaagtgcgatcaagcagaagcttcatcatatggccaagagaaacaataagtaaaatcacccatatcatcttgattatgatctgttatggagacatttcttatttaatgtgtaatcagatgtgatgatagatatttaaaatgtaacagtggcaagcatgttttgccttctcaaaggcctgtggtggcaagataaaaaatgcagattattagtgagactatgttcatttatttatgactcctgttgattgcatacagcagccaggtatcagcaggatattaaaatacctttactagcatccatggagcgccccaatgaatccctagggtccatgtcatcctgagatagaaaagattcaacattttcatccaatgaaccatcttctagcaaacgatccacgtcagcctgaaattgaaaactttctgtggtcatgttgttaaatacaaatgaaaaacaagaataaaatttgggggttttaaggatatataacaatactaactgatgccctcagttattgcccgaatccagagaacaatctccaactctgaaaactattcacatttcaccctccacctcaaactatcgaaaccgttcactatgttggcagtcaaatcactaattctagtcaagtctatatagtatattgaatctctttgaatgagtaatcacttactcttgatacatatcttgtattgaatctctttggatggatggatgagattagaattagtgaagagtaaaaagttctttttcttggaacacagggcacagtccatattcgtagtactaggttactatattttaggacagatggagtaagcgagtagcactaagcaatttatttttattttcttaatgtggaaattctagtcaacactatagtgttaatggaaatctgataatcctaatgactaggatgagtgataagggatggagtgaaactaaaagaaaaactaagatttttaggaggggtgctgacatactgatatggtcaagacaatacctaagtatgggttacgcacatgctttgacacaggtcccacaccacaaaaaaccaatgtggtttaaggggaggacgtgtttccattggttttaatagttgagggacgaaagatgataggtcaatgttcaaggaggttttctgaatctaaattgtactcgaatggtcaagaatggagttgttccaaagaaaatatgtccataccagtgcatttgctggagacgtcaaacttccagcaccatcagagccaaacattaccaatggttttgcggaaccaccattctgctgcagctgtggcatagacattgcatctcctggtgtatgagtggaaggcgttgatggtgcagaacttggagaagggccagcagtatttgcagttcctgaactattggctctaccagaggatgaaccaggtttcttcctcttctttgtagtctggacaacaaacagcacagtttatgtgactcaatgactgtggtcaagttaatatttactcttcatattatcttaaacagtggcaagcgttttgaattcctttttgacgaaaggtgaaagaacatcagtagcagcaagggatatggtgactctgtcggcaggaaaaactacacaacaacataatttctgtgccaaaggacaatcaatttcagaccaatataatcaaagaatgcacaaatcacttagctccacagccttatatagtagattcatttccagtgattacagtaaagcacaaagcaatcagctgagtcattgaacaaggcttgagtttaaaactgaaactagcacacgatacatttcatggcaatttttgtatcacgtagaaatactataattatatataatatatatcaggatagaaacaaaaaagcagttagattccacaaaactgacagtgatcaattcagaccacaacgaacagtagtatattaggtctaagcattaatgcaaatggagcatggcaagcatggatgtgtacagataagaattatacttgatcaactccaccgaaagagtttggcatgcccccatcaacaggcatagttccgattcctggtttttcttgttggagaaactgatttgagctttgagactgctgactggagacagcaggctgctgaagctgtggatgctgctggctgttgctttgctgctgtaataattgttgctgctgagcaattttcttctactacgcagaaaaatccatataagaacatggaacatacaaaagagagaaaaataacgcataggaaggtgtccatagaatgagaacgatggaatcattacagtaatctaggtcaacttatatgcataaggtaagcatacagaaaagagcagaaatgtaacaaatactaaatgataaataaaccatcaattccatattagaaaacatagaacatagatattaggaaaattgatggatacaaggtaaatttgagttatcttctcaaaaatcgaacaggcagcattgtacttatctctgtaaagaactacaggtctagtataacagaaaaatggaagagagctgctaatccacattcagcaagaaattaagaaagcacaacatgcagtaactgcaaaacctagaaagtaaatctaaacaaacaaaagcttttacaccagtttaatggtggaataacacttgtaaggatgaaaaatcaaaagatatacctttatcaggatatctacatctccaccacttagactaggagaaccaatatttggaataatatcaccaccactgtttgtctgcccaacattcctgttgttaagcatcatccttaatcgtctgctgtcaacatcactagatgttggggaagccatattttgctgagcctgcaacataagctgctgctgctgttgcggggtaagaaaatgaatctgctgttgtaattgctgttgattctgcacaaatgacttctgctgcagaagtccagagcgaagttgttcaagtccctgtgaaaacaaaaagaaaaaaaatggcacatgaaaataagcaccgagagatagcatatgcagtcaattaataatagataccaatcacagtcgtttaccactatattggaaaataaaattgcaagttggtcccataattgctaccaatgatattaatgctggcatatattaccaatacacaaactgccacaaattaattacgtatatgcagaggaatagacccaaaaagaaggatggatttaaagttttaaatataagatgaatcagtaaggcaagtgtgaaatttgttgaaagatggtcaataaaataaaagtttcttggaattaggcgcttgccaatggcatttcttggattttctcataaaataaactgagaactacaattgcactatgcaaatggacagtgcaaacaaaacaaaaacaacacaggaaaacttataagcttatcttgctcagtagaagtgctacaagacagtctatgccattaataaactagagaaagcatgaacacccaagggagaaaagaccgctgcatttcctctctataggggagttaaacctaggcgcagtctattgcaggagcattaatcataaggaaaatgcataaaatctgtatttaagccaggcaatctatatagaaaccattcatgtccaagactaaagttactacttgatcataaactaaaccttaccgtgagtggccatcctttcagagtcaaattgtttccagcttgattagaccctgttaaaaatacatctgattaaggtatgcataacataaaaaagatcatgttccaaggtcctataattttacagcaaggctaataaactcttcaagattgaactaagaaaaaaaattacaagaaaagtaattccagggactatactgaaaacatgttaccttggacaccaataaatgacccctcaggacctgctgaccttggtgtcaaaatgggattcatctctgtcttgatactctgctaataatatgaataatattaggaatacatgttgacatttattctttttgtcctcctcgccttggaggtaagcatgttaggaattagagatacatgacagatcagaataaacagaagactaacctgagctggcccaggaatctgtggactcctggactgaacttgttgcagactgcctgacagaccaccaacagtaccatgcaaaatttgcctacaaaggaaagaagtaaactatctgagaaaagttacctcttgcagcgcatgtatattatggtcaatataaaacatggtgatgttcaataggcatctacattccattaaataagcaataaaatatgggaatgagatgacacttcagtatattttgttttggacacatcatttttcaaaacataactaaatgatttatatctacacaagtaattaagaaccaaaattaagagccaaaacaatgcatgcatgtaaaaaaaacagcaaaatgcagaagcagcaattccaagcataaataagaataacaaatagaagtgtgtctaatttatctccataactaaccaaatgactaaaaagaaaagttcaaaataaaataatatttttcgaccaacagatagacaactctgtgaatttcgataccagaagtactaagtgtagtgtggattagattacagtgaagctgtaacacgaatggtgaaatatcagctacaactgtacacggtataaagcttgttaaagtaattatatacttaattcacaaattcagcaggtaccctgaagattgtccacttgcagatgctttcaacaacgcttcgtttgaatcaagtagttgtccagcattctctccatatctttgctgaaaccaaagttcacgtgttatgataatattaaccacaaaatgaacatattggtgaggtgaggaatctatagaaacaacatcaatcaatgattatagataacagtcaaccttaattgacacctcgtccaaaccatctctctgggaaggcaactttaacctctcctcatacatttttgttgccataacatttgcagtactctggttttgccgcattaaaggattgtttccaggaagtccacttgcagtaccattaagaagatgagtaccatctctgcgctgttgttgttgctgctgctgctgctgttgctgctgttgctgctgctgctgttgctgctgctgttgttgctgctgctgctgtgctgctctttgtagcaacatttgttgcatttgtatatgctgtggttgctgttgtcgctgttgaggaggttgctgctgctgctgctgttgttgctccctggctttcatgtgctgagtctgaaagagtggtgagttgaagctgagttagaactgtcaattcagggaaaaagatctcttcaagttcatactaccataactaaagatgcaaatcagacaatttggaatatttatcgcacttgattacagcattagtaaaatatgctcccaggaaaaaaattgaatagcctacaatgtaaaaccgaaacaaaatataagttacaatggaattacctgcttgtggtggatctgacatacatataacacaagcagttgaatcataaagcaacaaacaaacagaaagaatcactaaccaatcaaaaggcagttattgacaaggtaaaatcagaaaggctcagtatctcacgcaaaatgagtcgagtcattagcgcaactaatcgagtattaattattattataaacttgaaaaatgtttttttttattttttttttgaaaacttctatatagaattttttttttgcataaaatgcactgtttggcagttcgggaagcgtgctaatgggaaacgagggagttgccatttcaatatgcagaaacaaactgagcgtaatgctttacaattcaagctgaacttatttgaaaacgccagcatggcaaactaaaatgcctgaaacattaaatatgtccataaaaagataattagatgcacagacacttacttcaatatatgaagccgcaacatctgaatgcttctcatttgtccttgctatgaaaatatcccaaaaaactgaccaccactcaaaaagaaaaccaccaggagcatcaatcgctgcaagaaacaagagttcagaaagttcgcgacatcctttactaacaaaaggtaaaaaattgtagcaaaactcatgacacaaatagcttcactcaacttgctgggaaatacataccaactggatccgaagagaccttcccttctgcttggaaggcctttgcagttgcctgcagatttctcttcataaagtagtcatatatgtagacatccagcctatttcagcaagcagtcgaacatttaggttggaggttagaaaattgccaaacatacaactcttttatccaagtacaagacaacgaaggatgttcaagcagagcggtgaataagaaactagtaggcgtagaaagaattataataaaaatgacaggaaaatagctggaaaagtgaacatattcaatggcccatctatctacatcaatgtacatccattttttcccttctagtttctcaataaatcaattagcatgctgccaacttcctctgcccattctgctataactgccctcatcttctctgtctccagtcactctgcccccagcttccctgctgcttctctccgcccccagcacaactatggctaccaccactactctgctttgccattaacttccattgccctcaatcctcccatgcagactcgtctctacctctaacgtggcctactctccttccatcccacaaatccactagattgccaccaatttcctggtgctagccatcccatcgtcctgagctctgcttcctccaccagctctgctcgctatcagccatgttgctctgcttcagcaacccacgtccgccaagctgtcacccaactctccgcttcctgcccctgttccaccagcttggactgctctagcccctcaaaccactgctgcagctgagggtacttgactcactgactggaggattcgcttctacttagctgacttcgccgcctaccactgctccagtttccatcttcgtgatattaccacattgtagaaccccacctccggcatggcaaaaggacaataaacctgcctctctcattgccacattgatgcacttttgtgctcgttcacctccctagctactttatggtaacctcgtttattcagcaaattacggactatttgtagtacgaacaccaacattccaccttcagaccgtggcagagtcgcttctttatattcaagagcagtggttcagttcctttggcacccgatgagctcttctccaggacttaccacttatgttttgactcctattgatggacacaaatccagcattgtcaagatatcagggaggaatagctgacagcttgttcgagctgtgtcacgatgagggttttagtgttatgaccacacgtcaggcccatggggcaggttaggcaggacaaattaggaatagatcaaacaaagctaagagattatctaattaggaaagattagagattagagatagagaacgaattagtttttataatatcaaagataagttccttggatgccaagtcagtcttccctatatggtatagagagggacgtcactaccgagcaacgggggtgctcaaaatcctgctgcctgctagcacagtgatgacgtggacatcaccagaatgtaacacgtcagtgcaaaactgtgaggtggcttcaagtggggaggtcttaatatatccgatataaaaggactcgtataccccattataattaagaaataaggaaatataatattaggtctggcttgataagagactcctggtgattgggccaagctcagcgatctcgcctttatccctgtctttcgatccttacaccatccatgaatcaacatcagttatattttgaaagaagcatttagagtgaccaatttccaattgaccaacactaaaatgaggcttcctagttattacttgtctatgcaaacataatgcttatatattacttaatcagtgaaagtatagcctagttaccagaagaatgggatatttccactcctcttcaaattcttatacagatcaaactgcaccgctttgatctaatctaacttgtagtagcataccagaactgctctatcaaatcatttcatccatgtctaagcgaaatcaagttattctctaagtactccctatcatactgtcagtaagtaaaccgatgtaggaggctaatccaggattccacagatcctgaaaaaactaatcaccgccaaacaaatcccgctcctctcttctcacgatcactatagctcaaataatacagtcgaatattcaaaacctactggcagaaatcatgttatcttattttcccaccggtattccaaatcgtacagagaagctagttatactgtatccagaacacagtcccgcaaaccaaaacagtgggttcgtccaataaacaaacaaagttcaaaggaaatccaccccccaaaaaaaagaaaaacaacatcgcccgcgaaaccctagcggccaaacacgccgcaacaacccttctcccacctagagcacaaggccggaaccggaaccactcacttcgatcccttcccgtgatttcatcttcaaaatcgccaaccccccccccccccgccccccagacgcagcaaaaaaaaaaaaaaactccacctcccagcaaaacacggcgtgaatccacgggaacaaggagagggaaaccccaaatcctcacatcttatccgcctcccagttcgtctgcgacatggctaccccaaacacggcggcgcgcccgcccgaaccccaccaaaccctagaagcgcccccacccccacccccaccgccccttgcccgcggccgccgccgccgccgcgcccaccgtccaacagacgccggagcagccaagccgacccgaaccgaggcggaggcggcggcggaggcgggtggtggtcgggagagaggggtgtggcgtgaggcgagtggaggaaagggggagaaagcggagagagagggagagagaggtggagacgaggaattcgtgaaatggacacgcgagagggagaggagaggaggagtgggggcgcaggcaagggtatatagtacactggctggtgacgtatcagcacacggagaatttttttggatatgtgagagaaaaaaaaaggggaaaaaaagagaggcgcattgaggaagggcggaggctgaggtgtgcttgtgcacccgcggaaggtagtatggcacagttcgggttcatcgcagttttgtccacttgaactcactcgtcacgtcaaaaagaataacttgaggacatgaaagttgtttttttttaacgggatagtaatcctattaactcaagtttaacgaaaaagcagtgtcacgtaataaaagtgtagagttattaggtttaatggtagctgctcgccaaaacttgttgatctgtactgttgttagattgagattaagatcatgggtatatctcttttcttcaatctccgagctaaccaagatccctatagaaaggggtggcgatagaggaagagtccctacaggctcaatggcggattcaaagtccggtacctcaagcagaggctctggatcacgtcattgtagtattttaaatttaagtgatcggcatgtctataattgttcacgtatatgtttgtcagatctctaaaaagtttctagacttgttactaaataggtctcaccaacgcagagtttctagggatatccctggatggaagatggcgatccagtttttaagggtgtttggttggtgggcaaaggtggatagggtggcctagagaggaaatattccatgaagatgttggatgagtgtatctggccaaattggtcggatgaggatatccacctttgctaatcttaatcattagtaattgattagcaataattaatgtattttgttgttaattagtaatcaacttatcaaaattagtgttgattagatataattggtctattttgttgttaattagtataaattatagctatattaatgataattaacatatattattattaattaatatgttattatttttattctatccattctcatccatccaaccaaacaagaaactggatggccatctccacccaaccaaaaaaagagtaccaccatatccctgtaaatatggatggccatatcctatccaacctcgaccacaaaccaaacacaccctaaatgggcctcaccaatacagaccgttatataataataagtgcaattagttgtggtgatggcagtttaaagagaagaaagggagaggtttattaagatttataggatgggtagaactttggagtaaccctagtgcctagagaatatatcatcaaggagtatcacacaaatagacaattcagtagaaaaatgcttcatactttgatttaaggaagtacatcatcaaggagtacccaataacaccatgacaatctataataagagatccattagttgtccacacgtcattgacttattacgtgtcaaataagtaaagggttcttatacttttactataaacttttgtattacaatatagcaaatcaataggctacggtagccttgagacctaagagtaaagaaaggcggagcaatcatttacataggtaaagatcacccctattctatttggcaggaattgaactaaacctatactacaacttaaaaggaattgaataaaacccttcctgtccaaatatgccctaagcaaatatgacgactaaatcagtaagggttcgttcgaacctctggttaggttacgctaatatgtttcacgcaaaacgacacagtcgtcagtgaatgattaattacgtattaactattacaaacttgaaaatggatttttttcaagaaacttctatatataaagtttttgcacaaaacacattaaacacattagttatcagtttggaaagcgtaaccacgtagaacgagaaagtagctcagtagagtagctaaatcgaactcagcgtaagcaattggttttaatttcaaaatctaccgctctttttattcttccacgttagtaattgggaatcattggaaatggacaattggtggatatgcttagctaaaacattaaaaaaacatggatgaaaaaatgttcacaataaattgacaactatatatatgtggttagactctaggtgttgtagtcaaattgcttctttccttcaaaagtctattacaacagtgtataacagattagccaagccaagccaattaacgagccataggccttgttttggagttggagattatgaaaatagatggtgagaaccttggcaagtattggcactactaaatttgatattgtagaatttgaactagcgtgggcaaaagttggtagcaaaccaaacatccatatgataaagttgccaaaattttggtagcaaacttgactacaatctaaacaaatcctacttcattttctagattctatggcatctagttatcagaatctttgtgagaatctggttgtttgtgaaaattatactcgaagaagctttaggtgcaaaaaaagcgtcctaaaacatggcctatagccaacagcctcaaaactcaacttagacctagaaagcacatagcaaaatatatttcttgttttttcaagaaaaaaatctactcaatacgttctccaataaaaaaagaaaagtgcccatttggccataaatatgcagtagacacctgaagcacatcaagaccataacttttttttcttccagcataacacactagcaattataagtccacgacaataatgatgagtccacgtcaactactacgagtttgcgcaagtaccacaaccaacaaatatggggcattcttaaggaaacatgtatgatgattaccagagattcacatgcagcaacggagtctgagagactgggacaaccataaaatgtaaatagggttagttctcagcacaaacggttcaacaatttggttagctgccattttgtcctatgattatctgcagcaaaaaagacatgttcctacaacgaagtttgatgaaggttgcaacttaatgtcatttccagagcttgacaagcctatcatggctcactgaggcaatcaaccctgatgcatttgatgctgctagcgatggaatcatgccatcatgagcattgttaatggtcacgatattcttctccctgatgtcccacagctccaaagactgcaagatgttaaccatacaaaaatttaatttaaaatatttttaaagtactataaaatgattatcttgaatatgatatataagagaacttgcctcgtaacaaccaatcacaagcaagtatggaaattttgggtggaagacacaagaataaaatttgtttccgctgcaaatcaactcatgcacacaatcaccatcatttcctgtagtaaatgaccaaaccttgatagaatcttcactaacagaggctaggtagccacccgtagcatcccagcaaactgaatggatattctttaagtgcccctgcacatgatcgcagacccacatgctccaattgagtcaaataccgaatgacatagtttgaagtattgatgtaatggtgggagttgtgggtgcacacaattaaatgcatatatacattggtgcagaaaccaaaagttatcactatttttaattgcaatatcaatattatgatgtcaagttctagaatatatattgcgttgaacacttaagaatgcaattccaccttttctttatgtcttaaataatccaaaaagctctagccaactagtggaatgatggtccaatgtgtaaatgcaaaacgacttctactaaacatagctgaacaatgtgtatactatattctgcaacagttctatcgatatgagaaattctcctagaaatgcatatgtaaaaagatataggtaaatatcattggttgtctacctgtagatcactcctataaatgtgcagcgtttctgcatctagtatggaaatcatcttttctgagacaactgcaagatatttcccatggtgaggttgaaatctcaactgaatagcacctccctgcgaagatatgataaaaaagcattcagggcaagttttagcttgcaaacaacatatatcaacactaaggaaaagaacaagaaaagaaatagctgatacatacattaaataccctaacacagttcacgcagctaccattatctatgctccagcaacgcacttccccatcactgtcacatgagcaaattatatcttctttatttgggtgaaaatcaagtgacacaacagatgttgaatgacctatgaaagtatggagagaatactccggctgcatagcatcaagatagtaaaatagttagtacatttgaacacatcaaagtgacattactataagagggtaattgacacaaatgaattacattgttagcatcccaaacccgtatggttttgtcaaaggaagatgtagcaagacgagtcatgattgagctaaatcggacatctgtaattatcatagaatgctcttcaaatatagctttaatgtttaagtcatctgtgaaccataaaacaacctgaaaaaaaaagataagtataaatatatagcctttttagcaccacaaaatccatagttgcttttacacacttttttatcatggcctcccgtggctagaagtttcccatccgacgagaaatgacaacaatcaaccttgtttgtacttgcacgagcttttgcaacctcgataaaaccaaaccctacaacaaagagaacatgttatgcatttagtctctgccaaataattctagtcaagctaaagaacacataactctaatactctataacaccctagtaaaggcatatcatatatgagcatttcaatcctcttgaaagcgaatgaatcctaaaacaacacatcccaccatctttgctttctgaaaactgaaatcttatcatgtctgttccacatactaagcaatgaatgaggaaattgtgcaaatcatttcatgacctttttttgctgactttgggtatgcatgctcgaacagggattgaaattgcattacactcaatagttcaaataggcatggagaccggttagatgttgcaatgaaatttgaagtgaagaaaagatccctatcaatgcagatgttgattattggaaacatcctttaggataaatgatcccttcaatatgtttgatctcacaagtggtgaggttgtgaaagtcttaagcaaagagaagggtaatagtttttcaaaaagacacacatttcttttataactctttttagggaggtgccatatgatactgcatatgatgggatggcatagattttttttcttgattgttttactatcaaggtcaataaaagttaaatgtacccaatccaattatgaaatatgatgctttgtgatatgtatactcactttctaaattttggttatcatcatcattaagtcagggtgaaatatggagatacctttactggcatccatgcaatgccccatggtctcctgaggatccatgtcttcctgagataaaaaagattctacattttcatccaaggagccatcttcctgcaactggtctacatcaccctggaattgagagatttttcatcttacttaccaagctatgtgctagtggcactttaaaatagagtggtatataaataccagtggatttgttggagagatcaagcttttggtgtcatcatagccaaacatagacaatgattttgatttaccaccattatacttcagttgtggcatggacatttcatctcttggagtgtgagtgaaaggtgttgaaggtgcagaacttgaagacgacccaacattgtttgatgttcctgagctattagctctttcagaggatgagacaattttctttctcttctttgatgcctgaacaacgagggacacattgtaaacatgcaatttgccaatctaaatatattggaaggcaatcgtaaatatgtcttgtttcatgagactaataggggcagaaccctagtggatacaacgtaatatagtatatataaatatataaaataatacaatacaagaatattatattggtaacaatacaatcctacaaggcttaagaaatcgatacaactccaaatatttcccagaaatgattaaaacaattagtagtagcgaaaagatatagtatgaagacatggaacagtaaagttccatcggaatagactagaaaaaaaaatcatatttgggggtatagaaggggttgagcaaaaacttggaggcgcataacgaattttctcagtagacaatgagagtaatgcttcaacaagcagaaacattgcatagtgtagtgtaaatgtagtatatatatgatctatgatatagagtttatgtagctttataaacaataaatcatatttttattataacatcatactcggttagctaatccaaaagaatttggtatgctcccatctagcatacttccgatgctttgagcctgttgatggtgaagctgattcaagctttgagcctgctgatgggagattgtagactgttgaagctgttgctgctggctatgaccctgttgttgcaactgttgtaaatgagcaattttctactatatagaaacataagagagtagttgataaacaaatggaaagaattcttgtccaaagcaagtatttctgataggtgtattataaaacactctaaagacaaatccctgtaatgtccttctcatactgcactatcagcatatcttattgtaaaatatctttgagataatttattctatgccattgacaacgcttggattctataatatgtcactaacaaagctcagttctataataaaccatcaaacaaccgttagttaaaccatcagtcaatcgttttcttcctcatatgccatcattgctagtaaactatcagttaaacttcgttaaagatgagaaaatgtccattttacccctatgttattatgcgtagtcatgaattttattggtcatgacccactactttttcttaatgatgaaaaatataaatcgcttgtctttttatcatccaagattattcaatgcgacatgtcattatgcaaaatctcaattttatccaagggctaaatggtcattttttgctccctattggagtttgactaacagtcaactaacaatgatgacatataaggaataaaatgagttgttcaatggtatattgtagaactgagctttgttggtggcatattatagaacatgcgcttttttcgatggcatagaatgaattgactcgatatctttagttgctttagcaggaaagcattctgcttaataaataagctatgcaaagcaccagggaagcttctaggctacaattgtgagaataaattaagtacatttagaataaaattttcagggtcgaatgaaaatgattaaaaaaagtatagaaaattgtttgaaatatgttatatagggaaatgttggtaacaagtaaaattgtcttcaataaaaaaactacaaataaatatgttcaacttttaatcagatcagacagaagtgccatttggataggacatgccacacctctaagcaaattggttatgcaacatctagaaagtaagaaactaatagcatcaaagcttttattggaaatgtaactagtacataaatttccagaattaggagtatcagcagaaaactagcatttccaaggtaggaagtcatagaacataccgctattaacatatctatcttattacgtgatccaccaatttggtcaggggaaccaatatttggaataatatgaccactattattattaatctgtccatctagatgaatggccatatttttgttgttatgaagcatccataatcttctagtctctacatcattagctggaagggaagccatgttttgatgggtttgcagcaaaagttgttgttgtggagttagaaactggagttgttgaaattgttggggtgattgtaggagcggcttctgctgcaaaattccagaacgatgttgatcaagccttatgagcaatgataatagaaagatgtatatgttaaaaaaaagttgcaagcttctagaatataataatgtgtaaatgtcatgttttgcactatacggaaaaactacatatgtatttggtgttttttttaaatttctatcgacaccatgcttctttttatttacataaacatagtgctcttttaacaccccaaagatcataatgtacaccaactagagaaaaggaacaacaaatggtgaccagatgtgggatatgaaatgtgcattggcatcttgagtaggacaaacaatcacaagactctcaatcacattttggcttgtgaagcggatggatctagtaacccgaccgggctgatgaatctcctaattttattattggtttgctcttagacgatataactttatttgcaaacaataaagtgtgctatgatggttttccttaaaagaaaaccaatcaaagggttttctcaagtaatacaacaaaaatgcacatagaaacattggcaatttctttcatgatgacgaggcatggctaccacccatgtcattgtactaaacaaaattccaatgaattttgtgtgaattgctaggtagagttttattggcacaaacatttctagcaattgttgtcggtagtttttaattagctgtcaacaaaatatcagtactcgacaagtccctagtccctccaatatagcaagctatcacaagaatagaattttcagatgcaaatataatatgaacatcgagcatatgccgtagaaaatgaaaatagctgacatcagacaattaggggcttcctatcataagtagagggtttttacttggaattccataaacatagaacgctaattaatgcatacatatttttattaaatacccatgttttttgcaatatgtaatttcctaaaataaatgtctccaacgtctcctagagaaaagaaaatgcacttaaaccaaatacaagataatagttggctctaaagcttaccatgagtgaccaacctttcagcataaaatttcttccaccatgattagatcctattaaaatgacatctcaatttagcttcaaaaactaaccaataaaattatgcaactttgcataccaataacaatcgcctgaagaattcaacatgaatcaaaactcatgtaattttttagactaaaaagcggtacgagttttgaactaaaaaggaaagtgaaagttgaaacatgaattatttactaggcaaggtagaacagtaattcaagggttcaagctagatgaaaattaccttgtagaccaagtaatgatccatcagaaataacatctctatttgtcaaaattggattgatcctaattttgatattctgccaagaatatcatgataagatgaaattggtaataatcttttttcttatgttattttgtatttggtatggtgagaggtgataagcagtatacaattcaaattaacctgttctggaataggaagtcgcggacttcttgcctgaacttgttgcagagtacttgataagtcaccaatacctccaggcaaaattggcctgaaaggtatgtgtcaatactatatgaaagcacatgtacaacaagttgctagttgctacatgcattgaacatccaacaagtcaacaagtaatccttgctggtatggttattaacttcatttctgaatggcttaaccatgattcatgtatcatggcaggtctggataagctatgaacttacactattaagaataaagctacatagcttacacgccataataatattataagtgtacacgcaatgcaatacccaataaaataatatagtgttcctaatgtcaaaattctaactatgtgcatacatatacaaaatgaaattactaggtgcaaacaaatgtatatcatagcaaactacatgcatgattaagataataattttctaacaagaacatagcatacattgaaaaagaataaagaatcacaattactttaatttagtagtgtgttgcatctactaagttctagtgatctttgcaagtaaactttgctgatgttagtacaacaaaaaaaaagtgcaagaaaataccctgaagattgtccacatgtagctgctttcaacaatgatgcttggtttggatcaagcacttgcccatatttttccccatatctttgttgcaactataagttcagcacaacaacgcaagatttagatcaaccaaaaacgcattatctaagaggcagataggagcctaggaaggttggacttggtgtggtacctttattgatgcctcatctaaagaatctctttgggaagggagctttaacctctcttcatatatttttactgccatagcatttgcaatagcagggttatgtcgcattaaaagatcatttccagaaaatccacttgtgataccattaaaaagatgagaaccatctctatgcagttgttgttgttgttgttgttgttgttgttgttgttgttgttgttgttgtgcagctctttgtaataacatttgttgcatttgtatttgttgatgctgatgttgttgatgatgatattgttgttgctgttgtttttgatgctctgcttttgcttgttgagtctgaaagattttagcaaagtacaatttaattagcattatctattcatgtgaaaaatgcatcatattccaaatgcaagtcattttacactcgtacacgagaattaaggaggtgatacaattattttcttgtcctgcagaaactacacatggaaaaagatacttcatttattgcgaaagtaacatcattcaaatagtaagcttatttacctgcaaagacccattagttgtagtaaatatcctaaaatatcacgtcaaggcggttcagccatgaccaagccagactactcttcgtaacactatactcatgactctaattcacatcaaggcaacatgagacaagctacggtttgtcacaataaggtactaggttttccaatgcatcatgtagatcagacataacagaagcccattacatgtgcagtgcctatgtaggtggtgcacaagggagtaggcaaaggctcccattaggcatgctacaaaatgggtgataggtgctccattttttctttgtctattgttctgcaatttttttatgcacttgggcattgctttattatttaattcaatccaaaactacgcatcatcaagtatgcaactcaactataaagttcatagactacacttagcaccagatgaaatacatatgacaaatttgaaagaggttatcaacaggctaaactggagctaacaaataaaagacaaacaattagcaatccaaataggcttcactggaaaaatgtttgatgatttaactagcatgccacattatgaagtagataaaattgagtttttaatggttcaactatctacattatacatggtttatgaaggcaacaaagaattttctatgttgtgatgtagcagaaaaggaagaatgaaaggccctaattagtagcatttgtcatagatggaaattataatcataaaaggataaataaaagcacagatacacacctcaatatatgacgttgcaacatcagaatgttcccgatctgtttgtgctatgaatatatcccaaaatattgaccaccactcaaaaagaaagccaccaggagcatcaattgctgtatgaaagttaattcaaggaagtaagtaatatcattaaaattgtggcaaacacaagccaaattaaataactccatagcaacttccaatcactaattaagtcaaaaaaaaaa

SEQ ID NO: 73858 - DNA, 14020 bp, Oryza sativa
tgggtacgttctagtaaaagaaacttgacaatttagcatttttgtgcaacaatttggctagatgtgtgttgttttagttcagaaatgctagatgagttttttcatgatgtttatatgccatcatataccagttatgcagatattaccttacaatcttgcatttaatctataaaaattatgttactcattcaatttgcaccactagtttggatttgtttcttcaccttctacaatttaaaccaaaatacaaaattttctaaataatacaatttaattgacttttaattactagaatgacagcatattaaatatgctatataaaactatgttatatattgagaaaatatatacttggaaattgaacatgtatagcaaaacgatgctaattaaaaaaatcaagttaatgcgctaacatgctcacttcttaagtaatggtacaaccattacacatacattccaagttggtactccctccgtcccgtaaaaaaaactaacctagtactggatatgacacatcctagtactacgaatctagacatacctttgtccagattcattgtactagaatatgtcatatcccgtcctagattcgtttttttcgggatggagcgagtacacccgtatggttacttcttaagttatacccacttgtaaagttgatgtatcgtgaatacaatttactcccaactaaaataaccaagacaaaattgtactaaatatttttagatattgagacccctctcggtcataaacaaggcatatattattccttgtatgacccgctttacaagcaatacttaggattcacctattgtcacaaacaacattttctggagacaagaggaaatctaccccactccctggtccattactttgttttcttgaggcattccagacctagaccccaaatggttatgctttaaatcattttcacaagccaaacaaactattgaaaaccatccaaaacaacaaagtggggtttccctgaaaccccagctcccaaactcacgtctactatcctcctactcgtgagacatacaagattgaacctccaaacatagctaccatcccgccgttcggtattgctaaaaaaaatggaaaacactcaaattgatctaacgccagccaaacaccacctaggaagcaagatgcataacaactatttttccatctcaaccagttagctatcatttaatttctccatttattttcttgtcttaatcaatcacaaccatttataatcttaatttgtgccaaaactaaaaaaaatacatatattttggaaatgggggaagaaaaactaatgaaaaaatggacagaaatcatgaaaaatgcatgatgcatgtcatcataatcatatagtacttcaacattagtaactcaagatgatttttcttgtgttctctttcatatgtaaggagattgttgtgtgcgagggtaaaagattggatagtacgagacaggtcaattctcaaagtgaatcggattgaaatataacaaggctttctagatctaaaagaggggcatgttagaacaaacggatctactaagaattttttgatagaaaatcagtgaagaaatctcacatgttttgggccatattatctgaatacagaaccatgctccacgcttccgcttctccaactccaacggcctccgagggtgaggatgtgatggtagcttttagagtttggggaggtattagaatgaggaagcgagcttagagggagattggtccaaccttgggtggtggcaatgagaggtttgcggtggcggagggaggtggtggcccttgccggcgttgaaaagaagtttagggatggcacacggagggggattgcggccgacgcgggtggtggaaccgcggcggtggctaggattggttagggttcggtggggtgggtagggtgagttatatagtaaagaggtcgatggctattaagcgttggatcaaaatcgggtgtctggaaattttaactagctatgcgggtagaaatatgtcaattgttgcatatttattacctagaataaatatttttaataaaataattgaagttcttatatgttttgtgacttgtgtgattcttcttctctaacgagcttgccaaattaatgtgcccttctgtgatatgcatgaattttgtagaatataaattttataggatttagttcggttcccacaaacttcctcgattccaaagaaggctaaggttagtgtaggcataggggagggaacgattaagattcaatggaccttggctatagcgcgaatgaggacgttggtggacatagatgtcatgatgagatagtaagaatagagcaatattagatggtggtgcgtgctcaatcaacgataacattgccacaaaagggaaaggatgtacatggaggcaaggaaagctaagcggaggagatggggatggacagtgtcaatgcttgatgtcctaattagggaggcgcctaagagaggaagaggatatgagtgagttaggttacaatgagggaagctgagcttatatggaagtggagggataatctagattgcacattttctatgtgattgttatggatttgattgatttgtcatttcccccaaaatcacatggccatttcttcatttttagtacacacatccctttcaccattctatttgaagaaaatatataaaagcacgggtagggatatagttcctttcattgctcgttgacatttctatatgctaccttacagatgcattgatgattactcaaccattcctttcatatatcattctattcaggtgggtattttcgtttccttctctattgattttacatccttctttattcttatatccagttattagcaatttactaagtactattaggtatattgaaagcctgcacctactctacaagctaaaaaatgtgcatcaaccttgtaaatgcgcacctacaagctaaaagagtatctgagtatataaagacctagaatttgctaacatcctaatcaaaatagcgtatgccatgaagagggataccaaacatgtacaattagatttacacgcttagagacggtcaccagaaatttgatctattttacaatgcagttggaatgtcagtacacattcgcccatacttcaaattctgaggaacacaactctacaaaattgacaaaatacccttgctaggcaagaaatcaattgcgttaagtacgtggtgatcaagtaatcggttgatgatggtattaaagtggtgtactccacatagggtggataacgagctagctcggctcggctcgttatcctaatgagttagaatcccagctcggctcgactcggttagcagctcgagctagctcgtttagcttgcaagccacctatgaccaacgcaatgcacttcaaagaacgatatcaaatatatcaaagataacaatagctgcaaactataatttctgcaattgaagaataagaaatcaagcaacctgcgaatcacaaagtcttggcataaaatttgtgtacccatcaattgggaatatttcatccatcaacacacctgagccttagcagatctggaagtattggtacatcggaaccaaccaaaaggcaacaaacatcctactgagtccccccccccccaaaaaaaaaaccaaaaccaacaaggcagattgacttgccgaaccaccgacattgacaaggacggcaggcttgagcttttccttctcgatttgtatcttggtgacgtggtgacgccagcacggtccgagcacaactgcctcctcctacttctcgttcgttcctccacgatgaagtagaggagccatggtccgcctcggattgggatttgggggtggcaacttcgcgcgacatcactagctcgctacccactggagggcaagagggctggtagcgatgggcatggtcgatgatgactggttgtgatgagggcgtgagggcgtgatggcgggggtggtgctacggccatattggagagaactggcggcgcggctggaaactgggtgtggggaaattgatcgatctctgagctagttggctgtcactatggttcagttgggaattcgttgggccagatgggccttgggctgcttgcttttgcttggctcgtttggctcgcgagccagctcgagctggctcattatgtctaacgagctaaacctctggctcagctcattactaaatctcaacgagctgaactgagtcagtcatgagtcgagcgagttaacgaggcacacaagtttttggtccagccctaactctacactattactgtttaaggtggtgttcttttctcctgaagatgaagattaagttttttacgcaaaacgaggtggtattgaagtatgattgattgagttttaattattacaaacttgaaaaatagattaatatgatattttagagcaactttcatataaaaagttttcacatgaaacgcaccgtttagcagtttgaaaagcgtgccacgaaaatcttaatcttcattcaactcttgttggagaaaagaacgagaccttaagtataggtaaaacttccccatcatgagaattatctcgaaaacaaagtatgatcatactaaattttcattactccatgatctagtgttgataacttttgcctttctcactagttatacaaccaactaaaaataggatgtgaaatatgtataagagtacgtgtgtccaactttgtgctaaaaaaagaaactaaatgcctcatcatttgtcttattcgtggaataagccaaacggtatatttgcaaacgaaaagtaatttaataggtgttcttaacgatctaaaagcaaaggctgtaaaatgaacttcgatgaaaaaacccccaaaatcaactccaaatttaaagttgaaaattcaaattttggttgataagcataagcataagcaaaaaagatgaggccctaactaaaaataatctatccaagagggaggggggggggaatcatgtcttcttatactatatacttctatttcccccaaccataaaaaacctacttctagctttataaggagaaaaagaccaaaatgcctcacattgagaaataaaatataatattggtgaatggttaggtaagaatattgaaaggataaaatatcttgagtaaggagatagaagtttgtgaaatgaggattgataaggagatagaagttaaatttattttgagataaaatttcaacttccaagttgatttattttagtacttcaagtactgataggtggatttggctataaacccacaactcctttttattaataccttatggtctctgttttacgtgcgaattcactgaaatatacaacccaaaatacgaggtgatagtaattaacaatacaaagtaacatttatggttctgccactgccacgcaaactcatccaatccaccaaactactccccttagggcatctaccaccaaaccacacctagagtgccctcagggcactcatctcccattggaggataccctaaatgggctcctcaaaatctgaagcaacttgttggagatactccaacccacaacgggtgtcccagcccacgaagccccatgtatattttcacttccctacccttagtccacgatgaccgcacaaattctctctctctcttctctttttcttcgcctcgtctttctcccttcgcccgctgtcgctcgcctctctttatccctctcgtcgccgccgctcgcttctctctctccctcctgtcactggcggccgcgagggtgatgaggagggccgcctccctccctctctctcattgtcgttcccgtcactcgccgccatccgtctccacgcggtggccgacagagaactgcgtgggggacgcgctggtcgacggcgaatgatgcgaaggacagggtggccgacggcgagcgacagttggttgacggcgcgtgagctctgccgctttctctccctctctctttcaaagcacgggagcagggcgcggtggccgacgacaagcaaagggtggctgacggcactctctcccgtcgccgcccgtcgcatcgcgtcgtcaccgtcctccccggcctcctctacctcgcgtcgtcaccgaccgagggcggtagatctggccccatcgtgggcggatctgtgcccccctcccctgggccagatcgggatggagcggcgtcggtcgccgacgattgggggggcgccgacagaggaggtcgcgatggtggaggggcgaggggtggaaagggacaaacgaggggagagggcggtgtctacaggctcctcgcctagcgccgaccgacccagcgtggcttcttgctcgggcccccagccgaggagcttgtagagccgcgacccctgtagagtagatgcgtggctctgctggggacggctcgagcaaaaacgtgaatgggagtcggactccgtgagctgaagccacgagccaagctacccatcgtagatggccttatttatatctagactagatgcgagaattgttatggctgtgcaagaaagatttgtcaaaaaaaaaagggataaaaggttccttataggcttattcagttgtactacacaaccaatcgtccaacgttatctgattattattattatttgtcaaagcatgtttgatgtacatcggattgacgtgaagacaagaatgatgtggtctttgcttatttagtacccggtcaagtcactcgtcataatagcctcaaaagtactgtaacagctcataatttgcaagtagccataagaaaatatctcctccactttgtcctgaggtgaaagaggaagaggaaaaggccagtgaggaaatagaagaaaaaaggggagaaaattacataaaagccctccgcaacaggtcccgaatactttgattcggtaggggtactaaggccattttcaacgcgaggacagtggtcccgttcttttgtccaaccagagttggatgaagattaagattttttggcaagtttttcaaactgctaaatggtgtgtttcttgcgaaaacttttaatataaaagttgctctaaaatatcatatcaatctattttctaagtttataataattaaaacttaatcaatcgtacgttaatgtaatctcattttatgttaaaagcttaatcttcgtcatcattttcatatttagagaaaagaacgccaccagtgtccaccaccatcgtacgttgaacgggcctaccaaaatggaggcctaataaaggcccaagtaagtataggcccaaatacgcccatgggtcgttaaaaaacggaggcccaataaatggtcgagttagtataagcccagttaggcccacgagtaggtggaacgaccacctcacggcccttacccgccttatcttccacatccgaggatttctctctttctttttccaacgcggccatggcgccgctccctctccccctcccgcttcccgccactcgccaccctcccaaaccgcacgaggcctcggcctccgcctccgcctcgctccacgccgcgctcgcctcgctctcccagcagtgcggggcgggaggcggaggcgggggcgccctccgcgacgccttcgccctcgtcgcccgcgccgagcgcgacgcgtgccccgcagcggtggtctcggtcggcccggaggcgtacgcgtccctcctgcagtgctgcgtcgcggcggggtgcctccgcgcggggcggcaggtgcacgccgccgccgtcaagcgcgggccccgctactgccgccacgcctacatcggcaccaagctcgccgtgttctacgcccggtgcggcgcgctcggcgacgccgagcgcgcgttcagcgcgctcccggccaagaacgccttcgcgtgggccgccgtcatcgggatgtggagccgcgccgggctgcacggcaaggccctcgccgggtacgccgccatgctcgaggcgggcgttcccgcggacaccttcgtcgtgcccaacgtgctcaaggcctgcgcggggctcgggctgcttggccccggcagagcggtgctcggttacgcctggaaggcgggggtcgggaactgcgtgtacgtgatgagcagcctggtggacttctatggaaaatgcggcgaggtggatgatgcgcgggaggtgttcgacgtaatgccggagaggacagtggtgagctggaactcgatgctgatggggtatatacacaatgggaggattgatgaggctgctgacttgttctatgagatgagggtcgagggcgtgctgccgacaagggtgagtgttctgagctttctgtccgcatccgcggatcttgaggttcttgatgggggaaggcagggccatgcagttgcagtatcaagcggcctggagatggatttgattctgggcagttcaatgatcaacttttactgtaaggttggtttggtggaggctgcagaggtgatatttgagcagatggttgaaagagatattgtcacctggaatctgatgatttcaggatatttgcaggatgggcaaactgacaaagcccttaccacatgccatagaatgctggagagtggcctgaagtttgattgtgtgacgttagcgtccgttatcatggcttgcgtgaaatcttacagaatggaggtgggtggagctgctcatgcttacgcagtgagaaacaatcttgaatcagataaaacggttttttgtagcctgatagaattgtattcaagtagtgggagaatcgaacaaatgcgcagagtatttgattcaattagacggagagatatagccacgtggaaagcgatgatctgtgcttatgcagaccatggaatgggttctgaggctctgaagcttttatatcaaatgcagcttgaaggcacatctccaactgcagcatgttgggattcagtactttcagcttttattcgaaatggacagttagatgatgccctaagcaccttctatgagatgcttcaaacgagcacacgccccaatctgcggacatggagtctgttaataagcggcttgtctcgaaatggtatgcatcctgaggttatgaatctatgttgcaagatgcaagaagtagagccagcacctagtccaacaatattttctgcagcacttcttgctgttaaatctgcagcttcagtacagtatggaaaagcaatgcacgcatgcattgttaagaagggcctattattgtcgaaatctgtggtgcagtcgctgctaaacatgtatggtagcttcaatgatagaggcacagtagagagtttgctaagatttcttgctgctgcacagtaaataatttcagggcgtcaagaatgtggtgctagtaaaataggacatacaggtttacaggttacagctgtacataaatacatggcgtttgcacatatgaattcacattcataatacaattcctattttgagtgatggagtatggactaaatcagagtggtcatgaaacaaagatacgtcataccagtttgatacgaaataacatctcttacatgattgtattaaccttgcagatacattacagagtatgcatctattgttgggaggcattattcctaaaatcagaaggttctgataaaagaaccaatcaccttaaagggctgaaaccagcgagtaaacagtgtttctgtggccacatgactctctttgagacctacagctagtcagctacaagtggttgaataatttcaagaaaagcataactgttttagtcactgtaacgatgaatatgataacatgctgacagatgtgctgcagttctgttgtcatccaattgttcggttttgaattaggatcgctactctgtgctggccctttttcggatactgtcaaagaacaatgtccagatgttatgggcaacttattatcattatataggtcattacttcttttcacactgcaaacaaaagtgtaactgtatattcctcctgtaaagtgtcaactcattgtacatatctttctgaacaactatacacagcacttttccactccagaaattgcagaattattactcacttgaagtatgagttaccacttctttcacactcccatgctaacaactggtgcttgtctcttttcgcaagccctgcatccgatcttgatggggtgcagaaggttccaatcagaaaaaccggcgtcttaagagagagagagagagagagagagagagaggctggaccatcgagcagctagaagttgcagcagctgctgggcacaggactgctcttcttgatgatgaaacttgcatctacagatgatcgagattattcgcccaaaagtggggggcgtactgcatatatgtagctcctgtaacagcgggtagcattgtcgagagatgtgccgcattcatggtggtgtgtgtgcccccggtttgctccgttttggatcagaatgtgtgccccctgcactggcccatttcgggaaggcatgctcgctgggaatgtgatgctgcggacgcattaacatgtcgctgccgtagcacagtaacttgagtttctccttactgttgcactggaatggactcgctgcgaataatttgggtactttgatcttcattcgggtgggaggaatttccacccataggaatagaaaaaatggaggaatataaatgcatgcacatatcaattcataaaataaattcaagaggtttagatggaaaatttactatgttttctctaagcaatttgtaggaaagaaaaaaaaatgtttttctatattcctagaaaccgaatggcactcgtaagaattaatcctttacttttcctctaaactgaacaagccctgcctagatagacattgcacagctgacttcaattcctggctcgtttgcagaacatgaagaagaaacatcaccaaagactttgtctgtaacgattgagaattccatgtcgcaatagtaataactgaaacggttcatgagaaattcttacgaaaatcctgcaaaactggcgcattacatttacattacattacagaacgggatgtgagcttttcgacccgaggaagaactgcatcggtgcctccgccacagcccacagtgggtggactctgtaaactgcaaaccggcctgatccgacccgacctgacctgacctgacggctgccgattaattaagcaggtaatttcccccgattcgcttagctggatcgtcgtcctggctgtggacggccgggcagcaacggcgacgagaggcggtgggcggggacgacacggtccagctttagaaaggcaggcacgtgagaggtgggcacgcaccgaggccaaatcatggagccgagtgcgagtgccaaggcccccgtgtcctcagctcatcactgcccaacatcaccattcagcgaaggcctacagaaagaaaacacagcaaggcctccgtactaccaaatgccaatatgcatgagtacgcgaacgatttttcttttttcagattgaagggctatatactccaccggtttgcaaaatgcgacgaaaaccgctagaatcgataggattcagtaggctttcggtgtaatttgacgaaattcgaacgagatttgcgaattatgagctatattttggtgattcaacagggggtcatcgcattctgactgacccatctgaacctgtaaaacattgtacactccaggtttccagaacttagccatcggtttgtacgagcacggtgcacctgggctcgacgtgttgtttgctgggggatagatgtcgcagggcagatcagatctcgcatccacaatcgttgatccgtgtggtacatgggccaacaagccacacgagctctctgtgcgtgtctggtacgtacgtcgcgtccatgcgatgcaaggctatagcgcgcgtgaagggcacatctgtgcgacccccccttgatgaatgatgacgctgaccgatgagtgaggaggcatatgatccattcccgttgtgaaaaatggatcgttgagctagggcgatgtagcttgcagacttttctctcaaacgatgatacggaagacgcacatgtacacacacgacttcctcgatgaattgccgatcgactaccgttcatgaatttcgtcgaattctgccaattcgcgcctcgtagattataaggacggtatcacgattactatgaaaaccgtgagattactgtaaaatgaaaaagtttcaaaatataagattaccgtatggagtaacggcgtgctattgcaaaccctgctgcttcgacatcaaaccaattggcaggcgaatccggttggtacttcctagttcctacccttgttctccactaatggaggtcaggatgatttagactgaacagtcacactgtctgtcgtgccgtttttctaccactgttccttcactatcacaataccatggcttgttacctgttggcttgttgctagtatctgcaactcggcattggtaaaaaaaaaaaggaaagatggaactcaaatgacaaggacgggagagaggggatgcagtaaaaacgcccaagatagcgcaagtaaagacgcgccggccagcctagcacgaacgggccacgccaatgtcacgcagcccgtgcctttgtcgccttccctacatgtagcagaatccattggtctccacggggaagaaatgcagaatccattgctctccatcgtcgctacgttgcgatgccatagaaactctacgctactgctgctgtgcaaacgccctcaccattgacgaatacagagccgaagacctcctcgctcttcttcgccagaattggcacaagaaaaacaaaaacaaaattgattcaccttatatcggcgacaataatgtacgtgtttcatagagtgagcagcaacaaaaaacgtagtcctactagtaacttactacctccatcgcattttaagtgtagttgtaaattttcgtatccaacatttaaccgtccgtattattttaaaaatttataaaaaaaataatcacatataaagtactattcatcttttactatcttgtaattaaaaaaataccaatcataaaaactttcaaataagacggacggtcgacattaataagagtaaagaccgaggtagtagggaaataaaaaatttaacaagctaacggatttaatgatttatcgctagtgtccgcatcttttagcgtgtattaaagacaaacaaaaaattaaggatttaattatatggtggacgtacgcgatggtgagtgtacatgtgtactctcattaaatcgaaaaaaataatactccatttattctaaaatatgtgtcacccacaactttaaagaaaaaaatcaatatttgtaaactttgactaatacttccttcatcttaaattgtatttttaggtgagcacaaatattaagaaaataaatataaatgattaaaggaatgctattattggttgaaaaaagaaagtggataaataaattaattgaaaatgcttgtgaactgattggttgaaaggaaaatagtaggtgaagaaataatttcatcttaaaccaaatcatattattaaaaatagctacattttaaaatggatacattttagaatggatgtagtagttaaacttaactaatatacgatattactctctttgccccaaaataaatccaatcatagagatgaatgtgaactaagagagggagtaatgttttgcattggagatcgcataaaaaagttttatattttttgcgatagaggagcactatagtagtgccatggacaatagaaaggccatggaaatgattagttttggaattcctttgctcccagctcaacatgtgattactcaattctagaacaacataaacgaaagaaggatgaggcacaatgatcacaaagggggcagacgatgaaatgaaggtaaaaaaaagagaagaaaaaaaatacatttacttggaagaatgaagcctgagaaaaatacaatttgatccaacaaaacaatacccaggaaaagaaactgaagaagagaagagaagagaaaaaaattggcaaagaacagagcattggcatacaggcagccaaagaacctatgcaatttttaacctttaccctgaccaaaaaggtgttttccgccgccgccgccggcgtcgtcacggcgtcggggcgggcggaggcgtgccc

SEQ ID NO: 73859 - DNA, 18556 bp, Oryza sativa
  unsure (1)..(18556): unsure at all n locations
gccgaccgcatccgcgcgtcccagtccagcggcgtcttgccggacccccggctccctgggcaaaaaagaaaacacaactccggtgagaaatttacattctggcattctccaatcaaacacctccaaacttaatgcaatgagtatctgtaaaaatgaaagactgaaaataactctgccatagtactaccatccaattaccaatggaagaatgcatttacattccaccatgatctttggtgaatgttgcaaggaaataacaataaaaaaatataattagtgatccttcacaagagaaaatttgctgccatcacttggttgaaatcgcagaatactcctggttgttgtattggattcttggtaaggatagacagagaaggttgatatttttattgatggggtgaataaaaatctcatcttggactggtccagagttggtcactgttaaagaaatcgggagtaacaaacaagtagtatgtcttaaacaaaaaatgtagtgctaacttgcatgcatgggatggggtgactgttgcaggctatgcattgcaagaggacaagacatcttcattggttaagtacagttggacagcacaaacaagcacacgactaatcaatcagcgcaatagttggttcagtaggtctactaaagaagagaataaatatatcagtgcattacatagattgcatcctagcaagtactactataaatagactattagctgttcatctggccatcaattaagcatatctgttaggtagcctagtacattacagaccagcaaacacaccgaattgttagcttcttgtctagtaaaagcaaggagaaaatcaatggtgcgactgatcctacagcaatagagtatgcatcatcatttctaaatgtgcaaaactgaatttttctgccaagtgttttcaaaacattgccgagcaattaggcaaatagagctgatgagcaagtgagcttgctaacccactgggcaagatccaaaagcaaagctgtggtctctactctcttgtcaagtagtggagaacattgacgagcaggtagcagagggcactggttacacatatgtgggtggcagcactgaccggtgccatggacctactatagctatagtaccctgcaattggaggccaggcgagcaagaacatgcatgtgcaactgcaattgctcctgtgacccttctctgaattaccagcaagccgtagtgcagagttgttgccactggcagtccgatcccaacccaactcaaaaaccacattctctcaactttgatatctgtgaacactctcaaggctctacagcactccagctgatacaggctgcagctccaaattttaactgttttttctctgggagaaacggagccagaggattaggacgccaagacagtgatggacactaacaggcaaccacctcgactgtttacgagttcatcgattcaactatcaaccgtcgttttccagggagttgggggtacgtttaagcgcaggcaattaaggagcccgatcaggtgaggcaaacacacacacacacaccacaacacggcgtcaaccccgtgtcgcggccggccgcacgaacagctccgcaataatctcacggattctggtgaagcctagccaagccaagccaagccacgccgaagccatgaaggcgcacgtagtagccgagcaaggcggccatggccccatgtccatgatgacaactcacacacactacaatacacttgtccattattattctactcgcctcaatcttgcatgctagctactcctaaggtcctatttttcctaagcaaaaacaccctatcacatcgaatgtttgacacatgcatgaagtattaaatataaaaaaataaaaaactaattacataaattgcgtgtaaattgagagatgaatattttaagcctaattgctacattatttgataatgtggtgctacattaaataattgctaatgacggattaattaggcttactaaattcgtctcgtagtttataggcggaatttgtaatttgttttgttattagtctacgtttaatacttcaaatgtgtgtctgtatatccgatgtaacacgctaaaacttttcaccgctggatctaaacacagcctaagtcatagctagatggggactgtaccaacgacaatatatgctaagcgtacaaggataaataaaagtctcctccctcgttgccctaccattgaagaatatattgacttcgagggaaccactactatgcacgaaggcccggccggccggcagtacacattacgcacgcacacagctagaattcgtggcaacattttacacacctttaaacacccagggggtgtacactgtaccacgatgtacaggcagcaggacaggattaagtggagaggcactagacattctctactctacggtaaaaagctgggccccacacgccagggaccccaaggaaaagtactgcactactactacaccttttctccctccgcatcaagtgcccatgatgatgatgatactatggtgccacgaagagtacaaaaactaccaggccaatgggtggttatgagccccggggggtcaccgtagcaaatttgcagcaacctgcgcgtttctgaactttgttctgggtttacaaaaccgtatatatctcgtggttactgctcggttttttgggtaacgacatggttatcgcggtaaccgtggggtggaggtaagcccatctcaaacatcagtttggtgaaacctggtcccggggcttgaatcgaacgacacgatacgctacgagtactactactcgtcactgcaggtgcaggtgcagcagaactgcaagtgtatcggagtagtagcagcagccaatgtgatggcacgcaccggcccagcgtgaggcggagcatgggatggaccagaccgtcgcgggcgctttacagcccaaacctcgcagtcatcactcccttgcacgcaccaccaccaccacctaacacacccacaacacacttccgcatcaaagaaaagcgacgcgaaaaaaataaataaataaacgataaagagaaaagagagagggataaaaaaaaaaagaaggaaaagcgcgggagccaccacgccaccgtccacatgccgccatggcgaggaaaagaggagagggaatttcgtcctcctcttccctcccatggaggctttggctttcgctcctgctcctacctactaccttgctcgcgaacacccatcaatgccgccgaattccgcgacgatttctgcgtctacgatgcacgcacgcactcatcgatcgcttcttggacttggtgatttccgctcgcgcgtaatgccgatctcatgtcgaaaaatccccgcgcaagaaagcgaccaaaatacgatttggcaatggcaatgcggtgacgcagagagagagagagtagactgaccgtggagcatggcggagaggctgccgttggggaggtagtcgaagacgaggagcttctcgtccttggagaagtagtaggcgcggacggggaggacgttgcggtgctccaccttgccgagcgcgtccatgtgggcgtcgaactcgcgccgcgccaccgccacgtccttgagccgcttcaccaccaccgtcgtcccttcctccagcaccgccttgtacgacgtccccacgctcccctttccgagcaccttcgccgacgcccgcagcaggtcctccaggtcgaagctgtacccggccccctttcccacgaacaccagcctgctcggttccgccggcaccgncgtcaccgacggcggggccgacccggacgcgccgcccatgtcctccttggacgacgacgtcatgcccgtcccctcgccggaccccggcggggggacacctctcgcgggggggtgcccgcacccgccgccgccgccgtagtgctcttcggtccctcgctggcgcctcgccgccgcttggacaccgcgcagagcacgccggcgacgaggaggagcagcgccagcacgacggcgcccacgacgatgccggcgattgcggcgccggagagcctccgcttcttggaggaggatgccgccccggggacgtcggcggggctcaccccgggcgacggcgacggggacgggaagaacgacttgcagggcgggagcggcgagccgcagagctggaggttgccggcgaagtcctcggccgggaagcgcgcgagcgacgccgggatggagccattgaggttgttgtcggagacgttgaagacgacgaggctctggatgctgatgctggggatgttcccggagagcttgttccgtcgagcggagagcgcggagcgaggtgaggttgttgagcgtgaaggggatgggccccgagaggttgttgctggagagaacgagcctctcgagggcggcgagcttgctgaccgccggcgggatggcgccggagaggaggttgttctggaggaagagaagacgaagctgggggagctggagcacgtcgtcggggatgccgccgagaatgcggttggagcggagggagagcacctgcaggttggtgaggcggccgagcgtgcccggcgggatggcgccgatgagccccacgccggggagccgcacctgcaccaccgtggcgttcccggcgtcgcacgtcaccccgacccacccgcacgccgacgtcgaggagttccacccgagacgccgctcgtgcggcgtcgccgccaggaacgccagcagcgccgaccgctcgctcggcggcggctccgcggccacgagctcggcagcagccacgaccacgaccaccaccagcaccgccgccgccaccgccctggtcacgacgccggccatcgcgtcgcacagcagctggacacggctacgggcgaggaggcatcggagtgtgaagctagcaaactgcagcggatacgaccacactgtgggttagcgagagaagtggtgggaaaatccgggagaatgtgcgtgtccgggagcgttttatgcagtggcgtggtgtgctatactagcagcagcagtaggagtacacactacacagcagccagccagcgcggccggatcggcaggcagtggcgcatacgatgccgtggtggtaaagcccgtgacgctgggcgtctcgcgggcgtgtgcgtgtggcgcgcggcgcgcgcgcgccttgtgatctgtggacgctgtggctgtgcgtcgcagtggcgcgaagcgaagcgctgctctgctctgcactgtgccgtgtctgggcttgcgcccttgttggtttctgggtttttgtggatgggcgggtggctcacacgcattgtgccatagttgcattcgtgactcgtgagcgggcagggggctgggtgtggtgcggcaggtgccggttccgcgtcatggtttgcatgcgtagcacgggggtgtcgttgtggacgggtcggtgcgtgtccagctgggagaattttcggggggaaaaaagaattcgagatcggtttttgagcttttccgtttaaggtggtgcttggatttatgaattaaattttaactagcatggtggcccgcacagattgcgcggcaagaatcattatattttctctcatataatagcatatatgttttctcattatattattcaaattttttagaatgacatcaaaattttaaattttgcaataactttacaaaactacaaatgtgtaatattcatattgtattttatatatgtgttagttattaattatttttaatattaaattttagttatttgtaaattatatatatttctatatgtactctagactcgtcttttcatatttttttaattctgaattttctgtaaattgtatttctatatagactttaggctcttcttctaatattatttatttttatttctgaatttttattatttctaattgtatttctatgtggactctaaactcatctctcaatattctttaatttttaatttcgaattttagttacttctaaattgtattcctatattgactttaaactcttcccatgtttttcttaatttcgaattttagttatttgtaaattgtatttttatacggactcaaaactctacttttaattttgttatgtttattccgaattttagttagttttaaattcctatatggactctataatctacttctaatattctttttttttaattctgaatttctatttattttcttaattgtatttctatatggactctatactctatttctaatattccttatttttaattccgaatttcagttatttcctaattgtatttctatgtggactctagtgtcctcttctaatattccttattttttaattccgaatttcaactatttctaaattgtatttctatatggactctaatctcatcttctaatattccttattttttaattccgaatttcagctatttctaaattgtatttctatatggactctgttttttctttttcttcgattattgtgagaatttctatgccatgagagcgaatgtggaggctcctttttctattcatttaataatataatagattaatattacattggatatttagacactaattataagtattaaatgtagactaataataaaactaattagcttccgttcaaaactaattagcttccgttcatctcgttttcataccaccagactctgacactttacagatctttctagcagaagtgtttgtttgcgtttgcagttatacattggcgtgtttttaatttaatcctgtttggtagtaagacctatttttaagagattgtggatctcaattagtcctttttaacttccaaacgtccacataaatgaacaaataagactgttcatttagagtgccaatgtgatagcaacagcatcatttgccaaacaaattgtataactagttctctaataacgcagctttcgaattaaatgaggattgtatagagctcgcacatcaggtgcaaaaagtgatcgacccttgtaacaggatcttccacggctcacgctatcgggtgctgaacaagtgtgtatcacacaaatgtgtgtccatccaatattctttttcagcgatgcaacctgaaaaacacccggcaaccagagaacagaatccccctcctaatagcttctcgctccagcaaagcgaaacgttgggggtccaaaattccaaattactaccaacaaacccatcttaagccatctccatcgcttaaccccctcaaaacaaacaaaccccatcatctgagcaacgagcatgcagagctgacaagccacagccaccagcagtctgccactcacctagtcacacatacaaggtcaatcaatcctcggcacacccagacagacagccagctcgatcgccacggcggttaagtacagttgccgaaagttggcggccgctcgatcgaagcggatcgccggtcgccgtcgtcgttgcgcgcggagcgaaccgcggggagcgaacaaccgggcgcacgtncaacgaccagagcacgtacgcgcgcgcgcgctctcgtgctgttagctagccccaaccgctgataaaaaatccagcgtcttgatcagaaaccaaacagaatcgatcaccacctggctttagctagctagctttgctttgcaaaccgttgaatgatactgtccctgacagtgagagattacatgggcttcgcgcgtctaaccaattagtaacagtgtaccgtggcagacgcagatgctgatcgtcttatctgacgtgtgtagcagcggctctctccggcgcggtcaggtcaaagatagacaaaatgtagcgagcgccctctctcattgttccaggagtcagaaaaccggaatctccccgggcacgtagcgttgtcctctcctctggggcagcaaaacgtgcagacaaaacggggacatcacatggagaaaatccgctctcgacgtccggacaggggcaaattaccccttcagccgaccgaggtccgtatttgtaagaatcaacgtgggggttaatatagtgccgcgacctgtgcgattgccagtaccgattgtgtgtatgtgttttttctcttcaaactattaagttctactgctatatttttcctttaaaaagaaaaaaaaactgttctactaccatgtgaactctgcttaattttgtttggcaaaatttattacatgacacccgaaattcacgttctttgctggaagacactgtaagaacgtgtttttactgaaagacgcggtaaaaaaaaggtaaataggatacccccgacattatttaactaaatcaagagagaatggagagacaagcatttgttcaagataagtttctagaccatgaaaacgaacatggagactcattttttctattactttaataaggtaatagatggattgaaatccaacctctatatctacacaaccaaatataacatgcatgtctactatctagaagtttttttttaagaaaatggtttaaaacctagtcttggtacgcaaactcatagaagtgcaaacccaaaattcttataaggttttttttaaaaaaaaacattagcgataacctaaaaaagagaaacaaaatgctaaggccctctttaaaacacatgatagaaaaatcacatgaacaggacaaatgtagggattgaagtagtatgtttttctaatcctgtaggaattaagaacacaggagacagagagaaaagccctttgattacatcacagaaaacacttaataaaggaaagtttcacaagaggtctaatctcttgcttgtttttctatggaattgaccataggaatgcaatcctatgaaaattttcctatcctcttcctacgaatcaaagctcttcctacgaatcaaaggcctctatagaaaagaaaaatccttataaaaatgaatcctccaaaattcctttactaatcctctatttcaaaggggccctaaactttcatctcaactagctcccccacacctgaaacaaacacggtaatctcgtacaaccaaacttttagggctcctttgatttggaagaaaaagatagaaattttagagaatttcattcgtgcgattcaaaggggccctcaacagctaatagttttggggggtgttgctgattgaaatgtcacttagcttgcaattgaggacttgtgaagataagcatcgtttttacacagaagctccaaacttgtttgagagcgccaatttgcttgggtggcctattttggttgtaattttcaaggactttgcaacctgttgcattcgtgttctttttaagctatagcacctatttgcacttaaatacaattttgtgcaccatggacactatttactcgaacaaagagtaccacatttatgaaaactaagtgtgtaaatacagcaattcatgattagagttttagcacaggttcttccgttgaaatgataaaagtaatgatcataagatgttgctcgcattattgggactagatcctcacgcatcctctttattgtcgacaaattatttcactaaattcatctaataattatttttagtcaataggcattattccctaaatatttcatcatatctcaggtccagagtttcttttagattgattttcaaagatttattaaatccaatttttagaattagttaatgcattagttttggactctcaatttaagtaacatagggcttgttcgacagaactagctgttgcagccctgcatctgcgctgcaactgctgttattacaaccgctgtaactacaggtctgcagcaggacaagcttattacaacgttactacaatagccatccgctgcacgaaaatcctaacgggtgaatgatcgccccacgcgatcggtggcaaccggttccccttcccacctggtttctttttttttttggtcaccgtattatttttctcttttagtaagtttatacacctaaagtttacacatctaaattttatctacctaaagtttgtatagcgaatgtttataattcaaaagtttatatacccgattcaaattcaaatttggattcaaatattttatttgtagaatatttctatacataaagtttatgcgtgcattattttcctctttttagtaagtttatacaacctaaagtttacacatctaaagtttatccacctaaagtttgtagagcgaatgtttataagtcaaaattttatatacccgattcaaattcaaattcggattcaaatattttttatatagaatatttctatacataaagtttatgcatgcaaagtttacgatataaagtctatgcacatgaatgagagtaggggtgaaaatggtaacagaaattcccggccgtccggtgttcatttccgactttctaccggccaagccatacggaaatggtaatcgaccgataaaatatggaaatggaaacagaaatggttttgctgttatactgatcatttccgtatttaccgtattcttatggaaattaccgtttcttataatatagtaattactgtatttctaaatatgttgatatttatagggcatgtctctacttaacccatagtttagagtttgattgtctcttcaatcaaatgggcatcaccaatgtatatggcaaaagtgatccatataaatgggactcacataaaaggactttaactataacaatctccacaatgtatatagatacaatgttgcattaggaaatgagagagaaataaagatagatagtattatttattccatatgggtagtctatatgcttatggataccttttgttattttttctatatggaccagttgcacaatggtaataggtagctgaatggaatataatattgcctatggactacttttgcttcacattgtggatgccctgggcatgtctctacttgacccatagtttagagtttgattgactcttcaattaaatccctaacttgagggctaaaatggagttaatttataatttatatagtatagcttgaatttatttgtacatataacatacttatgtaaaattaaatatatgttttctatagtttaatgtttatttaccggtttttgatatgtaccgacatgtttctgtccgtattattccgtttccggttttccgatatttccgatatcgttttcgtttctggctttaccgttttcaatttcattttcgagaaaaatatgattatggaaatggttgaggctgttttccgatcgtttccaaccgttttcatccctaaatgagagtattagatttttttctaatttttttactaactttgtttttttgaaatttatgatgaaaggagagaagggagaggaatataggggggaggggcgggttgatcgctgggatcaatcacccgcccattaggggcaccctccgctgcagcgcttcagccgttcggctatggctgcgctgtacaaccgaaaaagctgcaggttggcttaccgaacaggcccatagcaatcaattaaaaaattaataattatctaacctaattagttaaattttggtctgtctatatggatagtcatatttgctttggctctcaatttagtatcatactagtatttcataactaaaatcctaatgtctgaaatcaataattagcaaattgtaatttgatagatttgttcggaggctatatataataatctaatatttgcgaatactgatggggatctcccagcgtgatgaatctcagcgaagccgaataattggctatcagggcagcgtgcttggctaaagcgaggagatcacgtttaatttttcaaaatgcctcgaaaagctacgttttctcaatgttatccccaacgcattgtcatgtggtctcatcatgcaccagcttgctatattatgcatgcaaatatatataagcaatgcatggagagtacgatcgatctccttcaattcgcggacatgccattattctaacgcggcttaatcactcatgcacttgtatgatttgataaggcgacgaagccagcaaggcaagtcacttgataattgatcgaaccaaaactccacttgttatcagctaaggattgcagcatatatacactgtacatggagtaactatacattaaacacgaactaatcagtccaatatactataattttggcaaaatgaacttatgaagacggttgatattatctaccaggcacaaggtgcgtgaccatcatcgagctaaaccggcactaagaacagtagaaccaataagatggacggtacaatgattgaagcgaatttgtgaagaaattgttggctagtgtatcctgctcctactaccagcctaccaggcaactagtatgatgaggaccacaaccacctatgctatgctatattccatccgtcaaaaaaaaaaaaccatagtttacgtgtctaacttttgaccgtccgtcttatttaaaaaaattataaaaaaaataaaaagacaagtcacgtataaaatattaatcatgttttatcatctaacaacaataaaaatacgaattataaaaaaaatcatataagacggacaatcgaagttagacatgaaaacccagggtttgccttttttttggatggagggagtatatgctatgcattgctgccattgctagggccaagagcccctctgctcagggattagtatcctttgcagtcactgcacggtgcttttgtcactgacatataggcctgatgtatcgtcaggtccacatgttaatgacaaagacacggtgcattcgactacagttgagagatcctcttctcagggcatttctaaatagaaaccacaatgtatcctcctactagtctttggagagtgaacgctgtcatacgcgggttttcctgctgatatgacggaggcccctacaagtcttatatgtattatcaactctgatctacagtgtcacgatgatacacgatttttagggcatccacaatctagttggaaagtgggtattagggattaaaatattcttactagctactaggtagatacattgtggaagtaatagtaaatagctattgccaagtcaaagcttaccaccaagttatatagcactttgtggtgggtcctatctattttttaattgtggtatggcttatatttagggttttttcagatgggtcacaccttattacccactctacacatatatattgtggtgcattttcaatctattattaccattttacatgagcccaccttattatctacttttacaataaacattgaggatgcccttaacgctgcccacctattgaggatgcccttaacgctgcccacctctaagaccgaaccacattaacacattataagaaggggttacccatgaacctgattaagattttttttccaaagtttatttatttttattatatgcacactctcttagcataaaacataaatatctgcatcagtctaaacttagttgaaaagtcatatatttcgttctaccttcgcccttagccgaccagcatttggtacaggtcgatttggtgccgtcaacctcagtccaccactacatacccaaggcacgagtgtttgacatgcccttaattaccatcttctctcgtagcatcgatttcttctcgccgcaactcaccaagtgagaaatcagctttcccttgtacttctccataatgcccttagactttatgctcactcaaatataaaaaggtttaacttactaacaaataaaaaatgttaatatttgattaattaaaatgacatcaattatttgttttaaaaattttcttttttgtgcatcaatgttattactcatggtagtcatcaagatttggttaaacttcaaaactttaaccatcaatagtttttcaaatgcttagtttaaatctatttttaaaaatcaaataaacctattttttaaagtttgtaataggtaatactcaattaaccatgtggtaattccccccactcgacgcggagcctttctctaacacaaaattaatggctgccatttaaaatagctcctctaacacaaaattaatggctgccatttaaaatagctcataaaatcgtatctgaaacgccatatatttataactgagagaattttgcttggcacagtatatgactagctcgaaaaacaaaagatcacatatgaacattggaaataatcatctaatttacatcttactagctagaacgggatgaactttagttgctattaaagtaaccggtatcttttatgttataaaaaaaacgtgaatttttcatgctatataaccaattttgtctttttttttaatagggaacatccatcttaaactagaaagagaaaaggaaggcattgcaagtactgtagcacgatatagccctaatcaacgcgtccccattgattgataggacaaaatcccacaattcatccgccatccgtgatcccgtgatccgtcagctgcgatgcacgcatgtgccaatgtgcggtgcgtgggggagtcgttccacagcgatcgagccggccaccccccaaccgccactttatttgccgccactgctcgcagttatactcgctagctctcagctcgtcggcccgccgcgcaccatgtagccggccggccggtcggacggacccctccaaatccaatcggttgatgcccgatcggacggccgagagatcgtcgcgcgcgtgttgttatcgagtatcatttgtacattcgcacacatgggccaacgacggacggctcgatctacgctagcttctacgagctcctagcacagctagtacagcacattaatccataacacgataaaattaagacacatcatgatgagccacagggtggtaccatcgatggactacatagagtataattcagtgttcacgttggtctattgttaagtaactactccctccgtctccataatataagggattttgagtttttgtttgtattgtttgaccactcgtcttatttaaaaaatttgtgcaaatataaaaaacgataagttgtgcttaaaagtactttggataataaagtaagtcaaaaaaaataaataataattccaaaattttttgaataagacgagtggtcaaacagtgcaagcaaaaacttaaaatcccttatattataggatggagggagtacacgatattgtaaactcgtacaatatattatatactgtacaatactccatattatacgtatttttttggcacatataagtatacttcctaagaaaatttaataacaaggtgataggtacggtgtagtcacttatgtagagccatgggtcgaagagaggtcatcgaagcaactcagcaagatccaagatggtgactagtagaggagaggcgacatgattatagggtagcgagtgacttagagcagggggaggggtttggaatggggtcaaaaccctaagccatatgagctttgggtgggatagaaaatttcaactccggtcacataaaaaatgcattagctcattgcctaccatagtttaaacgatagttttatgatctacactcatctcgatgttgtctagtgtgtggcctagacagtctcgaagcttctagacgtgatttggtttgttcaaactattatctaggcgaacactggctatatatttgaattgtcaactttatcttattacgtctaatttgtgttaaactatttggtgcatatataactcaatatacataatattggaattaaatgtctcgtactgaaatctagacggttgtgcaataataaaactataggtttaaaactaagtatcgcaaaactatagatttatgatttataataatagaattatctcaaaactacatattttggaggtctaaatcctacatttgagttatcaacattcatgttttgtaattatattaactaggaaggtagcccgcgcattcgcgcgagcatgtaccgtatgtaggatgaatttgagaaacttatagggacggtataccagcgaaataatatataaaatgtttcaaaactgtgattgtttttcatgagttttcttcattagcattacaaaatgaatttaaattttatttataaaattacatattgaagattggggttggtaacttatggtacctaagacatgactcttgaagtttcatatggaaagagaaaaaacttaggcctattgggatcatttagtccttagactaaaaagtttagtcgcttactgtttggatccagggatttaaaaaagactaaaggcatgtgctctgagcgagaaagaagaaagaggctgtcactttagtccctataagtaccttcaagagggattaatggattttagtttcaatatgcacttttagtcaccctgtttgaattcttagggactaaaatggagggactaatggattagccccattaaccaaatttggcctaagttataaaagacattacatatacaaccatatataattaatagttctactgatttatgtagaaaaaaatataataactttattatttgatggcagacatcgattggtcatagctacggataattcctcataggaaattataaatatgtgtacagtatagggatacaaattagaaaaaaaaatagtagaagttatgagaaaaaacaaatatatgactctcaatttttacttattcggtagtccgtcatttctaaccgttggatatttagataacctagcatattatgcatagtccaactaaccaaattattcatcttacctcatcacgtcatcacggatgttggacatgttaatctggataaatctatgtatctatgatttacatatataaaattttaagtataataaaaaatacacactactatgccaatgtagtgaacgatgtgtgtgacaggttcaccatggccggcttcaacatgaacatgatcacgcgtacctgacgcagcagctggacctaccgctggtggaggcctcgaacctcatcaccaacttcaccggcacggctgattccttcgccggccgcctcctctggaccatcgccgccggcggtgttctgtcccagctcggcatgctcggcctcgtcgtgtccgcactcgtccctaccctctgccccgcgccgtgcggcgctgccaccgccgccgcctcgtgacgatgactattttagattatgtatgtatacgtacgtacgcacgtatgagagggtgggactatgggagaagaggtgggttgtgggatttttttttctaaagataaatataatagttaaaaataataggtctagcgatttattattattattatagaaatattgggtccaccggtttattaaaatgccatgtggcggcttagaagcgtttgtaggagtctcacgtggcggcttgagagcgtttgtagaaagtttaatggacttttagtatataataatagatagatagatagatagatattaaacctgtagttttgtgataattttattactaaatttgtagttttacgatactccaccttaaatatgtagttttctgatacatcactttgaattttagttttacgataatttgatcaaagtatatgtagttttgttaaatttacttaaaataattacaatatatctttctgcaaagaattaaagaaaaagtgcaaaagtgttatgtagcttataaaccgaacatatgtgccgaaacaatggaaactatttttaggacaaaacttttacactcctatttgtagcgatctagactgagcaacacaacgatgaaaaatacccttaaattaattaaaaaagacgaaaatttaaattggaattgattgacgcctttacttctaacaagcagactcaaaatcaattctggcgatctcctgtaaaaggcaggagaaattgggtttgcgatctttatatgctgccagctgatcgaagcattaactaatctatcaagacatccatttatgtgacgacagcagtagcatctctaggttggtggttttcttaatcacaccgaataaatatatcgatcgcgattaagttggacctaaaccgcactttatttggagtacttggattcttcggttgtactactacagcctgcaactgcaaaagaagcatctcgatcggcccatgtgtttagtggcgcaatcatgggggttaagtacgggcagcgcgcgcctaaaaggcgttttaattaggtgtttttggctaggtgacatcctgttctaggatgaattcgtctatggtgaaatgatcggctggtttggtttggtttggtttgtggaattaataatcaatcacgctagaacttaccactttgaggaatagggcattgcgattggcatatctgtttcttttttctctcatatcattgtcttctagtactacatccttatatgttattttcattcagatcagccatgataggggcataaactattcgttcaaaaagataggggcataaactataacatcttatttatgaaagcaaacagttgtaatagattcaaaccactcaatcgatcctttaaagattaaggtatcatttgtggcatttccatacaacatcaaataagtatatatattccatatcaatcgtatggaattggatcctatccagtatcgcgtggatgcaagaaccgtcattgacaggttcttccaggttcatatatatatatatatatacatatatatatatatatatatatatatatatatatatatatatatatatatatatatatatatatatat

SEQ ID NO: 73860 - DNA, 31924 bp, Oryza sativa
tcatcctccccaatctctccttccttctctaccggctaggccgctttctcctaaaaaaataaagtgttttcagcggtggcagagtggcggggaggttgaggagagggcggaagcagggtgatgagatgttggagccgaaggagctcgagggagccgatgtggtagctatggtgagctgagtagcttgtaagtctgatatagtgaggtcaggtaggcgccggcttcaacccaatgtggccggccaggcctctcgcgtaaagcagcgacgcgacgatcgatgaccacaaaacggttcggtcgccttgagcagatcctcctcctccttcctcccctcaacctcaaggaagatgggaagtcgccgccatcgagctgcatagcgcgagtcaatcttgtatgctgcttggtagtattacagaacacagcaattaagaagagggtcatcaagtgcaagaggcacccacacatggaaggtggcaagggcatgcatgcattttctagctgcacccatcaggtactgtcatgaggccaacatgtgggtcccactgggcagtgatataagctaggaaattggcattaatttgggtagtactgaggaagttatttcaaaaaacatacaaactctgaaggctagagaggaggctcaagccttgatctgtgtggctcaagagagattgaaaaagaaagaggtagaagataggttaccaagtgcaattgaaatagatggctgtgtgtcacccccaaaaaatgctaggggcaaagagctgtgtgcaaatgggggtgacaaacagcaacaatacagttgtatcatgatgaatattctgttttcgaatgtgaggggtttggggaatcctggtagaagagagcagttgacagaaatattaaggaagaataaagtagaggtggtttgtttgcaagaaacaattagagtgagttttgcagccaatgaattggatagattctgtggggggagggactttcactggttaactaaaccggctgagggtcattctgggagtttgttaatgggggttaacttggagatggtggatgtagtggaagttgacctaggggagtttttcataagtatgttggtagaatcaaaaagagagaagaaaagatggaggattgttaatgtatatgggccagttcaaacagataagaaagatagatttctccatgaattgactgagatggtgctggtggagcaagaggctgtaatgatagggggagactacaatttagtaagaagtgctgaggaaaagtctaatagtataatcaacaagagatgggctgccaaatttaatgcttttatttctactgctgaattaagagagttacatagagggggaggcaaatataccaggacaaacaaacaaacaaatccagtgagggaagttctagatagggttttggtgtctgcttcctgggataatctggaccccttcactgttgttggcggtatggcatgaggcccttcgaccaagcctgccgaaaccatgcgaccagcgaggattcaagcccgaggcgtcaagaatagtcaaggcgaagctaacatggcgaagactatggaacaacgacggcgaggggcggagaatcgcgcggatctcgccaagccgaaggcctcttgggcgaaggatgtatggcgaagagtgtacgtcgaagggagacaacttcgccatagcaagtttggcctcacgggggccaatgaggccgaactatctcgacaagcctagtggccgttgggccaacaacagcctgacggcccattaggtgcccgtgaatctcaattacactgtatacccatgtaaattcccctgtgtaacctaaaccctagtagtaagaacctataatgagcctataaatagtcccatagggtcatgtaatagggggatcaaaaaattctcaatttaatatacttcacttcttttcagccaccattgagtgaccacgtccttcgacgtatgcggttgtcgtttcgacaacagctggtgccgaccttggggacctctgagcgaaaccactgagagcaaatgccaccgaagagggtcgtgaaggagaaggttacaaggcgaaaggaaaacgaagccggggaggatatggccgtcgaagagggagcagagccttcggcgtccattgccgaagagggagggccgccgcctgcctctgcacccgcaccatcattaccgacctcggctcctgtcgtctctgggcaggtgccgaacacagctgacatggcgaaggcagccgcggcggcaagggcactccagaccagggcggaggtcctttcgacaagccaaccgctggtgtcccaaactgtatcagcacagccggcgatggcaccgactgcgcttgccgccgctcaagtcaatcctgaccctgaaacacaagccgaagccgacatggaggccatgcggcaaaacatgacacaactccaagacatgcttcgacagatgcaagaacagcagcaggcatatgaggcggcgaggcgggccaaggccgcttcggccctaatcctacagtattcggcaggctatgtcccaccccaagtctttccacaagcgccgatccagccccttctgccacaggccacgcaagcgccagtgtacttcgccgggcagccttcgactgcagccctgcacgtgcagccgcaagctcagcgtgtcgctgcccaagcacactctcaaccacctggccaagtatcgcaagcaatggcagaaggggcttcggctctgcaagcacagcttcaagctttccttcagcaattcaaccaaccccacaacatttcaagtacaaccccttcggcccagccggagggaaatacaggtcaaggtgcgcctagttggttgccgtcgaaccagccgggtccgggggcttcgccttggagtcaaggaccgcagttcgacttcgtcaatgttgctccggcaccaaccgctcggccacaagcaccgacaccaggcttcgggacaaaccaagcaccaaaccaggtcgccatggcatggacccagactacgtttgacccatccatggcgcctcaccaagcatcaccaatcggagctgggcagccgaacatcatgatacaacctcatgcgcaagccatgacttcacccttcgccacgccatacccgcagcaaggtgccgtgaacagggtaggggacgaaaaggggctaccactgagtgggggaatcaagaatcgtccaatcccaccccagttcaagttcccacccgtcccgcgttactcaggcaaaaccttcagcacaggcgaaaacagacgcgaagagcaaatattgttcgatgttgtcgacatcccgtacaaatacaatgccatcttcagccgtgcgaccttgaacaagttcgaagtcatttcccaccacaattatcttaagctcaagatgcctggcccgacaggagtgatcgtggttatggggctccagccttcggccgcctcaaagggcgatctggccataatcagagctgtgcatattgttgaggccgaaccgcatgaccggccgaagcacgcaccaaaacccgcccctcatggcaaggtaatcaagatacagattgatgatgccgaccccacaaaactcgtatcgctgggaggtgacatgggcgaagaagaggccaagaatatcctagaggtgctcaagagaaacatcgatatcttcgcctggggacctgatgaggtgggagatgtttcgaaagatctcatcatgcaccacctggcagtcaagccggatgccaagccaaggaaacataagctacacaagatgtccgctgatcgccaagaagcagcaaaagccgaagtccaaaaattgctcaaggctgggttcattcaagaaatcaaccaccctgagtggctggcgaacccggtgctagtgcgaaaatcaaacggcaaatgacacatgtgtgtcgatttcacggatctaaacaagtcatgtccgaaggacaatttccccttgccacggatcgaccagcccgtggattcgacagctagctgcgagctcatgagcttcttggatgcatactctggctatcaccagatccacatgaacccggccaacatccccaagacagccttcataacaccattcggcaccttttgccacctcaggatgcctttcggcctgaggaatgccggggcaaccttcgccaggctagtgtacaaggtcctttacaagcagttggggcgaaatgtggaggcttatgtcgacgatatcgtcgtaaaaagccgcaaggctatcgaccatgcatccaacctacaggagaccttcgacaacttacgtgcggcgggtatgaaactaaatcctgagaagtgtgtttttggtgttcgcgcgggcaagttgttgagtttccttgtttctgaaaggggcatcgaggcgaaccccgagaaaatcgatgccattcagcaaatgaagcccctgtcgagtgtacgtgaagtacaatagctcacaggtcgaattgcgacactcagtcgattcctctcaaaggcagccgaaagaggtctgcccttcttcaagaccctctagggcgcgggaaaattcacctggacaaccgaatgccaagcagcattcgacgagccaaagcaatatctgcaaagcccacccgctctgatcagcccagcaccaggaagcgaactgctactgtacctagtggcttcgccagtagcagtcagtgctgccctcgtccaagaaacagagtcaggccagaaaccggtctatttcgtctctaaagcattgcaaggagcgaagacaagatacattgaaatggaaaaacttgcttacgccctggtgatggcttcatgcaagctggtagaaggtcatgttgacaagtcctttgaggcaaaggaagaaggaatgaagaggtatttgaaggctgttcggtctatggaaaaatgcttcgcaggcataacggtcgaacatttacctagaggccagaacgaggaagcagacaccttggcgaagtctgctgcttgtgggggcccacattcgctgggcatcttttttgaagtcctatacgcaccaagtgtgcccatagagagcttggaggtcatggcaatcgaccaggcagaactgggcaatgatccagaggactggcgaacaccgttcgtaaagtacctcgattgtggctggcttccggaagatgaagcagaagcaaagcgccttcaactcagagccgcaaagtacaagatggtctcgggccaactatatcgttccggggtgcttcaacctttgcttcgctgcatctcttttgccgaaggcgagaaaatggcgaaggaaatacaccaggggctctgtggcgcacaccaggacgtaagagcagttgcctcaaaagtgtttcaacaaggtgtgtactggcccaccgtgctgaaggtctgtgtcgagcaggtcaagaaatgcgaaagctgtcagcgccatggccgaagcccaactgcgccccaataagagctgcagcacatcgcactcaggcatttcgccagataggggttggacatcattgggccgttcccggtggcgcgaaacgggtagaagttcgcaattgtggccgtcgaatacttctcccggtggatcgaggccgaaccactcggcgcgatcacctcggcagtagtatagaagtttgtatggaaaaacattgtatgccgtttcggagtgccgaaagagttcatcactaacaacggcaagcagttcgactctgacaagttcagagagatgtgcgaagggctaaacctggaaatcaggtttgcatcggtcgcgcacctacagtcgaatggggcagccgaacgcacaaatggtaagattctagaagcactaaagaaaaggcttgagggggcagcgaagggcaaatggccggatgaaatgctgtctgttctctgggcccttcggacaacccccaaaaggccaaccaagttcagaccgttcacatcgctcgccgaatgtcgaaaccgcaacagcttgttttgggaagcaaccaaccgaacacccttacattcgattaatatgaaaaaaaaaagtgcttctttcagcacagaacgctacagatcgaaaacggacgccgaaagctgaaaagtcagtagacctatttcgctaatatacgcaaaggggccgacatgctctgacctaacgaaagcgcaaaatgtgacaatgcgaagaatagcgaaaaggaaataaaacacatctttattagtttcaaaaaaataatcgaagaatacaagttttacaacatgatacagcccagcttacaagtaaattacaccttcgcccccacagccaccttcgccccctaaggaatggttgggtgagctgggttcgtcatcactactaatatcgtacatgaccctgagaggggaggggggcaaaacacaggctagactgtatcgacgctgggagatcgcctcctgccgatcggtcttctgatggttccgccaaaagcgaaccatgtcctccaaacgctttgtatgaacatgatcgtagtcctccagggtctgcccagggtgcgcccgcatccagccggcaaccttcacaaccgtatagatgttgccgtttatcatcatatcgcgataaacaggccaaaacgcacatcgcgcctttggcaaacccttaacagccacgaacttcttgttcctgcttcgccaatcaccaagagggggccgaacacacaattttcggtgaacaccctgctaaaataagtgcagaaagggcaaagagcgaagtgcaaagttaggactctgcagggagagagtgggcgaaaagagtaaacactctgcagcatacaaaaataatgcgagaatgatgcaagcatatataccaaaagacatcgaccataataagtggctaaactttgagtcatccattccatatatccaaaaggccgttttcggctacagtaaggagggaaaagggccatcggccaaatgtacattgttcgccttccgtggcaaacacaagaaaagctacaaaaatctaaggagagggcggagggcctcacacctctgggtgatcttgggcatcgcctcgacccactccggccgccgcgtcctccccttcgccctggtcctccgcctccgccttcgctagtttctccagaaggtgcgccttggcggcaaattggccgtccttctgccagaactatctccgccacgcgcgaagcgcgagcgaaacgtcctctgcactgatctcccagtcccctttcacatagttggggaactcggtgacgtgttgtcacgtcctgataaattcattccgaaataaaaatcattccctaaaaggaataatagaattaattaaaattcgaaaagaaattgtcaaacactaaaatacgtgccagaaaaattcaaatgtggtccgaagaatttttgttaaattctccttggtctaaaaggagccctcaaattttacttgaattttcagagcaccgaaaatatttattaaacaacaacaacaattaacaaagtttactaaaaagaaaaactaaaatcctccttcctcctttgggccaagcccagccaaagtctccctctcctcctcctcccggcccacctcttccctccccctcccgacccagctccctcccctcccctctctctcccgggcctgcctctccctcctctcctcctgggccgcctccgggcccaagccgagcggcgccctcccgcccgtgccgcgcatgtgcttgcgctgacggcgcgcccgcatgggtcccatccccgggtcgtcgtcgtcctcccgcccggcctccttcctttctctctcccgtgcaaaccctagtgccaatcctccccaaaatccacgcgattcaaaccgaggtttccaaaattgattagggggttttaatccccattccttcctcttcaattgcccctaattttccccttgaatagcgccttaaatcgccaggaacggacgcgccaaccccggccaccttccatggccgccggccgagttttccgccgccgttccccgctcctcccgtggccggctccttccctttgcctataaaatggaaccccctcgctccgttccctcgttttagccccttcccgagctcccccgtggccgcaccacctctccccgcctcctccttctctttcctcggcgccggctaccctccagccgcctgtgccgcctctcccgtgcggcggctgacgtcgccaccaccttcctcggcctcgcaggtgtcccctctacgccggcctgccctccgtttcgcacggggaccaacggagacgcttcctcgctggtgtacagtggcgttgccgccactgtaccacctccagccgcctgtgtcgctttgccagagcgtcgtcttccatcgtcgctgcctctcccggcacagcagcgccatcctcttccccggccaggccacggcatcgctcgaatttcgccggaacgtcgtcgcccgcgccggtctcgccctccgcctcgccggagttccttcggcagccccttccgccgtgcccgtgcgtcagccggcgctgccgtctcctccctcggcacggtgacgtagccctccacctcatccactcctcggattcgcccggaagccgccgcacatcgccgcgaacctctccatccgcctcgccggaatttccccggtcggcccttcctccacccgtgcaccgtcggccgcaccaccaccacctccggcatcgcagcggcagggtcgccctcgacctcgcctcccctccatctgaaccccgccggtgttcgttatcgtcgtctccgttcgtcctcgtcgacgactcctccggtcggtcgttcctcctcgccggctcgtcgtctcgctgcgccgcctccgtcgtcggattcgcagcggtgtgttccacgccgtcctagtctctgtgcagctgccgccggctgccctcgttgcctcctcgccggtcccggtcgtcgtcctcatcgtcgtggtgttcgtccctccgtcaagccgttctcgtccgtcgtccgcgtccatcaagcgagccgtggcagccccgttgtcgtcttcgtcctcggctccgcgtcatcaagccttgtgccggccgtgtctcgccttcgtccaaggatcgccgccgaagtcgttccctcgccgttcgtctacgccgcgcccgttcgtcgttgtcgttccctcgcctcgtcgcgtggtggtatggatctctcctctcgctgccccgtcctcatcctttcggtgtcgccccgtacccgttgtgcggttgtcgaccccagtacccgtgtaccggtgtcggtagtcgttcgcttgtacgtgtggtgaccctgttagtgtgcccgctcggtagccgcgtggtttcacgtgtgcagcccgcgtggtgtctagtggagtccgtttgttggccactcgcctcggttgacacacggggtccgcttccgtcgacccgtggaccgtctctgtgtactcggtctaccgcggtcctttaggttgacatgtggggtccgcatgtcaacggcgcagccttcctgtcttttccaggctagtgcttgcacatgttttatagttgcaaaacctaattataataatccgcaaatctccatataacagcattaaacttcggatgaccatgtcttggtcatacgagctccgaatcgatccgttcaagtctcctaatgtttgttataacctaaagaaccctgtgctttctttttatgtattgttattgcttctttataggcttgtagctttgcttgtgtgcttcgcgtagtcttcgtcgttccggaggttcccgaagcgtggtttacggtcgtcgccgaaggttcggaaggccgttatctctgagcaaggcaagtcacatcatccttgaacatattgaatcccaatttataaaattattttgatttaaattaatgcattatcgctttatttaaattcccgcgttatcattgttttatttagccatgcctatttatctttgttatgaccttattattattgctattgttattattaccttgttcaccctaggataaacaaaaccccaactagtgggtactctattcatggttccactagtatgaatttaggtagatgcttcgctgattaattaggcaacattaggtggttttataactttagactttgggaattctcatatcatttggacactatggaatggttggcttatgttggaattggacacacacctccccctctattcaaaacccccaaaatggttttaggctgggctcgaggtgcgtggttgggttttgttagtcgtacctcgggtattataaggattaagctcgggcctctgttgtaaagcactaccgtacttccacatgtctagtgggtaaagcttagtttgtggctcagtctggttataaacaaaagtacacggatggagatagatgaagtcgggggtcgatggacatctctaggacaaataaaggctacacgagctgcggcccggtagtcgagatgtcatggcacagggctggtgtcctgctgctaggggctcaatcctgcctgcctgtcctggaggttccggccgtaggtgggttgggtcggtactcttgtttatggctaggatgggttgggaactatgtcacgtcttccgtccgtataccgtggtggtatgtggcacgtggttacacgtgaggaagatgtgtcttgtgggtaaagatgtacacctctgatcagagtataatctattcgaatagccgcgccctcggttatgggcaagcctagcaatgtacccaagttagtgttttaattcttaaaacctgcttaacaactaaaatgtggaatgggtggcctgggttggcttgggacaagctgggacccagggtcgggttgccagctcggtctgaatcatcgtaggccttgggttaaggcaggttcgtgagggttcacggccttgattaataacactgtgtaactctaggatcgtctttataaaatggctttgggcaactaagtgacttttaaatgctgttttctgcaaaacttaacccctatattattaccccttgtacccccttgcattaatcatgcatctgccggtgtggcttgctgagtactgtggttgtactcattcttgctcaatctttcccccccttcagtaagagaagctttggagaagaagtcttaggtggagtcctggcttataccccagttgagcgcctgtgaagatggagccgtaggcccgctagtccgctgctgtttattttttattgtcaggccttaagtgcctttgtaataatgtaaatattatcgatataataaagatgtgtcttttatatcatgtttgtgtggtgtaccccggcttttcctgggacggggattaatacactagcgttcgggaaaatgtatttttctcggtcgcgacacgtgctcgcagccgcactactgcagaaggcccatggtgaaggccactgacactcgcgcacagcaatcgccgtacgcggtggcacaatccgagatcgcaccaccggcttgttgggtccactccgagaagtcgaagacggaggcgtcctcgccaggaactcctcgaacccacgcccccatgtcggagagggcaaggcgaagtgtttggcgcgccgtcttcgcagaagcggtggctttcgccatctcccgcgaaaaccgctgcgactcctccgcagctctcgcctcagctttactgacctccaggcgaagagcctccatcttcagctcggtgagattgtaatagtcagtcagcgccacggaatgggctctttccttttcaagttcgactctgaggcggtcgacctcagttctagactctcttcctttatccacatcggccctaaggcgatcaacctcagctctggcctctcttcccttctccagttctgcctggagtcgcttgttttcggctttcgcctccttgaaggtgttagcgagggcctctatctgcaaacccttgcggcctaacacgtcatccttggcccgaagtcggttcctgaatccatcaagacgggcccacacggttcgcttagtcgaacagtgagccgcaagaatctggatacaaggaaaatcagacgaagggagcaaatgtaaattgagggttctataagaaagaaacaaagaataaacaaaaagagagctaaaaaaaagggggcatacccaaagcgccaagcttttgatagcggaacacccctcgtcgaactcattcagttcggtgaatagactcggggtgctggcaggcgagacaaggttgcttacccactcgacaaagggaatgagctccgcccgggtctcaaaatcgccaggggcaaagtggggcgccacgagagaataatccgaggcagatgtttcgacggccgcccccttccccttcggctagaccagcggcgaaacgaccggctgacacaaggggcttccgaaaaccctagccgcagcttgcacgacgcgatcagcggaggctgaggccacggcagcgccactgccacccgctctgctaacgtcgatcgaaagaacgggggcggtcgaaagatctaagcaatgaccggcgggcgaagtcggggtttcgtcagaagactcgtcgtcgctaaaaacacgaccaacgttgacgagtcctctcttcttggcggcctttttaactggactccccttctccaccttgccagctgaaaacgcgattagcgctctcgccacctccgaatcccttcgatgaaggggggagctattcgactctaccccggtctcattgtgccccggacttggagtgggagtgtagccaggggtttcaacgcggttttcgaccgcgtcgtccgcagcccttccgaccatggcctccgcctcctcttcctcctcgccttcctcctcgtcgtcacgatcttcgacgtcgtcctcgtcgtcggcgtcagaatgagaggaggaaggggcccttcgcttcctaggggccagcttcacttgcccgcgctgtcgtaaacccgatttgcccggccggccgcctgtcgtgtaagcaactggctgtactcgacaaccgacacgtcgccgatcatcctctgggcttcggcgtcggcctgatcggtagccatattaagcgtcgaattaggcaaaatagcgaaagctgtcagaagtgtgtagcgaaaggtgcagtctcaccgttcgtcccctcaggaagaaccagcttcggcaagccatcgacctcttcgctttggtcaaccgcgacctaccacgactgggagaggggaaaaatgcgaagcatgcagaactcctctaccaagtcgcgacagctaaggcgggagtaaactttgcgcagcaagacgaaccgtgcttccatagcaccgtccacggtgatcttgggtttccggttcggcgcaatcgccttgcgccgacaccggagggatttcaccgactcagatccagcctcgaaggggatggtgtgatagaaccacctcaccatccgatggcgatcccacttcgacatggcggcattcaccggccaaagatcggagcgctcggggcaaacattaaagttcacgctaccaaacaccgtcttcttcgttccggccagggtaatcaccgtcttcgaattcacggtggcgaaaaatatggctccaagagctcggcgctgggttcaaacccggatgtccggcatgcccagtcgaagatggcgatccggaccagcgccgacggactcaactgtgggagctccacctagaaaaggcgaaggatctccggcaacaacacgttgcacggaaaccgaagccccgcctcaaagaagacggcgaacaacactgtccgattgtcgacgggcttcggtaccacggccttccccagggcaaaagcctgcccctccaccaatgctccagagctgaccaacttcgccagctcggcatcgtccatgagagagagccccaagaaggcggtggtgtcgtcgtcgattcggccggggtctggccctttcaccgaaacagggtttggcttgcgaggggccatggcgaagggtgtgccggcggtggcgaaggaaagaacggaggaagagagcgtgtgcggtaaaaacagcaagtgtggtggtgaaaaggaaaaagggggggaatatatagcccacgtaggcgacggttcgcctacccaccaataggaaagcaccacgtgtcgcaagggtaggtgaaacggtaaattcctattgaccgagccgcacaataataagcccacgaagggaaagcccattactatttctttcggcccgggaaaaataaaatatatatataattcgaccatccgcaggaggcggaggctgcgaaaacaatatcaaccgaaaagacaacaaattttatttgcaggaataatataggtttcggcaggagcatcggtcgaaagagggcgtcacataccataccacatggtttgcacggtctcggccgaagctcctatctcacccttgcccgtgaggggcttgttggcgatatggcatgaggcccttcgaccaagcctgccgaaactatgcgaccagcgaggattcaagcccaaggcatctagattagtcaaggcgaagccaacatggcgaagactatggaacaacgacggcgagggacagagaatcgcgcggatctcactaagccgaaggcctcttgggcgaatgatgtatggcgaagagtgtacgtcgaagggagacaacttcgccatagcaagttcggcctcacgggggccgatgaggccgaactatcatgccaagcctagtggccgttgggccaacgaccgcctgacggcccattaggagcccataaacttcaattacaatgtatacccatgtaaatgtccctttcataaggacaaccatgtaaaatcccctgtataacctaaaccctagtagtaagaacctgtaatggggctataaatagtcccatagtgtcatgtaatagggggatcagaaaaattctcaatttaatatacttcacttcttttcagccaccattgagtgaccacgtccttcaacgtgtgcggttgtcgtttcgactacaactgtggttcagagtctaacaagggtgggatctgatcacaacccaattctggtggagttggaaaatcaaataaccccttctggtcctaaatctttcaaatttgaaaaagggtggattcagcaagaaggttttaaggcttggataattgacatatggcctgagaggaggaaaaaacatatcctagatcactggaagtgccagagatatatcttgagaaggaaaatgagaggatgggctatgaataagaagaaggagataaacaaggaaaaagaggagctcatcagtcaaatacagaaaatagatgaagaagtggagaagaaagaactgacatgtgaagagtgggggcatagatatgagctggaaggtgctttgaaccagattttcatctctgaagagatttattggcaagggagaagtggggagaaatggatgttagagggagatgccaacgcagccttcttccatggagtagctaatggaaggaaaaggaaaactacaataaggagtttggaaggggaggagggacctattgagaatgctgatgagttgaaagagcacatttatggtttttataagaaactgtttggaatggaattacctcctaaattctgtcttagccataatatgtgggagggaagaggcagactttcttcagaagacaatatagaattaactaaaccattcagtatggaagagattgagggtgctttgagagaaatgaagactaatacggctcctgggccagatgggttctctgttagcttttacaaagaattttggcctcaagtgatgtgaccatggctactatggatacgaccattgctcacatcatgaatcaacaagaagacatcaagatcaagtcctccatgtgctgcaatctgattcggccacgtgctacattgctgacttcaaacggccgccaaatctacatacgtgctccgttttgggcccgtgagtacttaatggaaagctctcgaagtcctccttccaacgaatccagcctcatctcggaattctatcttgtttggccgcaatcacataagcaatgtgctatgtcacctgtattgggccaatgggcttgtaactttgtttgggaccctggcccatgtggggtgcgccccaatctggtggagcacgacccttggaccctcttggtcgtcctcccacctcaataaataggtaggtaccccttcagggtttcttgggttttaattaattgtaagtttagccattgctacttcgcttgcagcgtgcgtgtcggctaaaccgtccgtctgcttgttcggaaccccactttatcgtgtatcaattcatctttgtgcatcttgtctatctagcaattcagttgctttatatcttgttcttgcttgttctcgattgcttgcaggaataaggttgatctgcaccggcaagatcaacaacccacggagaggtgtatcgatcgctaaggcgcaacgcaacgtcttgtacggttgtagtcggatcgtcaacgtttctcccaaatcgtagttatcatcaactcaccgaaagatcgggccaacaacagccttgagtgtctcgagtggagctcagggttcatcaggtggtattagagctttcgttgctcggtgagtttttatctacctattatcagaaaatagccacaaaaaaaaattgcatcctgtacctagccatctttgtgcaattgctttgttctattcagtttttgctttgttgaattttgtgttgcatcgtctcgtcgtgttgctggtcttagcatctagttcgtttagagtttcgagttttggtcacgttttataccacagtcgtcatcgcctccgtgtctctattgtcgtcgggacctacgaaaacggaatcggcttgctgccacggttctatttttgtagttttcagaagtttttatcggtcggttttggtgttgcatcaagggtttgttgtttacccgggcttagtgtttgtggcgtggttctgttttgcccatgaggaagaagaaggggaaaggaatatagaagatctgtttggattcggttgggtggaaggaaaaaaaaggaaagaaaagaataggaaagaaaaagaagattggattaggtggaaatccgtttccttttattttgtgcatcgaatccaaacactagtgctggccgcaatattcagctccacctctccgtgcgaccttcctccctctgagtccgactcctccctctcttctatcggtttaagatccataccgtgtcttcccgcatagcttagtgaaaatttttagagtgtcggattggagatccgtttggaaaaacagaaccagtacaaattcagcattccatttttgtataattctaattttgggtttggacttttgcatttaagtccctgtaattttagtatttacatttgagtccatgtaattttgcattgaagtccttgagtcgtttttgcagaaaaaaataaaaaaaagtgagaaaaggcagaaaggtgcatacaaaagcaaaaaaaaagccgcaccaaaaaaaagaaaaagaaaaagaaaagaaaaaaaagaaagaaacaaagaaagaataaaaaaaaagaaaatcagttgtatttttagaccattttcatgtatcagagttgtgcttgagttgtgctatcttgtcgttcgtttgtgtactaggctcgcgtctctagtacattctagcctaggacaagcacggtacttgactttgaatgatcattcaactttttattctctagattgagcattttctattcctttgctacatatttaagcctacccagagctctacagatttgattacagccgtacagcatgtgtttgccaaggcatcgatacatccaaactccggtggggtgcttggttgagtcggtgtatgtcaccattccacttgctttggtaagaacttgtaagagcttggttaaaagcttgagtgtgtgtgatatttgagctgccactacctagtagttgataagagcgtacatattcttgtgtgtgttcttgtttgctactaaccatggcaggattgtgcaaggggaaacgagatgatcatgctcaacatcgacttcttcaccatcaacgagatatagtgacttcttcacgcatagcatatgaggtacatgataatgatcttgcaaaggtagaatctaatttgccagtttttgatggtaagtatgattccgccgcttatgttaattgggagctagcagtagacaaacaatttgatgagtatgatttctctaatgctcaaatgattaaggctgctagtaataagtgtaccggttctgcatctttttggtggtatactgttggcaataagcttgaaacttgggatgaatgcaaaacaatgatgaggaaaaatattgtgttttcatattataagcgtactctccttgagaaattagaacatataaaacaaggtgataaaaccgtgcgggagtactttcatgactttaaaatttgtatcacttatagtggtttaaaagaaaatgagaacacaatgactagattttttagagggcttaattctgatattcaggctgggcttattaacgtaacatataatcatataagccacttgttcatgcttgcttgcagtgttgagagcaatattttaaagagcccaagggagaaacgagctatgcttgtgcctcctattagtgacattttgcagggagctcagaacattcaccatgaggagaagagcaatatgatcgagatgccatctacatcgctcacgaaggaagaagagaagattgatgcacccacatcattcgaagagagaatcacaagtaatcttaatggtgcagcaataaatcaaggtgggtgtgttgttaatgaattgaatttgtccacttttcatgctatagtagagcaaccattagtggaaccaattgctgagatgcctttgtcacaagttgatttacttgttgttccttgtgataaagaagagttgtgtcataatgtttcacttatatccatgccacaactagtgaatgaacatgttagttctactatttctttgtgtgctgattctaagcatgttgttcacattgctaatgaagtagaggaacgtgaattactatcttctttaaatactttgggctatgttcagtttgatgatttttgtgagctcgataatttgaaggagaaattattagctaaatctgatttgccatgtccaactaatgctatttttcatatctttggcgaatataatgatagaggaatatttttggtgcatagagtttacatttgttcggatttagaacaccttgtagttctggataaaatatgcaagctagagagacatgttaatgctaatcatattatctcgagtttgtcttgttttgattgcaagaaacaggttgttttcagtggaccaagcgaagagcaccatatggaaaaaccgaggacggttttccatgaagaaggggaggatgatgtgaccatggctactatggatacgaccattgctcacatcatgaatcaacaagaagacatcaagatcaagtcctctatgtgctgcaatctgattcggccacgtgctacattgctaacttcaaacggccgccaaatctacatacgtgctccgttttgggcccgtgagtacttgatggaaagctctcgaagtcctccttccaacggatccagcctcatctcggaattctatctcgtttggccgcaatcacagaagcaaggtgctgcgtcacctatattgggccaatgggcttgtaactttgtttgagaccctggcccatgtggggtgcgccccaatctggtggagcacgacccttggaccctcttggtcatcctcccacctctataaatagttaggtaccccttcagggtttcttgggttttgattaattgtaagtttagccattgctacttcgcttgcagcgcgcgtgtcggctagaccgtccgtctgcttgttcggaaccctactttatcgtgtatcaattcatctttgtgcgtcttgtctatctagcaattcagttgctttatatcttgttcttgcttgttctcgattgcttgcaggaataaggttaatctgcaccggcaagatcaacaacccacggagaggtgtatcgatcgctaaggtgcaatgcaacgtcttgtacggttgtagtcggatcatcaacgtttctcccaaatcgtagttatcatcaactcaccgaaagatcgggccaacaacagccttgagtgtctcgagtggagctcagggttcatcatcaagtgagagatcaaattaaagagatgatggatttgttatttgaagggaacttggagttatggaggatcaattacggagtgatcactctgataccaaaggttaaagatgcaaacacaattaaatctttcagaccaatttgtttgttgaatgtttgctttaagttgctgactaaagtgattgctaatagactgtctaaggtggcccaaaagacaattagtgaaagccagacagctttcattcctggaagacaaattttagatggagtggtaattttacatgaggtcctgcacgaggtaaagatcaagaaacagtcgggtatcattgtaaagtttggctttgagaaagcgtacgataaggttcaatggcagttcctatttgatgttctagagagaaagggttttgatgaaaaagtgattgggtggataaaacatgcaacattgaatggtaaagtggcaattaacatcaatggtaatactgaggagtttttcaggacttataaaggggtgagacaaggggaccctctgtcccctctcttgttcaattatgttgctaatgcactatccgaaatgttgaccagagccaaagaggcagatcatattagaggtttagtaccacatttagttgaaggaggattgacatatttgcagtatgcagatgacactactctttttatgtctctgtcagatgaaaatatttgcacggcgaagttcttgctgttttgctttgaagaaatgtcggggttgaagattaattaccaaaagagtgaggtgatcgtactggggggagggcctgaggaaacaaaaaagggtggctgatttgttttactgtaaagtggggtcactcccaatgacatacctaggtattcctattcatgaggggagactgacagtggtggatatggaagtcgtaccaagcaaaattgagaaaaggttgggcacatggaaatgtggacacttatcaaatggacaaaaaaatgttctgatcaactcttgcctcagtagtatccccatgtacatgatgggtttcttcttgctgcctgagtctacacatcataagatgaactctatcagatccaggttcttttgggaaggactggagatgaaaaggaagtaccacatggtcagatgggaggctctctgcagaccaaaggactttgggggcctgggcttctcaaatactagagtgatgaacattgcacttttgagcaaatggattattaagctggagtcgggttgtaatgatgcttgctgcaagttgctaaggaataagtacatgcaggaaggggggttttttcaatcaaatgctaggggagcttcacagttctggaaggggttatacgaaatcaaaaagtggttaagtctaggcagtgcctacgaactgggtaatggtaagtcagtgaggttttgggaagatgtttggttgggagatacacctataaagactcagtaccctaacttatacaacatctgtggagacaaggattggacagtagggcaatgttgttcagatggggagtgggagattcaattaagaagatctttgggccctgatcttttaggggagtggaatgatctccaggacaagtttttgaggagttcatttaacaaacgaaaaggatattatggtctggaatctaacaaaatctaggaagtttacaactaaatctttatacagggaaattttgtttggtggggtaagagatgttttgatgcaagatctctggaaaatccctgcgcctcttaaagtcagaatcttcagttggctagtggttaaaggtagaatccaggtggctgcgcagttgaagaaaatgaattggaaaggggagcatttttgcaaattgtgcgggttgttgaagatgtagatcatttaatgtttacttgtgccccagctaagttcctttggtgttgtgtaagggatgctttactgtggaaggaaattccaacttctagagttgaactattggatattactaagagtgtgagcaacaggagggctatactttgcctctttgcagcttgtttttgggctatttggcttgttcgtaatgattgggttttgaatgataaattgttaaaagacgtgacgcaattacctcataaggtgatgtcgttcttgatgcagtggagaagtttggcgcaacaaaagctgatggggagttggatacggttcaagtattactgcgtgccaacattcactcgttgggggtccaagggatgcggcaagctccaggacaggggtaggcgtggtccaggcttaatctagtttctttttctcttagtgtgatcagatgtaatctctctggcttccctctctcgaactggcttccccagtttattttttttcttttcttgttgtatgaacctcgtatgctttttatgaaaagctgggctgagcgccttcgtctaaaaagaaaaatataagctaggaaatcacataaacagctaagtcacaaactatgggcatgagcagttttcccatcctccttttcatctacatcatatccagggagtttaaaaatatgtccaagcttcaggaagtagagatgtgctaggtgccatggttaaaagcgctatcgatttacaacgttcaagtcaactaagtggtttgttcgtattagctactcccttcgtctcacttactaagacacgattaaacttggaacggtctttaaaactacattttagcttaaaattatatttatatatatatatatataaacgattgtacgatacgccatccacaatgtgatacaaaagtactccataggtattatagggtctgctcactttgatgtcattttcaaccataccattttttttggcaaagttactaaaattttggctatgtttagtttgttgccaaattttagtaagtacatatgaaatcttgccaaaattttgacaatcttactaaaatttggcaatgccaaaacttggtaagattaaaaatggtagcaaagtgaacaagcctataatattctattcagctacctattaccattgtgcaactagtccatatagacaaaataaccaaaagtatccataagcatattgttaatgaccaaatttggtaatatcagcatcggagacgaaggatagatcgaagcggaatcgaagatgaggattatcgcggaagcagagcaagaatcagttggagtccggatcggctacgactaggatcggctaagtttgagtcagactgggttaggtaatacagccgattccgacaatatgactcgtatccaacatcgggtttgagttggtgtgcttcaagatgattgccatatatggatagagtcctgagaaggcaattgtatctattaattaggatattttatgtaaattccttagagataaatatgggcaaaagtccgccgcaaagacttatggtatcttagagtttgttagagataatagtcgtgtccggtatggatatatcttgtaattctcgggtataaatagatctcgaaccctatgtaattattaacacacgttcaatacaatctcggcgcatcgccacccttttactttcattttgtttagacgagctcttgctttcgggttgagctgcatcggtttcgatcttcaacaagaggtaaaacttgttatgacgacttgtgttctcgagattagtgcttccatctttatgatactctaatcttgtttatgtaattcgtcgagttatcatatatttcacataatccttgataatatcatcatctaacctatattcggctagcatctgtcaatagaaggtagccgattaggttaaataacgatgttgacttgaattatgtgatatatctaccactccatgaaacatccaacggcttgattgtctagatattgttcttcttttcatacttaatgctgcatcagttgagtttaacctattaagtcgtgcttagaaccataatatctagcatgccttctggttgccgattagagtagtatcggagtttcagccgatcttacctgatttaactactgtcatcctatgtgcttgatcgatatgttaaatctgccatttatgttaagatattgttgtatttaagtatattaagcttctgtttggtatattctgcttattttaatatcttaatatagagtggtatcggagtactagccgatacatgctagatctatctgatcggctatgctatgaatatatataatctcactattaacatatatttcgatctaagtgatttatactgtctcggcaagatgaccgatctatcccaatcacttgatttaagtatatatcgatataaggattatatatcattaatatctacagctgatcgggtagatttagttttgatttgcttattaacacttgccgatcaatgtacatatgacatcggcctatagataaatgatatgtcatcggcacctagccgatcggctatcatttatggatttaatcacggtttctttgtctttatttcttgttgattgtaggatcaaatcaactgtcacgctcatacatccgaaggcgagttttgaacctgcactggagttaagcagatctcccaagcctcgtgttttctgtcaacacatatgtactacccatatgaaataaataatactatttatcgctatttctctctcatctccaaatgctaccttgtatctatatacattgtggagattgctatagttaaagtctctttatatggattccatttatatagatcactttagctatatacattggtgatgttctaacaaatttttttcttccctggtatggcattgtttcagttgatttgatttcctgtgtcaccggagggtacacgccaaaatatcaaatcgtgtcctatataagagggtagaaatgtcaagccaatcagaatgggtacgtaccctcatcgctcggtctcccatataaccaaatgatgtacaatgcaaccactgcttcgttgaaaacaatcaccaaagttggtataggtgtcacccaactatctagggtacatgtgtgctcgcgtgcagattttccatctcatatatatatatatatatatatatatatatatatatatatatatatacacacacacacactataacgtttgtagcaacataccataatcttatatgaaagtaaaattaaatgataatcaaattacattattatcatcaaataatatttaatttataataatatatttattggtcaaatatttaaacagttaaatcttaaaatgtgtgtgctcgttagtgagtgggacggagagagtattctttagggggttttgtgttatcagctcatgtggtttcttcatatattttactaggacaacctactagttgataacttgatatatagagtaaaacttggttaaaattgatcctacagataaatttttagagagtggcaaattgggcactatgttaagaatattattctcggcttctaggaaatgattcacaatactgaaatagtttggtgctttgagtatttaaatcctttaagtttgtccccgaaatcaccaccgcaaacccagaagaaacaccataggaaatccaaaactgatggcgacaccgagatacgatatttggtaacagagttcaaccgaatcctacatcacctggcactgattatggatgttgttaacgcttttttaggtcaacacaatatcacctaacgatttgcgatgcaatcaatagagtcgccaaaatcgatagatcaaaatcggctagcagagccgatttcaaggttaattcactttcgcggaatcaagcgactaatttacaagcaaattggcaaagaagataaatatcgtacttacatgacgacgaacgactagtttccgagcaaactaacaaaggataacattctcgctttcgtggagaagcacgaccgtttttcagcgtaaaacggtaaagattaaccaaatgacttggccatgaaaacaaaatagaaaagaacagaaagtaaagaataggaaacgttagattgataaatggtagattgaaattgttcgggcctctcgccaacgtcggagctgtaaatttatactggcaccacacccggcaccataggtctcccttcatgttcggtggatccatccttccttcctatccgagtcgataccgtaggcatgtaatcaggctgatgatgatcttctataatgtaacatcctaaaaatccctaataacaaaaatcactaaaatttcaaactttttaaaacttttgcaccatgctggtgttattcgtttctctgttgcaaaacgggttgttttaattgatgaatatggaaagacaaatgataaaaactagaatatgggaaaactaaggttagaatctataatgttgggaataaaagaaatctaggttagttgtgataatattaattcttaatttttgggattcaataaatcatgaaattggaagtgttaaaatatagataaatatctgaaagaaataagaagattaaaccatctaaaaattattcacacaaaaagtctagaaaaagccctaattgtgatttttctcgggtcgctactgttcattgcgcgccagttgttcgatccgcgcctaacccgaccgaacacccgacgcagccctctccaatcactgccatgccgcgcgtgtgccttccgacccgtgcgccgcactagtcatgcccgtgcgccgcaccgcgtcgcgccacgccgcgtgggcccgccgccgaccgagccgccaaaaacccgcgccaaagctgcgctgccacgagtgcccgcgtcatcccgtcccctcgcacatcgccttcgggattgagtgataacggccgccacaacgaccccgcgtcaccctagggcatagccctgcgtcttccctatcgaggccgatatcactgtccgtcgccgtcgctcttgtcgccgtcgcgtcgccatcctgtcgcccacaactgagaccgctggatattagggtgctccttccctagctaatgatccctctcctggaaccctatcatctaggcaatcatgccggcacagtgcattgaactaaacctaggagagatcgaaacgtggctgagtcatcgattgaccttatccagtaggaatcgccctcccctcgcttgtataaactcgtccctagctcgttcttatcctaacccaaccttccattagctctttcccttcctaaaactcttgctcctccgaaaaggagcaaaaccgcgccgcccgccgggtgtcgaacacctggtgagcgggggttgcgccgccgccgcagggcctctcggccgatgtgggtggcggggtgtggagaggaggtgctcgcactgctgttaccgccattggagggagccgggagccgttggacgaagagggccgggcgtcgaacaccttcaagcctcgccgaccgccgtctgcccctatttcggccgcaccgcgccgcacgccgtcgaactccgccgttccaccactccgtggtaagccctcgcgcccgtagtattgcctggacacctagaagctatcggccccctcgatttggggtgtgagccgccgtagccgtgccgcctccgaccgccaccgcgccatggccgagctcaccgtggagggacctcgttccaatgcaacctaggctaggtttttgcttctatatgctccatgtggacccgagatggttaaatcgtcgtcggttgcgctcgtattggtccccattgtgccgccgccgattttgagatctcggcgccgccacacgccgtcgcgtcgcgccgagcattcgccgcgtttcgccgtcgccgccggcgagcattcggtggtgccccgccgctcgccccaccatgcgccgagccgtcccggctcgggccgtcgcaccgccgcgcgccactcctctgtccagccgcgtgcgcgaggaagaagacgacgggagagagaaagaacgagagagggagagattatgacatgtggaccccacttcattagtgcacagtaatccccaaactaatggtattattatgagtctatgacatgtgggcccggatgcttagaaatttaattaaatgaggttttaagtaaatgtatcaatgacatgtgggtcccaccggtgattaaagggctggcttgacctcagtcaacaaagggttcggccccacctgtcagtgacacatcgcatttcctttaggaaaataaaaccgagaaatggaaataggagaacggcccacatgtcagcctctgtggtttatggatttgtgttaggaataaaaataaatgaattaggaacagtaacttttcacaatttctcgaattaattcaaatttgaatctttaaaccctcataactcactcattttaactcggatttgaatgaaacttgaacctaaattcatctaaaatcaagatctatctaatggtaccattttctcaatttaatttgtactgtttgaatttttggtgatttaatttgaattctaattgaattcaaatcaaatccttcgcacgtaaatatagattccgagggagtagctgagttgactgaggagcagggacagcaagactgtgatccaggtaagtcatcactaatctttgagcatgttgaacccattgtgaacttattttggatttaaaataaagttgcatgttatatggatatatgtgaatgccctactttgttatatgccatgcctttgatattgatgatccatgcaatccttgtaatccatgatatcgtatgtctttactcaatatttggtaaatgcttagccatgctactttatgcatattcatatttatcaaaatgctttatgcttgggcaactacctttgggaaggtggttgagatgcggcatgtggagacatgagcgccatattgccatgacatttgtgacaggatttgtgaaaggaaaaataaaactaaacaactgttttcgactggggcggctgggtgacttgggtggagtccgataaaggctagtgccgtccctagtcaattaaggaccgagccatgaagttaagcatgaaacgaccccaatagaaccgtacttctcgtatgggtatagacctagcggagtaaatagccgagcggaggcagtatccctgcatagtggttttcttgatgtgtgtgaggcagggcctacggtggggcagccattggtaggaccgcgagggacgggtgcctacagtggtgtcgccatcggtaggactgccatgtgtaaacctaaacttaactataacttaatgcatgtgtgagtctttccttcccgggagcgccagaactcctctcactgctagaaaccgtgtacgcctagagtgcatgaggactcaagttcatggagcgggtactgccaaagtgaggtggttgaaaggctttgccgtggcaattctcattcgttgggacgtagggtcatgtgttgggcaagtcacggagtacgggtaaagtgtacatccactgcagtgtgagtaaatcaatctattcgaatagccgtgctcgcggttattgagcaccgggacatgtattacacttggctagactcaaatttcctaaatatgaaagggatgggatctgcatgatgattttgagctggtggatcaacttctcgagaggcgagaaggggtaaaccccagaaaacaatgacgaccagtaacgggaagccatctttgggaagacaatggatggtgaacagaaccgttgctgtgtaataaccactggaattaaaacttgactagtttatgctaaatcttaggcttgtgaaaaaaattgtgaaactagctttacgcaaataaaccaaaggccacaccttgaatacctctatcatacgcattgttgttgtggtagcttgctgagtacggttggtactcactcttgctattacaaatttaatcagtggatggcaatgaagtcgaggaggatccctatgcttatcttcaggaggatgcggaggatgacggcgccccgtagatgttagttacggtcgttgcctgtggcaatggcaaggccgctgcttaaattccgctgccttatctatttctgcttttgcatgtattccagaccgttcgggcctatgttctggtctatgcatgcgggcctatgatgtaataattcgcgctagacaatctttgtatgtgcacttgatatttcagcaatgtaatcgtgagtaccagactatttgatccagggaaatggtactattaacacgagtgattcctgttataaaaacgggggtttacatataatcttcaccacgtaccagtccacctgattcaccgttgtggctatccaaaactcctaatcatccggctgcacctgcatgatctgtatacatatatgcatatctccaaaataggtaaaattctacagccacccaacaaactgcacacacatttgaccaactctcaagcaagccattcaatgaatcgtgaagctaaactaaacaatctggcatgcctaaatgaattaactactagccaaattatggcataaacacatgccccctgttttcggtataactaatgcgtataacttttattttaccgaaaacactataaaattaaccaacccaaaccacaattattctctcagaacgatacaccacacacggtatcggttctgagcccatccacatccacagttgtcctctcaaaacgatactcagataagtaatcgttttaagaccacccacagtcgtcctctcaaaacgatactcaaataaataatcgtcctgagataatcaagctccccttcctaacttggcgaccaacaactaaacttgttaccccaagcatcaatggacaaaatcatttgccatactaaattatctatttgaaacgatttttcccttattatcttcatataagcctcaacccaatcatgacctacacactttgaaagcaacacatctatagttcggtgatataactgattatctacacactttaaaatccatcgctgaacttcctatctcaccagtctttcaaataatcaaccaaagaatttttcagatcatttggtataaatttaactggtaattcggttgtccctaatgtccacctaaccgaattagctcatctctgggcagttcttcgacataaaacattttaaaacaaacccatcttaactttgatatattttaaaaacaactcatcctatagctcggcaatataattcatcatccaacaaaatatatctcaaaacctatcgccgaacttttctatatatgatttaacctaggcttttcaaataattaaccaaatattcactccaatcacctagtcactactgattcgtgtaacgacccgcctctcccaggccgggcccgcttacatctggcagctttcataggtcatagagtgccctcacagaccaacacaagtcttttctgcacactttgtcctcactcgtgtgcaccgggaagaattttccggtcggtcacccattccaaattgctccaggccaagcacgcttaaccctggagttctttggagatcggcttccggaaaagaagctacaacttgttaatatgagtattctattaatcctattaagccctaggccgggatgtcacatcctcaccccctcaagagagatcgacgtccccgtcgatcaaccccaggccaggaacgtcccctcttgggcacgtttgtgtgcccagtgccagcacatgtgccatgctgtgtgaccactccggatccacaccagccatgcgcaccatgcttgctcaactgcgacacacgcgcccgtgaaaccgcgagagtcggctctgataccattttgtaacgacccgcctctcccaggccgggcctaattacatctggcagctttcataggtcatagactgccctcacataccaacacaagtcttttct

SEQ ID NO: 73861 - DNA, 14365 bp, Oryza sativa
gaccctccccccccccgagagggccaggccacgtgggtgactgcagctgccccaaacctctagtcaagatacccccggtcccatgtcaccgacagtagcccccggcgttacgctagggcgatcgcccccccccccccctctccgagggaagcgcttgggcatgacgccactccttagacctggtgacaggtggggccggtctccacaggcggcagaaacccagcggtcgcaaatcgcgcacatcgtcaaggaaaaaaccgaccaacaataatgagcggcttccttcaagaccgctacattacttaagtagcgcgcgaaccgagacaagccggttcgtttcgcctggagatgtgatgacggtgcatcggtcggcgagcgtagttaacgcgcgcacgatatgtcccatctcgactgccacggccgcacatccgcctcgtgcgctgcaaacgggcgagcgggattagtggaggcgtgggcgcgagagacgagggggcgaggtagtgggcgtggggatcgaggagctgggcatagcgttggcaagggtactaagacatcaaggaagggatttgtttccttcctctcgtcactcttccctttgcctttgccacttgtgctctgactctccgtttccggcgccctacccttgccatactcgctcgctctcaagctcctcctccgccggcgtcatggcacggggctccgcaccgctcgagggtagcgtgctgccgccttcccgcatcgtgagcgagaggcaggccgggctgccgcgccgattcatgccggaatctgccactggccgggaggtggtcgcgctgggcgagggacgcccggcgccgcattacccggggtggtccgtcttcttcctctcttttgcaatggcagggctggtcccgccattctcttgtttcttcatggatgttctggagctttatgatctccagatggcgcacctcacccccaacgcggtaatgacgttggccatcttatcgcacctatgcgagatgttcatcggggtgcgcccatctctccggctgttccggtggttcttcaccgtacagccggtgtcgccaccgtcggtagtcggtggctgctacttccagccgcgagggccggtgttgaaccgctacattccctgcgtccttcgcaagaagtgggacgactggaagagcgactggttctacacccctctcgccgacgaagcgcgcctccgacttccgagccagcccccggcgcaggtctccagctggcgggcgccggtagatctaggagatggctacgacgccattcttgaccgcctggcgggtctgcgatcccaggggctcacgggggccatggtgttcggcgactaccttcgtcgccggatcgcgccactccagcggcgcgccaggggcgcctgggagtacaccgggtccgaggactacatgaggacccaccaggggggcagatgggactgggcccctgaggatttcaagatggtggtcccaacgggtgctgaatctcagctccgtggaggcatccctcatcccccaaggtgtcctccccctctgcagcgatccagagcgcgccaacatcctgaccatcatgcaggcggtcggggcgtcaggggagcgggctcctcgaggccacgatggcgcgggcgggagccgcagaggggaacaatctaccccgggagggggtcgtgcttctgggccccgtgacgggggcccggggggcagccgccctgccgacgcccgggggaagaggaaacaggaggataccccctccccatctcctccccgagggggcggggcagtgcgtgccagcagcaggcgcccggagggtgctgtgccgacgtcgcagcccgagggggagcgaaaaaagaagcggctccgcaagatgggggggaccgaaccatgccggggaaacctcatctcccccccaaggtggtcatttagccgacctcctcgcaggttcgtccccgcgcccactgcggccgtattcattctcccaaggcgagttttcacttacccgtttctttttgtcttctggtttttcttccgctttcagcgagattccgtcacgcccccctcgccattccatgtccggccggtctgaggccgaggagacagcgaccgcggaggcccggaggcgggaagctgtccggcgagaagccgcggaccgcctccgggaagctgaggaggctgcccaggaagccgtccgggttcgccaggctgaggaggccgctcgggaggaggccagactccaccgggccgggaagtcagcccgggaggcagaggcgacgcgcgcacgccaggcggcctgccaagcccccgacccgactccgcccgaggcgacgacgacttccgaggccacccacgacgaggccgcgggcgcaccgctcggacccgacccttcgggcgacgttcgggacgagccagcctcgggggacgcccctgagtccggcacgtcgattggcgggccgagccgcacagcgcccacaccgaggcggctctcccctctgccttccgccgccccactaaacacagagcccctcctgcaggccctggccgccgcgaacacgacggtgctggacgggttaggtgcccagatggaggtcctgcaagcagagcgggcggagctcgacgcggtgtgggcgcgcgtcgaagaggggcggcgctcggtggaggccatggtggaggcgggccgcaaggcataccgccggcacgcctcagagctcgaggcccgtcggagggagctggcggagatcgccagggaggtggaggaggagcgggagactgccctcatcgccaccgccgtgctcaacgaggcgcgggacgatctccgccttcaatacgggagccgggtggcggagctagagaagaaactcgacgccgcccgggtagtccttgacgccgccactgcacgggaacggcgggcgacggagaacgaggcggcgtcccggcggcgcgaagtggcccttgaggctcgcgccatggcgctggaagagcgcgcccgcgcgagggagagggacctggcggaccgcgagactgccgtcgctatccgggaggcaacgctggcggcgcacgaggccgcctgcgccgaagaggagtccgcactccgcctccgcgaggatgcgctcaccgagcgggagcgagctctcgaggaggccgaggccgcggcgcagcggctggcggacagcctgtccctccgcgaggcagcgcgggaggagcaggcgcgccgtaatctggaaggcgcacgcgccgagagggccgcactggatcagcgagccgctgagctcgaggcgcgggcgaaggagctggacgcgaggacgcgcagcggcggggcggccgcgggcgacggcgatctagccgcccgcctcgcagctgcggaacacaccatcgccgatctgcagggcgcgctagactcgtccgccggggaggtcgaggccctccgcttggcgggcgaggtagggcccggcatgcttcgggacgccgtctcccgtctagaccgcgccgggcggcaagcgggcctctggggcgagcggaccgcgaagtacgccgccaaccaggggggcctcgcccagcgcctctcagagatggccgagactctccagcggctccccgaggagctcgaggagacgatcaagtcatcctcgagagacctcgcccggggggcagtggagcttgtactggcaagctaccaggccagggacccggacttctccccgtgggcagcgctggacgagttccctcccggaaccgaggacgacgcgcgcgcgcaggtccgggacgccgtcgaccacatcgtccacagcttcgagggtacggcccctcggctcgcgttcgccctcgactccgacgaggagggcggcgacggtggtgtggacgacagcgaccacgaggccggcgacccgggagcctcgaagtgagcccccaggcccccgccaatcttaaatagtttttcctttcttcttccgaggccttcgggcccccttcttgtataaactaatttaatctgcaatcaaataaagaagaaatttctgtgtcaattttatttgttgtgtgtatgagacgaggatggtctgtgcggcggtccttccgtgtcttggcttgaacaagggctcgtgcccaggtcccagcctcaaacggcgcgggtcggggctagtgcctggggagatgcacgtgtcgagactggccaggccgggagcgcggtgaccgagggttatggggacccgattgtgggcctttgccgattcccccccggagttcaccacgccccggggcacggctcggttctgggccccgtttggcgatttccgccggcccgggccaccgagggcagggtcgagcacgagcgtgctaattcaagccaaaactcttcaaaaggaaacaatggcacagacacagtccttaggaaatcgaaaaagcttttattgaaatacggaagagaaaaaagataagtatatgcatatgtggtagcccccggccaaccctgcacgcccgaggggggtgcggggttggcccgagcccgagacctgacacccgacccccactaggggtagaagcgacgaaggtgttcgatgttccacgggttaggcagctctgtgccgtcgcccgtggccagccgaacggagcccggccgggggacgccgatcactcgatacggaccctcccacattggtgagagcttgctcagtccagcacgcgtttggacgcagcgtaggacgaggtcgtcgacgcagagtgatcgggcccggacgtgacgctgatggtagcgccgcaggctctgctggtagcgcgcggctcgaaggaccgcgcgccgccttcgttcttccaagtagtcgaggtcatctctgcgaagctaatcttgatcagcctcgcagtacatggtggcccgaggggacctcagggtgagctcggatgggagaaccgcctccgcgccgtagacgaggaagaaaggcgtttccccggttgctcggcttggcgtggttcggttcgcccagagcaccgctggcagctcctcgatccacgagtcgccgtgcgtcttgagaatgttgaaggtcttggttttgaggcccttgaggatttctgcgttggcgcgctccacttggccattgcttctggggtgggcgggagaggcgaagcagagcttaatgcccatgtcttcgcagtagtcactgaagagctcactagtgaactaggtgccgttatccgtaatgatacggttaggcaccccaaaccgagcagtgatacccctgatgaatttaagtgcggagtgcttatcgatcttgatgaccggataagcctcgggccacttagtgaacttgtcgatagcgacatacagatactcgaacccgcccggggcccgtctaaacggacccaggatatcgagcccccagacagcaaacggccatgaaagaggtatggtctgcagggcctgggccggctgatgggtttgcttggcatggaactggcacgccctgcaccgccggaccaggtcgaccgcatcgttgagagccgtcggccaatagaaaccctagcgaaaggccttgccaaccaaggtgcgtgaggcagagtgggctccgcactcgccttcatggatatcggcaagaagctcgacgccttgttcccgaggaatgcacttcaggaggactccgttagccgcgtgccgatagagggtcccttccaccagcacgtagcgcttggagatgcgctggacgcgttcactcccttcgcggtcctcgggtagagtcttatctgcgaggtacgcctggatctcagcgatccaagcaatcaatctaagggagctgggagcgcccccctcgggtcccgaggcctggactccgacgggcctcgggggccgttcaggcacgtccgtctcccctagggggtcgggtcgcgccgacggctgggcaagcctttcttcaaaggcgcccggtggggtctgggctcgcgaggaagcgagccttgagagttcgtcggcgaccgcgttatcccgtctgggcacgtgccgaagctctatcccgtcaaaatggcgctccatacgccgcacctggcgcacgtaagcatccatctgcgggtcagagcactggtactccttggagacctggttaacgactaactgagagtcgcctaacaccaggaggcggcggatccccagtccagccgccactctgagtcccgcaaggagtccctcatactctgccatattgttggttgcccgaaagtcgaggcggaccaggtatttgaggacatctccgctcggcgaggtcaacgtgacccccgcaccggcgccctaaagagacagggagccgtcgaactgcatcacccaataggcggtgtgaggcagctgcgaagggcccgagctggcctcggggatggagacgggctcgggagccggtgtccactctgccacaaagtcggcgagggcctggctcttgatcgcgtggcgtggttcaaagtgcaaatcgaactcagagagttcgattgcccatttcaccacccgtccagtaccctctcggttatgcaagatttggccgagggggtaggacgtaaccaccgtgacccgatgcgcctggaaataatggcgcaacttcctcgaagccatcagaatagcgtaaagcatcttctgggcctgagggtatcgggtcttggcatcccggagggcctcactaacaaagtagacgggccgctgcaccttttgtcggggccgatcctcttcaccaggggccgcatctccagggcgcttttcgtccgagaggccgcgcggggcgcactcggcttctgtgtcgacgacctcggggtcggaaggcgactggcgcggccttcccgcagtggccccggggccatcctgggggtcgggggctcctagcaccgtcggacaagcgggcagagggccagctccggtcgtcgggggcctcgggccgccgttcggctcgggggcctctcctccctgctctctcccgggtcgagtcgacacagggtggggatgcgcggagcgagggtcgtcctcgtcgcactccgcgaccaacgccgcgctgaccacctgcagagttgccgccaggtagagtagcaacggctcatctggctccggggcgaccaggactgggggagaactgaggtacgccttcaactgagtgagagcccgttcagcctcctccgtccagataaacggcccggagcatttgaggagcttaaataggggtagcgccttctctcccagcctcgatatgaaccgacttagggcggccatacagccagtgacgcattgcacatccctaagcttgctgggggggcgcatccgctctatagctcgtatcttctcggggttggcctcaatgcctcgggcagagattaagaacccgagaagcttgcccgtaggcacgccgaacacgcacttgtcggggttcagctttatgcgggcggtgcggagactttcgaaagtttccgctagatccgagagtaaggtctcctggttgcgtgttttcacaaccaagtcatcaacataggcctcaacattacgtcctatttggctacccaaagaaattcgagtagtacgttgaaaagtaggacctgcattctttaacccgaaaggcattgtcgtataacaataagttcctatgggggtaatgaatgcagttttttcctcatcctccctagccatgcgaatctgatgataaccagagtatgcatctagaaaacacaaaaggtcgcaccccgtggtggaccttaggacatgccttgttaaggtcggtgtagtcgatgcacatccgaagcttgccgttcgccttgggaacgacgaccgggttcgccagccactccggatggatgacctctcggatgaatccggcctccagaagtcgcgccacctcctcgcggatgaaggcttgacgttccggggcctgccgccgcactttctgccggaccggccttgcacccggccgtacggcgagacggtgctcaatcacctccctggggaccccgggcatgtccgccggtctccaggcgaagacgtcggcgtttgcccgcaggaaggagacgagcgcgtcttcctatttgtcgtccagaagaccaccgattcgtgtggtcttggacgggccgtcgcccagggcaacctgcttgatcgggacctcgtcacacgtgatcatccgctgcctcggggcagctgggacggaggtgctgagcctctcgtcgccacccgcgggcttggatgccgcggcgaggtggtccgcgcgctgctccatgcaagcaagcgcgactttgaggtcgccatggacggtgatagggccaccggggcccggcatcttcatctggagataggcgtagtggaccgccaccatgaacttcaccaacgcgggcctccccaggaccgcgttgtagggcagactgaggtccgccacatcgaagttcacccgctccgtgcggaagttggcggaaccatcgaaggtgaccgggaggtcgatatggcctagcggccaagtgtgccccggcgtcacaccgatgatcggctgggacggccggagcactatccacggggccttgatggcgtcaaaggcagcgggggaaaggacgttgagggctgcacccccgtcaacgaggacacgccccaacttcacattgcaaacggtgggggaaaccaccatcgcgatctgtcctccccgggcaacgcacggtgggtggtcggtgtcacgtcctgataaattcatcccgaaataaaaatcattctctaaaaggaataatagaattaattaaaattcgaaaagaaattggcaaacattaaaatacgtgcaagaaaaattcaaatgtggcccggagaatttttgttaaattctccttggtcaaaaaggagccctcaaattttagtggaattttcagagcacaaataataattattaagaaataaacaaagttaaaatggttttataaaaagaaaagccctaaaaagtccttttttccccttcccctcttgggccggctcggcccacctccctccctctctctcctctcccccgcggcccaatcggcctcctccccgcgcgcgtgccgctgacgagcgggcccgcccgccaccctcgctgacgggtggggcccacctgtcatccctatcctcccgccgctcccgccgcctcgcccgtgccctagcgccgccgccgccgcgaatcccgccgcctcccgccgtccccgcgcgcaataaagagggggaaatcactccccgtgattccctctctctttccccccatttttccctccctctctccctcggattcggttggaaaccgctcccctaatctcgccggcgccattgatggcggccgacctcctgcgccggtttcctcccttccccggccaccctctctcgccccggctctatttaaacgctccccgtgcctctctcctccgtttccgccgctcgccgctctctctccccgtcggaatcgagctcgcgccgtcgtcctctctctccgccgtcgccaccgagcttcggtccgccgtcatcgtcgccccggacctccgcccgcttcggcatcgcctccttcggcttcgccgcgtcctcgccgacctcgtccacccctccgtttcgcccgccgaccgccggaacgccgccgtccccgtcgacccgagccgcgccgccgccttcctccgctccggtagccgttcccgtcgtcgccgtcgacccggggtgagccgtggactgccgtttcgcttcccccttccctcccctctctcgggcgccgctccgccgcgccggtgatcaccggcggcgacgaccatcggggcgcgggcgcgccgcctcccgtcggctgtgccggcgaggccgccttcgggcgcgccccgcggctgccatgtggggcccggccgtcagccgcccgcgtcctcgggtgcggctgacgcgtgggacccacggcgccggccggcgtaagccgcgtgcacccggtccaccgtggaccgagaggctgccgcgtgggccccactcccatggacccggtccgcgcgcccctcccctcggttgacgcaataaatccgattttaaattaaaatttaaatgaagaaattcgcaaatatccatttaaagagcatataaacttcaaatggccataacttggccatttgaactcggaattggaccgttcaagtctctaatttttccttaagaagtcaagaacccatttttgtgctttgtttctgcttgttatatggagtttattagagtaaaatccttttcttttccgttggtcgtgtagacgctgcagcttcggaagatccgctcttcgtggaagttgaagccgacgtttgggaaagcgagcaaggcaagtcacatcatccttgagcatattgaatcccagtttataaaattattttgatttaaattaatgcattaccgctttatctaaattcccgcgttatcactgttttatttagccatgcctatttatcattgttaagacattattattgctattgttattattaccttgttcaccccaggaaaataaaaccccaactagtgggtactctatttatggttccactagtatgaacttaggtagatgcttcgctggttaattaggcaacattaggtggttttataactttagactttgggaaatctcatatcatttggacagtagggaattgttggattattgtggaattggacacacacctccccctctattcaaaacccccaaaatggttttaggctgggctcgaggtgcgtggttgggttttgctagtcgtacctcgggtactataaggattaagctcaggcctctgttgcaaagcactaccgtacttccacatgtctagtgggtaaggcttagtttgtggctcagtctggttataaacaaaagtacacggatggagatggacgaagtcgggggtcgatggacatctctaggacaaatgaaggctacacgagctgcggcccggtagtagagatgtcatggcacagggctggtgtcctgctgctgggggctcattcctgcctacctgtcccggaggttccggccgtaggtggggttgggtcgatactcttgtctatggctaggatgggttggaaactatgtcacgtcttccgtctgtataccgtggtggtatgtggcacgtggttgcacgtgagggagatgtgtcttgtgggtaaagatgtacacctctgatcagagtataatctattcgaatagccgcgccctcggttatgggcaagccgagcaatgtacccaagttagtgttttaattcttaaaatttgctcaacaactaaaatgtggaatggttggcctgggttggcttgggacgagctgggacccagggtcgggttgccagttcggtctgaatcatcgtaggccttgggttaaggcaggttcgtgcgggttcacgaccctgattaataatattgtgtagctctaggatcgtccttataaaatggctttgggcaactaagtgacttttaaatgcggatttctgcaaaacttaacccctatattattatccccttgtactcccttgcattaattatgcatctccggtgtggcttgctgagtactgtggttgtactcatccttgctcaatctttccccccttcagtaagagaagctttggagaagaagtcttaggtggagtcctggcttataccccagttgagcgcctgtgaagatggagccgtaggcccgctagtccgctgctgtttattttgattgtcaggccttaagcgcctttgtaataatgtaaatattatcgatataataaagatgtgtcttttatatcatgtttgtatggtgtaccccgacttttcctgggacggggattaatacactagcgttcgggaaaaggcaattttcccggtcgcgacagtcggtctggtcgaaggtgagggcaacctccgaccaccgcgcccgccacgtcgcctcatgggtaggggccacggccagaagctctcgcttcatggccttgaggctccggcgagaagcgtgagcacacgctcccccatcaacggtggcgacagtggcctcaggctcctggaaccctaggtcatcgtcgccatcgttgatgtcctcggcgggggccttctgcttggcctcacctcaccggttgccggcgggagccgccggggtattgccctcacggcgctcctgcctcctctcctcctcccacttcctcgtccgctcagccaaacttttgaccgcgcggcagtccgcgaggtcgtggagggaggtgttgtgcatggtgcaccacttgccggtcgggcgctccctgctgggagcgccggcctccttctttttgtcgctcgcaggcctcccctttcgggtggcccgcaaagcgccctcgacggcgaggacgtgaccctcgtcgtcggaatgggccgacctcttcttcctcctcctgtcccgtcgccctgaccgagcggcggatccgggggcggccgaagctgccacaccggaaccggaggagttccaggtccaggcctcctccttgcgagccacacggtccgcgagctgaaaaagctccgcggtggtctggggctccttggaggcgatcttctcgagcatgcggttgtggcgcacgccccccctgaacgcgtagatcaccgcgtgtgcagggatgcacggtatggtgttgcggacttgacaaaaccgctgaatgtacgagcgaagagactcatcgtcccctcgctgtaccgcgtgcaagtccgcttcttcacctgggcgcggatatgtgccctggaagttcatggtgaactgctggcacaaatcctccaagagtggaccgacgcgggtggcaagttcattagccaaccccgcgcctgtcctttcagggccatggggaagaaattcgccatgaccctgtcgtcacccccggcggcctcgatcccagtcgtgtagatctggagaaactcggcggggttgacgcttccgtcgtatttttcggtgatggtgggccggaaccttgggggccaacggacgttccgaaggcttgccacaaaggctcgacagccggcaccgccaaccggggacacggggggtggcccccgtgcccggaccgaagtggcgctccggacaaggaagcgccctccgatgcgtgggcagcacggcgatcattgcgccggcgctcgatattgaagcgggcatctggccccctaagcacatcttcttgggttggaggcgttgacgagggaatggcggacgaacggcgggtagcggccgccgctcgccgcgccctccgcctcgacgacacggagccagcagtagcaacgccagtggccttggtggcggaggaccgccagccggcgcctaggcgctgctgcgccgtcatgaccaaattggccacgtcatctagccaacgtccagttggagtctctggatcagggatgacgggcgggtgacgcaggagcgcgcccgcagcctggagcgcgccctggggcgtgctgccatcaccgtagacgaggagacgacgctccccgtctcgccgtccttctccatcgcccgcgtgcggcgaagtcgcggatttttcgacctcctcgagcgcctcctcccgcccaagacttcggcgagagggggacagtggagtacgagctcgacggcgcgggttctgctccccgtcttcaccgctagcgctcggagagagattgtgcaccactgcccgttcggccattgggctgagcgggagaagcttggcgcacacgaaagaggacgaggccttagaaaaacacacgcgccccctacctggcgcgccagatgacggagcgtggggctcctcaccgggagaccgcgcaggcccccctttgccggttcggccgggggcgctaagtgaggttcttcgccctcgatcgatctggagaatgttcgcgagagagcaagtgcacgagacacgggcgatgtagacaggttcgggccgctgagaagcgtaataccctactcctgtgttctggtggatctgtgtgtaaaagatctacagagagccggagagccagagagttcaggctccagaacccctctcgcccccccttttcttttcttctttctttttcttttggtgggcaaggtcctccttttatatctcaaggggatattacatgcaccacttctacctacttttcttctgggtggggacctaccctatcttgaccaaaacttggcttgcaccttcgcctggaagctaaatcacaacttgtccttgagtgaggctcagcgccgtctctcgcctgacaccggggatctccctgttactccctcattaatgggcggagatttgccatggctgctttccaaatgaccatccgacaagatgggtcatacctacctccactccaccggaggcagatgcatcgtgggagcacggttgtctgccgatgacgcgaccggcgtcagaccagtcacagaccggtcattcttgt

SEQ ID NO: 73862 - DNA, 16537 bp, Oryza sativa
ccagcatgctcagcattgttgtggtaatgacacgtcgcatgatggggctcgcctgggtggttcccatccaacctaaggcttcttttggttgagttgggaacccatccctccggtacagaaaacgaagcagtccattagcacatgattaattaattatttgctaattttttttaaaaaatggatcaatataatttttttaagcaactttcgtatataaactttttgcaaaaaacacaccatttagcagtttgaaaagcgtgcgcgcaaaaaatgagatgggggagttgggaactccaggaaacgaacagagcctaaatgaagtgcacctagactactgctgctactgttataagactttttagcattatccatatctatttatttatctatctattatatactaaaagtccattaaacttgctataaacgctcctaaaccgccacgtagcaatctaaaatcgctctcaaactatcacatagcattaatatctatctcttgatttttagttaatatggtgggtccaatattctaaaccgttagatttgattgagatgtaaaacatagagcccaaacggccaccacttccagccgcaggcacgcctgcacgtactcctacgggtccggcgccgccttcccagttcaggcttccctattccgatccgtgtttccacggcatcaataatccggttgtagccttttttttttttatcttcttcttctctccattgcgagccagcaaagtgcaagggcatagggcagaatcagagcatagacaatggaggaatggtctccatccaagaccataacaaaacagaaaaagaaaaccggagatttcattctgcattgttctaatctcctaacgatttttgtttgtcgctttatcctgagataattttgtttgccgcttcacatagggacgcgaaccaaagctgctgaaagcaatatgttttaggcctgaaaccaacctacacttggatcaaacaacggtgtttattgagtttaatctattttgatctgattttttttcttcgtttaactttagccccaggagagagacaggtaacgagatattaacatgaatagcgaaaataaaggacacgcaaaactaaaaagggattggtaaaatagtatgattcttaattttctcctaaatcgaaacaaacaccccatgtccataatgtggacatactaattaccttacatctatcctatgccatgctattataagtttcttcatatattattaaatatataagccacgctaaggtaactaaggtaataatacatacttggtttaaaagttatatatatttgttagttaaattcaaatttttagactcatgttaactaggtttttctatgataagaatatattatagaagcgagatatatgatatgtgtatcttctttgtctttatttaggccatgtttagttcctaaaacaaaaaatttcacgttgtcacatcgaattaatgtttggacatatgcatggagtattaaatgttggaaaaaaataaaaccaattacacagattgcgtgtaaatcgtgagacaaatcttttaagcctaattacgttatgatttaacaatgtggtgctacagtaaatattttctaatgacggattaattaggcttaataaattcctctagcagttttctgacggaatctataatttgttttgttattagactacgtttaatacttcaaatgtgtgtccgtatatccgatgtgacaaccaaaaccaaaaattttctccagctaaacaaggccttattcatagtaagtatgaaacaaattgtatcaatctgaaccaattagaaggaagaggctatccccatggtacaaacaaaaatattgtcaggattacggataaggtataccctctacccttggatgtatgctatacggcaatacggtatatcggtgcatatacggacgttctctaaacatgctaaggaaatccatcacgaagtctaccaatggaaaggttccgacccatataggactgggtcgttactatatcgtgtagggtgcgatgtctccgagtcctacttggagaccgcctgacctgcgatataaaagggaccccccaagggacctaaggcatcgaatttcagagcctacacaacgaccacagcctacaaagtcggagactacaggagccaagtcgccgggtgatctagtcgaatcaactcgactacgatctcgtcggtaccgccgagtcctactattccctttgtaatctgtggttctttccatataatcccatatcaactggattagggctattacctgctaaggggcctgaaccagtataatctttgtctcttgtttccttgatgccgtactacgtagatcctcgtaccagcgtaccccaataccctttatatctggtctacgggtacccaccgtcgacagtggcgcgctaggtagggggccttggtgcttaaggttctactactattacatcaagcttcgtcgacaacggcgtcaacaccggccccatcctaggagtccctacttcaacaatgctggtgtggactcaagtcggcgaaatcgtctttccggtttacaccacggtaccaatctcgacagattcatcaatgaccagaaacgagaacgtcgtggctataaacccggacgatcctgtgtcaaaggatcctcccgccgtggcggagaacggaacatcgatgccatatgagcccgagaaggttcctagttcggccaaatcttgtccttccgacaagaactgcgagccgacaaggacatcttccgaagtgacaaagtcctggtgtcctattcacaaatccaggaagcacaacttgcaagcttgctgggtttttctcaatgtacaagctgaaattcctgcttgcaaatagcgtggaatccagcgtacttctccaactcgtgatatctattgtcctattcacaagacgaagaatcacgacttctcaagctgcaaggtctttctccgcaccatgaaaacgacgcttcctaaggtccaacagtcaggaacctccctcaaggacacagacaaggaacaagaagcgacgttgacctcagatcgattcgttggagtaatcgacatcgatccccatgagccatcggtccttcacctactcgaagactatggctcgtcatcttccagtacaccgcgcgacgtgtttgccatcggtgggactaacacatctgcacaggctaacgcagaggcggagaaccagacggtcacgccgacccaacatctcggcaccgtcaacgcaatactgagagaagctccctacgaccccgtgcttaacaatgatctcgcacgttggacagaacgactacgggaatcggtagccaatctcagtaatgcgttcgaggaagctgctaccagagcacaaccagaacgaccaacagctgaaggtgccgacggcgaaccaccgaagcagcggacgtcgccgagatgagctacccctcaacctcgcggcaccggcgatctccatgaccatctgaatggccgccgagaagcaggacgcgccgagacaacgagaatcgttcccgacatcgtgtttcttcatgacgtcacgagaacgaagagcgaggaggccgctcgaacgaggaccaacaccgccatgatcgtcacaactgccgcgaccgcgatgatcagcgaacaccagacgatgctggtcgagggcgtcagcatgacggtgacgataacgggggtcagcgccaggacaacaatggtggacgacaacagaactctcgagaacctgaacgtcgcccgcggaatcgcacaccggagccgagtgaaccatcgtcatcatcgtcatcatcttcatcttcgtcatccgatagacacccacggaggacacacgatcgccgacaacccaccgccctagcgctgggtgtagagctttcaaccgttctctacgtgatgtccgatggcccgagagattccgacccggagcaatagagaagtacgatgggagtattgaccctgaagaatcctccaggtctactccacggtactatacgctgctggggtagacgacaacatgttagcaaactatttgccaacggtgttgaaaggttctgcgcgttcatggctaatgcacctcccaccttactcgatctcttcatgggcagatttgtggcaacaattcgtcgctaacttctagggaacttacaagcgccacgcgatcgaagacgatttacacgcgttaacatagaatccgggtgaatctttgagggactatgttcggcgctttaatgactgcagaaatacgatccccgatatcaccgatgcctctatgatttgcgctttcaaaaccggtgtcagagatcgctatactacccaggagttggcaacaaggcgaatcacaactactcgaaggttgttcaaggttgtcgatcgatgcgcccatgcagacgacgcgctgagacgcaagaacgacaaaccaaaggcgggaggagagaagaagccagccaaggacgcacccgaatcaagaaagaagaaaagcggcaagagtgggaagaggaaagctcaagcagaagtcctcgcatctgaatacaagcgcccgcccaaacacccagacccacaaggtagtgatacgaagagaatatgttgccccatacacaagtcggacagacattctctagaggagtgcctcatcttcaacaagtcgttggaaaagtagctggctttggagaagggcaagcaagtacgtgtagtcgagaaggccactgaggcaaccactcaggattcggacttcacatacccagattccgatcttcatgtctcgcacatcttcagaggctccatagtgtactcttcaaagcgagaatacaaaaaagtggaacgtgaggtttgttcgacatggcagggggctgcacccaagatgaagtggtctgaacagaagatcgagttctcagatgaggaccaccgcaaggctgctattatatcaggacgatatccgatcgtggtcgaacccactattcggaatatcaaggtagcactagtcctcgtcgatggcggcagctccatcaatctcctcttcgccagcaccttggacgcaatgggaattccgcgaagcgagttgacacctaccgatcaacccttccacggaatcactcctcagtcctcgtccaagccattgggcaagatcacgcttcctgtgaccttcggccaagcaagcaacttccgaacaaagcagataacttttcatgttgctgagtttgacacagcatacaacgccatcatcggaagaactgcactcgtgaagttcatggccgcatctcactacgcgtatgaggtactcaagatgcccgggccaaagggaacaatcactattcaagggaacgcaaagctggcggtccaatgcgacaagcagagcctcgacatggtcgagcacatgcccagcccacccgccacaaccgagccacccaagaaagtgatcaaaacgactaagacgccgaaaccagacggcgcaatcaaaatcgttccactctccagtgccaaccccgacaagacagtcaagatcggggcatcactgaacgagaaataggaactcgcgctcatcaccttcctccgcgacaatgcggacgtattcgcttggcagccgtccgacatgccgggggtccccagggaggtgattgagcacaaactcatggtgtgacccgatgccaagccagtaaagcaaaaactgtagagatttgcaccagatcggaaacaggccatacgagaagagctcgataaacttgtcaaagctggtttcatcagagaggtactccatccagagtggctagccaacctagtcatggtgcggaaggccaatgagaagtggaggatgtgtgtcgacttcaccgacctcaacaaggcgtgccccaaggatcacttccctctcccttgaatagaccaactagtggactcaacagctggttgcgagctgttcagcttccttgacgcttactccggctaccaccaaatcagcatggcaaaagaggacgaggagaagacagcattcatcacaccgtttggtgtattctgctatgttaaaatgccgtttggactcataaccgcaggaaatacttttcagcgtacggtccaaggggcacttagcgatcagctgggtaacaatgttgagacctacgtcgatgacatcattgtcaagaccaagacaagtgactcattgattgacgatctatgggaaaccttcgacaacctcagacgatatcgcctcatgctcaaccttgagaagtgcacgttcggggtaccgtcgggcaaactgcttgggttcctcgtctctggcagaggaatagaagcaaatcccgagaagatcaaggcaatcgagaatatgaagtcacccacaagactcaaggaagtacagaggctaaccggatgcatggtggcgctaagtgggttcgtcactaggatgggagaatgaggacagcccttctttgcactgctaaaaaagcaagacaaatttgtatggacacaggaagccgaagaggcgttcatcgcactcaagcgctacttgtcaaatccccctgtacttgttgctccccaacttaatgaagtgttgttcctctatatcgccgccatgccctactctgtgagtactgtcattattttcgaaagagaaaaggtgcagagaccagtctattacgtcagcgaagctctacacgacgcatagacaagataccaacagatccaaaaactgctctacgccgtaatcatgacgtcaagaaagctacgccactacttccaagcccaaagggtcacaattgtctccgccttccctcttggcaaagtcgtgagaaacaaagacgttgtcgaccgcattgcgaaatgggtagtcgagctaagccagtttgacgtccactttgtaccaccaacagccatcaagtcccaagttctcgccgattttgtagccgattggactatgcctgaaaacgggttagacagcaagacagacaacgaaacatggacaatggctttcgatggcgcgctcaacagccaaggagcaggtgcggggttcatcttgacatcaccttcgggagatcagttcaagcatgcaattcaccttaacttcagggcgaccaacaacacagccgagtatgaaggactactcgctgggataagagctgcagctgcacttggagtatgaaggggattctgaactagtcataaaccaggtgcacaaagattacaaatgctctagccctgagttgtcgaagtacctcacagaagtcaggaagctggaaaaagatttgataggatcgaggtccgacacgtatacgtaaggacaacatcgagccggacgatctagcacggcgtgcgtccagacgagagccactcgaacccggcacctttctggacatcctgacaaaaccatcagtgaaagaggcaaatgacgaagatagctcagtcacccccgacatcagctcgggggctacagaggtagagcgcgccgttgccgacatcaagaccacggacgactggcggaccctactcattaaattcataagcagcgacgagttgctcgaggatgacgcagaagccgagaaaataacccgtcaagcaaaaatctaccgtatgatcggcaacgatctatacaagaaagcgccaaacggggtacttctaaaatgcgtctcgtccgacgatggcaaacaccttctccacgacatacacgaagcggtctgcgggtcacatgccgccggtcgtacattggtcggaaaagcctttcgacaaggatttttctggccaaccgccctcaaagacgcttgcgacatggtacaatggtgtgaggcttgtcaatttcatagcaaacatacaaagctactagcgcaagcactacaaaccatccctctcacttggccgttcttgtgctgggggctcgacatactcggtccattcccacgacgacagggcggctacaaattcttgttcgtggtgatcgacaaattcaccaaatggatcgaggcaacacccacgggggaaatcaaggccgataacgccatcaaattcattagggggatattttgccgatatggattgcctcaccgcatcataacggataacggctcccaattcatcagcgctgatttccaagattactgcatcggactgggagtcaagatatgctttgccttggtttctcaccctcagagtaacggacaggtcgagagggcaaacagtatagtactacaagggatcaagacccgtgtctatgacaggctcatgtcacatgacaagaagtgggtcgaggaactcccctcggtacaatgggccgtgcgcactacaccgacaacgtccaacaaggagacacctttcttcctcgtgtacggctcagaggccatgctacctaccgagttacgacatcagagtacacgagtacagaagtactccgacgaggatcaggacgaacagcgaaacgacgacgtgaacctactagaggaacatcgagaacgggttgccgtcagagcagctagctaccaacaggcccttcgccgataccacgagaagcgcatccgagcatgcatactttcgatcggtgactacgtcctctgacgagttcaaagccaagcagggcgaaacaaactctcgcccaaatgggaaggaccatacacgatcacacaggtcttgcggccaggcgcgttcaagattgcagacggtgatggtcgcgagttagcaaattcttggatcattgaccaattgcgtaaattctatgtataagtcaatagtgtccacacttgtaagacatcaaagtgttccttcctgatgatcccttacccagacgacacctagcgttgaaacctatcctcatgtccctttacgccgtcttgacaaggcctccgaggaacctaagggaacttcggctggggacgcccagagctgataaggccttgtcgaatccttcagagacgaaagaccgtgtaagatctggtcatgtaagagttctcgccgtgcgtattaaccaagccgtgtaatcggaaatggatttttccaacttcacggctgggggctagggtcagtgcttattcaactaaggcaagtcgaaggtccaagagctttatcttccgagatgagttctccgatgacaaggctgggggctagggagagtgtataactcaagtgactgatcgaagtcgcgaagtgagaagacactcgtacacaccgcatccagagtaagaaagcttagttacatagatttcctttctacttcacaagtatttcctacagaccgaaaagatatccaaaatacattacatttttcttaagatgtttgtcacagatatacaagcactaccaggaaggccaacgccaatccattgactgaaagattttctccgccaacggagccatcgacttcgccaggttgtctatctccgcgggattcctccgagaacgggaaaacccttcgtggaggaactctaggtgcaactgcggacgatgatctcgtatacatgccaacacgtgccctccagcgtatcggctcaatcgacgacacttctgctttagggcctcatcgatacgcctgccgatgccttcaagctgagcaccagccccgtttagccacgagatgtagccagccgctgactcctcgggatccccacgaggtactcggagctccctgcagacaacggccatggttgtgcaacagctcctgaggtacgagttgaaccatacctcgcgacctcggagcgcctccatggcccggtccttcttcacttccaatatagtcctctcaagttcggcgacctcgaactttgtcctccagtactgaatgcgacggtcgcgatcagcaatcgcattttcgaggtctgctcgacatgcaaacactgaagtcaagctaatcaagacagaagagtcaaaggaaatggaaacgacaagaaccaacctaaaggagtcgtcgccacgtccgtctcctcgggcagatcctggtctacgccgtcctgcggcacatacggctcaagctcaagtgctggaacgactaccggcaattcaggctgcccgcgctgctggatatcctcgacatcgacatctctacaaacaacaaactaattacccggaatcaaaacgccaaagaaaactaaggtgatgattgcacacacaaaggcagtcggaaccaacgaaaagttttaaaaaacgcgattggttaaggggtacagacaagcggtggccctactcttcaaaaagtgggaggacagactcccctagttcgccgacttcttccatcacatctttgcgcgcgtcgctagccgccccctgatccaagatcttctggagattgagttcagggtgtgccaacctcacacacgcaaggacgtggcacgccccggtgtagatcccgttggacgtctcctctctgatcctggccgcgtgcttagaggggatcgcctccatcgccgttgccagttccgtgagcgaagtcgtcagcgagaactcatcgggattctccgggatggtggtcgtgacaccgcactccccggagagctggtgcagactagtgtaggtgacccacagcgagccacggatctccgacaagtcattctcgagctccgacatacggtgctcgagcccctgcagttgtcgctcgttgccggccaccagttctctcatcttctagaggacctcgcgaacctccgccaaatcacgcgtcagccgatcggcacgctcatttgccgacgatgccgccgccgccctcgcctccgcaatctcgtgactaatgccgtgagtgccagcctcgatgatgtgccccatctcgacctggagttcctcccaggtgaggacggcagccggcgggcctcgaccagctgtgggattgctggccgggccgctgggcgtcacctcgcggctccaaggcacgaccacgacctcggacgaggccactgcaggagacgcactggagtttgctgtagacccatcttgcgctgccttcgctcgtgccgccctacgaaagacggccatgtcggtcatcgtaacaagacgacaaaatccaaccaagtcgagaacctcaaatttcgtccacttacttctcgccgagtgtcagtagcctctgccatcgtggaggtgggggagacgcatccgagacctaagtaaaccgagtacgacatgagggcgacattctccaactacgtaaatcaataacctagaaagcttaccgatggagtgggcgtcttccggcggttgccgagcacggaggaaaacttcctccccttcttcggaaccttgctgccgctggtcgtggcagcagcaatgacaatggccgtgtcggacgcctcccgggcaacgccctccttcaacgaggccgccgtctggtggtccacgagcggcccgatggcgtcagtcaggaggagagcctgcacaacatgaagtcatgatgcgatctaagaattgaaaggtaaaggaccatcgactacactcacgttgatcgcggcttcacgctcagccgcctccctctcacaaagaggggtggggacgttgctcgccgtcgtgggactgctaatcatcacctgggcaacacggtgctccacggttgtgctgctcagacctgcagatcgagaaccaagtttcgacaagtcaggaggaatgcgcataaaagcagagaaacccaaaatacaagaaaaataccccgaggagaaacccgggtcgtgtcctccagtccaaagtagtcaaaggctagatgggctcgagccttgagcggctggatccgtctaccaatgaagtcggctgcgacttcataccccgacagccctcgtattcagaggtcatcaatgatatcaatgaaagattggagggatggggtcaaggtgggtttggcggtccaagacggaatcttgtctggttgctcctcaggaacaatgaagactggatcctaatcttctatatgaagatagaaccacctcccccgccatttaatacgagatgaggggcactggagagggatgtatcacgacttcaggccatcccgaagtcggaaaccgacgcacccggatacctttttaggttccatccagcgcaactcgtagtaaaagcggaacaggtcaagaaacggctctaccccaatgtaggcctcacagagatgagaaaaaatgctaaggaaggctatggagttggggttcagatgaagcagagaaagaccgtagaagttcaagacaagaaggaaaaactcggaaggcggaggaagaaaaccacagagaatgtagtcctcaaccgcaaccatgcggcccaggatgggttcaggttcagtacctcccggttccctctccatggtcccgtgaccggggagagcgccctcctcctgcaatttctccaaggacgcattgctggaggtggacttgtcgaggtccattccctgagaagaagctgaggcgggcgaacatagggtttgtgtggaagcggagaaggcgaagagcgtttggaggcaagatagttctcacaacagccggacaccaaattggattcccaaaactcccataaataggcgtactaccgacggtgtgaattccaaggaaaggagagaaatggccgccggaaatttctaggtccgttgcacgacgcggtttcttggacttcaatttaaattcactcataaccgttcgacttcgcatggtgttgtcgatcactctttgtctctacggtcctcacaccgagatcgaccaatcgagaacgacaacaactccgacattagaagtcacgattggttacacgagttcatttaagttgatgtcgggggctcctgtcagggttatggataaggtataccctctacccttggatgtatgctatacggcaatacggtatatcgttgcatatacggacgttctctgaacatgctaaggaaatccatcacgaagtttaccaatggaaaggttcctacccgtatagggctgggtcgttactatatgtgcagggtccgatgtctccgagtcctacttggagaccgcctgacctgcgatataaaaggaaccctctggagggacctaaggcatcgaatctaagagcctacaaaatgaccacagcctacgaagtcggagactatagaagccaagtcgccaggtgatctagtcgaatcaactcgactacgatctcgtcggtaccgccgagtcctactattccctttgtaatctgtggttctttccatataatcccatatcaactggattagggctattacctgctaaggggcctgaaccagtataatctttgtctcttgtttccttcatgccgtactacgtagatcctcgtaccagcgtacccaataccctctatatccggtctacgggtacccaccgtcgacaaatacatttattagcaatcatagttttcataatttattaaaaaatagggactctaaacattcaattaaatctggaaaacaccatatgtttaatttatacttaatttataagacatcttttatacaaactaagtcaaactcctctcaagataatgaaaaaaaatataaatcttatagtaataaattaaatatatatagtttaaagctaataaatagtttggaaaatttcaaataatgccgatgatgaaaatttgaagagaaataatacatttgaagcgtagaggccagatcattcggttgatatttcatcttataaatttctcaaacacatcctacaatatatacatgcccgcgcgaatgcgcgtgctactttcctagtccatatagatgtcaatgaatctaggcacatatatatatgtctagattcattaacatatatatgaatatgggtaatgctagaaagtcttataatatgaaatggaggaagtacttctggatgatggctgctcttagttccctaaattttctgctattattgcacagctccatgaggtaagaggcagctcatcaacatcttgacacttttttctagtataaatactcaaatgtgaagtttggtggggacaggctagtgagccttttgaccaacctgccaaagcataaaaaactggcgaagcaacatgaagcgaagcaaaccgtggcgaagttcagcaaagcagagtggcattaagcaagccgacaacgaggtagctattgcctaaagccaaagcactctaggtggccaaggggaacgactctagtgtgcctgattggaacaaggctaccgttggtatttcttaacgacattactagaaatttaattcccagcaatggcgctgaaatactcttagtatattgtggttacagagttcatccgcaagcgcacagatatacaattgtagcatttcacccgagagtattccaagggaatcgtatttatttaatcccgtggaaagattatagtagagagaaccgtactaatagtttatatgttacttgtaataatcatagtctaagcaggggttagtataatccaaagggtaggatgacacacaagcataatccaaagggtaggatgacacacaagctaaatggaaagaaaatagaaaagaatctattcctatacttctagtatacatattatacatacattctagttatatgattaactagctaataccctctatctgatgccctcctggtacttcgagaagccacccctgactaccgagttccttatgatagcccgtcatgaccatacaaccggggcaaaatacggaggagtaccctccccatgaaattaacccgtactgaactgtcaccatcagtggcccacctctcatctgcagcatataaccccaaataatgatatctcgaaatctagacaccacgcctaaactaccagatactactctaatatcatcatcatgacatggagtaattgcataaacaaactttatacccgtaactatgcatctcccagataagctagcagtataatcagtataacatgaacataaagtaagttggcattccctctgagactgcgccaacgactgcaacacctgtaagctttctttatcttctttaagcaaattagttaatatcattattaattagcagttagcccatacatatcagattaattatcatgctccaagtctgtatacaacgattaattatatatcatctttatgaaatgaattaattcacggatgcatatatatgctgcaggttgtatggcgtgatggtggccgtgcatccctgtcggccagatcgcagaaatcgtcgacagaggctcatcatgtaatttattaacctcatcgactcaaattctcttatcattaatatgattttactgtgcagatcgatgctgtttgaaattcccccaattttcataatttctcaaatagatcctgtacgttttgcacagcgtgcgcgttgaacgcggtgctgtactgcctggtgttccacgtgtcggcggggatgtgccagtgggtgtactcgtgcgcctaccgcgctcgcctccgggcggcgtacgacctgccggagacgccctgctccgactgcctcgtcaccttctgctgccagacttgctccatcgcacagatgcaccgtgagctcaagaaccgcggccacgaccctaaccttggtacgagtatattatattctctctctatcacctctcaaactcaactttacattgtatttcctacttccagtagctcaatcgtacatccatcttattacataagtttaatgatataatcatacatccatttcatataagtcaaaaaaaagtttcttcaacatatagtttttagcttaaaagtgtaagggtgacttatgactttaaaaaaatcaaacagaaaaaaatatctggtttaggtttagatttttgtgatcacagactgatttataagtctaaacaagagggtctaataagatatatattccgatcttccaatcttaaaaaaattagtaacttgtaactcattaattcactcaatgtgtttaattaatttgtactaattaatgtggggtgatgaaggatgggaggtgaactcgcggaggacgatgatgactcctccccaacaccaagcgatggaaggaatgacaactccctcataacaactactcatcatcacctctcgatcgaccaaacaatacatacacacgatatatagctattacaagcatgtacaccctttgatttataaagtggcaatacatatatagatgtgtgacgcttattttattttataaacatatttttttttctgttttccaggttaagttgtctctgctattttaaagacacagccgccctcctccctccttaccgcgcgcaccccgtattactctagagtctagatcctatcctgctgctacaattaatgcttgtacataatactagaaattcaaaaaactatgtattaatggcttgttggaaaacgtaaataaaaacataaggagttccacatcccacaagcattgggctgcactatacctggccaactgggccgtgccaagccgggccggcccgagcacagcagtactgtagccggcccaggcccggcacggcacgccagcctgtgggccgtgccggcacggcccattatcccgtgccgtgtttgggccaatgcctcagcccgtgggctggcacggcacggcacgtttactgtagcgtgccggcacggcacggcccaggcat

SEQ ID NO: 73863 - DNA, 2179 bp, Oryza sativa
catggatggtaatgcaggatataatcaaatttttatggctgaagaagacatccattagactgcttttcaggtgtcctggtgccatcggcctgtatgagtgggttgttgttgatggctattaaataccaaattcacacagtcaatacctgcataaatctgaaagtataaaacatccaacatagtggtagggtttatttctaacaataaattctcaaccatcaaagttgagaagaaatatacataaaggagaggaagaattacattcatatccaagcctatggagtcttgggcccataagtccaacgaaatacatgtgggcccaatcactatgccactagattaagggccttcctgccatgatcctggagaaaattcagggccaaatggcccagcaagggttcagccgaacccaaaactggcctgttcggccccaaatttcatcggcagttactaccgacgtcccaatgacgattgtcacagttttcggtgctccaaccatcattacgaggacggattgcaagaggggagtgaagatgtcgtcaggattccatggaggatctccatactcccaaggcacctacacctataaatacccctcacctccttcattccaacacacaccaagtatgaactgaattataagatgcactattgtatcttttatgtacattagaataaggagagagtaagtgagaaagagttggagaaatttcggagttgtccgtaatttcctcttacttttgtaccttgtcaattactctgctttaattgataatatctttattgagtaattgagattcactttgtgaggattatctcttagttcctattagcgtactggaatattgttcactagaaatagtgtttactttaatgtttgatcggcattagagtagtattaaatagtgtagacgtggtgtatatgctattgagtacctgtatttgctgcttattccacagttcggtatagaggtgggtatagaggtggtgataaccctcaagattaatagggagggacttgtatagatacatgacatgctatctaataggaccacaaagactcagctaatgcaatatgccacgttttaggttgttcaataatcttccttttcaccaacttgatcaaactcttgttacatgcctctgtctgtccaatagcttgtgtataatcaggagaagaattcaacaactttatgcccatgctctcagcaaattgaacaatttcattgacacaaacatagatccttgatatgtggtgattgtttgtggtatcccaaatctatatataatatgttccttgacaaactcaatagcatcttgtaacaccctggaaattcgaccgacaaaaatctaaactctaaaaatatgggccttcaaaaactttttaaaataaattgcatcatgccgattttattcgcctatttcattggattttgaattcggagtttgttgatcgcgaataaagaataattaattaggaataaaacctaaaattaaatgagcaaaataaataactgaaatataatttaaaataaaggttgaggtagggatagaaacgaataaaatattatcgcgatcatatttgtattaattaaatctaaatacgacggaatgagaattaactctaattaaaatcaagtaaattatataaaaataaaatatgggtacaattaatctagagtggatccattggttgggataatacacgtattgagcaaacttcatttatgcaagatttagaaattatagaatcaaatttatataggaaataaactaaaattgggataaataggaaaatacattgttcattatggcgtaggtgttcgatgcggtccctagccttccccctcctctcccacctctgcgccctagccggtcttgagctccgcgtcgccgccgcccgtcgcgtcgccgccctgcgtcgttgccgtctgccgccgcgcgccgacgccatcgccgctgtcgccgtcgccgtcgtgtcgccgcgcctcgcgccccgagccgccgtcgccatccatcaccgtcgacgtcccatcgccgcgcgcccgtcgccgtcacgcctcgcgccgcgcgcccgccgcctcgcgccccacgcgccgcgcgccgtctcttcgccgctgccgcgccgcgccgccatcccgtcgccgcgcgcgtgtcgccatcgccgcctgccgcgccg

SEQ ID NO: 73864 - DNA, 2263 bp, Oryza sativa
tatatatatatatatatatatatatagagtatatttgtttggagctatatggtgctcgggcaccattgtttatattgagtataaacccaattcagatgagcatgagtctttttcaattagttaggtataaatattagcaactttatacactagttaaaagcaagtttgaactgaatttgaacttgtttttgttagattttgattctaggtatatagcacccacacacaaaattagttgggtaggtaatcatggggtgtgaaataaagaaaaaacagagttgatttgtaaataggtataggcaatatctatatatatatatataggtatatactccacatatatatatatataaatatataagtatatatgtggatatatatatatatgagatatagacaccaatgtatacatatatagagatatatatatatatatatatatatatatatatatatatatatatatatatatatatatatatatatatatatatatatatatatacttcctctgtttcacaatataagtcattatagcattttccacattcatattgatgttaatagattcattaacatcaatatgaatgtgggaaatgctagaatgacttacattgtgaaacagagggagtaagtggctattactgtattagcgtgacggagcgtggggctcctcaccgggagaccgcgcaggcccccctttgccggttcggccgggggccctgggtgaggttctaagctcttggttttaggaaggttttcgagagtggaagaagcacacaagacacgggcgatgtatacaggttcgggccgctgagaagcgtaataccctactcctgtgtttttgtggatctgtgtatgaagaagctacaaagtgcgagccagcccccgatcgttctcagatcgttcggtcccctctttttctcctccccttctctaagtgggcaaggtcctccttttatatcttaaggggataccacatgcaccatctctctcttttgtgtggggacttatcctatcttttcataaatggacggagatttgtatggttgtcgtctgaatgaccttctgatgggacggcccatacctacctccacttccgccggaagcaggcgcgacgtgggaacatggctgtctgctgacgacatgaccagtgtcagacggtcacagacggtcacctttgtccacgcgtgtcagtttatcaatctgcatgttcgcccttcttcatacaatatcttgcctgtaatggttaggatgaagcctggaatatatctgaccggaaccaacgtgccatctccaggagctaacacgccggctccggctagggacgagtgcttggaggctctcgtcctgacggatggggcgaggcgtgcgtcagaccgcctgtcgccacctaacccacgatctgatcggtctgtgactggtcacagaccggataaacgagcgcgctgcactgcgttacatgcggcgtgacgcgctcgtccaaaccgcaataaatgtggttaggtgagccccgctgtgctcacctaacccatacgcgcggcgcaaaacccacaaggggtcggggcgcctcggccctcggggccgaggcgggagcggtccaaccccctcggggagacagaggagggcgaacacatcacccttgggcccgacgccccccgagggtgccaggctacgtgggcgattgtgtttgcctcaagcctctagtcatgatactcccggtcccatgtcaccgacaacaacttagaaaaaattaaaagaaaatagaaaaaaatctaatacccttaaaaaccaatgttcaaaatcccagacctcccatagttttcagcgcattttttttgaacgaatcggtgagccgccaatttcattgaatatagaaggagaaaactgtacagtgtaaagggaaagaaaaaaactcaggacctttcgccctagtcaactaaggaacaagccaatttctcagatgatgcgcgcctgctaaggcctatatcttggcctcgtccttgatttttgtcagaagaccactcggtgggagctccttatgctggaatgttctgcgatttctttcattccagatctcccagacgactaggaacgttagggagcgtagagcctttttgggtgcctcttttacacttgtggtttgatcccccattctaacaccgacgaaacctgccaccaatggttggggtggatattggggtccccgtccattccgctagggtcgcccatattctctttgtgtagcggcagcctgcgagga

SEQ ID NO: 73865 - DNA, 16136 bp, Oryza sativa
tgcgatttctttcattccagatctcccagacgactaggaacgttagggagcgtagagcctttttgggtgcctcttttacacttgtggtttgatcccaccattctaacaccgacgaaacctgccaccaatggttggggtggatattgttgcacgccgtccattccgctagggtcgcccatattctctttgtgtagcggcagcctgcgaggaggtgtagagccgtctcctggacccgacgacataagggacatatggatccatttggccatccgcgggtagatagtctatcagaggtccagactctattctgaatgaccagccaggcgaaggttttgcatttgcgaagagcccagggcttccaaattaggttgttggccgttgttccaagtagttgtgcattataggccgatgttgccgtatattgaccgtggctagtgagcttccaagatatttggtcgtcctcatgttctgtcagctctattgtctggatggcggtccaaaccgtgacaagttggtcaatcagctctgttgtccagcccacgtccgctggaaatcccagatcgagcagccattgatctgattgcaaggcatgttggagggtactattctttttcttggagaccgcgtagactagcggtgccacatctttcatccttctctcctgccaccaggctgactcccaaaaactcacagtcgccccatttccgattgttatggatgtcgctgctgcgaaaaggagcttatcggtgtcatcgcacggcgtaccagaacccacccatgctttctccggtgacttccattcctgccaaagccatcggaggcgcaaagctcttgcaaacttctcaaggtttaggattcctagaccttcggaaccagttttcagcttgcaaacaccttgccaattaaccaagctggttccaacactgaacttttaggggtcatctcccttccaaaggaaggctcttccgaagcgaatgtaaaggactctacggccctgtttagattccaatttttttcttcaaactttaaacttttccgtcacatcgttccaatttcttcaaacttccaattttagcgtggaactaaacacagcctatattccttacacatgcgtgaacatttgtattctcaaagacagcccaaaattaatgtatgctttggtacggtatatgcctgatcttttgccaatttggatgcccacgtatccgacagctctctgtgagaaagcggttacattgaaaaactacaatgttcacgagggattggggaagcgtcggcagtgactgtatatttggacactcttggatggtcaggatatcaagctttgtcaggcaatccaagttggcaggcaaagagttccagctacaatctgtgattgagaggtgatgcagaagaccgaaacgctcaccaatcatgggtgggttattcgagcctttacaactccagaacataaggatttgcaatgcggccgggaattctccctgctgcacgaccccttttactgacaaccaacttgggtatgtcgtaccattatattccctgatgcaaagggatgtaatccaggctggtggatggagctcctcaaggacctcagcttgcatttgaagctctggaccgctgctcatctccgttacaggtgcagttcttgatgcggagcgttcgtcaccaccccaacttagcgtcagatcagttatatgcctcttgtcagctagcctggctcgaacagcctcctctttgcttcttatattatcaagacagtcaatgaacatcctgccacgaaggttgttcaggtattccagctggtgtatctcatatcccttctctttcctcacagtgaagcgaaacagatttcggagcgatttcagtctccctatgttgggaatgtccaagcctttccacgtgtgcatataccgcaaattgacaaggttccccattttcgccggggaggaaaactgcaaattaacgaaaggtgtgaccgaaaactcgtggagatggtaaagcttggcaaattcggctggcaaagtgatgtcgttgtaattaagggatggcgaaataccaagataacgaagatgttttagttcaccaatacatgctgggaccgtcctcatatcttgcaagtccaagtacaccacccgcaatttccttagcctcatcagcacacgctcaaagtcgtttttactcatctcctttatggaatagcacatgattagtgtgcgcaagtttgccagctccaaaatctgctcggggaatacttcatcgtagaacattatacaaacatggcgaacatatttcgaaatatgttgtacaatgcctttcttgatttcaacacggtcgctgccagcaaccatctttgctacgtcatacaacgaatcatgagccgtgaagtactccccagaactagtgtcagaattaaccttcctttttagctgaagaaatgagcacacctgcagttcatgaaagtagagctcgccgacatcttccatatcctcctctcttgcattggttgtcttcaccaaaccctgtgctatccacatgctaataagtctctctcgttccaactcatatcttctaggaaatatgctatagaattcaaagcatctcctgacatccatatcaagctgttgatagctccagagcagagctcctgtggtagaattcaacacgtcgaggtttgatgttgctctccaataagtgatatctgggttttgcttaagccggacacccactattactgctgcaataggtgacctttgtagcttttctgcaatttttctcccaagtggtataaaatctcgatcatcaaagcttgtgccttctagtgcgtaatgcatgaacattgaaaagtatatctccttgtccaaatcagatatttgaatatatctattagctcgtagagctacatctgttcttctagctgtcactaggattctgcttcctctcttcccaacatcaagtggagaaagtaaatctcgctgctcctggtcattcttatcattgacatcatccaataccaacaagaaacgtttgcctcttaattccttcttcagcttattttgtagttctctacgatcagtaatactggaatgccggttttctgtgatctcctcaagcatatcatgaaatatgtagtctgctctcaatgtctcagaaacatgaatgagaatgatagggtcgaaatatttgtctttatcctctttttcgtagtcacaaacatattgtgccagggtagtcttgccagatcctgcaatgccatgtatgcaaatcacacgataacacttactgttactggagcttgctgcatgatcatctggtccctcacggagaatcctatgaatgacctcacgctcctcatctcgaccgaataccgttggtttagtaacaggtttaatgctctgcctgtaattgctggaaattgtattccatctactgcttctttcctggttcgagagatgtgattgatgcgattcggtgcaaagatgtttccagtcgttcaaaatttcttctatcgcttctattcttttcctcaacttccttttggcacaaatagtcaggaaagaatcactcccctgcaagaaacaaagcctcaaatgattacacaagctgattgttgaaaatatatgatccgcatttcttgatattttgggtttactttccttcaaagactcttagttctcctttacaatgcaacataagaagaaacataggtcccatggtacgtcatatttgtaaacgaaaagtaatttgtagataaaacttttatatatgtgttcttagcgatttaaaagtaaatgctgaaaagtaaacttcgatgaaaaacccccaaatcaactccaaatttaaggttgaaaatttaaattttgactgataagcataagtataagcgaaaagatgaggctgatagaaagcagaatgcagataagaaaaaaaaacaaagaaacgtaaacacatgaagttcatggcatatcttttcaattttataggaacataaaacaatggaagtacagcaggaaaagcactgaaaatattaaaattaaagtagaacatgtgcccaattaacaatcatatttattattttcataattaataattatacaataaatttgaatctatatatttctgaagtgatacaatattacatattgatttaacttgttaaattctttattattattattattattattattattattattattattattattattattattattattattattattcttcttcttcttcttcttcttgacgacatgatatggaagaaacgggaggacaccatatagtactacctttgcctcaatttatgtatagttttagatttctgtgtgtaacgtttgaccgtccattttatttaaaaaaattatgaatttttttttaaaaaaagttagtcatacataagtaccattcatgttttatcatctaataacaataaaaatattaattataaaaatttatcaaataagacgacgataaaacgttggatataagcgttccaaaactacaccctttttagaattgaggtagtagagtatgtggcttgtgggagactgacagaacgtaccttgtagtttgtgatgcccatcacttcgtaggaccagttccggtaaaaacatgcaagctggtagaaggaacggacccgttgcagcgagggtacaatgtctactccttctagagggaacggatccgtagtatccggtggaggccgagaaattggtagcggcgcggcagatgcagatttgctgctgctacagttgggatccggagccggagtatccagtggtgagcgagaaattggtagcagcgcggcagatttgctgctacagttgggatccgtagaatccggtggtgggcgagaaattgggaacagcgcggcagatttgctggtgcaaagcttgatgcaagcgccgacggcgtcctggaggtagtgcagccagttgatgtcgtcatcgcaatctgatttggtcgtgcacgtacgcatttttttcatcatgctctctccatcctttgatcgatccagattgattagaaagaaaaaaaaaagatcgaaaaaagacacataccattgaccttgttcttgatttggtgataatcgatgagatccaagatgtcctccgcttcgtacaaggcagaccttagctcctcgcacggttgttccagtttcttcacagcagatctatcatcttcagcttctttctgcatcctctgctcctctagttctctcagcatatcctccagttttgggagggtatgaatctccagttcccggagcttccgcgacgcgttaaagccgatgtaggaaacgaatttgttcacgagcaagttcataatgggcgctatcaaccatcctaccacggttacgccccaacccacagctgcaatcctccatggatttgccatggaacgcttttgagaaatgggacaaggagcataggaaagaaggattggagctctctactgtctcggtagctgctagctgcgtcctgcgtgcaaacattgcaccctcacctcgatcattgaccggtcgtcgaaatttccagcgaatcatcttttttttaaaaaaaaaaaaaagaaaagtgactagtactgaaaatgacataagtacataatatgtggacataccaactaagacgggcagacttttcaaagaaaacgcgtagtcaacattaaaaactgtccgacttttataactgacagcacaaggatgagtaatatgaagaaatctatctatctatctttttatactaaatccattaaacttcctatgaacactctcataacgccacatggtattctaaaatcgctcttaaactaccacatgacgctctaataaaatagagaaaattttaaaaattctaagaaaagaaaaatatctagcatttaattttcatttaaatggtagacccattagtttaccccgttagattagatccattataaatagtaatctatccctcctaatctaccatgtaatacttacctggaaaatattagccggaataagccaagaaggcataagttcaagctaccacatggcattctaataaaatagagaaaatcttaggaactctaagaaaaagaaaaatgtctggcctttaatttttatttaagtggtgaacccattagtttaccccgttaaattagatccattataaatagtaatctatccctcctaatctaccatgtaatacttacgtgaaaaatattggccggaataagccaagatggcataagtaagtacgagttaacaaccacaaaccagaaaagaagaaatgatatacagcaaaaaagaaaaacaaatattgcatatatacgtactacatactacttggaaaaaaaacattgcttttaaaactggattttcacttcctctgtatttttttttacgatggccaatgttaaatatttagtgaaagtaccgaaagaaaacaataattttaaaccagattttctattatacttcctctggatttttttattttctttatgatgatcaacgtcaaatatttactgaaggtggtagtataagaaaaatatattacttcataaaacatgaacacccaaaaatagatctataatataatataaaatatcaaataaatgtatcatttcacactataattgttgagtatagatatattttatttgcattaatgggcctaaattgatagttcaagatgaaataatgagtaattaaaatattactcgggacatattgtcataaacatgaatataaatgtattgtttaaaaatatgttgcatttttttctcacaaaacatagtcaggattttagcagttaatgactcaatctacgcttttgatttgtacatattttttaagtatataagtaataaatttaaggttgagttctaaagtgcttatcagattggctctccctcatttatcttgagcatgttctccgaactattaacctatgcgtgttttgcaaatactttctatacatttttataaaaatatatatattttttcatgtttgtaatatttaatacttaattaatcttgtgttgatgacctacatcatttttcatgccctgcataagctcaaccaatgagatcgaatgtagcctaagtaggagatagattagattatttactataaaatttaaaattaaagaatcaagttaactacattattaaaaaaatcattagtttgatcatatatactctacgaactgactaaagtcacgattattgtatttgcatggtatgcagatcgttggtaccaaggtatttgcgagattgaggtaaaagagatggagacaaggatttttacacatgtttgggccccttatttgacaggtaatagccctactcctattggccgaagctggtgtgctctatattcatcagaatcacacaagtacaatatttgggataacctatctagctgtcgtcgacttggcagcatagataaccaacacgtagtcgacagcatggtagtcttcctcctcaagtacgaactcatcgagtttagagatggtgctagatccctcttgtcggcctccgcaggcatcatattgggtttgtctaggcttatctctgatgtcgatgtttagcagcctgtgttggtatctattctgacttgtgtgtcgatctgttgtatcctctctcccctagggggtcttgtattttatacccatagatagccccttgtccaatatggatacaattcgagtagtccttgtcatttccgtatacaactatactcatccttccttatccaaaactcctatatgtgaggtataattccgtataaggcttggtatatggtggccccgtcgagcttagtcgattactattgggtatgtggtatccataaccatgacactattgttcactgatccatacattttttaagaaaaaagcaaataagttttgttgtctcctcactatttcttagctattaaattaaaacagaaacaatcaataatattggattttttagaaacacagcacacgtacaccctacctctttgagtacctccaaaagactaagctgacacattttgagatacaatgtcaccacgggcgtctcactgtcgacgggtacgtcacataccaccgaaagaataattagccataaatacgagcacagataactattgtattaattagctattaaattaactataaatgatttggagcaagtagttaactatattattaaacttgctcttagcacccatttcaattagttcaagaattgtggtggattccttggggacgtaactacacagctagtggtagctggtttgtctataagaggcaccatccacctatacttcaaatacaattttctcttaaactactcatccgatctacgatccgattacaccgttgtattcataacaattaaatctttacaacaagatctcacatgattatattttgatgaaaaatcacaaattacttttatgatatgtctaaattacttttagatttcactaagttacttcttagttatataaaagtaaattcagtaaaacctaaaagtaatttaacttagaacaaaacgaaggtaactttaagatgtcatttgaagtaaatccgttgtagagataaaaacatgactctatctagaaattaaattaatcagcacaaattatgaaattaactaaaataataataaaagtaatcatctcagagcattatgaatgtatagtaagtattttaatcaaatctaaaagtaactcacacacacacacatatatatatgataatttgttcaatgaaaaaaggcataaattaaagttacttctataatatatgtaaattacttttagaccttactgaatttactattatatgtctaagaagtaacttagtgaaatctaaaagtaatttagacatatcataaaagtaatttgtgatttttcatcaaaatataatcatgtgagatcttgttgtaaagatttaattattagaaacataacggtgtaatcggattgtaaatcgaatgagtaatttaagagaaaattttatttgaagcatagatgataggaatatttcccctacttactcaatggattaatagcaaccaaaactcctagagtaatagcacgtggatgtctctgattaagactaattggagaggcctcttcaattagatttaccgattccttggccacctttctctgtccgacccttctttagaattcccgtacctgcaatcctttttagaaagacacacatcattttgggaacacacaacagagcattaattgcgcgtgtcattccgttaagagaggttagagcaagtttaatagtatagcccattactagctccaattcatctatagccaatttaatagctcatctatacaatacaatagttacatactacactattaatacatggtcccaactgtcatacacacactgcgtcttagagtccgtgctacagttggctacaaatctgtagcccgctgctcttctctcttaaaatatgtttgcagctggcttatagcctgctattgtacctgctcttagatcaagtttaatagtatagctcactactagctccaaatcatttatagtcaatgtaatagccaattcatacaataactctttactatactattaatacctggtcccacctgttatacacacattacgtcttggagtccgtgctgcagcaggctacagatctgtatcccgctgctcttctctctcttcctttatctctttaaaatatgtttatagcctgctattgtacctgctcttagagcaaggctaataatacaactgacctgatggctataaggttctttatagccttctcgcagcttacacatataatagttagctctttaattgggggtgaagaatgtccggttttgtggttcagggggtaattcggacgaccgtgatagttcggggggtaattcgtactttttccattaaaataaaaccggagggagtaccatacaacatacatcgaactctgcactgacacatgaagtggaactcgcaagtatcagaatcaatatatacaaaaccatttgtaaaaaaaaaaagcaaaattcaatttttatcactactatgaaagaggtttttccaaactgtcaaaatcaatctttccatgcggttgggccagccgtctgcacgagaagtgctgtaaagatcgcgattttttcatgcatgcaaaaaacggattttcacatgcgggtgcttatgaggaccgcatgcaaaaataaaaaatcatgaaaaaaatatgatttcaaaaataaaagccaaaccctaaccctgccacccgctccatcatcggcgtcggccgagcaccatgccgctgctcccgccatcaccgtcaccggcgctagatccgtcacggcgcgtggaggtaggaagcggccgccacgccgaggttggcatcgccagatcctctgttctctcgccacccaccatcgccgaggctgcaaccgcaccgaagggcagcggatccgcccccctcccccccccccaagggtggtgccgccggatccgccgccctcaccgttcaccgtcgccgaggtcgcagccacacctaagggcggcagatccccccacccctccttgagggcggcgccgccagatccatcgccctcaccacccaccgtcgctgcccgctgtcgccgaggtcgccgctacacccaagtgcgacggattcaccccccctccccctcccgaggacggcgccgccagatccgccgcccaccgtcgccaagacacaaccgcactcgagggcggcagatccgccaccgttgcagaggccgtgtagccgctagccatcgcaccctcaccgtccgcccgccgccgcacccaacggccggcctcctcgtcgacgtcgccgcccgctgccacccacgtggattcggaggaggagaggagaggagaggataggagagaaagagagtagaggggagaaatatcagagagggagagagacgggtgaaatttttaaagtgttgacgagggagagagagagagagtaggagagaaaaaaaagatggggtatttttgcatgcagacaacttaaccgtccgcacgcgaaatagagttttgcatgcgactccttaagatcaccgcatgcgaaagtagacttacttttgcatgtggtccgttaagaggtacgccagcaaaaatagattttcgcatgcgcttctcttaacaagccgtatgtgaaaatatgggtcaatttttgcatacgcggacacttacaatccatttggaatctattgggggtctcgtctagaaaaacgttttctctagtagtgtatccttgtttttcgcaaattctattttgcaccttaattctagaaccagttgttttatttactgtagtatttacaaacctgacaaatagcgcagtagactatatattcactactgtttgaattggtcttacagttcgctaacatgaactattgtttgctagaatagcgttgatgtgtacttcgtaagtcattctagcattcccctcatttatattgaggttaatgaatctagatagatatatatgtctagattcactagcatcaatataaatgtggagaatgctagaatgacttacattgtggaacggagggagtacctagttattaataagtggcattgatgtcagcagcacatgtataacgggattgtgctagtgaaaaccactgtcaatccaaacaaaaccatggtacaagcagggtccacactttcagaaaccaccaaaatttcggaagtggtcaccaaaatttcgtaaattttggtactcttttgcacaaaattattttaaagttcaacaaatttggactgaatttgaatatatttagaccacattaaagaaaaggaaaatcaaaaaatttcggtcgagatagttgcttgcttggggggggttaaaaattttcaaaatttcgaaccaaaatctctaaccttgggttcaaggtgtttctttatgcatgttctaaaagtcaaggatgaataataaccgattttatagtttagggacgaaagtagactttgagaaaggtttaagggcttaaactagacttttccctttttaaaaatctaggttatgagttgagagaccaaaattgattacaataaaacatatttatatggactattaaagcaagaaagattgttataaaccacatgtacgtatatatatggttttgctaaaaaaaactttcgacggatttattttctcaaaactttcaaattttccacagtaagatgctctttaagatttgtgctaccgagataaaaaaaatacttgcgcacgaacaaggaggatgaatggatgatgatgtgtgtttgcaagttagctgcagtagccactagcgatgatgtgtgtttgtgaaagaaaagattaagttgcatactagttatataacagttacattgcatacaagttacatttgaaagtttttctctaaaaaacggtcgcatgctttataggtactttaaaccatgtaaaatctgtcagccagttggagagcacccatggtttttagccgcggtacactggcctttggttgaaactggatcgaactacacaatggtttaaatcaaccgccttaattcagtcgattttaacgactgtgcctcaagtgcaggagagcatgataatgatcctcatgaggttctgacttctgagtggatcacgcaaagcaaccagtggaattagtttagattagcaccactggaccattctacttgtgtatttatacatattataagaactgaaggacaggtacgtgatcgatcgatgcagttcatgtggtgatctaacaatttttttattagaaaggcacaaattaatcaagccatagacgccattccagtgttacttggcttgggatctcagcggccttgcttattaattaatgtcctcttgtcgttgtgttccaaattcggtgcatgtacaccttacttaacaaattgttggagcgtttgtaaaattatttaaaattatttgttggttgatctacaaagtccactctcttataaagtaatgcagtttgcccacatgatgaacaagtcaacggaagaagcaaattaatctgcgcccatagtttcggccgatttcgggtgggtttcatatcagttttactctctccggtttcattttaattgacgttttggacatcaaaattttataactttgaccattaataactttaaaaatatttagaaactaaaacaacaaatatagatctgtctttcaaagcactataatatatataatatataaaagtaaacatatatttatttattgtatatattataatagaaatataatgtcaaaggtatattttgtagaccgtgtcgttgtccaaaacgtcaattaaaataaaaccggaggaaataccatataacgtacatagaactctgcactgacacatgaattggaactcggaagtattctcaatatatacaaaaccatttgtaaaaagaagaaataaaattcaatttttatcactgctatgaaagaggttttcccaaaccgtcaaaatcaatctttccatgcggttgggctagccgtccgcacgagaaggtctgtaaagatcacgatttttccatgcgggtgcttatgaggacctcatgcaaaaataaaaaatcatgaaaaaaataaaatttcaaaaaaaaagccaaaccctaactcccgccgccacccgctccttcaccggcgtccctccccccctccttgagggcggcgccgccagatcctccgcctgctgtcgccgaggtcgccactgcacccaagtgcgacggattccccctcctcccgaggacggcgccgccggatccgccgcctaccgtcgccaagccacagccgcacccgagggcggcagagccgccaccgttgcggaggctgcgtagccaccatccgtcgcaccctcaccgtccgcccgccgccgcacccaacagccagcctcctcatcggcgtcgctgcccgcttccgcccacgtggattcggaggaggagaggagagagaacgagaggagaggataggagagaaagagagtagaggggagaaatatcagatagggaaagagacgggtgaaaaattttaaagggttgagaagggaaacagagagtaggagagaaaaaaaagagggggtatttttgcaagcggacaacttaagcgtccgctgcgaaaatagagttttgtatgtggctccttaatagcaccgcatgtgaaagtaggcttatttttgcatgcgcggtccgttacgaggtccgcctgcaaaaataattttttttgcatgcgctcctcttaacaagccgtatgtggaatatgggtcgatttttgcatacacggacacttacaatccgtttggaatctattgggggtctcgtctagaaaaacgttttctctagtagtgtatccttatttttcgcaaattctattttgcaccttaattctagaaccagttgttttatttactgtaatatttacaaacctgacaaatagcgcagtagactatatattcactactgtttgaattggtattacagttcgctaacatgaactattgtttgctataatagcgttgatgtgtacctagttattaataagtggcattgatgtcagcagcacatgtataacgggattgtgctagtgaaaaccactgtcaatccaaacaaaaccatggtacaagcagggtccacactttcagaaaccaccaaaaattcggaagtggtcaccaaaatttcgtaaattttgggattttggtactcttttgcacaaaattattttaaagttcaacaaatttggactgaatttgaatatatttaaaccacattaaaaaaaggaaaatcaaaaaatttcggccgagatagttgcttgcttggggggtccaaaatttcgaaccaaaatctctaaccttgggtacaaggtttttctttatgcatgttctaaaagtcaaggatgaataataaccgattttatagtttagggtggaagtagactttgagaaaggttcaagggctaaaactagacttttccctttttaaaaatctaggttatgagttgagagaccaaaattgattacattaaaacatatttatatggactattaaagtaagaaagattgttataaaccacacgtacatatatatacggttttgctaaaaaactttcgataaatttattttctcaaaactttcaaattttccaccgtcagatgttctttaagattcgtgctaccgagataaaaaaaatacttgcgcacaaacaaggaggatgatgatgtgtgctttcaagttagctgcagtagccactagcgatgatgtgtgtttttaaaagaaaagattaagttaaatactagttatataagttatataatagttacattgcaattataaactagttacatttgaaagtttttctcctaattaaaacactgtcgaatgttttataggtgcttcaaaccatgtaaaatctgtcagccagttggagagcacccatggtttttagccgcggtgcactggcctttggttgaaactggatcggactacacactggtttaaatcaaccgccttaattcagtcggttttaacgactgtgcctcgagtgcaagagagcagataatgatcctcatgaggttctgagtggatcacctaaaaaacaaccagtggaaatgtggaattagtttagattagcaccactggaccgttctacttgtgtatgtatataatatatatatatatatatatatatatatatatatatatatatatatatatatatatatatatatgtaagaactgaaggactggtacgtgatcgatcgatgcagttcatgcaaaagctagagcagatgataatgatatatatatccacatgaggtccgtgatacttgtcgtgccactgcgataaccacaccatcaacagctagctaaaataatcatgggattcgtcgccgtggtcgatatggtttccgggctcaacagcccaatggcgagattggtccggatcgaagtcctggtgctgctgggcgttgcagcgctgtttgtgctcctcatcctcggctcctaccggcggcagtcgagccgcaatgccgtcagggtgagcatctgggtggcgtacgctgcttccatccccatggtgagctacaccctggggctgatgcagtcg

SEQ ID NO: 73866 - DNA, 2094 bp, Oryza sativa
attgcagcccttgccgcggtagccgtcgccgtcccagccttgccatattaaccgtcgtcgagccattcgctgccagatctagcgccggtcgccagccccctttgctgctatcgccgctggtggcctcatctccttcggacagatctaggagagggaggggagaggagtaggaaagccagcaccgttgctccctctgttgccgctgcggccatcgtccttgatccccgccagccaaatccgggagagagatgggaggcggcttcatcgctgtcgctccatccatcgatgctccccttcctccacctctccatccctcccctttgccgctgttggtatttcttaacgacattactagaaatataattcccagcaatggcacaaaaatattactggtatattacgattacagatatggtctgcaagcgcacggatatactattatagcatttcacccagaagactatactaataatttatatgttacttgtataaatcagagtgtaagcaggggttaattaattcaagggtagagtgacacgaagaagaagaactaagttactctcattaaataaatccttggctaagtggagaaagaataagaaaagaattcatcctaatacttctagtatacaagtatctttaatttaagctctatagtatacaatcatgcagccaatacccctctatgccttcctggtatttcaagagaccacccctgattgccgagtttcttacgacaacccgtcatggccgtccaaccggaaatgaatacggaggaataccaattaacttaggactatatactaacgtggatgaatacccgtactgagctgtcaccatcagtggcccaactctattgtcccgcagcatataaccccaaataatgatatttaataatctaagcaccatgcttacattatcaaatactactctatatctactagcatgacatagagcaatcatttgcatgaacattatatccacaccattacatatctttggtaagctagctacacaattatatcaagataaatataaagtaaagtcggtactcagataataagaatgaagtaaaataccaaaactgaataaagaagaatatttaattaattgtacaagtattacaaaagagagagaagctactagagccatacccgaattctcctgaagacttgaggactaagaaaactattctatttcttacttcactagcactagaatactaactaaacttaagagagagcttttgatattcttgcttgagtgtgtggagaagtgagtgaggtgagcttcttttataggctgagtatgatggttggaaaggtcggaaacgccctccaaccggaattggagtgaatcctgaacgtccacgctaaacctagcctcaacggctgagatgggggttcggccgaaccctggactggcccaatcggcccaaatcttggcaagcctcctccccgttgattccttagtccactgacgtggtgtttataggccttttgagattatctttggatttataggcccatctatccacaaatctacctctcgacggcttccgattgattgttcatctgttttcctctcgacggcttccgattgattgttcgtctgttttccatcgattcatcttctctttatgtagcaatctctaaaatcaaatagaatccaagtacaagtggaaatagattattctaaaacaaatatgcattgcaagcatagctagttctccgttattttgagtatattgatggttgaaattggtctataatgaccatcaacagccacccctacccctttgctttcaccggacaccgccgtgacccttcgccgctgctggccctgctacctttgtcacttgggccaaccaccgtcgaattaagaaagagagatgggagggaggatgtgaggaattgagagagacggagagaggggtgcggtgggaaaaggaagaaggagagagagatcgatgtgcgatgggataagggaagaaggacctgtcccacattgaacccgacccgttttcacccctacacctcagttcaaagtgacatttaactatttgccgcttttaagatgtggcaattaagaatt

SEQ ID NO: 73867 - DNA, 6171 bp, Oryza sativa
gcaattaagaatttaccacttgctatctatgacatgtgtgccttcatatgtatatgacatgtgggtctaatgacaaatcctttattaccactcataaatgtggcaaatagtaattattccccattcaaaatacgtgacaactttcccctatctacatcacgtattcacgtgatagtgattgatccccttgtgtcgaaatatgaattcggcaataatgaaagggggtagcgcatgagacctaaaagtggatggatgcagagacaaggatttagacaggttcagaccctctcaatgagaggtaataccctactcctgtttggggatttgaatccgccgggtgaattatagatctgatgatctagttgtgtctcatgcccctagagggcctcctgcccaccttatataggatgggggggtaggattacaagatagaaaccttaaccaacacggtatcggtttcctaaatctactttacaatattaccaaaccaggactttaggccgttccgtaatatacaaggaaacgtaatacccaagtcatgatctgttatatattccatagatataagttatcccctataactagtcggataaccatgccgtgtgggtatggggtacccataatctccacagtagcccctgagaccttcacagtcgaaaagataatcttctctcgaaccagattactccaaagccaagtgcttcaatcatctttgccatggtctcccgagtacttttaccaaatatgaagactgtggagggctgaaaaataaagtcaagtgcatcgactagatgcacctaataggtgtagcccccgactatgtggtttgctgaacaaactaagcatacagtcaaggaataaataatccaaccaaccgagtggttttgataattgtaatcaaccaagtgacttgatatcaatatatagcatatgcggtgtgaatcccccaaataacatgatccaagtgatataccgactgctttataaaaattgatgtgagcaatctaaagttgactacatcattgaaaattcacatagcaaaatagctataaaaaagctcgaatgctgtgaataaagaaatttctaaagtattgggcatacgccatgtgcacactgctttaacagatgtgcttaagtctctaaaagacacatggtttcaccacacccgaaaatatacggcatatgtggtgtaaaatccgagtaaataaactcataaaggatttaccaaccgcctggaaaatgaccaatatatataatcagcctaagccataatattggtcaataaaattgcacacttacgtggcaaaaagcaacgatattgtatccaatcaattgcttaaaaacccaaacaacaccttgacttatataaaaaagtcagcggggcagctatataaagctttactatttgacattttttaagatgcattgtaccaactcctaaaaagttgagtaactgcggtataaaaggattttaaggtattgggcacttgatcacgcgcactttggcctaagcaaaaagtgtttaagtccctaaaagaacgtgacaggccacacctaaaaatatgggctgcagacatattaggcctaggccaaaaaatatgccttcgacacccttcaaaggatgacgcatgtaacatgctcccgagtaataaatcttccgggtgatatagaccaagtgtagcttatataaatagcttctgatctgagtgattatctcttatgggatactccaaaatagatataataattgaatcccgactggcgcaagtattcggttgataacccttattgggaataataaatagttcagtctttgagcatagaaaatagacccatgatcatgaattcatgttgcatgtatccggaacaagtccaaattgaaggtatgatacttgtatttgagctagtaagcccctgagcatatagcttgtccttctgtcgtagtcacaattgttcattgatggtagctgacacagttggcatagagacaagacgaccaatatagagataatattgcccaccagaggtggcaaaaatattggtggtagtgaagatagtgataccaatcaaaagtgatgaagtcgcacagccgtggaggagaagaactcagtcgacagcagtcaggctagcaagcagtgtagatgaagccatctggcaacagtgacagagttgtgtaaccatggcggcaaaataatcagtcagtggcagacaagacggccagtggagaagtcaaagtcgcacatcagtaaaggcataataagccagtcgtgaaggcgatgacaccagtcggtggcgacgaaggcaagctgatggtaaagatgtagatgctcatcaagagtaatggcgaaatccaccaatcatgaagattaagaaaataatcaacgactacaaatgcaactaacggtaatggcgattagcagcaacagagatgatcgactatgatgacgaagttgcccatgaacggtagcagagtaggctatgttgaagaggcttgataggatgttgatgaagatgagatgtcggtgatccagtcaatagcagtgtagcagccaatgataatgacgaagacgctcatcagcgtttgtgtagtaggtcaaccgtgaaggcaaaataataagtcggcaaagtcgtagtcatccattagcaacggcggagatgtcagggccgatgaagctgaggtgttggtgatgatgccagtgacaataatccatcaatctattgagaagatatcaaagctcgagtagtttccttgatgcgggcgtgtgcataaagaagacgatccaacgcttcttgatttacgaagatgactgcagaacttagtgttatagctgttgtagatgcttcacttggaggaaagtagatgttgttgtccactcgtctaaactgagctgattggttgataactccaaactcccgaacctgtagattaaatcttgaacttgatactttgagaaatttggagtagattatggcagcgtctagaaaacaaaattgccagtaaaataattggagttgctaaagtagaatgtcttctctgaagcgaagacgaaaataataactcccagagttgactcgttgattgattgatttcttcatcttgacataaaacttgtcgaattttgagtcttgtatttgtgtagcccccgactctttctttagttgggaaacaactgaacatagagtcgagaattgtagcttcttgtcgtcgagtagtcattgcttgagtgaagatacatattgaagatgtccaggtagaaatattgaagattggaacaccacttgtagtagtagaataacacggcgtcgaatctggaagtgcatgccaagatgtcgaagctcttgtagacgtcatggctagtgaagtagcaaaacttgcgaagtagtagcaatagagtttgctggtgccgaagataataaaaatgaagtcgctccaccatggtgacaaagttgcatagccgtgataaagtaaacacgagtcggcggcaacaaaagcaaaccagtagcgaagacgcgtagttgtgaagataaaaacactagtcggcgacggcttaaccagtcggtgacggaagaagtagaatgatgacaaaaacaaagacgtccttgaacggcggcaaaataggccagctgtgaaattgaagtcaccatgaacagcaacggaggcaaactggcgatgacgatgatgctagtcaatgatgacgaatacgcgcagtcgtggaggcgaacaaaccagtcggcgtcagataaagtgaccaacaatgaagacgatgacgtccatcaatagtggtagcggcataaaccagccgtagaggcgaggacaccagtcaacagtaggcgagacgtccggcgatgaagacgataaggccaatcaacagtggcagaatcatgcagccacggaagtgaagaaaccaatcggcagcagcttgcgttgaggatggtaaggcctattagcggtggcggcgacatggccagccgtgaagatgacaacaccagttggcatcatacgaggcggccggtcggtgaagatgtagacgtccaacaacggcggaataataggctagccgtgcaggcggagacaccagtcggcggcggcgaaggcaagccggtcggcgaagacgtagatgcccgacaacggcggcataataggccagtcgtgcaggcggagaaaccagtcagcggcggcgaaggcaagccagtcggggaagacgtagatgccagacaacggcggcataataggccagccgtgcaggcggagacaccagtcggtggcggcgaaggcaagccggtcggtgaagacgtagacgcccaacaacggtggtgtgaccaaccaaccgtgcaggcggaaacaccagtcggcggcggacgaggcggccggtcggtgaagatgtagacgcccaacaacggtggtgtgaccaaccaaccgtataggcaagggcaccagtcggcggcagacgaggcggccggtcggtgaagacgtagacgcccaacaatggtgatgtgaccaaccaaccgtttaagcaagaacaccagtcggcggcaacgacggcaagccgatggtgatgttctgactgatccattcctgaagcgtaggagataagcttaaagccatgaatccctactgtgcatatctggatctggatcctgcagaacaaacatataggatgagtagtatctgatgtaaatataatactcgaggaacattcaagtattttaaaatgtttataaatatatatttctcctcttgtcaattttgatttccccgagcagatgactccttacgtttaaacactctgcccgactagtcatagcccccaagcactgggagtcggcctaggcacttcccaaacatgcaaatgagtgacatgagttcgtcattaatggagcaaagtttcatggatcggagtttactactcaggtacttttgcaattattaagagtagaaaataaattattttatctatatgcttttgatttattccgaataatacttagcaccttgcgttactcggtccatccaacgagcccccgagtgctaggaatcggcccaaaggcaactatccattgacaaaccaaacgggaagcataggaagatagaactccataactcgataggcactttattgatactcggattatttcgtaagcaatcaagataaatattatgaaaattgttgaaaaaatatgatataacatctgtagcccccgtctcactagtcaatggcgaaccagttgatgtagtgaggcagaggaaaatgaaaatatcatataaagaataaaataataatgacttagcttcttggtatttccctcgatgacaacaaaggagaccgatgtaggaacgaagtcatccgtcaatggcgacgaaataagccagtcatgaaggcaaagacaccaatcggcggcaacgaaggcgactagtcggtgaagaagtaaacgcccaacaacagcggtgtgaccaaccacccgtatagacgagtacaccagtcgcaagccgcggtgataatgaaggcgtagacgcccgacaacggcggcgtaataggccagccgtgctggcggctagtcggcggcggcgaaggcatgccggcggtgaagatgaagatggccatcaacgggggtgtgaccagctaaccgtgacggcgaggacaccagtcggcgacgttggaggcaggacagcggtgaagtcgtagacgcccaacaacggcgggataataggccagccgtgtaagcggagacaccagtcggcgacggcaaaggcaaccacggccatcggtgaaggcccatcccggtgagatgtcctagctgactgccaacatgaattggcagccatgccaaatatatagatgaacatactgtagatagcttgatgtactgcattgttcctcaaaaaattgcatggtgttgggtttggtccaattgatctgaacagagatgaaaccaccaaagagggcaaaaactctgcctctgtgtgcacgtcatcgaggccgtggtaagtgcagatcatcgtggcaaacaaaaactgcaaaaagtccggcggccgtgaccggcgctcggaaagctatgcatgtgtgattgttgattaagccatgcacgcacgtgagatggaggcgactggcggcgacttctgtggtgctgatgcggtggaggccccctggtcaactgaatgcatatatactc

SEQ ID NO: 73868 - DNA, 12510 bp, Oryza sativa
cataaatttaatcgaagttgactggcaggctaaaggcccagcaatgtctccaatattcttctctcgaggcgtcagatatttcattatgtttgtttgatgacttgaattattcacttcatctctcaaatataatggaaggtccggagaggctacggcatttaattgtaagaaatataacggtgtgagcgaataataattgtttgggtacctaaaagttgcttttttgagatttattatgataaattaaaaatattatctcaactacttaaaaataaggagtaaaggggagataagacgaggtgaggagaggggtggtgggacagttggcagaaaggcattgtgtatatttctaatgatagaaaggcattgcatatatttctaacggcatatcattgtcatttagatttagaaatagagactgcctatctaacatttgatagaaaatcagcctaaaattctggcaaatgtaattatcgtataatagcagtgtaattacattcgtaattcgtatgtaactccagtacaagaaagatgtaattattattgtaaaatagaaaaatttacaaagcttggtagtgaacacatgctctagcgttttgcacgtcgatcgccggttcgatccttggtatccatgcgccatttgattttttctctcttccacgcatgcatcttaaagcatatctaatggtggaaaatttgcatgtttttccccatgattttctttcaaaagataaatatcagttccataaaagtttgagaatttttaatgatcgtctttaatttagtggtcttggggccaacgtgtaatatttgtcttttactctgaaatatagttcaatgcgcctgaaatcgtttgagtaaagaaatacattagaatggttcaaatcgatcacaaattggttatatacaatttaaaagccataatcacttaaaatactgtttatttatttttaaaaggtccaactcgaaagtataaaccacaaatgcatgcgaagtgcatgggtgcaaccggtgtatagtccgctctcagccttcacgttagaaaaagagaagtgagaatttaattaagtttctatataaaataggccattaaatatcttaaccaccaataaaaaggaaaaaaaagaaataggggcctacaggaggtggcaggtacgtgtgcgtggagagagctttgggcctttggcaggagagggacctgtaaattaatctaatttaacggtgtaaaattatgggtccaccagtttaaatgaaaattaatggctagatcttttgcttttttctcggaatttctaggactttctctaatttattagaacgccaagtggcgacgtgagagcgttttgaggaagtttaatgggcttttaagtatgtaatagatcgttgaccaataccaaagcaaacaaccaatgttagacgtgtagtagctgtatccatagtctaccacaattttaagatcaaagccgtgcctcctagtataacctggatttatattattgaaaggcaagattaagattattgtttgtttaaaaatgttgtcaaatagattaagggcaaactaaagttgtgataatggtattttataataatttagggttctatttttcttaaggtatctcaaaaaaccattcataaacttttgattaggagatggattaagtactttaccacttttgaatcatgtttttttctcgagtaaataagaaactattgctagttaattatcatgcaatccatccatatatatgtccacaaatgaaaaatgcgagagcaagatatttagaattcttgtgaattaaatcgtcttataaaggcgcatgatatagtaagaaagggagggaagtgtatgcttggaaaaaaaagaagaagggggaaaatcaaaaaggaaggggaagtgtatgtacccacgtacgtaggtgcgcacatatgccgtgggaggagaggtgggatctcatagtatttagtttgttctaagatcaaattaatctaacggtttataatattggacgtaccgatttaagtgaaaatcaagcaatatatactttgctttgtttttcatagaatttctaatatttgctctaatttattagagtaccacgtgacagctcgagagcattttaagaaattttaaaggtagaatattaaccgcgtaatatatatttatggggcatatggtaatatttgttccagcttcatcgatgtttatatacatatagagagaaattaattatatggctagcaagctattagatgtctaattagtagcaattaattttgacatctatttacagttgttcgtagtagctcttacatattcatcttatgactttgagtatccgttgatccccaatttactgttcaccatgactcgtatgaaaaaaaatatgtactacttagggtttaggacaactgaaaatgatgaattatctaatttatgtgatagctatttgagggtataaatgaatgaattgacttctaaaagttaaaatgttgttggtaaaaaacaccatttagaaacttggaacgcgtgcaaacgaaaatccaaactatggaatcaggaaataaagagggtcttaaactcccttgtcttagaagagttctattgctattcgttaatattgtgctcacatttataacataataatttctttcacctgtacgaacaaatagtacaaaatccaaatacgacataacacaatacactataattattttgtaatcaactcttggttcagcttaaacggagctaagtgttccaaaaacataacccacgatgcttaattcttctctcgctgcatcacacctttaaatttcttttcatgctattaacaaaatttattatctccatatatgatttggcatgtagcaaagtggtagcgctgcggcggtcgtgatcaccttatgcctcatacacgatgctttgtcacacgtgcaaaaggaaaatgtgctgacgtgcattgtgcagcgggccaaagagggaactttggacgctttatttattatcaaataatagattcgatgatttaaataatgggtccaccggttttagtttaagtgtaaattagttgatatatattttaaattgttaatttaatgggtacacaatataatgttgtagacttttttttgaaacagtgcattatttgagaatgatagtccactgtaataaaaaatagatccgatgatttaaataatgggttcatcggtttaagtgcatgtataaattagttaatatagattttaaattgtttatttgataggtacacaatataattgtgtatactttattttaaaatagtgaattatttgaaaataatagtatgagtacgacggtttattctaattgaagttatcttactccctccggtttcattctaattgaagttttgaacaataatacggtctacaaaatatatctttgatcttatttttctattataatatatacgataaataaatatatgtttacttttatcatagttttaagacaaatctatatatgttgttctagttcctttaaactaaatatttttaaagtcattgatagtcaaagttataaaagtttgacctcgaccttgttcaaaaggtcaattattatagaaccgaatggagtatattattaatttaatgggtaccatataatggtgtcaattttattttcaataactgtagagctaatttagttacatgtgagttgtatgatggtagattctttgttagtaaaattatgattacataaaaaatatatatccattatataaatggaaaaagaagaaaaaaagaaaaataagaagggaaggaatgtacgtacgtatacctatacatgcgtgggagaagaggagaggtgggatcccatagtatttggtttgtttattcttggaatttttatgattttttctaatttattaaagcgtcgcgtagcggcttaagagcgtttgtaggaaatttaatggacttttagtatagctacacatgcccaggagaagaggagaggtgggacccttagtatttagtttgttttttcttagaatttgcaggattttctctaatttattagagtgtcacgttgcagcttgagagcgtttgtagaaagtttaatatgaacatttagtattaataataatagatagatagatagatagatatattttattttttttaaattgtagtaaatcccgtcgattttctttccaacgatggtagtacgtacatatgtttctttggctttattttcttttatacgaatatggtcttttttttttcttgcggcacagtaggtaagctttattttttttcctttgaatcgtacctagtacagacagttatatatttgttgtgtgggaggaaggtattattttttttaataacagatctaatctaatggtcaaaaatatactgcaccaatttaaataaaaatcaatggtgggattagatagtgccatgtgtcaatctaggagcgtttataggaatcccacatggtctttttttttcttgcggcacagtaggtaagctttatttttttcctttgaatcgtacgtagtacagacagttatatatttgctgcgtgggaggaaggtattatttttttaataacagatctaatctaatggtaaaaaatatagggcaccaatttaaatgaaaatcaatggtgagattagatagtgccatgtggcaatctaggagcgtttgtaggaattccacatggcgacttaagagcgtttgtaggaagtttaatggacttttagtatataatagatagattaccaaagcataaaagattctcagccactcgttgaatgaccaattatgaattaccaaaatcatatgttctacacatatggattctatttaatactagcctgggtactttggctcaagcataaatgcaaaatattctaatagggccaatattgcaaaaacaacatctcttgataataataacgcaaagctagcccattggccattcacaaaagccggattactaagaagcacaactttcatggtgcaaggattataaaatcgatatcttaatggtgatacataaaaacatacatgttttggcttttaataaatatcaaacactcatgagccaaatcatacttcaaatgaatcgcttctttcatccggaatgtaggtatcatcatacctatgccagcactcggctgtcacgtgaccccatttcaagcaaacctaagagatggggcgatcattgccaccctgggttgatttccgctgttgccgcgtccacgcccagcggtggcaggagcgccattaccgcgcggagtacttccgccacgacaaccgctacatttgccgatgccacatgcacttgccgaataggtcacctggtctcaaaattaagaagttgagaacaaacttctgacattgtgaccgtctcattgcgtgccacaatagcagatacaacaggttcaaaatcctcatttagcccatccagaatgtaagcaagtaggtcttcttcatctaagggtttcctggaggtagcaatttcatccctgagagctttcatcttgccatagtattgagaaacactcatgttacctttttgtgcattgatgagtataagccggatgttgagcgactgtgcttcggtttgggtagtgaacatggcgcaaatttgctgccatgcttgcgccgccgttgatgcaatagccacctgggtgagtacataccttgatagggtggagagcaggaaccctaatacctgttggtcggaggcgaaccactcttgaaaggcgggttgacgatcttctctgtcctgccgtcggtggtgcgctcgatctccatggatgggacagtgatggtgccggagatgtgcccatccaagcacgacccgcgtatggctgccaaaacttgctctgaccacaactcatagtttcctttgtccagtttctcttaaacttgaacgctgaagagaggattggtgagggtagcactcaacgaggaacttgccatcaccaggcttgttgattttgccggactttacagctctgatactgttgacgaaaaaaatcgaacacaccggcctgagagatctgcttagctcctgtgcaggtccaaagattggtgagatgcgggcatgtcagtcagtttaatcctataactgacaagatatgcaaataatagacaaaacagccaatcggctgacaagccgatggagcagttccagccgatagccgataatagctaaatgcgataccagccgacagcgatagggttttgagcaatcggctatacgtccaatgtagattctaacattttagtaaataatgatatatagtcaatcggctactgataatgaaatataacagtaatatagtccagtataaaccaatcggctagcattgatatgatagaataagcactgatttaaaggttaaagcatacatcggctggaagtccgatgtcatgaaatccacaagattagattaaacagtgaaacctttgttatcatcggcaaaatccaacttatatgtatatgcaatccttatgagctgatgcaacgtccagataactcaccggctaaaaccccgatgaaaccctcattagcaatcaagaagcaggctagagattatggttcgaagcacgacttagtagatcaagcttaactgttgcagcactaagtatgaaaagaaacataatatctagaaaatcaagccgttgattgagtttttggggtggtagatgtctaagctaatctaatctagcaacgcgatttagccgataccaacagaaaccctaaaacgagaagcagccgatagagctaaattgatatgctaagactagattaacagagacatatgataaatagttaggcaaatatatcatccaaaccagagcaatccaagaggtcgaatgtactgatgcagccttaccccctagccggagatcgaacaccgatgcagccccacgtcaggtgccaagtcccgtcggacgataaaataaagtagaaaaggtaaaaggtggcgatgcgccgaattgtattgatcgtgaagatagtttacaatgaccccgggtgtacatatttatacccatgggtagatactagtccttgtaggacaagaaagaaacttttctaaagataaaaggaaaacataaagtccttacaggacactaaacacactttcctaaagataaaaaggaaactaacaaactatttctaattaatagataacttgccatgccgcactctctttgaactcggtctcttctggataagcttcctttagtagatcaatttccttaaccgaatatagcaagaatccgacaactgacaacttgataaatctcatcggctaatctcaggacttcgaagcctatgctgactctaagctgatgattacttcgggcttaccaaatttcactgttaacagatgccatataagaactcagatgcgagtggaggaagcgtcaaggtggacacgttacgtgttaatcagcttgtgccgaatcgtgctattgttacatatgtatatgcatctggatagagttggtttggaggtcgagtcggccagtcagaccgcaggctggccggtctgattgacagcacctgcccagtctgaccggttctcacctgtcagcagcacctgttcatcacatgcaaatccaatcatctccaaaaccacttcgccaataatctccaaatattaaaaccaataattttagatgccaattgtttatcacaaaataagaatcaaacacactttgattttacattgattacatgtgataagagtcctacctttctatctatccaaaccaactaaaatccatgcatatctgttacatatgataatatctaacagcaacttcgtcaatctcaattatgatatgtcgaccaaatattcgaagatgcttatagaggtagagtatgcgtgtgcgtatttataggagtgaatatgggtgcgtttgtaagaacgcctacatttgtactgagtttcagaaaaaaaaatagcacagtttttttatggtgctactttgaaaataattggtccaaagttccaaacctaaaatcatgaaaagcaagaaaaagaagacatgcgtgtagatggagaaaatatcgtgcaaaatcatatttatttctcagaaaccggttaattaaaccgttatggagggggcacatggaaaacagatcgaggtgattttaagaattattatataagaatgtgcaaggcatactggtaagcaaatatacgtcgctattgtctattggacacgttgaactcacgatgaaatgtcatgtaggtttcatagagatctcacatttgcattaactgtgagaagcctcggtcatagccggtgatgtctcgtgcaagtgacaccaaaatggtgtgatagatagggatcaaaatggtgtgacagcaaaatggccgcatcaaagctgaagagaggcatgtggcacagtgaacagaccgatgtgattattgtaaatcaccatctccttctggatgaatgtcaatgccatctgtacattgaccatgaaaaagagcacctgtgatgcacagacagggcataagacgctgtttagatgggactttaaagtcgctatcatatcggatgtttggacactaattataaatattaaacgtagattattattaaaacccatccataatctggactaattcgcgagacgaatctattgagcctaattaatccatgattagcctatgtgatgctacagtaaacattctctaattatggattaattaggcttaaaaaatttatctcgcgaattagctttcatttatgtaattagttttataagtagtctatatttaatactctaaattagtgtctaaatacagagactaaagttaagtccctagatccaaacaccaagagcagcagcagcatcttgtgttcctccatctggtacacaatgcacagcctccatgggcccactactacataaatcgttttcccaaacggccaaaagtgattttgcatctggacgggtggtctgcctacatgcaaaggcctagaaaaagaatataattttgcatgtgaaaatccgattttcgtaggcggacgccgcatgcaaaaataatttggagaaaaaaattccaaaactaaaaaccctagatccacgatacagaaaccctaatacgttgctgccgtcacaccggatccactgccatcgtcatgttgggatccgccgtcgtggtcgtcgatcgaggccaccactgatgtggtcgaagtcacctgggcccagtggtccaacaacggtggatctgcaccgtgctcgaagtcgcccgaggcccggcggcgcacagatcctgtgtgcccgaggccttgcggtggtggatttgcacacccgaggcacgtcaactgtggatcctgccctccgctgccacccggcgtcatcgtcggtcgtcgcagtatatgacatctgctcgctcctgccgcctccgccttagccgttggagtgggagggggagaggaaaggagaagagggagtatgaaaggaagagatgagaaggagaggagtaggagtggataagaagagtgtgagaggaaaggacaaaatgatgcaggaattgttgcgtggggcccacttgctctcccctttgttcggatgcaaaaatcatgtggtttcttaagaaagcccagctgaaaaaataagtatatttctgtacgcggacctctcagggggctacattttcacatgggaagtggcccgtgaaccttccctcggaaaacgatttttgcagacgcgaccaattacagtccacctgcaacctttatgggtcctcgtatataaaaaatgtttctgtagtagtggcctgtatgtgttgctactaattcctttgttgtccgagggtgtcgcggtagaaaggcagccttatcatagaacctggaaaattaatatataaatcatgcaaatgtagaaatacaagtgaactattaaatattttcaggttgctaatgttcaaacaaagtatttcctaggtacaatcaacttacgtggatggtgattacttacccctttacttgttgagtacatttagattgatctataatggtagtattttaccactattatcactcataaaagtggtcttggctgttgttttatatattgtagtactagtaggaaaaaaatattttagagtaaagtgcatggctggtccataaacttgcacgactatatcatctaggttcccaaactcttaaaatatatatttagatcccaaaacttgtaaggtgtgtcattccggtccaaaatggcacaaccccttcaagatcctacgtggcgctaatgtggcatgccacttaagcgccaccaacacagtatcatcactaactctacactgacaaatagagccttggcgtccaaatgaagaagaagaagaagagaaggaaatgaaaatgaaaaaaatggagaaaaaagaaaatttctgaacgggccctacttgtcagtcggtgtaggattggtgaatatgccacgtcaacgttcatgtggtatgtcatattggcatcatgtagcatctcggatgggctgttgtactttgggactgaaatgatacattttgataaattttaggacctaaatatgcatttgacagtttaacgacccatataatacggtcgtacaagtttagagaccatccgtgcatttttactcaatattttactaccaatagttggtgtggtagtataaatagatatcatccattggattagaaaaaaaaaactatgtagctagattggatcttctaccagtagagagttttaattgaagaacacctcttgtttttggactattgcatctcatgttggagtaaaagtactctattttaagtaatcacataacttatacttgcagaaggcccttgcaaaacaaacatctcacaactaagaaaacattttaaaaaaaattgtatgcagtaactgaattatttcatcataactcaagtacctgaatttattggtatgatggatcttataacttgcttctgatagtaatgatagctcatggagggttgagctataatcaagtaactttggatggcgatttcttactaacggaataattacttgagaaacactttttataggactttcttcatgtttcttgaaccagtacaccattctaccacccacgaacacagtgaaaccaacagtcataacaattatcgggattgtgaatctgacaccctaaccaatattgtcctacacccaaacaagaacagttgctgacggcaattatccagtagtagtaccagttgaagaattaatgagcactccttatcccactttagtggtcagcaacatcaaactgattggcccctagggctgaagagcagagcttgatcgatgcctctagttccatctgagacaagatagtgcccaaggtagacggtaacatgatgaacactgctatggtaggacaaatgcaaatgcaatgaaagtagagaactattagaatgagcatcaccaatataactaacagatatattagaagtcacatgcgagacatgaccaggattagaggattatattaaccggttgatatttttcttgttacacttacaataataaaaattaagagaaaaactattattatctgctatcttccccaagatctgatagcaaataattctccaataaacaacgtgaaataacaacggctcatccaattaaacacaattcttgccatgtcaagatatgtaaatgaaccgtctataaaatttttcacaccttgataactgattgcatatttagctttacaatccttattacatatccagctttacaatcctttggaagtccatgataaaccccaatataacatgctgccacatttaccatagcatctcccgatgttccagccgtaaattgatactcaaccattttaattaaactcatctgatatcctttcttaatcaacctaatgattgtgtcatatctcctactagtataactaatgtgcccacaaactagagtgcatcttatcacaatcgagaccaccgtttgtgaaaataaatattcagactgaattagtggtaatttcactatgttgatacatgtatgatcttcagaccaaccggtgaaattatcggtgtcttaataggagaagggaatatcctcaaccttaaaaaggattagatctatttcgatgttaactacatctagtttttcatcttagaaacttctgtgtagttcaacaatatcattggttacacattgggataaagaagatatctatcttcatggatgcatatgattttacaaataaattatctaataagatctctatctgtaaggacatgttttcactcattacagtaattgtctaaaacatgtgttacggtcaacaaatagagactattttcacgccgctcaacaaaaaagctggtaacattagttgtctttatttttaccttatccgcccgcttaacattgagcctagatatgattttataatgatagaaagcaagactcgttattttttttcttaatgctttatggttaatttgatgtggaaaa

SEQ ID NO: 73869 - DNA, 10839 bp, Oryza sativa
cgacctcgtcgtcgtcgttgtcgtcgctctcgtcttcaaaaatacgactatcctccccctgaacctgtgacagtgtacctgtaatattggctctagtacctgggctagcctcatcaaaagaaacttcgcaagtctcaacaattttgttagtctccaaaataagtacacgatagccacgagtatgtgcggggtaaccaagaaacaatccatcggtagaacgtgcctcaaacttatccaaatttccagatttcaagacaaagcacttgcaaccaaaaacacgcaaatgtgaaactttgggttgatgtccaaatcgaagttcataagaaatttttccaagttttgatatcaagaaaacccgatttgaaatataacaagcaatgttaatcgcctcagctcaaaattttctaggagttttatattcatccaacatcgttctagccatctcaaccaaaacacagtttttcctttcaacaacaccgttttgttgaggaacacgaggagaagaaaattcatgttcaagacctctttcattgcaaaattgttcaaaagaagcatttttaaactcacgaccattatcacttcgaattattttcaaagaaccaggaaattcaagctccaatcgaagaaacaaaccacgaaagtgttgaaaagcttcgtctttagtttccataatgaaaacccaagaatatcgagaaaaatcgtcaacaataaccaacacataccacttttctccaacagattgcactctagctggaccaacagtgtccatatgtaatagctgtcccggtgcatccgttatcacagaaacaataggagcatgtgaagtagaaaccatcttagcatgacgacacggtgtacaaaccaaatcaagatctttcttacgtttaggcaaaccatgaacaagatccaaaccacttaacctagtgagatgatgaaaaccaacatgtccaagtctacgatgccaaaacatcacatctttatcaaacttagcaaccaaacatgttttcacaggtgaaacaggattttcaaaatcagctttaaacactcttccatagcgagaaatattcaacacagaatcaccacaagaatcaaaaactttacttccagttttctcaaagtgaaccacaaaattttcatcgacaatttgtgaaactgaaagcaaattgtactttaagtcctcaaccaaagctatattcttcaattcaaatttttcatttaccttaaccaaacctatagcgagaacggcacttgtagcagcatcaccaaagataatcgattcagtcttagatgccttctttagggaggagaaccaatttttatcactggtcatgtgtcgcgaacaaccggaatccacgatccacacgttctccttccttgccaccaaagcctacacacaagcagaagtcgaagcctcagtactggggttagatgataataaaaatttaggaatccagtactgagacacacgaccagaagatccaataggcatatatacacgtgcaaaatcaattttagaatttacaaaaaaattcctccgaggccggtctgaccgagggtgtgcagccggtctgaccgggggccggtttgaccgaggcatcaccgccggtctgaccggtggtcggtctgaccgaggctgttcagccggtcagaccggtcgctggtccgaccgcgggacccactgcggtctgaccagtttcctcgaggaaaaaccagatttttgccactttgattttgcaaaagcaatctctctctccattttctgtttatgagctaatctgaaacaaaaaccaacaatatgtccatctttgccacaaaaagaacaagtatatttttcacgatgattagacacattggtagcactagtagatttagcaacatgagcaacaataggagattttgcatgcacaacattggattttgaagaagatgcattcatagtagacatgataccagcagatttaaacacagttttgttagtataaggtttaaccaaaatctcaccacttctagcaccaacacctaacacaacaggaggatgtctagaattatgaacataaggattaaaacctaaacctcggttatgtgtgctaacctttgattgatccaaaatcatgttgagattctttttaccatcagaaaatcctagcaaagaatttttcaaataagaaacctccttttccaaattagcacaattttcacaatctatcataacacttttgcttttacgacatttagggcaagaaagcacttcattgtttttcacgacgtcttccataaactcaacacgacctaaagcatcttttagtttcatcttgttcaaattacatgttgagcaatccaaaacatcatgaggttgttttaactttttagcagaaatcatgttaaacatcaaactagcatgaaaagcaatttgatatttttgcaacaactttttagttaaaaacaactcatccaaagtgcgtgtgtgcaaagcaaaactaaaagcaagagaagatctatttttcaaatcatgtgcagcattaacatctctaatttttgaaatatcattcattaaaacctcgcaatttgaacaatgatcatcattaggaataagagattttaatctatcaatttcagatttaagagattcaatgataaattcctgttttctatacatcttctcacacttcttattttttgcactcaaaatattaatagcttcctcaaaagcactcacctcactatcttcatactctgtgtcagattcaccacgcgccatgaagcaaacataggagatgttctttcccttgtcatcatctccactttcaccatctacatcacttagtggctcgaaggcggcgcaaacttgttgaaaagccttcctgagattgtccagcttcctcccttgggatgaacacttcgacttgttgttgggcttgtagttgttggtcttctcaccatctttgtcttctcttttgcctctcccaagcttaggacaatgcgaacgaagatgatcaattgaaccacattcaaagcaacgatttggaccacctcttttcctgttcctggcattattcatagctcgagcaattctgttagcaactaatgccaaatcctcctcctcgatttgttcgagttgatcatcggatgtggcattaaaaacagcaagaaaagaagacttagatgaagaagcatcaacatccaaagaggaaaccaaagcactcgacttagaatcaacttttcgagaaagaacattcatctcatgtgttttcaattttgtataaagtgaatccaaagtcaaagtagacatgttaatagattcctgaatagatgtaactttcatctcccaaatagacatgccaacaccattgaaaaagtggcgagaaatctcagattgtagataattagcatcataagaagaatcaacagatctaagatcactcaaaattttattaaaccgagaaagatagtcatccaaagcttctccaggtttcatctcaaatttaatatactcctttttgaaaagatcacgacgaagttctttaatattatttgttccttgaagaaaattactcaaagcagtccaaatctcatgagcagtttgaagatgagcaacacgatcataatccgaacgagaaataccactcaaaagaatattgcgagctttgcagttttgttcaaaaccgttttttttagcagcagtattaatagcttaaggaatcacataaggatgagaatcttttctccaaatatcataatcttcagccataatataagattgcatcctactacaccaatgagaaaaatccgttccatcgaaaacatgaggcttagttgaaaacctagcgggagtagccatggcaaaaactctagatcgataaaaatccaaagaataaaacaagactctgataccacttgtaggatcgaatcacaagaactaagccaaccagaggggggtgaatggttggtatacccaaaaaccgaaaacttttagcggaaataaatgttaccctcgaattctacggagatcggtctgaccgaagttgtcatgccggtctgaccggtatagatcaatcggtctgaccgccgaagctacttgtcgcgcctgtcgccgccgccagtctgaccgccgtgcttccgtcggtctgatcgccgcttgccgccggtctgaccgccagtagatcgccggttagaccgccaaaaccgggtaaacacaaattgaataactcttaaagtagatgacgactttattgattttctttgtgtttacaaagtgcaccaacagcactccttacaaaaattttgactaaactcgaaaccctaactcaaaactcaactcaattgctctctaaagcgataccgggaagcctcacgctccccctctatttatacccgaggtaggcagcctaaagccacaaaccaaactcatactaggagttctaaacaccttaggaaaccctctagtacaagaaagaaactttacataaccaatcgtaccaaatttggactccttccaaattcgactctgcatcccacacgcacacaataactccatcgtatgccatatggaatctccatcaaccacgtgcatcaactctagcctaagtatcccgcatgatctccgaccaccacggacgtcgccttatccccaagccgactcccggtccatctccgcaaatactctcccgagacatcgagtcacctacacatggaacaaacaaagaaaccatattccgagactaagctatctccaacttgactcattagtagcaaacaacaatattacatacgtatagtatccatctagaagtcataatcatgaaataatcacggatatgcaaacaaacaacccgaaaccgaaaccaacacagtatcggacggtcagaccgtgggctagccggtctgaccgcgcgcattccgctggtccgaccggctaccagatctcggtctgaccggtcacatgaaataacaaatcctgcgatcacctgtgaaatccaatcatctccaaaaccacttcgtgaataaattccaaataacaaaaccaataatctccgatgcccaattgttcatcacagaataatcatcaaaaacacatttgattttacaattaaggctagaaatctatctatctattactccctcaatctacatatagtttttttagattattcctaaatgatctacatatttgtgtttattcattaagtctattcgttatttgtgcattggagtaaatggacattaatgtatgcatccatgcacacaaatatttataacccacatgcgatatcttgatttgctattggctaggaaatagtgggtatggtgcatgcatcgactttgttgctagagtaaatatagtatgagagttattagtttttcttagtcttggtgtacctatgaaatatgtatatcaatttggaatggagggagtatatactaaaagtccattaaacttcctacaaacgctctcaagcctggcacttctacaaatgctcctagaccgccacataccaatgtctaatctcaccgtcgattttcacttaaatcggtggatccaaataatttagactattagattagattagatgtattttatttaaaggaaacgaataccatactgttgggcggaaaaagaacggaaaacataagtactccgtaaataagtacgtacgactaaaaaacaatcaagcttacataatgttgatagaagaaaaaagacctacgcacagacttgcttaaaaaaaatagagccaaaaacaacgcaagtacttagtaccattgaagaaatataaaaaacaacaaagccaaaaaaaaatatacatacgtaataccattaaaaaaacgatgatctttagatataattttctattatttaaatataaaatataacactatataaatttaagcaaatattaccgttggtttttcacttttccaattttagcatgaactaaacacacccgaaaaagacataccagaatcttagcaagttgattgaaaggcacggcaagtgggactgcctagacatccgtttacttctgcagtaacatgcagttttacgggcaccaacacatacataatttgttcaagaaaaaagcatacataatcatacgcactgcagtaacatgtagtacattttcttattgcaataccacactattaacacataggatgaggcacactatgacagcaacacactatatatactgtacatgcagtaacatgtagtacttctttaggcagtcggcacgacggcggcagcggcggtggcgacgtcgacggggtgtaccgtgcgagccctcttccctgcctcccaccactgggcggcggccttccagccagcgcagcaaacaagagtaactgcagcgagaagtacgacgatgaccacaatgaaacctgaaaaattcattatttagtaattccaaaagaaaaaaaatatatgaagaactaggacttgaacctatgacctcctagctgaggaaaacaaattttctcgtggctaatgatttagtacagatgatcttcttggaactttgatcgtttaagactcatcgccattattacgggtttttattctaaatactaaggataaatataaagaagagataaaatccaaccaatctaaaaaaatagatactccatccgtttcatattacaagtactagtaaattttttttaagttcgactaaatttgtagaaaaacataggccttgtttagttggggaaatttttaggtttggttatcacattggatatacggacacccatttgaagtattaaacgtagtctaataataaaacaaattacagattctactaggaaactgcgagacgatttattaatcctaattaatccatcattagcaaatgtttactatagcaccacattgtcaaatcatgaagcaatttggcttaaaagattcgtctcacaatttacacgtaatatgtgtaattggatttttttttcctacatttaatactctatgcatgtgtccaaacgttcagtgtgaccacgtgaaaatttttgttctgggaactaaacagggccatactagtattttcaacacaaactaacatgaaaatatattcaatgttagatttaatgatataatttcatattttagatgttgttaaaatttttataattttgatcaaacttaacgattcaaacgtcttatgatataaaacggagggagtactaacattacaaacatgctccagctcaccaccgataatcgtcatcagtagtaagtactaacaaacattcaaaagaatcaggggcggatctagagtgtaacaagcggggcccttggcccccactcaattttgcagcgagcgggggcaaatgcccccttgacactttttacttcctgttaacggccaaatctggtaaggtgtgaactaggttcaatactaggatcgaggcggattcgatgaagagatcgattcgaagaacagagtatacatcggctgcgaaggtatcggctggagtgtacatcggctgggacggatcagacagagggtagccgatacagccgatagaggtaatgcagccgatgatgatgaagacggtttcaaggctgtttctagaatcgatcaaagtacttcacagggattgccatggtggagataaagctctcttatgtaatttccttagagatatgtttgggcaaaagtctgccgcaaagacttatggtatcttagagtttgttagagataagtatcgtgtccggcaaggacatatcttgtatctcgggtataaatatgacccgaagccatgtaatcaaataacacacgttcaatacaatctcggcgcgtcgccacccttttactttcgttttgtttcgacgagttcttactttcggattgagctgcatcggttttgatcttcaactagagataaaacttgttatggcggcttgcgttctcgggattagtgcttccatctttatgatactctaatattgtttatgtaattcgtcaagttatcatatattatatataatctttgacaatatcgttgtctaaccttaaatcgactaacatctattgttagaaggtagccgattaggttaaatatcgatgttgacttagattatatagggtatctaccatcctatgaaacaaccaacggcttgattgtctagatattgttatcctcttcacacttatagctgcatcagttgagtttgaccttataagtcgtgattagaatcttaatctctagtctgcttttgattgctgattagggcagtatcggggttttagccgatcttatctgatttaactaatttatatcttatatgcttgattggcatgttaaatccgccctttatgttaagatcttgttgtgtttaggtatattaacctttttgtttgatatatcctacttgctttaatatcttaatatagagtggtattggagtaattagccgatacatgctagatctatctgatcggctatgctataaatgtctataatctcattgttaatatatatttcgatctaagtgatttatactatctcggcatggcgaccgatctatcccaatcacttgatttaagtatatatcgatgtaaggattatatattgttaatatctacaaccgatcgaatagatttagttctttcttgattattcatgactgtcgatcgattgaaatatgacatcggctcaaagataaatgatacgtcatcggcgacctaccgatcggctatcgtttatggatttaactgctatcttcttgtctttatttcttgttgatagcaggatcaaatcaactggcatgctcacgaacctaaaagtaagatttttggacctgcactgaagctaagcagatcttccagggctcgtgtttttcgcatcaacacttccttagtctacctaagcggtagatccttatcccccacttatgctattttctgcatccgccattgaaaagaatcagtcgacgggtagacacggcacattattttacaccattagattagatatattttattttaaaaaaactaataccttattaatctatgtacgtatacaggtgattaaataactgttggctaaaaaatacaaaaaagatacataattagtccataagaaggtacgaccaatagaaagaaatgaagcttatctactgtccagcggaagaaaaaaaatatgagcacggacttactataaaaacaatacaaccaaaaaagtacatatcattagaaaatgatcgacggtattttgaaatagtattttatactatttaaagataaacatattactctacaactttacgtaaatatactttgttaaactagatttatattataaatacgagatatccaatcaattatctttaaatgttctattttaacttacgaggctaatatatataataactaatgctatgattattttttatttcgcatcatattttagggtgtcaaatatcacttacgaatatacaacactaatttaaatctaaatatgtaaaaatggaaacaaagcaatttagttgttttattttacaccattatattagatttattatttaaaaataaaacatttctcctatatacggacacatgagaaatatataattgtcaaccagaaaagtactccataggtacatatgattgaaaaaaataataatgcttacgtatcgtttgccggaagaatagaaaacgtacttatgataaagccaacaaaatcgatagtccttaaaatagaactttctaataaaatataataatattcaaatttacgcaaatataaatataaaatatcctttgaatgctttttaagcattctatctaattattttaaaactatatatatccattttttttatcccattgtattcctttaaataaataaactattaatgtctataaccctaaatacaacacaatatatggagctgatatgtaataattaatgttatgataataatttcgcatcatattttaattaaaaaaacacttgacgaatatacaacactaatttaaatgtacatatatattctccaaattactaaaggtgaatgtgattagataggtgttgaaagcaaaccaaacattgaactaacatacactttgtctcggttacatataaatgtttctattattttgggataaaatttaactccttagatttatgtgacggagggagtataagtaatataagtctatctttattagatgaagtagtatcattagctatatttttaatagaaaatatctttcattaatatataataaaattaaaatgttacttaaagtcatctatagcatacaaaataaaaaatgttatataaagtttggaaactccacaaatttttttaaaaataatcgctcatatatcgtacagatagatatgaaccacctccatcatttgtgacatattttttttttctaataaatttgaggatatacggtttcaactaatatgcccaatccagttattaatggacccatgtttaaaatagagtcaaaaataaacattcgtaataaaaattcaaacaacattaaacaaacatgcacgcgcgtatgcgcgggctagcttcctagttaactataatgagacaaacccataaatcaattcaaattgtaaaaactttatttagaggaacctgctagcactttattcaactaactgggaccttaaacactctgacgaaacagagaaccaggtcgaagtaacttcgttagcacaacattccttcgctaaaaaatgagctgccaaattggctgaccgatggatccaaatgaccctaaaatcatgaaacaaacctagtcgatgcttcaactcttggattattaccccatacatcgatctattggcgttctcaccagtcaccattttctg

SEQ ID NO: 73870 - DNA, 9556 bp, Oryza sativa
tacaccgtttagtatttcgggaagcgtgcgcgcggaaaacgaagcaaaactcactaacaatcacccagatcacctaggaaagaacacagccttagcgactgctattttaacttagccggttgctatcgcatctgcagttcaatttagcaggctgttatagcatgagcctattttgttagttgattttctgccaaaacattatatgatgtaacatccaatgactagaacatcatgtctgcttttaatttaagttggaacaagacatcaactcttcgagtgctactaaatctcaacttatcttcataggttatacatatattgatctatcattaatttatttctcagttgctttgttaatattttataaagtcattactcataattagggctagacaaaaagctcgtgactcattagctcgctcatctcgtcactagcttggcatgactctgttaacagtgaaatttggtaagcccggactagtcattggcttagagccagcatcggctttgaagtcctgagattagccgatgagagttatcaagtcgtcagttgtcggattcttgctatattcggttaaggaaattgatctactaaaggaagcttatccagaagagaccgagttcaaagagaatgcggcatggcaagttatctattaattaggaatagtttgttagtttccttttatctttaggaaagtgtgtttagtgtcctataaggactttttcttttccttttatctttagaaaagtttctttcttgtccgacaaggacttgtatcaacccatgggtataaatatgtacactcggggtctatgtaatctatcgctacgatcaatacaattcgatgcatcgccaccccttttacttctacttttgtttttacgttccggcggaacttggcatccgacgcggggttgcatcgtcttcgatctccggcgaagggataagtccaatgttccgccggtccaagcaattgtatcgtctacatcagcgtcgttcaaggctgcatcagtacattcgacctcttggattgctctggtttggatgatatatttgcctacctatttatcataagtctatgttaatctagtcctagcatctcaatttagctctatcagctgtctctcgctttagggtttctactggtatcagctaaatcgccttgctagattagattagcctaggcatctaccaccctaaaaatcagtcaacggcttgattgtctagatattgtgtttcttttcatacttagtgttgcatcagttaagtttgatctactaagttgtgcttagaaccataatctctggtctgcttttgactgccaataagggtttcatcggggtttcagccgatgagttatctagacgttgcatcggcttacaaggattgtatacatattggaattagccgatcgcaacatagattttactgtttatctaatcctgtgaatttaatggcatcggacctccagccgatgtatgctttaaccttcggatcagtgcttattatatcttgtttctagccgattggtttctactcggttatattgttatgttattacatcatcaatagccgattgcctttatatcattatctatattggacatatagccgattgcttaaaccctatcgctatcggctggtatcggcatcggctattatcggctatcggctggaactactccatcggcttgtcagccgatcggctgcattgatttactatttgcatatcttgtcatttgcaagatcaaactgactggcacgcccgcatctcatcaagatttggacctgcacaggagctaagcagatctcccaggctggtgtgttcgattttttcgtcaatagactcgactcagctcgttacgttttcctaacgagccgagctaccgttttagctcgttagctataacgagtcagctcgagctggctcgcgagctgctcgtgagcttaacgagctggggcatatgatataccaaatagcaagcatcagcccatcattaggacacacggcccactaaatgaccccgaccttccgttggcccagataagaacagttgaaaagacttggatcgtgctgacactttttcgtggtccacacgagatcacctaacgatttgcgatgtaatcaacagagtcgccaaaatcgatagattaaaactggctagcagccgatttcaagattaattcactttctcggaatcacacgactaatttacaagaaaattagcaaagaagataaatatcgtacttacgtgatgatgaacgactagtttccaagcaaactaccaaaggataatcttctcgctttcgtggaaaagcaggactgtttttcagcgcaaaacggcaaagattaaccaaattatagggttgctagaactcagccctgaaaacaaaatagaaaacaacaagaaagtaaaaaaggggaaaatagtagatttataattttgttcggggtttcttctgaccgtacacccgtgtatatatacaggtgacatggtcaaacacaaaaatatcaaggttcagccgaaaaggaaacaaattgataaactaggaaaaatatatgtccatcttcctagtaaccgcacgcgctaactaattagcctcatcagatagaaaccaatgccgatgcttcaggtcttgacggtcgttacagacaaattttgaccgtcaattaactaaaataatagagaattagctatgcttgcaatgtatatttatttcagaataatatagtaccaattgtacttggagaataatatgttgcaggaatttagcaaataaaataaagagaatgtgaagaaacctcactcctaagcaagcaaatagataaggagggcccacatgataggtgtaaccgctggaaaccgtcttaactgccacaactgtcattgggacccacctgtcagtcaccctggcaaacttggaggcctgctgggctggcccaggttcagccgaaccctagcaactgtggctccagctggcctttacatgaggatgtccaggatgagctgctgatgacggttacaggggtaaaattgacattgcgcatcagagtaaccgtcataccgaccctataaaaggaggagctcacttcacttcacaacacactcaagcaagctcaacattcatcttcatactttatttagtagtttagtgctaagtggaagtagtatagagtagttctctggattcctcggagctttcggaggagtttcggtatggctctagtagcttttctatcctctcctgtaatactttccgaattaatgaaatactcttctttttatattctcggtactttacttagtatgagtattgcttttactttatacttgtgttggtataaatgagtgggtagcctaccagcgaggtgcaatggtgtgggtttattgtccgatttatcgattgctctatatcatctgcatagatgtagaatagtatttattaatgtaagcatggtgcttagattagtaagtatcatcatttgggcatatatgctgcgggacagtagaggtgggccgctgatggtgacagctcagtacgggtattcctccatgttagtatatattcctaagacaaattcctggggagggtactcctccgtatttaaccccggttggacggccatgacaggttgtcgtcgtaagaaactcggtaactcggggtggtctctcaaagcaccaggatggcactgttaggtggtattggccacatgattgtatactagcaagtgtagagtaaagtttagtgtatattagaagtataggaaatgagttctctctatcttttcttccacttagttaggattatttatctgaggaaatctactaaatgctgagctttccaatgtggaaacaaaagatggttgtggcggcaacaatggcattgcataatttcattcatgaccatgacacgcctaataggcatttccataggtttgagaggaatccagattatgtgccaaccattccatctatattttggagatatgtgatttctcaagatgcatcgaatacatccactgaggggtcaaagtgataatccatggatgcatttcgagatgacctagccggtcgtattgtaggttgacggaaatatatcatattttgtgtagttttgtagtattttgctctatctttcgatgatactatttatttttactaaacatttatattgctaaatatatgtcatgcaacaacttgaacttatacttttttttagtaccaatttttgaattatgtttatcaccttatatacttaacatgttgaaattattaaggaaaaataataataatcacagtgctgaaattattaaggaaagtatctattattaatcctacataaagttaacagtgaaaaaaacagaagggtagtattgtctcttgcaggatttctagagctgagtaagttagccaaatactttcagagcacctacatcttttagaggagctggcttccattggagttagagtttggagttgagagatagaagctggagctataccaaacggtgccttactgcgacagtgttatagcccttgcccgaagcggtcgtgaccgaacaatactgtttggcccgattttggcccacctatgtaattgacgacgatcgaatggcaacaaccaatggcaggatatatgtgtctttgattggctagattggtgtaatcgatgacgatcgaacggcaacaactaaaggcaagatatatgcgtctttgattggctagattggaaagtaatgctcttattagtttccttaattgacgaaaattagacacggtgcaggtcagttttgccgcaaagaagcagcagcggcagcagatgccgaggttaatgtcggcctaattgcaaagccaaaatttatcgtccccagtggagtcgtcaattcatgttagtgtctttttaccctaacacgaggctcatctaaatatttgcggtgttaatggagtcaccaatcacctcgatctagacaacattaaatgatgtgaccatgactactattgatacaatcgtcgctcacatgaaaatcaagttgaccaagtgttggaatctgattcggccaccgttgacattgctgaattcaaacggccgccaaatctctatacgaacttcgttttaggaccgtcagtacttgatagaaagctcttagagtcctctttccaacggatccagcctcattgcgaaattacttcccagagggccgcaattgcagaaacaaggtattgcgtcacctatattgggccagtgggcttgtaacttcgtttgggaccccggcccatgtggggtgcgccccaactacgtggagcacgaccctagggactcctaggttgccctcccaccgttataaatagataggtaccccttcaaggtttcttgggttttgtttagatgaaagtttagccattgctatttccttgcagcgcgtgtgtcggctagatcatcgtcttcttgtattcgaaacccgaacttatcatatgtattcattcctatttgcaattcagattgcttttatcttgttcatgcttgtttcttcgatttgcttgcaggaataagattgatctgcaccggcaagatcaacaatccatggagaggtgtatcgatcgcaaaggtgcaacacaacgtctcgtacggttgtagtcgggtcatcaacgtttctcctaaatcgtagttatctgaactcactgaaagatcgggccaagaacagccttgagtttcgagtggaattcagggttcatcaggtggtattagagcattcgttgcttggtgagtttttatcaacctatcaccagaaaaagctaaacaaaaagttgcatccttcacctagccatatttgtgcctctgtattgttcttttcagtttttgctttgttgagttttctgttgcatggttagtcgtgttgctggtcttagcgtctagtccatctagagtttcgagttctggtcacgttagtaccactgtcatcgcgtgcttgttgtcgtcaggacctacgaaaatggaatcggctctgacggagcgtggggctcctcaccgggagactgcgcaggcccccctttgccggttcggccgggggcgctaagtgaggttcttcgccctcgatcgatctggagaatgttcgcgagagagcaagtgcacgagacacgggtgatgtagacaggttcgggccgctgagaagcgtaataccctactcctgtgttctggtggatctgtgtgtaaaagatctacagagagccggagagccagagagttcaggctccagaacccctctcgcccccccttttcttttcttctttctttttcttttggtgggcaaggtcctccttttatatctcaaggggatactacatgcaccacttctacctacttttcttctaggtggggacctaccctatcttgaccaaaacttggcttgcaccttcgcctggaagctaaatcacaacttgtccttgagtgaggctcagcgccgtctctcgcctgacaccggggatctccctgttactccctcattaatgggcggagatttgccatggctgctttccaaatgaccatccgacaagatgggtcatacctacctccactccaccggaggcagatgcatcgtgggagcacggttgtctgccgatgacgcgaccggcgtcagaccagtcacagaccggtcattcttgtccaccacgtgtcagttcagcatgctacacgtctgcccttcttcatacaatgatttccttgcaatggttgcgatgaagcctggaatgtatctggccggggctgacgtgccaactccaggagttcccacgccggctccggctagggacgagcgcctggaggctctcatcattccgacgggacggggcgaggcgtgtgtcaggccgcctgttgccacctaacccgcgatctgaccggtctgtgaccggtcacacactgtgacctgtcacggaccgaacgagtgtgctgcgctgcattaaatgcggcgtggggcgctcgtccaacccgcaataaacgcggttaggtgagcgccgttgtgctcacctaacccacacacgtggcgccaaacccacagggggtcggggcgccccagccctcggggccgaaacgggagcggcccgacccctcgggaagacagagggaggggcggccacatcaccctcggtcccgacccccccccccccccgagggggccaggccacgtgggtgactgcagctgccccaaacctctagtcaagatacccccggtcccatgtcaccgacaggctcactgccacggttctatttttgtacttttcagaagtttatgtcggttagttttgaagttgttgagttgcatctagtgtttgctgatcctacccgtgtgtttgcttttgccgtgcttgtgtccggcgctgagaggaggaagaaggaaatgggagagagttctgtagattagactagaaaatcaggcgcgccctgtcaaaagtatatcctgtctaatgagaaaatgaaacccagcatctcaattctgacctccccagataatacaaacacgacataaacatgatatgataataccatcgaagcgctctccgtctcgttgcagcaggtggatgcgacctcagattgagatgcaagaaatggaggagatgtaagcagaggggaggtagtacctcattacatggcctcaaagaggcggagggagcttgtatccggcaccgtacgtcggcaagcttcgaccaggcctccagatgcagtcaatttggagaagaagaaaacgatgaaagctgggtttggggtgtttgtgatttgtgaaggttgaaatggaagtgcaaaggtttcagctaaagccatactgagtgcttgtgtagagaggactcagttgcatacttgcatgggaaactgaaaagctcatttcttagctcttccaaattttttcttcaaacttttaacttttccatcacatcgaaactttcctacacacacaaacttctaacttttccatcacatcgttccaatttcaactaaaattttaattttgacgtgaactaaacacgcccttattcagtattaattcagtattaatatattggaatgttccccttcccaagggctccacaaatttctggattattccattttttatttaactttttacatgcatgttgactgaactaataccagtactactttccacacttatctagagccttaaataacatatatgcaatccaacggtgaataatctgccacagttatcatccaacggttccttttttatctaatgacgtggcctagcctcttttcagcaaaagatcctgaattagtgtgtagattggtttggtttccgtttggtggccaacacagagaagagaaaaaggaagggagagatctatttctgtttttacgtggggcctttcgatcctaaggtcgacgggagtcaatctccacctagtgagtcgtgtccgagacctcctagatccacggtctcctctcctcacggtttcaatccatactgtgagttgcccatatagcttgatgaaaaaattttagtatcggattggagatctgtttgcaaatacagaatctatgagcattttatttttgtatatctaattttgggtttggacttttacagttgagtccctataatttttatatttacatttgagtccctttaatcttgcattgaggcccttgagttggttttttttaaaaaatcaaaaaaaagaagagaaaaaaaaggcagaaaggtgcataaaacaaagaaagaaaagctgtacccaaaaaaaagaagggaaaaaagaaatttacttgtttcgtttgagattgctttcatatatcattatgtgcctgagttgtttgtggtgctaacttgtggtatcgtttgtgtctaggctcgcatctctagtacgtcctagcctaggaccagcacggtacttgactttgaacgatcattcaactttgcattctctgatttgagcatttgctatttctttgccacatatttaagtatacccagagctccacagatttgattgcagccgtacaacaagtgtttgccaaggcatcgatacatccaacctccattggagtgcttggttgagtcgttgtatgttgccattcttcttgcattggtaagaacttgtcagagctcggtgaaaagcttgagtgtgtgtgatatttgggctgccactacctagtagttgataggagcgtgcacattcttgtatgtctttcttgtttgctactaaccatgacaagatcgcacaagggaatacgagaacattgacttcttcaccttcgatgagatatgacgacttctccacgcaatgcatatgaggtacctgcctataattttgcacgagttgaatctaagttaccattctacgatgagaagtatgattctgttgcatatattgattgggagctagcagtagataatgaatttgatgagtatgatttttctgatgctcaaatgattaaggctgttagtaataagtttacctcttccgctctcttttggtggagttatgttactccctccgtttcataatgtaagtcattctagcatttcccacatccatatggatg

SEQ ID NO: 73871 - DNA, 51143 bp, Oryza sativa
ccgggactaaagttacaccaacctggactaaagatcccgggggggcctgacaagccctgacagcatttgaaccgggactaaagatcaaatatgcccgttaccctttttaacctttagtcccggtttttgttgcaaccgggactattgtggaaatagcccgaccgacgaaagatggtttctccaccagtgtcaagtcgtatcctgattctatggatcaagcaaattgcaacataataaactggaaggtgagaggtttaaatgctgcagctagaagggattgtgttagagaaatgatgttcaagttgtatcctgattctatggatcaagcaatttgcaacatatttaactggaaagagaggattaaatggtgcagctagaagggattgtgttagagaatttgttgagcaactaaaggcaactataagatcccaagtgctctttatttttttctatatggtaagcgccacgtaaataccatgtaaaataaaaactaagtcaacttatcatgtgtgtgtcacgtaggactaaatcatcattcagaccgcccaagaactctatttagacaaatttttatatttaagagatcctatgtaacctgtagagtggatttttttttccttgcagtcatgtgctattttctttctactccttttctttgctgatatagtggttacacatttgacttataaagataattacataaagtctttgcacatggtagttctttaccatatgccttgttttcaacccaactttatcattcgccttccttgactagaccaagcctcctcagtgaacacaatcccgattcttgttgttgatcagaattgaacttcaatgttaatggataaaacatctgtatcgataatattttttttaaacaaatcaaattttcattgacccggctttaatagaaagcccaaaagacagacagagtcttatacaaacaaagaaacaacaaagaaaacagaaacataacggtagccaacagcgctggaactcatcaaaagcaccatccatcctagcgaagatatcacaccctagagatagatctcaaaacgcgtaacaaagaagccaagagcaaattttcacagctaaactactgcagggaggcaacacgacttcaattggttcagtttgcccatcaacagctcacactaccctttcatgattgcttgatcttcttcccttagcagaatacaccaccgctgaataaaagacagacttataagtgaccttcaaaggggacttgaccaaaatatctgaaaaaacccagtcagtcctatttaaccagagcacccaacacactagcaaaaagcatcacccaaacccaagataatactccctccgtattttaatgtacgacgccgttaacttttcgaacaatgtttgaccattcgttttattaaaaaattttatgtaaatataaaaatatttatgtcatgcttaaaaaacatttgatgatgaatcaagtcacattaaaataaataataatcacataaattttttgaataagacgaatggtcaaacgttggacaaaaagtcaatggcgtcatacattaaaatatggaggtagtagtttttttttcacaaactgatcagctatatataaaacaacactcgcacaaatgaggcgtcataaatactgtcaatttttcattgtgtaatttactgaccatgtatgcatggcctcacataacaaactagctgggtggcccgcgcaattctgcggctagtacctaaacaaaatcatatatttttttactatgatttttcttaaaatttattaaatagctatctcattgtcttagactttgaaagaccaaattttatcatcctcgtgtttctaattatatagtttttaaaagtcacaccagttgctaccccttatgccatcttcttctttatttgcttgctcgatctactactattttctatccattcttcttgtaacctttatagtttttagagtttattgtcacgttgggtttcgtttttataatttctagatgtcccgtcaaacgttaccattatattcctttacggcccatccactgtctcttttctttattgtcattgagattttaaaaatcgaacataattatcgtttgggttcattttttattttctagaagccccgccaaaccgtcaacggttttgccattatactcctctacggctcgcccgctgcctcccttctttattgtcattgagattttaaaatcgaacatgattatcattggttttttttttactttttagaagttccgaaccattaaaaattggactagtagtttcattttttataatttttagaagtcccatcaaatgatgccactatgcccctctatagcccgttcgctgcctactctttattgtcattatgattttaaaaatcgaacataaccatcgttggaatttattttttattttctagaagtccagttaaccgtcggcggctctgtaactatactcttatacaccccgcccgctgcttctcctttttattgtcattgagattttaaaaatcgaatatgattatcaatgggttttttttttttactttctagaagtcctggcaaccgccttactcgtttgcttcacggcctgcctgacgtccctccttttaatcatcattaggattcgatttggtgttttattaacagtttttatatgtcgtatcaaccgctaccactctactcctttatagtcctgttacttaatttatctcgtcatgtgttttaaatggtcttttctttcaatagtctttatttttatcataaattttagttatttataaattgtattccgaattgaaatcttatttttatttttctaatttcagaattgtttttgaaaaaaattagttaatatcgtattgtgttcttattgtttttattttttattttcaattttagttatttcaaaattgtattcctacttgaactcttttttatttttttctaattttggatattattttattttttattctaaattttaattaaactcgtattgggttttcatatggattattctttcaatattgcttatttttaattccgaatttcagctaattttaaattgtattcctacttaaactcttcttttatttttcttttgctaatttcggatttatttttatttttattctgaattttaattaatctcgtattggtttcttacatggactcttcttttaatatttcttatttttagtttcgaatttaagctaattttaaattgtatttctacttgaactattcttttattttcttttgttaatttcggatttatttttattcttattccaaattttaattaatttcgtattgggttcttttaatattccttatttttaattccgaatttcagctaattttaaattgtacctctaattggactctcctttcctttttaattttggattttattttatttttatttcgaattttgattaatcttgtattggattcttatatggaaacttctttcaatattgcttattcttaattccgaatttcagctatttttaaattgtacttctatttggtctctcctttttctttttctttctttcttttcctccgattaatgtgggaatttctagcccccacagtgaatgtggtgcctcctttcaaggctgttttaataatataatagatacatagatagatggatagatagatactccctccatactcataaataaagttgtttaggacatcgatacggtctccaaaacacaacttgacttcgtatttctataaaagtattcattgaaaagtgatatatgtatacttttatgaaaatatttttcaagacaaatctattcatataacttttacattttcaaactcaacaactcgagagttattcatgatttatatttccaaggtttaacttaaacattgtcctaaacaactttctttacgagtataacatgccgtcttccatgtactattaattaatgccaaaaccttaggcaggctgctagacaacgtctacggataagagatctatattattctcaccatgcaaattcacaatgtgcgtataataaaccaattaggaaaagcaatgaagcacgtacggagactatagaaaccaattaggaaaaggaaggaagcattgtgtaaccgtcgaatcagcttactagttgtcacacatgcatgaaggacaggaagagttgtgtgcactcataagcattagtacaccgaacaagtcatcagcaaataatatcgaatataataatatatggcagcgcatccaaataatcttatcaagtattactccaattaaagatggcagttaatatatatggaatttttttagattggaccatagcaatcttttctgaacagagataattaaatcttgcaaggacacaaccgacacctccccagctgatttccaagatctaaactgttacgccaaccggtcgatgtgatgtgacaattgatcaatggactacgtgtagcgttcgattgaaaaagtggtcgcggagcccctcctgcgtgttagatttcacgttgtcaacaaacgaacataaacacgcacgaacacattacacaagggaacgtgaaagtggaggggctataaaccgtacactgctgccttctctctcttaaaagtctttctttttctctcaacccctctactgtgtttatatccataataagatagtcatataaggatacatacatgcatatttggtataaggttacttcatccttaaaaaaactgaagaatagaaggaggaggcggtaccgtgatcctcacgatcacggcgactacctcatggtcgctacaaatccgactccttcgggagatcggtttcataataaaaaccctttttacttccagttgggaaccccctttagtcccgggtttctaaccgggagtagcaatccgggactaaagatgtgcatctttagtcccggttgaaataacggggactaaagatgaatctttagtcccggttggtaataccaaccgcgactaaagatagagtatctttagtcccggttgttaccaaccggaactaaagaggatagccaggttttttttccttttttattttctcccaaatctaggtggtatgtatatccttttttattttctcccgaatatgcgtggtatgcatatcccaaatcgaagtaagatcccaagtccacatcacaaattttaaagttctaaaaaattatatcagaaatcctaaaaataattacacacaaatcaaattacatcacaagtttctacaaaattcatcacaaatacatcacaagttcacatcacacacaaatcaaattcatcacatgatcctgcaataaatcataaattcttaaaaaaaaggagccagccggccgctgccgcctagcctccacgccggccggccggccaccaccgcgccacccgcccgctgccgcgccgccgcgccgcctcccctccacgccggccggcccccgacgccgcgccgcctcccctcagcaccggccggtccccgcgccgccacggcggccctccgcgttgctgcccaccatcgcgccggcttcccctccgcgccggccgctggccgccgcaccgccacgctggctgccacccggccttctctcgctccgatccaagcggctggcctctctcgctccgatccaagcgagctaaggaagaagaactaaggaagaaggaagaagaaaggataaagatatggagttagagaggaaaaaagagatagagaaagagttcgttgtgtggatgggaaaagaggataagtaatagggattatatagtacgtgttgatttttattcccggttagtaacaccaaccgggaataaagtaagataccaaccgggactaaagatcctagccgcctgacacggtctgacatatagacaaccccaaccgggaataaatatcatctagtcctgttatgcttataaaccgggactattgtggatttgagtcgaccgactaaagatggtttctccatcagtgatactgggatcccgatcgacggtgtttgccccgaagcttcgcattgatgtttagcgagaaatcgcgttctggatgccgatggatcggttcgcatggataacaggaggtctcgcatacacctgatttcgtgtccggcgtcgggcaagccattaagaccagttccagtgtctggcgacgggctcgtgttggagttgccccaaccatatgaatgaggcatccacctgtgagcagcttgacagtgtgcattatccttagttggtaggaaaaccggaagtaatactgcatttgttatctcttaccctatctgtctcaaagaaagaccattcctagcaatgaatctgacacactaggattgtgttttctttgggatggagtagtatgcttttaagtaaagctgggcgtgatgcgttttctctaaaagaaaaatactgcacttgttattaaaaagagaatgttaaaacacaagtaagggtgcaagcctcctccatgcgtatctcttaacgaatgcttttaatttttaaacataaatacacatcgtaattttgcaaccttggttttgttttatttttcagaaaataataagcttaatattggttttgactgacaatataaagttattgatgatatagtggaacaataaataaaacgtgaagtgggacatggaatcaaacatgtaaaccgtttattgcacctttaatttggaacaaacacaatcatggtacgtacaattacattggtcaaccaattggccaattattaagctggatgcgcgtgatcataatagatccttgatcacacatccaaattgaacacatgtacattcttttttccatcctcttctccttgattaattaagctggactactaatatttctcacaaatgcaagcgcgcttaattaactatgcacaaataaatctctctcattttgctaataataacaacaataataatcgacacatacgtaattaattatgtttgacatgatgacgttggttacttcaattttaaactaaccaacgtcatacatgaagtgataattaattgacccttctgcagttggtccggacctcacccagggaagggtcagtgacaggggagaggttgcccatgttgatcatggactgcgcgaagctgcggaagaaggcggcctggctggtggcgaagcggtcgacgatgggcgccgtcgtcccggtcgcctccggcgccgacttgagctcctggtccgactggaggaagccgcggttgacctcgatgttggtgtagtagtggttgtcgaaggtgtccggcgtcgtcgggtccaggtcgttgagcgccgccggcggcccgttgggcgggcaccgctgcgacaggaagctccggtaggcggcgtccatggtggggtccggcctccccgtgttgctgaagttgtacagcctgtccgtcacgaactggcactgcaccctcccgaacgtgtgcccacctgcatttcgcattattgtcgtcgtcgtcagctccggcgggcatgacggcagaactgaaattgagttcgccggagaagtgatacgagtacctgagagggcgacgaggtcgacgtcgttgaggttgagggcggcgaacttttggcggaggacggtgaggttgtcggtgggggccggcaggttgagggagccattgaagtcggaggtcttgccgtcgagccgccccagcagcactccccacccgggcccacctgactgtgaccgacaaagagagatcgatccatgtcgtccaaaaattattacttgtacgctcaattcaattattcatcgatgagttgcacttgtgaaccctatatgctatatatcttagatatgatgttttgtagtgcatgcagcatgcatggtgcacacgacaagattggtttcagtacaacagtgtcgatcgatcgtcgtcttgtgtgtgtgacacacacacacatatatatatatatatatatgtatatatgtatatatgtatatatatatatatatatatgtatatatgtatatatatttatatatatatatatactagaaaaaatacccgtgcgttgcaacgggtgaaggttattttaaatttattatttttatatggtttagttaagatgaaatttaccgtggaaattcgcttggatatatatatatttagaaaatcatgagctgtagttaagagtccgttcgtcttaagttagtatacgagttttttttaagagatttcttatacagctcattatgtatcgccaaaagtgaacgaacttaaaaccaactcaactacaaatatgtatttccacaagcgatccttctgtatttctaatagcaaatggacttaaaaaccgactcaaatatgggtatatatttccacaagcgaacgaacttaaaaccgactcatacacagatgacgtatcaaagtagcggcaaaaacatcttcaatttttataatagtagatagatatatatatatatatatatatatttatatatatatatatatgtatgtatatgttgatgctgatactttgtcctgtcgtaatgttgtccatatatattatacacaaactgtacatgtatatatagtagctagctctacatgtcttcctttccttggataattaagtgtggctttgttgttagcatgtgtaatagtttacagataaggttggcgtgagccgtaaaatgtaattaagattatccaatgatatgatgaaatatatatacggcggcatacatatgcatgcatgcaagcaccgacgacgggcctgtcaaatcactgttgaatgaaaaggtggtacgactgctagacagcactccaatttgtttcttcattatggttactagacctgtctatagagttacttcctccgtctcaaaatataagggattttgtgtaaatataacacatcctagtttagtactataaatctggatagagaatgtctagattcttagtattaggatatatcatattcatccaaaatcctttatattttgagttggaggaaggatagatgcatcttgcaagcacttaattaattcgagagacacgtacaaactaccaataatcatcgatcggcccaaccatatcacacactgtattgtgcaaccatgccgcatattatgatgatattcccacgtagctaatatgattggataccatcgaatccatacaattaagcatgcatgttaatcacgtacttctgtctgtaacgagctactattacgtcctgtgctgtagttagtagtttttattgggctcaagaaatatgtgaagatatctaaattttacgttaaaacttctactacctcaagatgttatctacccgagatactaagtttcatactagaaaattataaggtaactctcaatacttttataatgatgataaaattaccatggtaataataaatgaagttaatgaaaattaccagctcgacggagatctcggcggcgagggcgaggatgtcggcgcaggagacaacgccggggcaggcgtcctcgagcgcggccttgacgtcgtctacgacggggaatcccctcgcggagttgttgttgggcggcgacgtcttctccgacggcatcccggggacgctgtccagcagcagcgacgcgtcgcacccctgcacgaagcagtcgtggaaatggagccggatcaggctcgcgaagatccgggcgtcgctccggtgcgcatcgatcagcacccgccgcacgatgtcgtacgcgtcggggcacgtgcagtcgtagtactcctcgcacagctgcgccaccgccgcgccgccgccggcgaccagcgccaccgccgccgccaccaccaccaccgccagagaggaagaagaagaagaagaagccgccattgctagctagctagctgctacacgactactcctatacggtcgtgtcgtgtgtgttccacgagctaacacacagcgcctctcctgatttatagctgcccaagtgtactgtgtgttgccgatccattatttgatcatttagctaggcagctggggcagctagctagccaaactaattactccctcctattcgaaatgtttgacaccgttaactttttagcatatgtttgaccattcgtcttattcaaaaacttttgtgaaatatgtaaaattatatgcctacataaaaatatatttaacaatgaatcaaatgatagaaaaagaattaataattacttaaattttttgaataagacgaacggtcaaacatgtactaaaaagttaatggcgtcaaacatttcgaaacggagggagtattacatttactctcatcgtttttacttatttattgttacgcatcaagttgctgttcgtatttttgtgcatcgttatcggttgacatggtagaatatgtgaaggataagtatatgtaatccaaatggcttggcaataatgctagtctacagagttgtcaaacttggtctcctctagactgagacctgactatgaccagatgactacttgtgcagatacttgcaaataatacgacatgtattattcgtgtgttgggtagtgtacctactggttttttccttaatttgcttttctttaattttaagaaactaataatatatggatatatgttaatctatagctagtggtacgtgttgtttatcttatctcctctagacaaggagcagtccaattctttgcaacgaacatatcacaaccacatgcatttactaatatgtttttgggagtgaacatgataatatatatgtttaagataaaacttattacatcatgcatagtatttatggataataccttttggcccaatctcacagctataggtttagctttgcttggacaggacaatatgcaagaggcagaaaacgtcactgtcatgtcttgcaaaggccaagtaaagcttcgtttcttttctaatcattccacggcggctatacattaatttatagctttgcatgcatgcgtacatgttagctagctatgatcgatcacacgtgaaataatggagttaattaatcaaagggccatcgtttgttcatattataggtacgtaccgttgtgttttaatttgtacatatatttctcgtaccgtatgatactagtacaaataaatgtctgctaaaaatctctatattttttcccctggtccgggaaagttatcaagaaatgctactagtaaatcattacaatcacgtacaaaacaagtttctatctgaatcagtagaattgatcatatcactactacgaaacacgttttttcctaacggccaaaatacttcttttgcaggtcagcgcgcaccccgccccgcctgctaccaaagccatgtaaaaaattaatccacgatcttcatagacatgccattatcgctcgttaaaatcgattttcatagacggccaggttaagtcaaccgactgggaaaatgattttcaatgaaaaaaaaaggggaaaagattatcccccacatcccattgctctccgcatgccgcaccaattttcatagatcaaacaacaaataaagcaaaacaggaagaccaattcatcataattgaaaatcaagttgctccataaaattttgtattcacaaatccaacctaaattcacaagcaaaaaagggaagcagcctatgtggagctgatgtaacagatgcaggaatctcatggtcacaagccatgcatcacccccatcggatccacttccttcaccactgctggtggatcataagctcccaatcactaccggcaccatatccatctcctccaccaccatccacatctcccctttgctgccgctgccatgtggaaccccgtttttataacaggaatcaatcgtgtaaacagtaccatttccctggatcaagtagtctggtacacacgaactcatagctgaaatatcaagtgcacatacacgagagtctagtacgaattattacatcataagcccgcaggcacagtcttaaatcatcggaccgagcggtccggaatacatttcaaaaacagaagtaggtaaggcagcggagttaaggcagcggcacgccattgccacaggcaacgaccgtaactaagacctactgagcgccatcgtcttcatctccctcctggtagtaggcatagggatcctccgaagcttcatctcccacttctgattaattttatatttgcaagggtgagtaccaaccgtactcagcaagccaccacagcaatgatgcacacgacagaggaattcaaaggatggctatggttcttttgcgcaaagcaagttttgtaattcttttcacaagcctaagacctagcatagactgatcaagttttaataccagtgttcatattaaacaatgacggttctgtccaccatccattgtgatcccaaggatagcttcccgccattgggtcgttatggttttctgaggacgtccatattcccgcctctcaagaagtggctccatcagcataaaaatcatcatgcaatatcccatcccacacaagttaaagaatttagagtctagccaagtgtaatacatgtcccggtgctcaataaccgcgagcacggctattcgaatagatttggtttactcacactgcagtggatgtacactttacccgcactccgcgactgcccaacacatgagcctcgtcccaacacatgagacgcgtcacggcaaagcttttcgataacctcgcattggcagtacccgctccatgaacttaaatcctcatgcactctaggcgtccatgtttctagcagtgtgaggagttctggcgctcccaggaaagagaagtctcacacatattaaattatggtttaagttaagttctctctcatacactcatggcagtcctaccaatggcgacaccgatgtagggcacgcctctcggccctacctcaacggctgtcccatcgtagcgcacctgcctcactcaggggtgaaccatctatgcagggatactgcctccgctcgactatctaatccgctaggtctatacccattcgagaagtacggttgtacgggggtcgtttcatgcttaacttcatggctcggtccttaattgaccagggacggtactagcctttcccagataccacccaaatcctccgtccgccccagtcgaaaacaattgtttaattttatttctcctttcacaaatcatgtcatcaacatcatggcaatgtggcgctcatgtctccacatgccgcatctcaattaccttcccaaaggtaattgcccaatcatatagcatttgataaatatgagtatgcatgattctagaatggcatttctaagcaattgtcataattgactagggactcatacgtaatcatggttacaaggattttaagggtaaacaataatcgaggcatggcataatcacaagtatgatgttcatcattgcatgcaattttatttgtaaacaaaacaatttcgcaattgggatcaacatgttcaaggaatggtgatgacttgccttgctaaaggtcttgcgggtcttggccttcacccggatccgcggctccctcggtttctataattatgtgcgaaagaacaatttgaattcgattagaattcaaacaaaatccaaataaatccaaatgaaagtcgaatgcgaaagtcgattcctttattttaactttattattcgcgaactaaggcaaacccaatttcgattcaaactattttgcgggtataaatgttttgttgtcataagtttttaatttaatctacccgagcattatatccatataataggttagagatttctatcgcgagctaaatatcggacgaaatcctagaaatattatatgatttaatttagtctatgactaaatgattaaatataatacacggctaaaatccctagtaattaaatccgaatttctaccgtgaatcgattacttatagggattacccaaaaataatctataataatctataagaattcatctatttgtttagttattaattacatctaaattactaccgcgaattgatttcttattgaaattaccaagaataatccataatttatattaaattttgcaattctacgactataattaatctataattaaattctaattattttaaattttctaaacttccctaatctccctctaatctcctatttatttccttttcctttttctccctttcctttttttttctttcctttctttttcttttctttttctctttttctctcttttccttttcttttctttctctcctccctcccggcttctttctctcttcctcggcttctccctttctctctctctctcggctccctgctacctggggcggcgacggcgaccgagcaaggggaggaggcggcggcttaccaacggcggtggcggcgacggcggcgcgacgacgtcgcacggcgcacggtgcggcggcacgaaggcggcggtgcggcggcgcgagggcggcgcgacggcgacggcggcgcaagacggcgacgcacggcgcggcggctccggggcgacggcgcggcggcttcgaaggtggcggcgcggcggcacgacaacggcggcgcggggcacgaggcggcgacgggacgcgcggcgaccggacgttgacggcggcggcgacagcggcggcgcgcggctcggggcgggacgcgacgggcggcgacgcgacggtagcgcggcgcgacggcgacggggcgagatgactggcgagcggcgatgggacgggcggacggctcggggcgcgaggcagcgcggtacggggcgcgtcgcggggcgacggggcggcgcgcggcgcagggcgcaaggccggctagggcggcgcagcagcgatggcgacggcgacaggcggcgatggcgacgtcggcgcggcggcaggcgacggcgcgacgggacggtgacggcgacggcgcggtagcggcggtgcggggctcagggaatggccgggcgcgtggcagagaagggtctagggctagggaccaaaatcgaacacctatgaggcaatgaacagtgacttttcctatttatcccgattttagtgtattttccatataaatttgattccacaattcctaattttacatatatgcattttactcaatatttgtgttatcttaactaatgaattcaccctagattaatattactcatattttatttttatataatttatttgagttttaattagggttaattcttattccatcgtatttaaatttaattgatccaaatatggtcgcgataatattttatttattactatccacacctaatctttatttttaatttatatttattttaccaatttgtttttttaaggtttattcctgattaactattctttactcacgattaataatcttcaaaaaaaaatccagataaaataggcgaataagatcagcatgatgcaattaatttaaaaaagtttttgaaaatccgtatttttagagttttgattttgtcggtccaattttcagggtgttacatgccacctccccatcttcgctttgcagccgatgccgtcactagtatcctggagcgctatcgccaccacccttctctggatctctttgacggagagaagtagagaggataactctaagggagaaggagaaagagggaaagtctaatattctaggagcccgcatataaaattatttttataagcaatatttttagagggccgtatgtataaatagagttgtttttatacatggttatgctaatacgactgtctatttctacaaagtggggttttttcttagtctgcctttgaaaataaatttgaggtgctaccaaaatacttttcttatagcgtatcacattctaagacaagtttcacttactttggttaaatatataggagtatactatatatacatgaaaaactaggcacgcttgcccaatggatgcaaatacatacattttgaacgttcaacgacatgggaccagtgctttaactagatagtgctataattaataaaaccgggcaaccggccacaagctggtgaggaagaataaacgatctggatagcttaatttaattttaaatcataattcttttttatcaaattgttattcttcatccatcctagcttcatgcagtgtaacgaatatatgatccttgtcttcacgtacctcttaattaaagctaagttgtgagctgttatgttacctctctagtcaatattgttatgttacctctctggtcaatatattactccattcgttttaggttataagatgttttgactttggtcattaagtttgactaagtttatagacacatataataatatttatgttaccaaattagttttactaaattaataattaaatatatttttataataaatttatctttggtcgaaaatattattatttttttctataaacctagttaaacgtaaagctgtttaacttaaacctgaaacggaggtggtatataggagtatgtgtgtacgtactgtacgcgtgcaatgtatttttgctatgaacgtagtacaatataggagtatattatgtggctgctatatatacacattgcagtgagcatactctggccacatcatcagccaattaattgttcatcacaaattaagtgatcatggatgcacattagcccacaaattaagacaaagatcgctactgttgtcttgaaagtggcttctacgtaccaagcttggatttgtacatataatgcaggcagacatagctaacaaggccaactggcatatagatggttggcagatagctctttcccgttcatgatatatatcgaccgttttcgttaaacaactaattggctgcattattcgaggtttctatatattatgctagatatatatgtgcacaaatgtacgtgtgtatatatatgttcacacatgtcaataaagcagaaaaataagaatatactccctctattttcatgttataaaacgttttgattttggttaaagttaaattactcaaaggctgtgttcgttttagcctcttcttaacccatctccatcattttccacgcgcacgctttttaaactgctgcatagtgcgttttttgcaaaaagtttctatacaaagttgcttaaaaaaattaaattaatccattttcgaaaaaaaagcaaatacttaattgatcacgtgttaatggactgctctgttttccgtgcggaggaaataagttcccaaccgcctgaaacgaacacaacataagtttaactaactctatagaaaaaagtagtaatatttataacaccagcatagtttcattaaatctataattgaataattttttataatatattagtcttgggttaaaaatattactacttttttctacaaaattagtcaaacttagagtagtttaactttgactaaagtcaaaacgtcttataacctgaaacggagtgagtactatacttttcgtatatagtcacagatttttttatatggtttatttatcaagtgtatatatatgatacttgttttctatttttcatgtgactgtttttattcttatcaatcactttttttcaacaattaatagaatattaggattcgacaacttgcatatctattaagtttcaacaaccagaaaaataaaaaaaagtgaatataattttgagtttgtactgaaaacttgcatcgtttttatataaagcaattttaagctagatttacattttgcaggtttagttgagtgataaacgagaaaaaaaaacatcgtgttgtgcaaatttagatgactgaaaaaaaagaaataaaatagataactgataaataactaatatggaaatttttattttttaaaagtatatatgtttgtatggtagctagccagcatatgcatacgtatacacacacgtgtgtgtacgcgatacacaaggtgcttcgcaaaggtgtttagagggcttttagctgcttcatttttttccagaatcaaaagttttctccaaacaatcttgcttcaggtccagattctagaaaattgtagaatgaaaaaaataaactaaaagcaagaagctgaaaaatctagctttttccgattctcataagccggttaccaaccagctaattctgagaattttaaactcctcaaacagctcctcaaactggctgattcttagaattctcagaattaattcgatgattgtaggttgttggtcagcagcgtcagattttaatcggttgttcgtatgacacattcgatcgcttgtcacatttctagacggtacgcgttgagcactggtagcctggtacagcgctagtatacataaatgtgcctcgatttcgctatctatcgagaaataattaattacacccccgatcaatatgcctgcctccactagttcttaatacatacccatatcatctttacggaaaatcgaactataactaattatgatttttttggataatatataactataagtaatgatagtgaaattgataccctaaaggaacttaattaatttgttgccctatcgatcggtacagaaaaaaaatcctaataatggtgaaatgggtaccaaaaggtactttgttgtccctgtcggtaaaccatacttaagtaacattacctctacgattccttgaaattttcgttatcgactaccaccgaaaagaataattagctgtaaatatatatgagcactcatgttagttaaatctaggatttattaatttgaacctaggtggagtggtttccttaaaaaaaaatctaattagctgagttacattcacttcgcagcaatataatggtcgattggtcgtacggtcgtgtgcttccatttgatttatgattgattaacgtacgtacccttcaaagtgagtggtccagtatgtgttgatctagccttattattggactcattatttttcctagatgccattgtataccttgaggttcatggacggtccttaaacactagcacgtgttatcttgttcttaaactttcaaatacaaattcagatctttaattaatccatcacaagtccaaaagtgtcatgttttctactccttccgtccctaaatataaggaattttagttggatgtgacaaatcatagtacaacgaaactaggatagcttgtctagattcgttgaaatatgatgtgtcacacctaaccaaaatcccttatatttagggacggatggattatcttttatgctactgccttttgtgacttagctacattaattttagttacttccttcatttcatattacaagaatttttagcattgcccatatttatatagatgttaatgaatctatatagcaaggctataaagtcttgcaatatgaaatagagggagtactacgtacgcaccatatgtttggagcactggccggcgggatctagttctcgacaaattcctaaggaaagaaaaaaatcagcattaatttttattaatgttttagatcacatatgttttaattatatttctccaaatttgccccatttattcactcggccagacataaattggtacacatgtgtgtaatagttgagtctaaagcattaccaacagatcgaatatataatccgctctcaaaaatttgttattgggtttttaaattgaaaattggaagtgaaaaaactcatctgagaaaacctaaatttaataaaaactaaaagtgagcccttgttattttttgcggtttttgcaggaaaaaagtgagcccttctattaaattaccaactaaaatctttgtttttccaccgtccccgcgcggaaaaagatcactcctccagccagcccacacgtgggaaagaaaaaaaagcttgcaggaaaaagaaattgggaacaggagtggtgtcgatccacctcaaatgaagagagcgatgaatgcggtgatagggttgccaaaacattactccctccatctcagaatataaagagttttagagttgacactgttattaagaaagtaggtcgaagtgaatggtggaggattgtgattggataagtaatggaggtaggtggaaaaagtaaatggtggagggttgtgattggttggaaagataatgttgggacaaatcttaagagttaaaagttgtaatatttttgaacggaaggaaggagtagtatcagcataggacatctgttagaggttttcttttaccaaaatccaaaaaagtcaagatcggggatgaaataagggtattgatgatgctataagctagcagtgttaattacttttttttaccaaataatgatgaactccaacccagctttcataaacgtttcaggcccttctaaggtctagctaggtacccaccgtgccatatcatgtcaccattcaagaagtcaagtgcatattttatttagcaattttactgtacttcaggaggtaccacgaggaaccattttttctatggacgtaactacatagctagtggtagctggtttgtctaccactctatctataagagacaccattcacctatacttcaaatacaattttctcttaaactactcatccgatctacgatccgattacaccgttgtgtttgtaacaattaaatcttacaacaagatctcacatcattatattttgaaaaaaatcacaaattacttttatgatatgtctaaattacttttagatttcactaagttacttcttagatatataaaagtaaattcagtaaagcctaaaaataatttacatatattatagaagtaacttagaacaaaacgaatgtaactttggcatgtcatttgaagtaaatccggtatagagataaaaacattactctatctagaaattaaattaatcagcacaaattatggaattaactaaaaacaataataaaagcaatcacctcagagcattatgaatatataggaagtattttaatcaaatctaaaaataaattatatatatgataatttgttcaatgaaaaaagacattaattaaagttactttcttttttgttataagttacttctatataatatatgtaaattacttttaagctttactaaatttacttttatatgtctaagaagtaacttagtgaaatctaaaagtaatttagacatatcataaaagtaatttgtgatttttcatcaaaatataatcatgtgagatcttgttgtaaagatttaattattacaaacgcaacggtataatcggattgtaaatcggatgagtaatttaagagaaaattttatttgaaacatagatgataggaatatttcccatacttacttaatggactagtactataataaagtaagattcttccatcaacacatatctagattctggataggcgtcgctagttatgactaaatcgagagtgctctcgaattagattttgtgtttttcaattataaatttggtacctcatagtatctagatactaacaggtaccaaattttacactaattttttaatacctcatggtatctactcaaggaccatagaattgctctttttttacagctataaattaagaaaagcaatagtacttactcaacgaattcgaaggataccaaaactacaacactactttaaaaaatgtctatagatgcaggtttaggaaccgcctgatctgacggaggagacggtgtgagcgccgcagccgcagccttccatcccgccgcctcccctgtggctggatttggaggaggggagggcgcggatgccgccggcctccactgccgtctccaccgggccaccgttgcctcctcggccggaccgccgccgaggtccgctacctctcccctgtaacaccccaggtaaccacgtacctagagtgccacaccaaaatatattcaaaaccattaactttcaaaattattagaaatttcagcagagtctcccctataaatacggacatccacgataggcagttataagataaatcaataacgaaataattcatactttccaaaccatcctagttccataaattccacataaaaatacgaaccagaactttaattgacctttacaagttctacgcaaaacttatactaagcagaatcataatctaaaacaaaatttcaatagtacaataaaatgtgtaatccaagggagctacttcttgcccatgcatgctgatctcaatgtgtacctaaaagcaaataaacacgagtgagtacggaaatactcaacaagtatattatggaactagaagacacgcatacacatcatgcgtaataaagcctgaacataaaactttcttttttggaaaagagtcacatttcaaacaccaagttaaaggcagtcgtagttcccattccaggcaaacatgaattaaaatagtagtttccatctcggacaagtgtgaatacatccgagcattttgccggcaaagccgagtaagcgtgattagcgcttacccacaggaatatgagtaaaaaccatatagcacatccatgactcacatggaacataaataattgaaactagaacaaagaaccaaattaaaaccatattgcacatccatggtaagcatggaacttgaactatttaaccaaaacctgaatctggaatattgaaacaagaataacgtcgtaaacataagataaagcttgaaatctaaatagcattaacaataatctgaacatatgcaatcccatatcacacaaaaatatattgaaaataaatagatagagcaaacactcagagaatcacacaagtagttcgtcatgcactcgccttttaacctcgacggcaacccgacgaaaccccttccacaccagatctctccacacccgtggagtaaaactacgcataaaccaatatattgaactaataatagttataagagatatttactaaaatcgaaaccacatataaactatttaccgatttatattaaacaacctatagcagttccattactgttttatgcgtaactctcataccgtctaacggaatctggcaaataatacaacttcgatcatctaaaaaaaattttctgcaactttcatgttgggagaaaaatcagattaagtctttgtaaatcccagattaagaaaaatgaattgttgtcccggtttttggacccggtcagcagtactgtttctattgtttctcctaaaccgtttatcggaatcgagcgaaaccagcgacgttaaaaagatatagacgatgactacaaactttatttaggacaactaacctgaatcccgatagtttaacaccagatttgaaaatactattgtcagcctataatcagcaagtaagaaaatactcaaccaacgatttaatcgattcccacgtgaaaattgtattttttttggactaataggagttaaccttgcagaggagaaaatcaaatttgaggtcaatctgtgaaaacccagaaaatccccaacttttgcctctcttccctttttccttcttttctcctcctgctttccctgctttctgaaactcctcctctctgttcgttgtagaagcacagcagtagaccagcagcagcaacagcagcaacagcgaggaacgttagcagaaacagccacaacatggaaacatattagatcggtggcagcagcagcagcagcaaggattggcggcagcactcaccaaggaggagtcgagcaagaggaaacaattagtggcgcagaggcagggttggggactggcgctagggctagctgccacgatccctggtttctttttttttcttcttttttttttacaagttggttaaatagagagcctaatgaagatcaaacgacgtacattaattcaacctctaggaccttgttcggacttcgattactctaaacttatactctattttgcactactcggcgagctctacgcatccacggttcctaatcgcctatttgaacaacggtttaaaattttaacttttgcgcgtttgttctaatatttcccgaaatacactaattcgatactcggggtatcaccacccccccccccccccgggcggatctggcagaggggagagcgcggtcgctgccgagattggtgagagagacggagatattagatatggacaggaggatggataagatcgagagatggatatggcggctcgctggctcggctcagtataggtagcattttttttaaaaaaaaccgacacctataatagattataggtgccagttttttctttaaaaccggcgtctattgcttaatggtgccggttttatgtgtttttagtctgcggatgaggggaaagaactatatatgacagttttaactgttccaacacctatagtgtcaatctctatgagcttttttaagtagtgcaactacatatgttgatagaggaatgtacagtgaactctagaccggtaagagaatcgatcttgaccatccatcctttctcatttagatccatttgttccaaatataaacatttctaaagtttttcattgagattaaggtgaagggataaattaaattaaacagaaaagggttttgattggttgagatatgatgatgaaatatatagttgcagaagttgctatatttagagataaactatatatgctagctagaagttgttatatgtatatttttttattacggagggagtatctataacattgccacccaattactgttagattatcagttttataatagaattcctaaattaatggttaaaatcatttttactgtgaattaatggtgacaataccggtagtattctactattagtcaagaccatggtaggttagaggaattgaaggcatgcttcactacgccagaccaagtcatctctgacgggcccaaaccctaacctttaacgggtttggtcttggtcagtgattagtggtcacttatgacaaaatcacctgtgatgggtgaaacacccgtcatagataactcatctctgaccggtatataagtcatctctgacgggttaaaacttgtcacccgtcacagatgtgtcatcagtgacgtgtcgtaactacctgaccgtcactgatgactaatctctgacgggttgtaacttacgacccgtcactgatgacaaagcaagaaatacaatttttgaattttaaacgcaacaaaaaaacctcaaaaaaatattttgaattttactagccatcctatacatggttacacatcactacccacaaattcacaatttttcacgcaatataacttgcatgctaaactatacatggttacacatcactacctacaaattcacaatttttcacgcaaatataacttgcatgctaaacgtgagattcaaactcaagacctcaacctccatagagagctcccttaccaactcacctactcaacacatattgactactcacccaatgttattattttgtctatgcttgtctgaatcatttaacatatatttaacaccctaaatgacttcaaatgaaagtattatcaactaaatagttatagatctcattgtgttttataacttttacatagaaaatatcttcatccgatgttgtttgaagaattcaaaatttcatttttcaaaatagatttcactttataacatgtattttgaacatgtaaactttgtcaaatgaaaatattttcaattataatgttgtagatctggttgagttctataactttgatatggggcatgtatccatccatgtcatttgaaaaatactcaaaaaaaaatttttaaacgtaagatctcatcacttgtaatgcatgttcggcgatgtaaacgatctctaatagaaatattgttagttataaagttgtggatatcattgagagctacaacttttatataggacatgtctcaatccgaggtgttttgtaaaatttaaaaatttgaattttcactcatcactgacgggtcataactaccacccgtcagagataacgttatatgtgacgtgtgttagttaaagacccgtcagagatgagtggtctcttttgtgatggttcataatactacacctgtcacagatggcatatcatccgtgacaagccatggttttctatgacgggttacaagtgtaagccatcacagatgacttcacatctgtgacaggtcctccatagtagccatatattgaagaggatatttttttggcccatcagagatgactcatctttgacgagttgcgttggcctgttacagataacccgtcactgaagcccggatttttagtagtgcttgtagctagacacccatttttaacatgcatgcatgtattatcccattatagctggccatattttcccacacaagaactttttgttggattttgtcggctataaaaattatatctgccaaacttcatgcttccaagatagactttacaaaatgattgatcgaagcaaacgccatgcaaaaatttcgtcaaattaaaacaaattaaacagaatacaaataccatgcgtttgaattattagagcacatcgtcaacattgcaatcattaaatattcaaaatagagcatatatatagaatcttctttggaaggcaacattgtagacacctctctttcactcggcgacctatagttgaacgagtctgcacatgtaaacgtaggaacatgtatgttgacacgtacgattaaatatttggccaacaatctctttcatggaactagtgttaattagtgcaccctgcattaatgacatgtgtatgtatatactaaatctatccatgtgcgtgcgtggtgcacgacagcacacacagccacaaaccaagtataatgataaaattagataataaatcgcgtacttagttctccattaaatttatatctctaattaagcacgtacttagttgccctttaaatttagtttcccacaggaagacggacacacacaagtgccaaaaggtagcttaggattgtgatgcacatccaaccatattaaggctaatagctagcatacttgtgtttcgatggagacaatcttgaaaagactagtaactgtttccctccgttataaatatgtatgctcacaaaatgaacacattaattagcccattaaaattaagttgagagaagtaatcatttaagcatatacttcctccatctcaaaatacaaggcacaaccattttttttctatacaagacgtgcatgcatgcatacattaactattacttcttggttttttaaatttgggttattttaatttctctaccattaagtcacccaatcacattgtttgcatgtatggatgtggttcaattgatgaggtgattaaattctttcttagtttttgtgtcacgagtggctgagccttatattttgggatgaagtaagtaaatacttttagtgcatagtacttccgcttcaatcaacacacgttgtagattgcatttgcaattaacacgactctgattaaggtgagtagaagtgatattttaggatcgaacaacaataactaagcctatcaaagagggtgaatggtagctacactaaaaaaaatttttagtagaattaaaatttaccccaatcgatagagatcggtctgaccggcttgattgccccggtctaaccgttagtccatcttggagaatagcgtctgtcgggccggcgaggatggcgggattccttaccgttgtctgagcccttgtggtggcgccgtggcaacaaagtggtgacgcggggaaaagcggcggtttcaccggctaggagaggagggggaaggcgtgcgacggccggtgatgggcacggtggcccggccatggtggcgcggcgcctggtagcggcgttgccgctttgccccccggggaaaagggagatggagccgggctcgggaggaggagtgttagacttctccttccgctagcctgggagaggaggaaagaaaaaaaaattgggctgttagggaggcaaagtggactttttccagagagggtgaatttggtcgaggaggctgagtttaggggaggtaaacatagttttatagagtaaaacatatttcacaaaggaacaatctttttaaaataagcttttcgagaataaatgaattttaggtttttaacaaggacatggcactggaataggaagaaaatttcgaattggcaaatccagcatgatgcaaatttttcgcaaagtttttggggatgagtttttgagttctcggattttatttgcgaatttttcaggatgttacagttaggtactcctaccaatgttgaacgttttgctagcacagtactactagcagtactcaaatgatttggttgtcaatattctgcaaacacaacagatgaaactgtagagatagttgcaatcttcagatcatcctgcagcatgatatgatatacagtatatgacccacccaatttaaggcacatacattcagttctttttttccaatggatcacatctttgttgacgatcagttcacaaactagtcacaatcacatcgttattacttctgcttcttcaagcattcatgtaacatcaaaacataacacacatcgtctcaatcgccttgtgaaaagtacaagaaatttactatcttttcaacacactgaagctcagttaattaacaaccctgcagttcttgcgaatctggccgtcgtcaccggtgagtgggctgatgttgcccatcttcaccatggatctgccaaaatcccagaagaacttgtgggcatctgcgctgtaagtctccaccagctccttggtgttggcgatgccgtcgtcgctggagaagaggccctggtcggaggacaggaggcctttctgattgaggaggttctggtagtagcggttgtcgaaaacgtaggcggaggtgatgtccagcacggtggtctcgttgccgtctccaccggcacagaggctctggaggttggcggccatggtggcgtccagcgtcgggtcggctgagcttgaggtggtcgacaaccggttgctgaacagcgtgcaccgggctcgtccgatcgtgtgccctcctattgatgatcaatgagtttcagatttccagatcatttaaaagtttatgaaatcttgaaatgtgcaacagatcattttataattgatcaaatattatctctgacggtttccaagtttttactgtagacagtatgaaaattcggaactgacagagagcatatgttccctgaaacatgggctgccactgtacagtttcaggaagtactacagtgtaggaagaggttatcttagcatataaaccagattctgaaccattcgtgcaccatgagatggattgatcactagtgtgctacctgataggacgacaacatcggttgtgtcgaggccgacatcattgaacttctgtatgatcgatttgatgggttcgaacggtgaagggaggccgttgtcagctcctgattgatttgcgacaagaccatcccttctaccgagaagaacgtcatagtaagggcctccactctgaacaaatgatgaaattttagcatacttgagattttcaaacaaagatgtacagtatcagaaagtgaaacaacaaggacaatgggtagacgtagactgaacatacaaatagtactccatagccagctgcaagggctacaatgtcggcgcaggaaacaacttcagggcagatgttctcgagatcttcctttatcgcgtcaatgacttcgaaccctctgacagagttcttgttgggaagtgcaaatttctcgccgtcgtcaccgtccagaaggatggaaccgtcacacccctgaaatgcacaacaaattttcagtaattgtgacacaactagtcaatttaatatgtatgtagaacattcagataaagttcagagatgtgtgaaaagggtagttaatgtatacattgacaaagcagtcatggaaatggagccttaggagggaggcacccatcctcatctcagtcctcatggcagcataaacatgctgctggacaacggtgtacacatcaggacatatgtagtcgtagaaatcgtcggataactggcatctcgcaccccgagtattaaggcacagtacaagaacagagcatacaagcatgaacctgtagctgtaagagtactccatctctcacagaagttactgccctgctcttgtgctggttgcacagtccatgttttcttgccatgttcttataggcggttaaagcgatagatcgatgaattatactatttccgataggcgaagtcggcatgatagtgggcggctgcgcatgcactggtctgatgctgctaactagttttctatccagatattccactttctgaaaatggctactggagcctggttctcctttctgctctgcaatggtgaagtcactaactagtgtaatggagctgcacttagcatccttgcttcctagtgctaaccagctttttgtatcaaatccaaagtggtagtgggtgttccaaccagctgagaaggaattttaacgtatcgatcgcagtttcgtgtttgatttgggtattgcagatgtctgaagcatgataagataagtggattgttcacttgttcagttaagtagtggcaacggtggcatgtttgcaatgtggggaaattcatctggcctatcaaaagattcagatgaggcttaaagtgcattggtgctgcatacgagttgtctctgcattaccaattgagtccagtgcaatgatgtaatcatgcattaattcatgcagataaagcttcttcagagtcaaactgattttttttagataatggattaaactggcctctacacccagaaaaggatgtacacagcccaaatgccatcctaatcaataagcactacagcgaatgactgattgattcaaatccatgaccgagcagaaactcaaatttatctcctttgctgaaaggtacaggttttcttgtacacgctcgtactgaaaaataaaagtagcaaacaatagatcaactctttcacttgtttacaatagaaccaaactgaactaacaattttgtcttcaaatctttacataatggaagaatctattactcttcaaattaatggcatcctaatcgaaaagcattacagagaaatgattgatcgagagtcatgtgagataagaaattcggatgcacgttggtttagtttcttttctttatttacatgttatctgtcttgcaattttgccggttttgctacagtcaacgtggtcgccatttgagctgtaattctttactcccagtgaattcacagagctcttgatttctattccaaaaataacaatgagaaaacataaattttcccgtgtacagaaactaaagaacacatgagctgattacaatttacagattcacaattcgatcagcaattctcaattaattgattgaatccttgtacttgtatcgctttgcgcagcagatgaacacgacgaggttgatcgagctgaggccggcgacgagccagaagaagcggtcgaggtggccgtcgtcgatgtcgtcggcgatccaccccggcgagccgcccctcgcggtggcatgggacacgacggtgacgacgacggagctgaggtagctgccgagcgagcacgtcatgtggccgagcgccgagcagaggctcctcatggagtccggcgcctggttgtagaagaactccagctgcccgatgtgggccaacaccgcgctggcgccgagcagcacgtattgcggcacctgccacgcgatgctcacctcgccggcggccgccagtcgcctgccctcgacggtcgccgcggcggccatggcggcgacggatagcgccatgccggcgccgatgcgctgcagctcggtcagccccctctcgctgccggtgagccgccgcgccgcgggcaccaccgcggcgtcgtagagcggcacgaggacgagcatggcagcggcgtagacggagttgagcgacgccgccgggacggcgaacgcgaccccgaggcggcggcgcatggcgcggccctgcaccgggaagagcggctgctggacgagcaccatgcagtagacgatcccggtggcccacaccggcagcatccgcacgatcgccttcagctcctccacctgcgtcaccgtgcacagcctccacggctgcgccgccgccgacgacggcaccgccaccgccaccgccgccttgtccaagaaactgaactggtcggtgtgcgccatcctccgcccctcctctgccggaccatcgtagaggacgaagccgtcgtgaggcagcacgacgttcctcttcctgacggcggcgacgacgacctggcaagctcggaccacctggctgccacgaggctggtggtacctgtacatggcggagccgaggaggaagctggccatggcgaggacggtgcagagggccgggacgccgaagccgaggagccagccgaagttgtcctgcagccacaccacggcggagccggagacgagggcgccgacgtacatggcgaagtagaaccagttgaagtaggagctcttcttgggcctctccatggcgtcgccgccgtcgaactggtcggcgccgaatggccccacgcaggacttgatgcagccggcgccgatggccatgaggtacagccccagggagaagacggccggctgggtgctccggctgatgaccgccggcgacgcccccgacagcgccatcgttcccatcccctgcaatcagtgcatcgatgatcgatcacaagagaagatttcaaattcgtttgaaatttgtcagaaatcattggtcaatctctttttgttgccgtaacaaaaaattgtttaatccattgccggttatcaaaatgcctagtaagttgctacagtattatcgaaatcggtagtgggtttttttattctactctggatagcatagttattatagacttactttggttatagaatctatatgtcatttctattcaatacttcgacttatttttattgtagtatctatgtgatttctattcgatacttcagatatccaccattatattatgagggagatgaatcccataacttcaatttgagcttaacttttagaactcatctttgtgaaacattttcataattaatattttagaatgaacaattagcattgcaaatcatttatttgatgaaaattagtgtggacgttggtataagtgcatgtcactagtgtaggccatgttgcggtatttgtgccctgaaacgattgttttgtctgattgtgtggaggtgatttgagatcaaaccttaattgatggcaagaaccgggactacgctgcaggaggacccgaggcttagcatggtctacatgtcatgtaacaagatcgtactagagtcaggattcttgaggtcaacatcagtcataggtaggattattggaagtaaacttaggaagcaatggaggtcgtgatgagattggataaggtgtcacatggtgaatggacaccgtgcgagaagtctttgtaaatggcttttgcatgtcgtgcggtgtaagtgcatgtggttgcggagaatgttggaagaaagaagggcatccagttgcatggcagctacagtaaatggagtactgtagctaaatatacatactctctctaatattataagttgtttgacttttttctagtcaaattttgttatgttttaccaagtttatataaaaatttaataacatataaaatatcaaattagtttcattaaatttaaccttgaatatattttgataatatgtttgttttgtattgaaaatactactatatttttcaataaatttggtcaggaaaaatttctatcaacttataatataaaacggagagagtacgtaatgtggatggatggcatggtacattttttgggagagcaaattaagatgtgaactattgtcattgttaaagaaagttgtgtgaaatcaacaagaatgattaaatcaagcttacgatgatgtagatggagaagaaggcgaggatggtgcggtatcggccgaggcaggagtcggcgacgatggcaccggcgaggggagcgatgtagcaggtgccctgccacatgctgaagttcctggctgcttctgcatttccctgccgcaattgcgtcgtcaggaatgtcaccaggctgtactgcaccccgaagaacgccaactgccccaagcattccgtccctgatgaattcatatttcacaacaaaccgaatttcaatatgcaacttattacatgaacctgcagatcgatgcaactggtataagacaggttgaaatgggaatagaagataaggaaaattggtgaaaaccatgtagcatctgtaagaattcagaacatggagaaactgaacaggcagcatggccggatccgtactaccaatttcaagaaactaagtgagctaaatggtatatttcaaaatgccattttttttattttaatagcacaagtatcatttttttttcatgtaaggtgttgtatgtttaccaagaacgaaagcacatgccctccagcaaccagtagagtgtttggatgcaggattccctttgacatcaacagatccatctcctgtgtgctggcttagtttaccctgcagcaactgaacaattgttacctacgtgccactctgtaaattcttcatgtctgttcatccctagctgtcactatatagtagcatccatatcagtaaatttatatatatatatatttcaagaatttttctacaacaaaataaaataaactgttggggcacaaacatatcttctttctttgttttttttttgacaggagagaaaagcactgaactcaacgtaaccatgaacacaactttgtgacagtttggacttgggatccattctccttggaaaaaaaaaggataagtagggccgtttttaattcatacaaaaattactatgccctaccattttttttaaaaaaagaggaaatgtggtagcttcaattgaagccaaataatgtggtaccagtttcttcaccgtagtattaatatttgacttcattattgatctaactttacctacccaaaatttgtcactaccaaaaatttctggtagggctttaaaaccaaaatggcccgtcataattacttcaacatattcctcattttttgatgtgtattattccttttcacgagcataggtaaatttgtagcataccaataatattctttttagagtatttattttttattacacggtgacatatagggaagaaaacggtcagaaaatagcctcaaccatttcaataactttttttctttctgtacaacatagtcaaaaacagtaaaaattagaaatgagaacggtatctagaatatcaaaaaaatcagaaacgaacgaggacagggataaatcccaaacctcactgaattactgttgggagcacagatatatgtgtataatatttatggacaccttgattgacacgtgactttgccgtcattctactatttctttacattttcttcctcaagaactgtaaaagctgaactcaaatactctgaattacaatttgaattgtgcaggtagatttattttttcgtaaacgtgggaaaagaaaggaattaaccacatttctttggcacaaagaaatttatgttaagtgaaaagtcatctgaatattttttggaaataaaataggaaaagtgaaataaaaagaacagtgtagaaagagaagttgttcattagaaagcagaagcaggcagtcacctcattgttaagccctgcttcatctgccaaagcacccggtttgtttgtgtccatgtgtcttatcaagtgctgtatgaatgttgtctgtaaatgcacaatgcaacacaagcacacatgatgcatccatatatatactcaataatatataagcaagagaccataaaaaaaacaatgctattaagtctataaccaagagtaatgactctttccaaaaataaacaagaatgatgttgtacaggaggttacagcttcgaaggatcatgctaatgatcctcatgattgatcacctgaggacctgaaacacacgagatcgaattattgggttatttatgatactattagacttgttcacctcataattttttttctgatggaattgttcacctcatcattgatcacatagttaattaagctacacgtattgagatattcttgatcgagcttgttacaaccttgcagttttaagtagtgttcgaactgaattatgcaatatccttatcccaatcaagattttccttccccatggagaaaagtagcaaaaaatattgcagaaaacttcttgttgctgatgacataaacatatatgcaattgcaaaggctttcatctagaagatttaaccaacttgaggatatgtctgtctcaaaatgtgttgtgttgcagcactcgatattttggagacgacgaccctgtgataaagttaaacacaggttgtttcatcgtgttgcacttggcataatatcttgaacacatgcatacagcaagtaatgtttagttattgagtaattttattgtactttaggtattatgagataccaaaattttacacgaaattcagtgcctttcattacttttttttctcgaacgcgcaaaaggattgcacgtcaatatattagaagaaaagaatgtttgttacacgacgcaatgagtcagaccgacttatgccaagaaaggggagaaaaaaaagactaaaataaagaagagacgaaagactactgtgacagctacacacaactccaaatagctgggagggggcagagccactaccttcccaatagaaccccaaaattagtgataccagctaaagatcaaaggtggccctcagagaggatagactcaaggacctccgagaccgatgacaatgcagagtcaaaaactctagagttccgctctttccacagttgccaagagactaggaggaccatagaatcgaaactggcccggagatgccccggcaagccaaccctagaagaaggccaccaatcttggagacagctacctcggggaggagagagggtagtccaaccaagaggcgacagcacacggagccaaacttgccgagcgaagatgcaatcgaggaggatgtggttcgctgtctcaagctcttgaccacagaaggggctggccgaatgactatccaagccacgctttaggaggaggtcggccgtccagcagcgccgctgaaatgcaaaccagaggaagaacttgcatttagcagggcccttcgcgtgccagagaagatcggcacaggcaaaggagtgctggccaaaaaagaaggcctggtacgctgaacgcgcagagtagcgctggtcgctcgtccaacaccaaacaagacggtctctgacacccggcgagagctgaattcgaagcgcagcatcccaaataagaagaactgggagatgacagggacagtgagggccccgcggatgtccgaaacccaggagttgttcgccaggccagaagcaaccgtgcgcgaacggaggcgctgtggcacagcgaagaggaggtcaggagccaaggaggccactgagcggcctccatcaatccaatggtcagtctagaagagcatagattcaccattccccggcatgaagaaggtggacgcctcgaacatgtcggagacagactgctcgaccggggccttcaagccatcccaatagagatgcccggaacgctaaagccaaagccagcgaacgcgcagggcgaaccctgccaacctgaggttaggaattcctaacccaccgaaggccttaggacgacagacattcgtccaggacacctggcactgtcccccatgaaccgcatctgtacccgtccacaagaagacgcgtcgcttcttgtcaatagccttaacaacccaggcaggaaggccgattgccatagacacatggactggtatggaggagagaacagactggaccagcacagagccaccagcaagagtggtgagacgccccttcgaaggtggtaggcgatgagcgaccctgtccaccagtggctgaagagccgcctttggcaacttgcgaacggacagcggaatgccgaggtaggtgcaaggaaaatcagaaatcgagcaggggaagcaagagtgaaccagctccaggtcctcatccgagcagcggatcggagtaatcgagcatttggcaaaattggtgcgcagcccggatgccgcaccaaagaccgagagaatgccctggatgaactcgagatcctgccgaaccggggagaggaagaggaccaagtcatcagcgtagagggaggcgcggtgtctcaaagcgcgatcattaagcggatcatgaaatttgtcttatagttgtttcatctagtaagatcaaatcaaagaaactagcacaatgtttcttaatcatgttattcagaaacaatgagaaatattgaagggcattggaaaaatgttatttagtactcctttgaattgaaggggttctttgtttggattgaacggtttttggaggataattggatgattccatttcctatagaatttgccactattgattcatttggaattaatgaaggaatggggcatagaaaaagtggaggaaatctatctttgccatcgattccatagaaaattcataggaattttatatccattgggacctcttttattgatttcctttgagaagcccaggacaaatcaatgtttgcacctccaaatgaacatagtttagacacatcttgaacatataaaatatatattatgcacagttagcaggaattgataagtattaattgtttgttcggccagattatgttggactaattggggtaattaagtagaacaagtggattatgttatagcactgttttcatgggtaaatatattctcccgcatcaattagctaagatgatatctcttttagataatgagctaattaagaggatctgaccggaaaaaaaaacagttgaattaaaaactctaagcctagttgttccgtgtataaatatatgcatgaactggtcatttgagtatcatatatatagagcacgatttaattaatcacgttaaatatcgggtcgtgttttttatgcgtgttgtcttctaattttgtcacattaagcagctgggctatcattattctattttttctttcctttttccacaaaatgaggaaaaggatgaaatatacaatccattgatcaagcaaggacgcatttgcaaacgaccatgcctacaatctacaaagatcatataaagccagaaggtttcatcgtgtttatctatcttgcacatgtgaatccaaaatttggaataattcagaatgcagaatatggagataccctcataatagatgttgaaatatcttttcgcatgatttactctttcaattccgtccacttttactaacctagctagacttattctaatttcagataatcaaactttatacagtttgccaataattatatgtatagtagtatttagtacctacaagctataccaaattaataatagatcatatatctgattcacacaaactatatatactgaatttatcgtactctaagatacatattgcaaatcagaaatcacccatctgagcagttctttacatttttctcttttccaaaatatctttgcatattccaaagggtcatgaatttagtgcaaaacccaaaagaaccatctagtttgaaaataataagatataaacactgatacgtttgttttgcctttacggtagtctttgttggtagtagaagccaacctagacattcatcttctctaatctaatggattgtatatatttataacgggaaggctaaatggctgtcgaatgatttttgatagctaaatcattcatgttttaatatattcagaaccgttgtttcatatgttgtagtaaaatattacatgaggtgatttgattgtgtttcagtcttttaaaagattgaaacattttcgatctacttggtaaaacaacgctcgattggcttcgaaatttgcatgatggaagcctaaaaaatcatgcgaatcccatataaactttttctcgatgtactcggatttgtttcatgttttaatatatttagaaccatagtttcatatgttatgttgtagcaaaaagtttcatggggtgatttgattgtgttccagctttttaaaaagattgaaacattttcaatctacttggtgaaacattttcgctctacttgatgaaacactgcatgatggaagcctaaaaaatcatgtgaatcccatatagacagctatttataacgcacattacaattacaagaactaaatggggtttatgcagatttttgctaaccatagatgaaggtttaggaataggtcatcatttgtgcctgtaggctggtgtaggctggtgtttcagttagttctcttgttttccatcaaattgcgttgtgcaattcacaatcgttttaatgcaaacttcgtaataatttggttgtaacttattcagagcaaagactggaatggttcttccattatctaaaatgtagaattcataaatcaacaattaggatcacttttactagtgataataagcaaaggtacatgaaattggttttttagaatattacagaaattagaaaatggcaaagtatttattgttgtcctgctgttaattaaaaaaccgacgtttaaacatctaaaaaaacctccgatgaggtttacacatatcacaaatagcacatttataattgattcaaccctacactacataggcacttccaaggcaattttattactaggactaattaattaattagctgaaaacacacatacacaaaaagaaataaaaagtcaagtggtaggcagcttgcgtttgtaggtggcagcgcagcagacgaaggcgatgaggttgatgagctgcaacgccgccatcaaccagaagaatcgatcgagatgtccctcgttcagattctccgggatccatccgccatggccgccgccgccgccggtgacggagctgatgatggtgagcatggcggagaggaggtagctcccgggggtgaccatgatgagcgagcacgcctggcacaagctcctcatggcgtcggggctctgctcgtacgcgaactcgatgtacccaacgacgccgaacaccttcgccaccccgacgagcacgtactgcggcgcctgccacaggatgctcaccgccggagcatccgcctccacgctgcggaggcgcgccgtctcaacggccgcggcggcggcgagcgcgagaacggcgaagaccattccgacgccgatgcggtgcagctcggagaggccgcgcttgacgccggtgagcctgctcaccgccggcatgaggaccctgtcgtatgtcggcgcgaggacgaggatgcagacgcaggtgaaggtcgtcagcgacgccggtggcaaggcgaaggcggcggcgacgtggttgtccatggcgcctccctgctcgacgaacagcgggaagcaggcctcggcggtgttgaagattactccggtgaggaagatggggagcatcctcgcaaagatcttgagctcctccacctgcgtcaccgtgcacagcttccatggacgactagctgatgcttcatcggatgcagtgatagtggcagctcggtcaaagaacctaattgcaacaattagtgataaaaattcatcaaatttgatcttgtgttttcagttcactgaacaactcaatataggtacggtgaagattaataagtgatcaccatctgtaattttgtaagctgaaagtatgacttttagcaggattctacatttcggatttaaatttccagtttccatgctattgcattctaagatttagaaaattttgtcgaaattttgttaaacgacacctgccgttagcccgttacggcagatgatgcataatgaattgagatcagaaattgatcagaattggcagaatttagtttacctgagtccatcagtgtgcatcagcttcctgctgccaacaatggcagactccttccctggcatctcatagagcagagagctgtcacttggcacgtccacgtggaccttgcgaaacgccgccacgacaacctggcagatcctagtaagcgcgctaccgccgggtttctggtacctgtaaaacctcatactcgcaaggaatccgacaacgccgatgaccgagaacagtgtagggatcccaaaacccagtccccaaccacagttatcctgaacccacactataaccgtgctcgcgacgaagaacccgccattgacagcgaagtagtaccagttgtagaagagctccttctgcgccttctctgaaacgtcggtgtcgtcgaactgatcggctccgaatgtcggcacacatggccatatgccacccaagcccagagctgtcatgtagaggccaagagaggacaatgcctcctgaggaaaggttgccattgatctgtgcatgtttggtggaaccactgctgaaagtgtgagtagaaccattccctgaaaatgtacagtacataacacaaatgttcagacaacttaactgatattcagacaactttgctcgtattcagaaaaatatgaaaatgttgtgatctcttacaaaggtaaaggtggtcagggagacgacgattgtgcggtgccttccccaataggagtctgcgaggaacgcgccgagtattgtggtgaggtagcagttaccctgccaagcagcgatgttgctagcagcagtgacattgctctgtccctgtaccttggtcaggtagctcaccaggttggtccctactgcgtagtacgccaatgcgccgcaaaattcgccacctacatacaccgtgccaagaacatgttcttcactagttcaaaatgaacactgaaatgtgattgatgaacactgagatgttgggcagtgtgtgttattcaacctagaatagagtagcatgccttccatttcccagtgtgtgttttagatgctggattgcctttgacatcaactgatccattgcctgtgtatggaccttcctcctgcaaccaagcacaagcatttgattactcctacatttgattgttaggacacctcatcagatgagcaaaagagatcatagaatgaaaagaagttgcaatggtgaatttctccaggcaaatcaaggaaatcaaagaaaatgttagcaaccggctggcagccaaactccccgtccatccactgccgctgctcctcatttgccatgctctgctcgatcgccggcgacgaagcggacagtaagttttaaggagctcccacgatagcattaacaagaagcacttgccatgtcatttggcacggaaattcgtatcgttagaatataaaaagcaaactgcttgtgcgacacgatcgacagttgcagcctttgcagcagagattaaggttgattaagtacacttaataggtcgcgtgaaggttattgaagtgtaatgagtcatcgtactcaactttcagcacgccgactttcagggatcctagcaacttttgtgtcgaagtagttggacggcccgcgcaattgcgcggctagcatcaatgtaaaattatatatttttacacatgattttatttaaaattattatccccgtgactctaataattttatagtttttaaaagctatggcagtcgctaccccttacttctttggcacatttttatttgcttacccgatttaccactacttctattaatcctttttagaactttaaaaattaggccatatagtttttagagttcagtgtcttgttgggtttcgttttcataatttttagaagtatcgtcaaacatcgccaatttactattctatggcccgtctgctgacacctctctttattgtcattgggattttaaaaatcgaacacaaatattgtttgtgttcttttttactttctataagtttcaccaaatcgttagtagcttcgccactatacttctctatatcctacccgctactttccctccttattgtcattgagattttaaaaatcgagcatgattatcaattggttttatttttactcttcataagtaccgccaaccgtcgtgaccatgttgcttaacggcacacccatcgtcatttctcttaatcattattggggttctatttggggttttgtttataggttttagatatcccatcaaccgccagcactctactcctttacaagcctattgcttctcccctctttattgtcatttgttatcgttctgttctagatggactgttttttttaaacaaaattgcatatttttcattccgataatttttatttataaattatattcctacttaaactcttataattatttttctatttttgaaatatattttatttgttattttgaactttaattcatctcgccatgtgttccagattgccgcttatttcaatagtcattacgtttttattaaaacttctagttatttataaattatattctaattgagctcttatttttctttttctatcttttgaatttatttttattttatattttaattaatctcgtattgtgttctatatatactatttttaatattttttaatttttattttcaatttcaattgtttcaaaattttattcctacttgaactatctttttaatttttatttttctaattttgaattttatttgattttttattttgaattttatttaatatggtattggttttttatatggactattctttcaatatttacttatttttaatttcgaattttagttattttcaaattgtattcctacatgaactcttctctttttttctaacttcagatttaattttatttttattccgaattataatttatctcgtattgggttcttatatggattcttctttcaatattccttatttttaatttcgaatttcagtttatttttaaattgtattcctattggactcttctttttgttttctaatttcgaattttgttttatttttattccgaattttaattaatctcgtattgggttcttatatggactcttctttcactattccttatttttaattccgaatttcagctatttttaaattgtatttctacttggaatctctttttctttttctccgattaatgtgggaatttttagcccccactgcgaacgtggtgtctcttttcaaatatgttttaataatataatagatagagagatatatagatggcataaatactggctttggatctaggcagatcacattagctttcttcagtgttgtgtttcctgggctcttctgaagtcaaatcgttagtacaaatcgatatttattgattcctaattttcaaaattattaaattgacagaaagtaacgaagacttttaactctgaggtagggtttgttattccagttcaaaattttagtaatttcagaccccaccggcaaacttaaatatcccccaaaaatttcagattttttcaaatatttatgaatttgatcaaaagttattcattaaaaatacatgttaaaatttcaaataattgcgtgcaaagaaataccaaaactcctaagtagattgttttttttcgttagccttaaaacgataaattctatatttaactttcaacgtaatgtagttaatatctataatactaatgaaagagtaaagtgcacaagcgatgcaactcacatgttggcagttagtggaagctagtaatacttaagtggcaaaccgatggttgcaagggccatggaacaacaaacgtgaacttggtatcttccatggctctcttcgtccttagttcagacctcaactgattttctattcatgtatcccgcccaaggttcacaattctgacgaaaaccggtcgaattccataaaatttcgaagcttcgacaaggctcgaaagtaaaagccgtatgagatttcgatgagtttcatcgaaattcaaatttgaattgataaaaaaggaaaaaaacaaataaaatcttataaatagtatgatattcatagaacctattgggatataaatttttaaaaaaattgatttattccgtgtatttactgaaatttacactgggaaagaaaagaataacgaattaaaaaaaggaaaaaaaattcagtttacctcttttctagttaacgattgaaatttcgatgatttcgctcggaatttcaccaaagccgactggttttcatgagcttatcggtaaattcaagaaatttgtattcaaattttggtttataaaatttgttcggaatctaccgactttccaccggattttgcgaaaactgtcgttccgctagggatgggtcatgatttcatttggcccgtccaaataaggcctgagttacattgaacgatttggagcaataggttgttctggcccaacaaaaatataggaatactatcaattattggcatgtaataaaagacatgccaatacagtgcagtagtctatataaatgtgttcttcaaaaaattattataaactttgaaaatgccaacaaatatgtttttttatacataaaggagttttgtttattccggaatgccagcatatatcgatagcacatataagctcgcagctttaattctgcgtctgctccaaatttttcttagcatgaatcagtacataccataaataatttgaaactttctgtataaacgtgtgagttataatattctgaaatacaaacataaaaaatcagaatataagccaaaaacaaggttttaaaataatgttccggaccatcacatcgatcctaggaaagtaggaatgagttataaaaacgaacggctgcccttgcccttcccaaaagtacaaaaccatcctttcattctcttgtttttttgttaaaaacaactagatctgccaagaaaaaggaaatcaaagaaaaatctcaccaacaaagttcaactttctcatatgaaatataaatcaatgcatgcaactgaggaggtatgtttaaccatccgtctcaattctcaaacaaacaaacgattttttttaccctcgcccagaagaaaagtagaaaactaagatgaaagcagagacatgcatgaaaggttagcaatggttacctgcagagaaggtgtgccattgaggagaggaagaagaggtagtttggcgtcagtaatggagccttccattgtgccgaccctgctgtggctattttcctcttgtccaacaactctgcctcacaagcttacagtcctgagaatcgtggatatatataagcaattctcattgtaaaggtaagattaattagaggagcaaataatggaagcacctgaagaagaagaagaagaagcctcaaaagaaggacatgaaagaacgagggccatgccttttgtcattcttttgctgtataattaaagcgagtagggcaatgactgactagagccttccatgtcagtgtctccttaaaaatgtggaggcttggtactgtttggtgatcagaaatctgtgaccagagaggaaacagatcaataaagatgtggttggtaaatatttattctatggaaatcatagatgatgtgctatttgttatttttaatttttagatgaactagtctttcgaaaatttttagatgaactataaaaacttgtggtcccctatatggatggatactcatacagtacatattgtaacgaaatatttatatatttataaggtgttgtgtgcttccaattaaacaaggtagttgccaaaatatttatgaattagtactatcaatgtatgtcctggattggaccaatatggccgtgtttagttcgtgtaccaaattttttttaagtatatgaatacacatttgaagtattaaacgtagattaataagaaaataaattacagatttcgcctgtaaaccgcgagacgaatttattaagcctaattaacctgtcattagtaaatgtttactgtagcattacagtgtcaaattatggtgtaattaggctcaaaagattcgtctcacgatttacatgcaaactgtgcaattggttttttttatattcacatttaatgctccatatatgtgttcaaatttttaatgtgatggaaaagttagcagtttgaagaaaaaatttgaatctgaacacggcaatctcaagttgttccaagattagccatacgatccgtaagctattgaatattgagtcttcgagtcattataataatatagtagtactccattagagtccccgcacccatccgttcagaaataattaatgcgatcaataatgtacggaaccaatactcataagtcacaattaatggcctaatgaccatcttgttggccccatgcccagacactttcaggatgcttaattaaacaacactgctctacttgtgttctgattggttaagctatgtttgataaagtgataaaaatcttttatacgtgtgttattagtattttagaagttaacgtaggatcgaatcacaagaactaagccaatcagagggggtgaaaagttagtatacccaaaaaccgaaaacttttaacggaaataaaagttaccatcgaattcgacggagatcggtctgaccggagttgtcctgccggtctgaccgctcagatgccgtcggtctgaccggttgaggtatagatcaaccggtctgaccgccgaagctgctcgccgcgcctgtctccgccgccggtctgaccgccgtgcttccgtcggtctgaccgccgcttgccgccggtctgaccgccggtagatcgccggttagaccgccgaaacccggtaaacacaaatcgaagaactcttaaagtagatgacgactttattgattctctctctgtttacaaagtgcaccaacagcactccttacaaaaaatttcgactaaactcgaaaccctaactcaaaactcaactcaatgctctcaaaagcgataccgggaagcctcacgctccccctctatttatacccgaggtaggcagcctaaagccacaaaccaaactcatactaggagttctaaacaccttaggaaaccctctagtacaagaaagaaactttacataaccaatcgtaccaaatttggactccttccaaattcgactctgcatcccacacgcacacaataactccatcgtatgccatatggaatctccatcaaccacgtgcatcaactctagcctaagtatcccgcatgatctccgaccaccacggacgtcgccttatccccaagccgactcccggtccatctccgcaaatactctcccgagacatcgagtcacctacacatggaacaaacaaagaaaccatattccgagactaagctatctccaacttgactcattagtagcaaacaacagtattacatacgtatagtatccatctagaagtcataatcatgaaataatcacggatatcgaaacaaacaacccgaaaccgaaactgacacagtatcggacggtcagaccgcgggctggccggtctgaccgcgcgcataccgccggtccgactggctaccagagcctggtctgaccggtcacatgaaataacaaatcctatgatcacctgtgaaatccaatcatctccaaaaccacttcgtgaataaattccaaataacaaaaccaataatctccgatgcccaattgttcatcacagaataataatcaaaaacacctttgattttacaatctcccccttgatgaacacattgtcaaacccataaaaaatgttttggtttttggaaaaaaaataaaaacaaaggtggtaaaagcacacttcgtacaaacgtacacatcgtgctcgaaaatccaaaagaaaacttctccccctttttaaacatgctcttctcaacaactcttcaaaaattcaccttgcttctccaaaaataactctctaaaaattcaccttgcttctccaaaaatccaaaaaatttcacattacttctcccccttttgacaatgatttcatcaagcataggaattatattcattaatgttcaagagcttagcatacatatagcatatcatgtcatgtgttgcaataaaaagaagatgaacccatctataatataagaagcatgcattaaagtataaccatgaaccaaagattttacaattaagcttgaatcaacaaccaaaattcatgatttcatacaatttataatgcaacatcttaacaagcacataggttgaagaataaacactaaatacatatacctattgcatttatcactctttctcaaataaactttagcacaaaataaccaagagaatttttgaaccttttcttttcttgagcgtttttgctcatatttttctcttttattccgggtacgtccctgtcgtcaagactgtttccagggattcagcacccattattttgctcacatcgaatacgtccttgtcgtcaagactctttccaaggattcggtattcattttttttcatattttgtactctctttttcacaataagcaattaaagctatttgaggaataacaattcaataaagcatatatatagagcctttataaatcaaaccatatgctagcatcaacattgcatatttgcttaattcaagtatagaatttaagtgtcatgcatcatctcccttaaaaacaaaatctaaatctcatgaaaaaactagaatacatacaaactatactagagacaaataaatcttcaaagtattgctagcatgcacaagaaaataccatatgcataaacaaagctcccttttctcaattttcattgtcatattattgcttgataaaaccatgaggtacaaactccccctcaaaccgtgccaaaaggatgaattatgcccaattcaccacgaagaaaagcaaagcgattagaatccaaaggtttagtgaaaatattagcaatttgcaactttgtgtccaaaaactgcaattcaacatctcccttctcaacatgatccctcaaaaagtgaaaacgaatatcattgtgctttgtgcgtgagtgttgaacaagattcttagcaatattgatagcactagtattatcacaaaagagaggtactttctcaaaagtaagaccataatatttcaaagtagataaaagccaaagaatttgtgaacaacaactagcagcagcaacatattcagattcagcagttgattgagcaacactagattgtttcctagaagaccatgcaatcaatgatttaccaagaaaatgacatgttccactagtacttttcctatcaattctacaacctcgaaaatcagcatcagaatatccacttaagcatatagaagatgaagtagaataccaaattccaaactcaagtgtatgattcaaatacctcattattcgcttgaccgcttgacgatgtgaagcacgaggagaagcttgaaagcgtacacacaaacacacagcaaattgtatgcctggcctagaagcagttaaatacaacaaagatccaatcatacttctatattccttttgatcaacagcttcaccatcttcatcagaatccaacacaactgtagaaccaattggtgttgaaattggcttgcaattctccatctt

SEQ ID NO: 73872 - DNA, 9261 bp, Oryza sativa
agctcgaaactaaaaagttaatgcgaagaaggaaacacgttcgacctcgtcactcctttgaaacgtaagggggacgcggttttcgaacaaggttttgccttagctcgaaaacacgacataaaaaaaagcttgaaagcatttacccaaattcgagctcgaaaactaaaaagtaattgcgacgagggaaacacgttcgacctcgtcactcctttgaaacgtaagggggacggcggttttcgaacaaggttttgccttagctcgaaaacacgacataaaaaaaagctcgaaagcatttacccaaattcgagctcgaaaactaaaaagtaattgcgacgagggaaacacgttcgacctcgtcactcctttgaaacgtaagggggacggcggttttcgaacaaggttttgccttagctcgaaaacacgacataaaaaaaagctcgaaagcatttacccaaattcgagctcgaaaactaaaaagtaattgcgacgagggaaacacgttcgacctcgtcactcctttgaaacgtaagggggacggcggttttcgaacaaggttttgccttagctcgaaaacacgacataaaaagaagctcgaaagcatttacccaaattcgagctcgaaaactaaaaagtaattgcgacgagggaaacacgttcgacctcgtcactcctttgaaacgtaagggggacggcggttttcgaacaaggttttgccttagctcgaaaacacgacataaaaaaaagctcgaaagcatttacccaaattcgagctcgaaaactaaaaagtaattgcgacgagggaaacacgttcgacctcgtcactcctttgaaacgtaagggggacggcggttttcgaacaaggttttgccttagctcgaaaacacgacataaaaaaaagctcgaaagcatttacccaaattcgagctcgaaaactaaaaagtaattgcgacgagggaaacactttcgacctcgtcactcctttgaaacgtaagggggacggcggttttcgaacaaggttttgccttagctcgaaaacatgtcacatcctgaatttcgttttaggatttttaaagtatttaataaattattattagaatttatattaaatgttcattaattttcaagtgaagttaaatgtgggaaataaaatttcctaaatataaaggatggatggatttaatttttattaaattcttcatggttaattatactctttggaattatctcggattttttcggagctcaattcctaattttaatcatacaaagaacatttcagtaattacccacatatttaattaataattaaatggtctaattataattttttatttactttgagtgtccaagtattttcaggatttttcttgaaattatttgagcattggaagtatttttaacaattcaaagatcatttaagtgattattttaattggaaaagtaataaaattctcctctcccttgtcttaggctgaatcggcccattcctttccttcctctctcttccgccggcccaacccgagcctgcatcctctcttcttctctcagccaaagtccggttttactccctcttctaatcaggctgagaaaagaaaagcccggcaagaagtctacttttcctccctgtcgctacagtgcgtcttcaagctccagccgccagccgagccgagtcggctgccatgccgagccgccttgccgcgccgaatccgccccaatctctccccttttcttccgtttttttttgaggggtttttatcctctcatcttcctctatccttacccccaaaaatcggagcaaatcgttgagtattttatccgaatcgaactcgttttgagtttatctccaaaaccgagtttttgatttcccggagcgatttcttgcgggaggagtccgatctattcaacccaaggctataaataggaccccctagtcctcctctttcgtttgccccctctcccgtgatctcccgtgcctcgtagcgccgccgccacgtgctccaccccgccatcgtcgccggccgagttccatccgcgtcgcgccgccgcctccgtcgtcgccgccggtcgccgtcaccaccgttaggtgcgcgggagggtggagaagcccggccgcctgacccccgaagccgccgaccaccgcagctccggcgccaccgccgaccgaagtcgtcgccgccgctcttcctctccgccggccgtcgtccgtcgtcgtttgtcgtatcggtgagcaccattgagttcgcaatgttgtcctctacgcgtatgtgtcctccaaaagtccggccgaccaccctagctccggcgaggtcgccacccgtgccgtggctgccgtcgatgacgtcatgacgtcatcatctcctctttttcagttttttttaatagattaaatcttcggaaattcataactaaatcatcgtaactcggttttgagtggttcaagttgctaaattcatctaaaatcatgatctttgtactgtttatttggtttttattagtctttttcctcgttttgcgtgttagcttgtcgtttccgtcattgcgaaggttcgtgagtgcgtcgggagtgttcagaagattaattgagaccgattattgcaaggcaagtcacacagatcctaaacacaatcatttgagcatgttgatcctatatttaaattctctatttattttaactgtgcatttattttcgaatgtcactgggtggtgtgaacctattcctttgttatggccaatctgcattgaatgccctattccttgataccttgggtaataaattgattagcttgaaccttatgtattggtttggttcagctaaatgttatatatataattgcttagccatgcttagaaacattagctcactaatgggatgaatcatatatactacattattatttatggttatatttaatggtagctcacgatggttaatcgtgttatgataattaattggtaattaaaatatgattaatggtgggttgtgagcacatggttttgaaggtcgtgctcatggcaattaaggaccggttcgcgagctactgttgtgaaacattaaccgtgccaaccacaagccagcgtgggcaacggctttaccttttgtatagcatggttcattgtggagcaccagactgagaagtggcggagataagcccacgggggtcgctggggagtccatgccttgttttataaggggtgattatgatccaggaatggtgtactgtggtgagttgtgttgtgcagagggtattgtcacagcctctattcgggtactttccagtatcgcgacgcatggtagacatgatgttgaggctgtgtcttgtaggtacagtggtacacctctggctagagtaaaactattcgaatagtcgtgcccgcggttatgggcgagttgagcaatgtttttcgtgattagtctcacgcctctcacaataattattgatgctataactggtaataatttgtttagctcctggtttggagttagatctgtacagccgggtatggttgttcaggatggttgggcctgtgcagcatgggtgtgttgttcagtgttgattaaaatttctgattaattactctactgttttactactcttaactctttgctaaatgctgctttcgcaaatgagactatattatgccatcctttggtatccttgtgcacttgcatatttgctgtgtggcttgttgagtatatcatatgctcattcttgcaataatcaatcaacctcagttgaagaaaagggatccagaaggagaagacgtttggcttataccccagttgagttgcctgtgggagtggagctgaagccatcgctagaccgttaattccgctgctgtttttcttttcttttgtaagtatgtaacgttattattatgatggatttgtatattaaattgtcagtttgtgtacctcggctgatttctggacgaggattttatgcacaaattagtttggaaattattagtgaatttccgggcgtgacaaaacacgacataaaaggaagctcgaaagcatttacccaaattcgagctcgaaaactaaaaagtaattgtgacgagggaaacacgttgacttcgtcacttcttttgaaacgtaagggggacggcgtttttcgaacaagtttgccttggctcgaaaacacgacataaaaaaagcttgaaagtatttacccaaattcgagctagaaaactaaaaagtaattgcgacgagggaaacacgttcgacctcgtcactcctttgaaacgttagggggacggcggttttcgagcaatttttgccttagctcgaaaacacgacataaaaaaagctctaaagcatttacccaaattcgagctcgaaaactaaaaagtaattgcgacgatgaagttgatgcattcaaactgagaattctgctttgtgtagtgccgagcgatatggaaatatgcaaattccccgccatgcggagttccaccgcagctatctcaatgatgttttcgaccgaacagggggacggcggttactcccctgcatttttgatctagcacggtttcggccgaaaacacttcgcccttacccgtgaggggcttgttgtagcaggtggtaaacaccatcccccatgcccggccgaaaacatatgtcaagaaggaaaatgtgttcgagttatttattgactcgaatgaagtttccacccaaaaagtagttttaggtatgggaatatatatgtattcaccctaaaggatctgtcccaaggaaaaagcattcgagtaaagttacttgctcaaactaacatcactaattaatgaagctgtgtttcaggcaggttaaggtgacaaggagcctgaaaggtgggagaatgtgttcgagccttagcacgggtgatctcactcgagcatatgaagttgaggaaaagtgccattgagcaaatggtctaatttgggaaagtaccatggggaccacctcaaccactctcaccagctagcaccagatgtcatttagggaccaccagaatgtaccaaaatgcccctataggtcataaactttataggggtaaaatggtaacttcatgtaagcctgtaatgacaaacttgtaaatcttggacatgcggttgagcactatttaagccaaccaagatcctgtaagcacgggaggagatgaatatagaaaaagcacattcattcactttggtatttgtcttttgagctcactcttaggatagacgggaaattacattttcccttctatctcccaactttgtccatgcccttaggtcacgacaacaattatgctcaaagggggggaataataacttgccttgctccaacgcaaataaatccgagataagcaacctgattatccgatcctcgaaatatcacaggttgtcatccaaaatataatagattctactaaagaagaggaagaaccaaattcaataaaagccataaaataacaagagaacgataaacaactaggagggctagggtttagggtataatctatctcttctataggatatagggattatatttcatatgtaggttctaaagggttgtaggctaggttggatagaggattaagcaactattgttgcttacattttatgtatgggctttggttgtttggagatacagagtatattaggtaattgaactggctaagtaggcatatggctagtattagctggtgataggtttaggtagtatagtgtctggggtttggttatatttaagccgattgtggagtagggaagcatatcggctagggtttggttgtttactagtcgttgctagagttgggcagtataacgactaggtttggtattttctctagttggtgtcaacagatagcatatcggctagaggaataggaggttggtgcaggtttagcggggcggaagtgttactccgacaaccgtgggtggcggcggagtggctaggatcacacagagcccgagagctaactgtgcagcgtgcggtggaggtcaagggaatagtgaagctctgaccgctgtacgcatcaaggcgtggggtgccaagagcagcacttaaaccttgggtttggttctaccgggctttacaaccaatgatctgacatcgggacccgtagaccgcatgaacgtccccatggaagacgtaaagttccaaccggcggctttttagtagctaataggtattttgggataaagggaaatatttgaaaggtaaatatatgtttaaattggatattcaaataaaatattaaaatagtaaatttagtatcaaaatgtagattttgaatttagatgaatttggggaatggatttgcctcgtcgaggcaaagcttatggcgcgagggtttggccggcgtgtctctggtgaaggagatcgacggcggccggtggtggttgccatggtggggagagagagagaggaagagcttgaggctttgttgatgtgtggagaaaaggggagggctcgccttctatttataggcagcgagaggttggttcgtaaaggaggaggagaaggacgacatggcgacggcggcgtggagaagaggagcacggcggcggctctgtctccgattggacgatggagtcggttcggctagcggttgacgtcagcgaggtgaggtggcggctgacgtcggtggcagtagcggtggagaaggagcaacaaggccgcacagcgatggcgcgtcggctcggcgaaaaggcagcggcgtgtttgcatgcaccacgcgcgctcacaaaggagggagagaggcgcctgcctcttgggccctctgggccaagcgaaggggaaaaggaatgggctagattgaaattttttggcccacagtgaataaaaaatctttttgtattttcgaattagatttgaaggatgaaatttgaatccaaattaatatttggaagaaatttaggtggctaacttttgagatgaacttatttttagaaatagttttcaaaagagagatttcctaattatttgagtgcaataattttgagagatggaaactggtagtatgaatatttgaagaaatatttgtggctaatagggaattaatttggaagagaggaataaaataaaaatctattcttcttagcacaagagaaatcattctgatatttataatactgttattcttgaaccgaggaggaaattaagccacataaattaaattggcgactagataaaaaggaggaatttggataaggataggtttagaatcaaaggatgggtcaacaattaattcaaaattggaattggaggattttcttggaccataattcataaaagtagaaagggttttcaaactaaatttcaataaaagaattttagtcgaaagaaggtttaatgtaggattccatcaagaaatacctcaatttaaccaaatatatttctctactgcttaaaaaaaataagagatgctttcttcatcgtcgaaacaaaaataatagcgaaaaaaaataaaaaaagtccgactcccgtcaaaacaaaaacaatagcgaaaaataaaaaataaaaaagtccgactcctatatccattcccttttagaaacgaaaaaaagtccgactctggattggtgaaaaaaattgatgagccgaactgaaaatctgtttaaaaaatagaacctacaggtcgagatcatttcatttttatatgattttaatttttgggtttgtacttttgcatttgagtctctataatttttatatttacatttgagtccctataatcttgcaataaggtatttgaggtcgtttttgttaaaaaaataataaaagagagaaaataaaggcagaaaggtgcataaaaagaaaaagaaaagccgcacaaaaaagaaaataaagaaaaacaacgataacaaaagtttttttcccctaagtggccaaaaaaactgtagatccaaataaaaaaaaatctgattcatataaaaggcaaaaaaaagtggtgaaaaaaaaggctagaaccgattcctttaaaaacaggaaaaaaaagtctaattcctataaaggcgaaaaaaatccgaaaaaacatctaaaaaagttcgtccgattccctaagaaagtggcgaaaaaaatggttcttaaaaaataaaaaactggttcatataaaataaaaaatgcacgcgaaaaaaaatttggaaagggcggaaaaaatcctatttctaacaagtatatatctcttctctatctctaatctaatctaactattaaaaaaagagaaaatacacgagaaaaaaaggttaaaaaaacgcgtgaggcaaaagtcagaaaaagctcaaaaaaacacgctaaaaaggttttccatcttcaataaaaaaataaaaaaacacgcgagaaaaattatttccatcgtcggtaaaaaaattttaaaaaaacatgcgaggaaaaactgtcagaaaaaacatgccatttctaaaaaatggttttaaaaaaccacgcaagaaaaaataccgtctattaaaaaataaatcgctctaaaaaaactatcagaaaaaagctaaattgatggacacttgagtcggataggattcatcgattttttgccatctactacacggcttttattttgtcatatattctcctgtattagaaaaaagaaaaaaagaacattcgaaaaaaaacaagcaaaaaaacgtgcgagaaaacaggcaaaaaaacaaacgagaaaagaaaagcaaaaaaaggagaaaaatatggttttctttgtcagtaaaaaaagcaaaaaaaatgctaggaaaaaactgttagaaagaaatacgccatttctgaaaaatggtttgagaaaatctcgcaagaaaaaaacattgtttataaaaaacaagccgctcattaaaataaaacattgtcattgacatgattatgcatgaaaaacgtatattttcattagaatgtttttacccattgcaacgcacgggtatttttgctagttaaatgaaaaatacgaaagaaattaaataaaaggagaggttttatgcgacttagttttaggagttccctctaattataattataatgtccttggtttaggaggttattaagaatataagaatcaacatgatgcataattagaaaataattaattttcgggatgttatatatttataacatcaatatagttttattaaatatacaattgaataaatttttataataaatttatcttgagttaaaaatattactattttttttctataaaagtagtaaaatttaaaatagtttgactttgaccaaattcaaaacgtactgtaacctgaaacactgtaccaaaaaattcggttcaaatagcccccccc

SEQ ID NO: 73873 - DNA, 20974 bp, Oryza sativa
  unsure (1)..(20974): unsure at all n locations
cagctgtaaactacaaaacttgcagtctgatcaccctcaactggctatgatgtgcaaaccatcatccttgtccaaaataatcgttgtttcaatgatgcgaaacataccctagctcttctattcacatgcttcaactaatgacttcctagtcaattattcctcatcttatttcatcaaagttatcagatccttttttcatcctcaaaatcaatgtcttcctcatcttattcctccatttatgccttcagtgttaccattaggagatccaattctggcgctcccttcacctatccgatgctcatattgtcacactctcgaatgccaccaatctcaacctgcctcctttgcagccccttgtggccatcttgccatagttaccaatccacttctggttcttgatctagctacccctgattctgtttcctgtctcccctggtgtttcagcagcaatgacacttgtatgctggccatactaatctcatcattcgtagacatttaaaacttcagcattgataatttgaatccccttattagtggttgaagtattatagcatttccaaaacattaaatgaagtatttacttgcaggtggttaatatgactgttttgtaataggtgccattcaatgcttagcgttgatatgtgttaaaagtgaagttatacatcatttttatgtttcacaactgatactattgtagatggctaagtatgcataaaactataattccatatgattatcgaactgattttttccataaattgtggaaaattaaacaataggaatttctaattgttttcttttccgtcctttgctgtattttttcagttctgatatcactatttcaggaaatactagagcactttaaatcaaggatataaaataatcttctgcatcacccatatttgttggttgcattgcatatttggcgccatattggtatctaatgcatattaagtactggtatggtgagtttttagaggattctatgttgtctgctggcggttaggcaagctcctgggcaatgatggggtcctggacttggtcaatacagctcttgtctgaaacctaggcacaacagacttgtgcagtatttatgcataatatcttccgttagctaacatgtagctgtgtactaatttgacaggccaaagcaaatgatggagatggaccagaactactccgaagtgcatctgatggtgaaactagtacccatgctgactcattaacggcaacattggctgaacatcgtcagcacttagtcagtatacaggtaaaaccaactatggttggaagctaagcttgcaaaactagtgtccaaaatttttgtggtgtcgactcgtgtccgcttgtctgacgcggggagacacgcatctgaccctgctaggcgtgtccaaattccaaactaaaggaagggatttggtgggggaggggggggagcgagggagatggacaaatggtagtattttcttgctttgtggtggtttcttgggagcagcaaaaggagagagaagcatcaaggagagagagagctcagctgcacccctaccctttagcctagcacacagttggcctgttaggtagtactaaggacctgtttggtagagctctaagcctctaactcctaaatttaactatgggagttggatctggagtggagttgtggagcagcatatacccaactccacctttctagttcattttatgaatgcgctccacccagctccactcacattttagatggagctaaaactgtttggctgggctccagctccaagagaggtggaggtggaggtggagccgtgccaaacatgccctaaagtattaatgtgtgtctgtgaaagctctactcacgagagtagctggctaggattatctatgcataaaggatcctctgcttggctctgtgggtgtctccagagtctttatccctatttctgctttttattttatttattagtgtataatacatgtgagtccccgaatcctattttttagagtttaccgagtcggactcctgagtttgagtaggacactggctcctgtgtccgagtcccagtaacacagcaacacccttggggtttgaatcacgtggattttactgatgattacttttatctgtcaactgactgattctctaaccattttctagggcctaattaatcaactcaaggaagctatcccggcaatgcagcagtcaatagcagatctgtcagaggaagtaaatagcgtatctagtaatccaatggataaaatcatctccagattgtctccgtcagtgcaaaattcagggtttggaagagcagaagtaagaaaaagaaaaaaatattggattggttttttgttcgatgatgatataccatgttttgatcaatacagaaaatagtctcgttaaaaagaaaaatagtggggctatttggtttgtgaaatgtccatgctcgtttaatcagcttattgaggaatgtgtgtctgttttgatcagctgtccttgaatcattgggtccaagaggcatgcactttgtgtaatagggtgaattcatcctgcacaagctaataaactgtagcatgggtaagggtgtacagaaccagttgaacagggttggtaatctccataattcatgcatgagaagcagtccatgcatgcatacaagcccaataccaattattggcaaaatttgtttttatacacacctagctaattgtcatgttaatccaatccccattataatggacttcgcgtggcataggggtattcctcaaccaattggagtcttcttttctcttgtagttaccacaacagcttttggtgtaaagacattatatcaccatgttatggcgtgtcactttgagtctgtctatttattctcctgctttctaataactttttacaggaaagcagcagtgaactttcagagatgacttccaagctttcttctacacaccttgacaaggctgggagcagtcctgctctaaagctaccacctttatttagtctgactccaagttcttctggaaaaggaacacaggcacaaaaaaggaatgcgttaggacggcaacctagccaagaaatcctgtctgaagagaaaactcttccccttccctcaactaaagatgaaacaaatggctcaatacatggtattttctatattgtctaaaccatatgtttcttctgtaaattccttattgttccgttggttacaagctgaacttttgacaatgacattggctaatttttttttctatatctatttttgcagaaaatgagggttattttgctcataacatcagacgttctgttcgtgaagctgctctatcaaagccattaagaaacccagagaggccacatgaccagagtagtgatgatggttcagagcacttctttattcccctatcaacaggtgcttcaaagatggagattgatgccgtcgataataatagaagaatgcaaaaactgggtttttcatcaccacaaatgaagttcagtgatcttcacttcaatgttgacagcccaatgcatgcaactcctgttctgtcaagtaaacttaatgggcatgatgatcctaacactgtcacaagcatgcttgatccagtaagtggtctgggacatcagtcatttataactgatgatgctcttgatcaagtattctccccaccactgttgttggagacttctttatttcaggatgcatacgaggacttgcttggtaagtcttcccagactcattgtcacgcttaagtagttattaggtgtacgctcaaactattgtatgcatgcaagtctttaaggttttgtgttgtctgaattgattaggcctcagtaacagtctgatatttaaggatctgtcgggttgaaggaatgtgacgaatgattgaccactcaatctgacatgacttatttggtttgagaaacatgatagttggaggatccgtaataccttaagccctcaaatgcatagctcagtaggaaaaaaaagaggaattagatttatatcccaccaaaattatggaatgacccattatggatcaactttgacaacttattttactaataatatttaaaataaaaagtataatattgatgtaaaaaatgtgtagcaattctaatgatgtcaactattacgataaatcaaaatttatttatatataatagcagtagaaatttaaaaagttatgacgacattttttgaaagtcatattgttttagagagggcagtactttgaaggcaagtttggtgcatccctttctgttttgattcacaggtttgcagttacagcacccaaaaaaaaaatcaaacttacctgtatgttatctgttatgcagctccattatctgaaaccgatacagctttaatggaacactagagctcacatgtacattgtgtaatactttgaccactgccgtaagcttcagtgcttgatcacagcctggaggttcttatggtttggttctgactgctgctgggacatttttggtgaatttcttgctggttgtgttgcttgccagttgccaccagcttgtgagggatgtctgcgtcagaagaaggggtattattagggaaagttggggtatttggttttggggagaggaaaagagtgttttagcggtgatatagatgtctgtaatgttccagccgttgtgtgcacagtaagataagattcaaaatcgtgtgtatttagcgtacattgtatgtatttcttgtaataatttgcttcgcttaaaagtttttctgatgtgcgggttctgctgttctgcacttggtgaattgcaccggcgatttgcgggaaagcaatctttggagacatacatcgatgggggaaaatgtcgaaaagtcatgaactaatgctgaaaagcttggagtccacaggtgtgacatctggtgggattctgatggttcgatgaatgaagaattttgagaaattccgtgcatgaagtgcccaccgggcacctgccaccgcctctcatcggtaactttgcttatctagtccgaaccaaactggaacacttgtgttaactagtaatcgtgcacgtgcattgcacgtttcccacattagttatagtaatcatataaaaacacttcaaatttcttgcattttcctgtaatatatgtcaggcaaaatatacaacatactaaaaagtttaagaactatatgtactataatgtaacttaacatactcctttaaacaataaaaaaatgcaaagcagctaacaataccaaacatataatttgtcatagcttgataaacacttgaaaagctcaaagcaagatatttgtatttatggtattgaattaaaccccacagcctacaatatcttatcaggaaaaaagactcagatcttcaccaacaatacttcaaatatatccttcatggccagcaactaaaaatagcatttacatgatcaccaatgaggtgtatacagctcctgccgtgggtccacagaagttcatgtgatctgcaaaacacaaatttacatccatttcacttgtaagaaatggtcatcacatataattccaaaaagaatattgtctatagttgccttaattgaagtaaaaaagtagatagcaagtgtgaacattccagaaacactaacatttgtcaaaacgcctctatattttccttgaccacaatattaatctaaagtggtcatattgctaaactatgcacacacctgcagttgaagtggcagccacgaaaggatctaccaatcttaaaatctggagaccaatatctttcatggaattccctcaaggaaagggttccactattagactggaaaaagggaaacatatcaaatcatgaaaaaggcataatctgaaattggaatagcgtatatctttttaagatttaatttaatcctggagtccacacttttttcgtgaagctacaaataaataatatatccataatggtgatgaaaaggatttaaaacatggatagtagcactggattaaaaacatgaaaagcaccttacaatccaaaagcttgagaagacattagcatcaggcatcttcctaagaaaccaaatgctcttttagccacatcaaaattttcaagcaaactacgtatgtccaaataaaaagaaataacaaaccgtccaagcaagcatatgccgatggataaaatttatgaattacatcattagtaattagaagtcatcagcacaaagcaaatattcaaacttcccaaaaacaatgcaaattatcagaggagaaacatcaaattccatgcttataacttgtagaatatacactggattcaactgatgcactttttaaggaaatgaagccatagttccattgtcctgagctccaaaattgatcattggtatatacaaaggggatattcacttatatttaagtctgctagaataaaactctcttgacctatggagttatatgtgcatacatacaaactgaaagagacgcttacatttaagcttgaggacatttcaacctgataggctcatgtcaaaccaaccgttgaaacaattccgaaattaagtgattaccagctagagtgacagccaaaagcaagctcaacattgcaatggggaaattgcgattagggaaatcttgcccgtgattgcaatttcggaacaaaattttcaaaattttgcctccccccccaccggcaagcatatatctcacccgaaatttctccttttttcatgtttttgtgaatttggtcaaagtttattctaaatcattcaaaattcgtcaatttttcaaataaattcagtgattttggttctttcgccccctccccccacggaaaaaaccccaatttctagaatgcaaaccctgaatattgcagtaaaactacagtgaaatacttggtgcacaaatgtcattacgggtggcaccgcttcaggttttttttttcttttgcaaaaatttgagagcattacatcacctatggcaattgtagattgatgcatccttccgctgcttgtactcatggttctgttgaaccttagcttgctactgcttacaattgagcaaagcatacctcatccaagcttgctatcttctttaactcgagagcacttaaattagtggtattccctacggtgtttgccagtaaattagaattagttaactcaaacagtacatgatatatagtgaagaaatcacaagcttaaaagctgttacataccatcgatctgtataaattaatttcagagatatacaattagcaattaactggcagcggcataacagctttgcaaaagaagcgaacatgatgtgtattatttacttgtcactgcaagcaatggtgacgtaaagcttcctgcattaccgggccgagctgcaaaggtgagtcgtgataaactttattacattcagatcacaaatgttgattaaaatattttttttgagcattcaatcgatccagagtactacctgatgtagatcgaaccactatacatgaatatttgtcagaaccactatcaatgtttgtcgttgatgaaatcccactgatggatctgagcaaccaaaacatcacatcagcatttgcatgttcctagcaaggccgaggaaccaatcatgagtttgttctgcgtattgtattcatgcagaacatatgcgccaagcagaacctgaacccggacaggtcgccttcaatctcactcaaaatttgtaaagctagaaggaacaagaaaagggattgcgatgaacaagagttgtagccaatcgttgtacttacaggacagatcggtggaggaagaccttgggggtgcatgtagcgacgcaactgctcgcttgcggcggcaggaaagggaccacttgcgttccggtatttgcacgacgagcgcggccgcaacggcgaattgcctctcgctcgtggcggcaccaggggctccgacctcgccttcgtgtatcggtgtgcgactaaggatgaccgagctgcggtggagtgtacggtgaggcgctggagtggaggaaggctctcgccggcgcaagtggaggatgttggatcggttgagtgtattcaagcgctggcgggggcaggccgcggttggggaagacctcgacttcgtcgggggcagcggtggacttcggcggccaccacggatggggaagaactcggctccagcggcaactggggacgacgtcggctccggggaagaccacggctccggcggtggctggggatgacctaatctccggcgtgggcagcgggggtggcagcggaaggggacgacctcgttgccccgtcgcgaggaggagggaggatgcgcacggagcgaggagacggcggggattcgtgggtgtggaggagaagcgaggaggcgcggggattcgccgggcggcgaggaggagcgaggaggcagcggcgaggaggagcgaggaggcgggggcgattttgggggcgaagttgtcgcggcggggaggagcgagggggcggaggaggcggtggggatttgtgcggcgtagtcatcgcgtgatttctgaataggtggaatcgctcatcgctgcgcacagttaggaggatagcggacgtatgagattaaatcagatgacggatggacggtagagatttgattcgggtgatttccccagtaggattggagaggtacagctcctcttttttatattagtatatagatatagatatagaaattatactatgtataccaagaagggagggctagtagaatcaaggatgtagagcttttgtatttgtataggagtcttgacttagtctgcatcttagttgaaccattaatattgttacctgcacaatgttacgttggattggatttctcttaatttgattcactagcaaattgcatgtgccttgcacgggaaaaactaacttatgacagacattatataatttggattaactatttcttgtacacttaatacaattttttttgctgtgtcggtagtgaaggagcatcccgaccaattttgttagggtataaattgcatcttgggccgagtttagttaaaaactttttcttcaaacttctaatttttttatcacattaaaatttttctacacacacaaacttttaactttttcgtcacatcgttttaatttcgtcaaaactttcaattttaatgtgaactaaacacacaccctggaccatctttttttacctttgttccaagttagacttgggtaggacagttttcactagtctcgactagggaagtttgcataatatttcactttagaccagttcttctctatcctctgccattgcggtcctcaacgactttgcgcagctcctgacctgtcttcctggaactttgctcctccgccccagctccgttcattcccgagcttgaaagtccaaacgattatctccgtcagttcgcttgctccatgtcaccttcacccttgacatcccactcgtgcgacaagcacgagagagagaggatgaagaacttttgcctgagcaactcgaaatggccaacttctgctgctcttgcatcctctgcgtgggcggataccgaggcaaacgatctagttgacgcgcggcggcgtaaacctcggcgcactcgcggccaaagcttacatccaccatcttccgtgcgatctggtgcatgttcgcaactgaccctggcgaaagctcatcgatcaccacatcctagtctatcaccggcttggcaattgggatcggcttgccgccgtaggccgtagccttcctcatcaccaatcctgtggtcttgggctggttgcattgcttctacctaaaagtagtactctaggaggcaagcagaggagagaatgggccggcggcggctcgacgctcattggcgctcctgcagcccatggaagacgattaggagaaggaataagttcactttacatcccttaatttgttgccgagtttaaaattcatcccaaattgcaataccacatacgatgtgcccctcaacttcaaacaatacaaataaatttcaaggcggtttggatgacggttttggctgacatagcacctacgtgacaagtttgacttggtcctcctacgtggccgtgacgtgtcactaaaagcaaaaatataaaaattaattaattttcttagaactgtggggcccacatgaattcttttcttattctttctccacttagcttagtatttatttaatgagggaaacttagttctttcttctgtttgtcacctaccttttgaatcacttaacccctacatagactttgatatatacaagtaatatatagctattagcatagtactctcttatcatatcttccattgggattaaataaatacgatatattggaatactctcgagtgaaatgctacaatggtatatccgtgcgcttgcggattatatctgtgacactgatttcacgtagaaggcttgaaggagggagaggatgagagtgaagatctacttgtctctcgtgccaacctggtgatgagatccaagatccaagatactccctccatctatttttgatagtcatatttccaaatctgaaaaatttatttttgataggcatatttcaatccaacaatctatcctcttaatgactttattagatttaatgcgtgactctccattcttccacacatgattggctacataggcattgagaaatgtaaatattaatgaatcacttgcttacgagaaatgactagtagcatgtttaaatggatgataagtagaattatttatccttagtctgtgtgtcaagatgaaatatgactatcaaaaatagatggagggttccctgcaaaaaaaaaatggagggagtacatgttaaggactgagctaagagaaggtgaggaaggaagacctcatagacaatgcctctagggaggtcgtgccaccaatgcacaccaccatcgtccatctaaattctttacaactcctcatttcctatgttccaaacaaacgaaaaccatcacatatttttcttatgtctttcattactctattttgcatatacaatcatctcatagggattcctatattttcctataattttctccattcgtaaggggttataagggctcgaaaagcgcatttggaaatagctgattagctacacctgaaacatgggcgcatctgattaattcagtattaattattaaaaccatcaaattattttattttttcaaaacaactaattatataggatatgtttggggagtttttacggtccaagatcttcgtccatattctaagtagttctagaatctagaaaataaattctctagaatatcaaaagctgggtaccaaccagctcattctcagaatattaaactcccccaaatagaccaatagaaagtttgaaaaatgtgctaacagaaatcaatgaagtagtcaagctgaaacttttaggctgtgttcaagaggacgggttacgacacgtacaatgaagcactcattagcatataattaattaagtattaacttaaaaatggattaatattatttttaaaaataatttccctagagaacttttacaaaagacatatcacttagtagtttggaaagcgtacacgtggaaaatgagagagataagttgaaaaagtaaatagaagaacaggccataaaggtatacagacctacatgtagagtaaataaggccgtgtttagatctaaagtttttcttcaaactttcaatttttccatcacatcaaaacttttctacacacaaacttttaacttttctatcacatcggtccaattttaaccaaacttttaattctggtgtaaactaaacacattacatttagcctagctataccagattaccagtacatgaaaataaacttaaaaaatacgctctcaatgtccaactaataatacgtgtagacgaaaaaaagagccacattccctcgaaagaaagaaagagaaaaagagccacatgtaaaacactccggaggggagattaggtgagcagtccaagtgtctgcgcgtcctgtcccagttagtcaaaaaggaggaagcagtaccgctgctttcagttcctaccacacacacccccatcctcaccgatctctctaaacccaaatacgcaacaaatactcaatcgtcacatcttaaaaaacaaagaaaaaggaagagagagagagagggaaaacaaaaaagaaaagaaaaatcaattcccaaccttgctgctacaaatgcctcaggcttagcaactcgacctcctccccccttctccccttcctcccttctttgacttcccctttcctcctccgtgcgcacgctctcctgattcatacagcatttcgtcggggatgacgtcgacggcgtactcccggccgtcgaagctgccgggcggcggcaacggcagcgaccgcaggctgccgccgcggctgatgaggggcctcaccaccaagatcgagcccaagaagctcggcgtcggcctcctcgccggctgctgcctcgcgctcctcacctacgtctcccttgccaagctcttcgcaatctactcccctgtgttcggtgcgtgctcccctaatcccgatccgccctaggagcttacttttggttaaatcccctcccgcgttgtctctcgaatccaatccattttgatttagtctaatgggagctgttttgaatccgttttcagccagcacagccaacacatccgctctgatgcagaactcgccgccatcctcgccggagacgggacccattccgccccaagaaactgcagctggcgccggaaacaatgacagcactgtggaccccgtcgatctccctgaggacaagtcgctggtggaggcgcagcctcaagaacccggcttcccctcggcggaatctcaggagcctggcttgccggcggcgctctcgaggaaggaggatgatgcggagagggcggcggcggcggcggcctcggagataaagcaatgtaaggaaatcttgcctctttcttccgctcccttttatttgcgcacctttactggaaggcagagcaagctacagtagagcaagtccccagttgttgttgagcgcaagcaagcaatcaatctcgtttggatttggtagagacgcacgagatctgggcggtgttttattggggatttgatggtaattcagtctcgttggtttggttaattcagccgagaagaagaacggcgtggcggcgggtggtgataccaagataaagtgcgacgagaacggcgtggacgagggcttcccgtacgcgcggccgtcggtttgcgagctgtacggcgacgtccgcgtcagccccaagcagaagaccatttacgtcgtgaacccgtcgggcgccggcggcttcgacgagaacggcgagaagcggctccggccctacgcccgcaaggacgatttcctcctcccgggcgtggtggaggtgactatcaagtccgtgccctccgaggcggcggcccccaagtgcacgaagcagcacgccgtccccgccgtggtgttctccgtggccgggtacacggacaacttcttccacgacatgaccgatgccatgatcccgctattcctgacgacggcgcacctcaagggcgaggtccagatcctcatcaccaactacaagccgtggtgggtgcagaagtacacgccgctgctccgcaagctgtccaactacgacgtcatcaacttcgacgaggacgccggcgtgcactgcttcccgcaggggtacctcggtctgtaccgcgaccgcgacctcatcatctccccgcacccgacccgcaacccgcgcaactacaccatggtggactacaaccgcttcctccgcgacgctctggagctccggcgcgaccgcccgtcggtgctgggcgaggagcccgggatgcggccgcggatgctgatcatctcccgcgccggcacgcgcaagctgctgaacctcgaggaggtggccgcggccgcgacggagcttggtttcaacgtgacggtggcggaggccggtgctgacgtgcccgcgttcgcggcgctggtgaactcggcggacgtgctgctggccgtgcacggcgccgggctgacgaaccagatcttcctcccggcggaggccgtggtggtgcagatcgtgccgtgggggaacatggactggatggcgaccaacttttacgggcagccggcgagggacatgcagctccggtacgtggagtactacgtcggcgaggaggagacgagcctgaagcacaactactcgcgagatcacatggtgttcaaggaccccaaggcgctccacgcacagggatggcagacactcgccgcgactatcatgaagcaggacgtcgaggtcaacctcaccaggttccggccaatcctgctgcaggcgctcgacaggctgcagcagtaactcgtctatcccaataatcgcaggcagctcatggcacacatcaatgtatatgccgggacgagacgacacgacgaggaacaagaacggatactagtatattgtactgctgcttgaaagagatgatgatgatcttaaccggaggagaaccatcagttgttggcgaggcggtggaagcttttcgcatattggtaattggttgggttgtccattttgggtttgtaacaatttgcataggcattacacaccaaagatgttcgatttttttgttcttcttacacttcttcacttcgccagcccattcaacactatacattcttttctactaatacggagccaaactaaactatggtgtttaattattaaaacatcaaattggtcacccaaacaaaacaaagtggcgatgaaagaaagatccaaatctgagagttgtttcagacatgtgcaatctcctctaataaattgaacaaatggttgttaaacgaatctgcatcccgagcgttgaaggggcttagctggtgcggacgtgccagcatggaagtgttcgtggagaaggaaaatggattcgatgctctgtccaacactggtgaactgctgtatatgcacccgcctgctgcctgctttcagcttaaggaaaagatcactaataattgaaaagcacaggctaactaaccgggctctgcaagaaagctgtgacaggtaagtcgtaactagttttgggcaatcgaataccttctctcttttcttctcttttcttgagaggcagacagggagatatagagaaagaccttctccttttatctttattttttcttttttcctagaaccttcttgctgtcttttggtagggaaagagactagaaaatggaacgatgatgaatgcatgaatttcccataagaaattggcaagctagcctcaccttttcagtatcgtatgcatcacgcgaaaagattaatcacaagagggtgacccggcaacgagaagaggagatcagccaagacaatcttgtagccgttagtatgaaacacacgattaatcacaagccacgccatgctcttcatgccgtcacttggatggacgcatgcaaactaagtcccccttttatttatattaggaaaccataacaaatttagaggattttaattctacagaaaaaattcttacgaaaatacttgaaacaaaatattgattcatatactgaggaaagttaatatgagctccaacctttcaaaaaaaaaaatagtcattcattcttatcgattcatgtatttttctaccgtttattcgaacaataatttatgcatcttttttgtgttttgtacttatgtttctattaaaatcaagtgtattttttattctttgcttttttgggtcctgcaatagcccttatatgtaaaattgtttggagcacgtgtgtttgagtagtcatatttctcacgaacggagtggtagatcattatgctacattttttttcctccagaaacatatgtgcagatgctggcacatgtatcgggcataaatttatctggaatcaactcaggactcaaccagtatgtcagtgatgccgatttattggcggaattcgtagactttgtgtgcccttgatctggccactttgcgccagtcactacaaggtcaaccgtagctatcccataacctcttcccttagtttcctactctccataacataatcatgttcgtgtagacgtacactactgtttgtatcagatcgtgacgtttctggatgtgtgtgcgcgcgtgtgtacacaagtttctggatgtgtgtgcgcgcgtgtgtacacaaactagaaatacttacatttttttccttttcttcgccattacaaattcacaattagaatataagtattttagtttgtgcagtatagatcaaaggttaatataaaaaaacttcagcaccgctccaaaaataagggatggatggcgtgagaggaaggtgggataagattaggagaaatttcaagtggagaaaattgatgggacaactagtattatgaataatgttagaaatcttaagggtccctttgaattggaggaaaaacatagtaattttaggccccctttgattcagaattttagaggattttattcctataggaatttttcctacaaagccctttgaatcaaaggaatgaatcctatggaatcctatgaaatttctatggaatgcctcttcccatacaagttttagatgaattttaacaaggggtagtacctcatggaagaaatcctttgaggttcaatcaaacggtcattcctatgtttttcctgtattttgcaaatcctctgttttacatttacattcctgtcagaatcctatgtttttcctattcctccgttttttcattcctgtgattcaaaggggccctaggatttcaatcctataggaaaatttcctatgaagccctttgaaacaaaggattgaatcttatccaatcctttgaaattcctatagaatggacaattctatagagattttggaggaaatttagcaagagctttaatctcttggtaacttttctttaagtctatctctctcatccaattcctatgtttttcctgcggttcaatcaaacggtcattcctatgtttttcctgcgttttgcaattctctgttttacattcctatcaaaatcctatgttttttctattgttatgttttctcaatcttacgattcaaatgggcccttaatgtttaaaaattcaagattcaaatgctaaaacatctagtattttcaaagagaattctgtaaaagaaataggaaacgttgatggagtgtaggagaatgaagtaaaggcatgcccaacctttggcacgaagaatgctgtgtcattcttgcacaagggggaaacgaaaatcatgccactattgttggtccagagagaaagcatgcaagaaacgtctttgctttgaacatacgtgctgtctgcccaaggcatgccaagtactctggaatttatgaaatcctgcagctcacaaatcttttacgaaatacagctcgcaattttttttagtgaaatccagcaaacaatttacatggcccgaacaacaacggcattgtgttttgtttgaaatagaatggcaaaaattaggtgaaaatgttacaagaagacggttggtttacattggcatttctggaccaacggcaatttgttcgttactgcctcgttttcagagaaatctgatcagctctcgcctctcggcttcagagaagctcccttgctacaaaccaaaccaaaccccgtccagcccccccccnanccccccaaaagtttctgttcgaagtaggtacaacaaataaaaacaactatggtttccatgtcacagtcaggtcagtagcagtttggtaggcctaaaaattaatgcgcacatttgacactgctgctgcaacttggacctctatgtttcccgttcatttctccaagaaaagtcggataaaaaaaaatttcgtgacacgttttttaaactgcgaaaattttctatatgaaagttgctttaaaatatcatattaatctattttttaaatatgtaataattaaaactcaatcaatcaaacgttaatatcaacttgttttacgtaaaataacttaatcttcatattcatcttcatcttcagtcctagatttctattactgagtatactagtactactacaaaataaagcttgattaatcaagtactagtactccctctgtctcattttaagtgcagtcgtggatttccgtacccaacgtttgacccatccgttttatttaaaaaatttataaaataaattttaaaaaataagtcacatataaagtactatttattttttatcatctaataacaacaaaaatacactaactataaaaaattttaaataagactaacggttaaacgttaggtacagaaacatttaaagtgggatggagggagtaggtgtgcacaaggcttggtcgctgtcatgtacgttggccacgaacactgacgcaacaagaaattagatcaatttgttttgcttgtgcctcactccataaatgatggttatgaacaaaaaaaaaacaaaatttaaggggattataaacgtgtagtatcggaaacatggcccctttaggatttagccttgtcaagtggagatgaacgtagatagttactaattacgcctaaatttgataccaagattcgaaatatgaaaacattgtcaaaattttgaaggcattgggtttccttcacggggccagtataactgtcgcctatggactagtttgaccgatatgttgggcaggtctaaccagcggcatgtgaccgccgatcagaccgacatagtttgactccgagctgttttcgtcgggtcttgggcttgcttgctcaggaatgtatgcttcgggttttcattggtttctaccctgagttagatgtcgaggagaacctatagaaggcaagatcaaccccttaacaagggctaagcctggtttgattaaaaacccctcaacaatctctcaatcccgacacaatcaaatcgttcttttacctttattttttagccacattttccaatttaccctagttcagtccatctttatcgatttgcatcgtaaattgttcacctttgctgctagagtgcaattatccctttgtaattaagtttgccccgtaaacctttcattcgcccatgagacgggtggttatcttcaattcgatctaaatcagccttgtggctggttttgatacctaaatcggctctgctagcctgtttaatctttaaaatccaccctgaattccactcgaaactcaacgctgttgttggtttgatctttcggtgagttcagataactaagatttggaagaaacattaacgacctgactacaactgtacgagatgttgtgttgcgcctttgcgatcgatacacctctccatgggttgttgatcttgccggtgcagatcaaccttattcctgcaaacaaatcgaagaaacaagcaataacaagataaaagtaatctgaattgcagatagaaatgaatacacacggtaagttggtgtttcgaatacaagcacacgaacggtctagcagacacgcgcactgcaagaaagtagcaatggctaaactttcatctaaacaaaacccaagaaaccctaaaggggtacctagctatttttaacggtgggaggacaacctaggagtccctagggtcatgctccacctggttgaggcgcaccccacatggctcggggtcccaaacgaagttacatgcccattggtccaatataggtgaggcaacaccttgtttctgcatttgtgtccctctgggaaggaatttcgcactgaggttggatcaattggaaagaggactctgagagctttccatcaagtactcacgggctgaaaacgaagctcgtatactgatttggcggccgtttgagcaatgtcgcagttggccgaatcagattccagcagttggtcaacttgatcttgatgtgagcgacggttgtatcaatagtagtcatggtcacatcatactccccttcttcacggaaaaccctcctctgtttttccatgtggtgctcttcacatagtcgattcaaaacaacctgtttcatccaatcaaaactagagaaactcgaagtagtgcgattaacaataacatgtttctctaaatccgaatagatgaaaactctaagcaccaaatatatttctctatcattatattcgtcaaaggtatgaaaaatagcattagttggacatgctaatcagacttagcaaataatttctccttcaaattatcgagctcacaaaaatcatcaaactgaacatagcgcaaagtatttaaagaagatagcaattcatgtgaataacatgtgaataacatgcttaaaatcagcgcagtaagatataacagtagaaatagcatgtccattcactagttgcggcatagatataagtgaagcattatcacacaactcttgtttatcacaataaacaacaagtaattcaacttgtgacaaaggcatctcagcaattggttaatggttgctctattatagcattaaaagtgaacatgtgtagcttagctcgagaatacccaccttcatttatttcagcaccatttaatttaccttacaaactttcttcagacatcacaggtgcttcaagcttctcatccgtcttctcaggaacatcattcttcttcttttgttgaatgatcggaactccctgcaaaacgttagtaacaggagacacaaaagtttgctcctcccatgtttgcatgtcatcattgcacaaggatatatgagattcagaaacatgaaataaatcacattgttcatgctttttcgcatttgatatgatctgactctcaatgctgcgagaaagcatgaataggtgtccgatatgattatatgtcacattagtaagcatgagctgaattttagaattaagccccatgaaaaatctgcacattgtgttttcattgcactcttttagatcactgtagatgatacaaactttaaatttatggatatactccctaacagttctatcaccctgtttcagatgttctaatttctcacaaagagtacttttctaataagaactcacaaaacgctttctcatcatgtttttgcattcatcccaagtttcaggtttgttactacttcctccgtttcataatataagtcattctagcattttccacatccatatgga

SEQ ID NO: 73874 - DNA, 6032 bp, Oryza sativa
aatcatgtcgtccaccggtcgatcgcatccatacacctcggtaactaggattcaatgaaacatatactccgatttttgattaagatatgtctcatcaaatttcaggtaattactccctcccaaaatataagtgtgtccagattcgtagcactaggaagtgtttcatccgtctaaaatcacttattttttaaggagggggtaagtatattttagataaagaaagtactctagtagtagttaattacgtgtacatgctattgtgtttgcttaccccccctattgtggttatctaaattacccccttaaactctaataccagacatttgataatctgaacttgtaaatccggacgaatcaccccctttacttaatccggaacggttttcagccaatatgacagcaggttctcaaacagcagcatatccatggattatggatagattgtggttcttgttaaaaaaacaaaaagctcttcaaatgttcagttacgctcattgagctgactgaaccaccatgcagttgtatgaaggtgtagattggcagatcaggacttcaggatgaacaagtatcttcctagtagttcttaaaacagttcagcaggggacagttgctttgccatttagagcacccatctgaaaacagaacggtgttcccacagcaccactgcaccagctcgtccaatgatccagtccatgtagcaacagaaaaattgttacaacttctaagtatccatgataggcataaaaccttaaagcttcagcttccctttatgccgcctgtgaagcttctgcttcttctaggcgcagcttctggtaatcgttagcatgcattatgtcctcatgattgattgcactctgagaaaagtagaaaaaaggtattcttttcagaaacaaaaattgacccaaattattcgtgttagagatcataatttattttcttacatgaatgccctgagcacaaaaaagactcttcaaaatgttggatacttcatccatgcctagaagagctcagctcagtctcagaggttgtcggcgcagccaaagctgcacatggctgatcttattgcttcatttggaatcccgatattgacatcttcagacaattggctgaaaatatttgatgtttcagttcaatcattattgtcatcgtcttgcagttcgaacaaatccttcacatctttggctttaaaaaaaatttcacctctgctaaatttttaagtttagtgagtagttgtgtcaactacccattttgttgtaccagaaccgacccaagcggctgtgggatgccaccactaggtttctagaactctttctcggccaatagtctgcgtatgcttttttgttgaatgcttcttgtgttgtatgcctttttgtttttgtttgataatgcttgtgcgagctacaatatggttatgaaatacattagatctattcacggggactactttctcatttgttttcctgtaaaatgctaattttgtagagaattactgttgaaaataaaactacatataagccaaaattcagtgaataaatgacaaagcattactatgctagcctagcagtaagggaatatcaaaacagcaatgtatctcctctccaaccctatcttaatgtttaagataattggctgaaaatattggatgtttcagtcaaacatttactgaaattattggatgatcagtctatatactatcacatctcctctcccatcatataataatgttttaagacattaagcttgtctctgcttaagacacggttttctgattattgtgtgcatggagtatgttgtatggaggagtgttacggagtaatcgaactattttgcaattggttgaattatcccatgagtagcaatgtcaacagggaaaaaaaatctaatctacaaatttcaaaaaagcaaagcgctaatgtctagcgctgcctccaaccgagagacccgactgtgtgcctctagggcatctttacttcttttttttttatggatgcagctgaccggcagggggtcgcctgccgtgcccccgtaagtagggggatcttttcactgctcctctttttttttttttgcagctggccggcagggggtcccctgccgtgccccgtataggggatctttacactgctcttttttttttgcggctgaacggtaggcgggtacacggccctaccgctgcccattgcagtcggggtgggtgcctctagggtggcgatggaatagaatcaaatcgagctaataaacaggtcgtgttgtctcagaatcggcgatatggtacaaaactaattgccggatggattcagtccgagccaaagaacagcgcgcatatcgacctaggagtagaggcagaagcatacctggtctccacggaagccggcggcgaagggcgccgtcgatctaagccggtgctgaatcttcgcgccgccgatgccggcatgccgcggagagtacatcggagatccagatcctcctggagttttgacggcgcgtccgcagccagctgctcgctgccggagccagaattggggaatcggcggcgtcgggggaggagaggaagcaacaaggtgaggggggagatcgagggttcccatcgactcaagtgtcgatgcaagccctatacgggctaggcttctctcttcaggcctgggcatcgagcccaagctgctgcaggcccagtccacgcctgtttttcttttctttttctttttttctaaaggatttttgtttgtgctcaaattggtaatgcggttgtttggttttatagcggttacaagttgaaataagtaagccaaggatattgatttgttcacgcagccatgtatcctgcccaaaagtttggcagaggacaacagagtttgccatttatagagtacccgtttgaagactttggcccttccctgtttgaagtttctggtggctaagaagggtctatttagattggtatcattttaaaccataccattatttaataaaataaacaaatatatagttgcatttagttagttatcaaatattagtaatgcataggaaattttggcacaacatatttattctcttctactaaaatttggcaatactgtcaacttgctaaaaatttggcaataaggtttattttggcagtaatctgaacatgcctctgcatcaggctattgagtgttgacttcaacctaagtttccaactcactttctcgttttctatgcacaaatttcccaaattgctaaacgtcttttttttgcaaaaaaaaatatagggaaattgtttaaaaaaatcatattaatccattttttgagtttctgatagctaatactccctcaccaaattgatcatcatataatggaatccaaaacttctcaaattgaacatcatataaccgcattaacatggatttcatcggaatacaattaatacaatatgggagaagtgtgtgcacgctacggtgtaattgacatgatgttttaatcgatacatgtattgtgggaggatgtgtgcatggtgtcttgattaatgtgattttcttggtcttagtgtataaatatatatgatgatcattttgagataaagagagtggttaactaatcaagcattagttcattgttctgttttgcgtgtgtaggagagtggttctaacttctccaagagaacccatcaagttcaagaacacagaggatggtaggtgcctcacagcagcacaaggtcttgcggtccatgtagcaacagaaaaactaccatgatttctgagcatccgtgattggcgccaagcttctgcttctagctgcagcttatgttcatcgtagcattcactatggcaacatgattgatcacaccgagataatcagaaaaaagaaaaggacatcattttgagcaataaaaaccgaggcaaattatttgccttagagatcatatattgttttgattccatgaattgcctgaccatcaaaaaggatcgtcaaaatgttggatccttcgtctatgaatggatgagctcggttcatattgaaccccggcattcgcatgttcagacaattggttgagaatattcgatgttttagttcaatcattatttccatcttcttgcagcgttaagaaatccttttacgtttctggcttaaaaatagggtctttcagtactatgtttctcctctatcggtacacctctaatttccctagttttccatgcgcattccctagcctactcaacagatgatttaatctggtatcgttattagatactacaaatgaaaatttgcagagaaaattactgctcactttatattttaatgtatgatgccgttaattttttaaccaacgtttgaccattcgttttattcaaaatttttgtgcaaatataaaattatttatgccatacttaaagaatatttcatgataaatcaagtcacaataaaataaattataataacataaattttttgaataagaaaaatagtcaaatatttataaaaagttaacggtgtcatacactaaaatacggaggggtactttacatttgggtatgatccaaaccattcatctgccagatcatctgtcactagcatccaatcgaaactcggcaaggtggttagaaaatttggcatcttcacagcgaaattgctggcagaaggttagcaacacagcaatgtatctgctcttacagtcttagagcaaggataataatagtagctataaacaaactatatgcttatgtgaaagagacaggtaaagagaagtagagagtgttggctctcatgcacgagttagctcaacacaagctgcaagaaatatgcattaaattcatagtgagagaacgagagaggatgacaaagataaaactaaccttgtagctaacataacatattatacatgttagctataatattgacttatgataagtagtgagctttattgcttttatatcatgtgcacgagtatcagagtatgttgaatgtgagtatcatggagtgcttgaactagttatccaaaggaaatttggaattggtagattaataaccaatgagttcaacaacaaaaaattcatcaacatatttttatccaaaggaaatttgaaccggtggattaggattagccaacgagtttaagaagaaaataactccatcttacaaatttggaattggtggagtaaccagttagatggtgtttgaatctcctaaagataaagattaagtttattttgcaaaacaaagtagtattaacgtatgattgattgagttgtaattattacaaacttgaaaaatagattaatatgatattttagagcaattttcatatagaaagtttttgcacgaaacgcaccgtttagcagtttgaaaagtgtgccacgaaaatcttaatcttcatctaactcttattgaataaaaagaacgggaccttaatgcaaccggaaaaaaaaaagaatttcatctcacaatttttttaaaagccaagcgctatgtacacccctagcgccctctgtagaaatatttttttttctttcgttgtattccatttcgttcatgccaccgattatttaggattttaggggagagagaacctgaagctgcatacgatagtttagatcagtaatcttttcaactaactcatggacagattacatctctgcaaacatgtttcttgttatttctaatcccagctctctccagatatatttaacatacttacatttgaaaaagaggtgtccctgatcctcatcaagcctcctgcaaacatggcatctagtatcaatatgcatcccacgccgcttcagatttgaggattacagaaaatgtccggatcaaattgtgtcccttaggtgtgtgactggtctcgtaattcctcttattagtaaccatggatcatcattgcaaatattgatgctttagccattcccaactctccaaataatgccctctttcagcagctcaacaccttttacaatacttcgctatgtgtatgacatattcccgatcagatgggcagataggatatcagcagtagggaaataccttgctttaaggatcctagcacacagagcctggatctt

SEQ ID NO: 73875 - DNA, 26572 bp, Oryza sativa
ttccctcgtcgcaatacttttttagttttcgagctcgaattggggtaaaggcttttgagcttttttttatgtcatgttttcgagttaaggcaaaaccttgttcgaaaaccgccgtcccccttacgtttcaaagaagtgacgaggtcgaacatgtttccctcatcgcaactactttttagttttcgagctcgaatttgggtaaatgctttcgagcttctttttatgtcgtgttttcgagctaaggcaaaaccttgttcgaaaaccgccgtcccccttacgtttcaaaggagtgacgaggtcgaacgtgtttccctcatcgcaattactttttagttttcgagctcgaatttgggtaaatgctttcgagcttttttttatgtcgtgttttcgagctaaggcaaaaccttggtcgaaaaccgccgtcccccttacgtttcaaaggagtgacgaggtcgaacgtgtttccctcgtcgcaattactatttagttttcgagctcgaatttgggtaaatactttcgagcttttttttatgtcgtgttttcgagctaaggcaaaaccttgttcgaaaaacgccgtcccccttacgtttcaaaggagtgacgaggtcgaacgtgtttccctcgtcacaattactttttagttttcgagctcgaatttgggtaaatgctttcgagcttccttttatgtcgtgttttgtcacgcccggaaattcactaataatttccaaactaatttgtgcataaaatcctcgtccagaaatcagccgaggtacacaaactgacaatttaatatacaaatccatcataataataacgttacatacttacaaaagaaaagaaaaacagcagcggaattaacggtctagcgatggcttcagctccactcccacaggcaactcaactggggtataagccaaacgtcttctccttctggatcccttttcttcaactgaggttgattgattattgcaagaatgagcatatgatatactcaacaagccacacagcaaatatgcaagtgcacaaggataccaaaggatggcataatatagtctcatttgcgaaagcagcatttagcaaagagttaagagtagtaaaacagtagagtaattaatcagaaattttaatcaacactgaacaacacacccatgctgcacaggcccaaccatcctgaacaaccatacccggctgtacagatctaactccaaaccaggagctaaacaaattattaccagttatagcatcaataattattgtgagaggcgtgagactaatcacgaaaaacattgctcaactcgcccataaccgcgggcacgactattcgaatagttttactctagccagaggtgtaccactgtacctacaagacacagcctcaacatcatgtctaccatgcgtcgcgatactggaaagtacccgaatagaggctgtgacaataccctctgcacaacacaactcaccacagtacaccattcctggatcataatcaccccttataaaacaaggcatggactccccagcgacccccgtgggcttatctccgccacttctcagtctggtgctccacaatgaaccatgctatacaaaaggtaaagccgttgcccacgctggcttgtggttggcacggttaatgtttcacaacagtagctcgcgaaccggtccttaattgccatgagcacgaccttcaaaaccatgtgctcacaacccaccattaatcatattttaattaccaattaattatcataacacgattaaccatcgtgagctaccattaaatataaccataaataataatgtagtatatatgattcatcccattagtgagctaatgtttctaagcatggctaagcaattatatatataacatttagctgaaccaaaccaatacataaggttcaagctaatcaatttattacccaaggtatcaaggaatagggcattcaatgcagattggccataacaaaggaataggttcacaccacccagtgacattcgaaaataaatgcacagttaaaataaatagagaatttaaatataggatcaacatgctcaaatgattgtgtttaggatctgtgtgacttgccttgcaataatcggtctcaattaatcttctgaacactcccgacgcactcacgaaccttcgcaatgacggaaacgacaagctaacacgcaaaacgaggaaaaagactaataaaaaccaaataaacagtacaaagatcatgattttagatgaatttagcaacttgaaccactcaaaaccgagttacgatgatttagttatgaatttccgaagatttaatctattaaaaaaaactgaaaaagaggagatgatgacgtcatgacgtcatcgacggcagccacggcacgggtggcgacctcgccggagctagggtggtcggccggacttttggaggacacatacgcgtagaggacaacattgcgaactcaatggtgctcaccgatacgacaaacgacgacggacgacggccggcggagaggaagagcggcggcgacgacttcggtcggcggtggcgccggagctgcggtggtcggcggcttcgggggtcaggcggccgggcttctccaccctcccgcgcacctaacggtggtgacggcgaccggcggcgacgacggaggcggcggcgcgacgcggatggaactcggccggcgacgatggcggggtggagcacgtggcggcggcgctacgaggcacgggagatcacgggagagggggcaaacgaaagaggaggactagggggtcctatttatagccttgggttgaatagatcggactcctcccgcaagaaatcgctccgggaaatcaaaaactcggttttggagataaactcaaaacgagttcgattcggataaaatactcaacgatttgctccgatttttgggggtaaggatagaggaagatgagaggataaaaacccctcaaaaaaaaacggaagaaaaggggagagattggggcggattcggcgcggcaaggcggctcggcatggcagccgactcggctcggctggcggctggagcttgaagacgcactgtagcgacagggaggaaaagtagacttcttgccgggcttttcttttctcagcctgattagaagagggagtaaaaccggactttggctgagagaagaagagaggatgcaggctcgggttgggccggcggaagagagaggaaggaaaggaatgggccgattcagcctaagacaagggagaggagaattttattacttttccaattaaaataatcacttaaatgatctttgaattgttaaaaatacttccaatgctcaaataatttcaagaaaaatcctgaaaatacttggacactcaaagtaaataaaaaattataattagaccatttaattattaattaaatatgtgggtaattactgaaatgttctttgtatgattaaaattaggaattgagctccgaaaaaatccgagataattccaaagagtataattaaccatgaagaatttaataaaaattaaatccatccatcctttatatttaggaaattttatttcccacatttaacttcacttgaaaattaatgaacatttaatataaattctaataataatttattaaatactttaaaaatcctaaaacgaaattcaggatgtgacatgttttcgagctaaggcaaaaccttgttcgaaaaccgccgtcccccttacgtttcaaaggagtgacgaggtcgaaagtgtttccctcgtcgcaattactttttagttttcgagctcgaatttgggtaaatgctttcgagcttttttttatgtcctgttttcgagctaaggcaaaaaattgctcgaaaaccaccgtcccccttacttttcaaaggagtgacgagctcggtaccccgaacgtgtttccctcgttgcaattactttttagttttcgagctcgaatttgggtaaatgctttcgagcttttttttatgtcatgttttcgagctaaggcaaaaccttgttcgaaaaccgccgtcccccttacgtttcaatggagtgacgaggtcgaacgtgtttccctcgtcgcaattactttttagttttcgagctcgaatttgggtaaatgctttcgagcttttttttatgtcgtgttttcgagctaaggcaaaaccttgttcgaaaaccgccgtcccccttacgtttcaaaggagtgacgaggtcgaacgtgtttcctcgtcgcaattaatttttagttttcgagctcgaatttgggtaaatgctttcgagctttttttttatgtcgatcaacataagcactgccaagtacctgtgaagaacgaacgagtacgacagcaattctcggatgggtgtagacctagccaattaagttatctagcaaaggtggtacctctctctatagtggttctatatttaagtccttgcacaggaggcaaacttatgccgagtagggcaatggtgatatttactgaggtacaagtaaatatttgatataaactgtgatatcacgaattatttgtaaaccctgattgcgatgacatggtgtcatacaatcagtcctctctaaagaccccgggaatgccagaactcctctcgctgctgataacatacgttcagagtgcatggggactagagttcatggaacaggtaccactgatgttagaaaccgaaaagctgggccgtgactaagctaatgaatattggcatgtcatggattgcgggtaaagcatatatctactgtagtatgaatattcttgaaactattcgaatacctatgctcacggatattgagcatagggactaactatggcatcttggttagaaacataattcaagattttattaaatactgttgcattccaaatattacaggctttctacttctataatctcaactttctgcaagtaaacctagccctactcaattacttctatttcatgaattcatatttgatataatagcttgctgagtacattgtactcacctttactttaaccccctctttcagaatcaatttagagtttttgccgaagccgggagttcaatcatataatcatataagttagtctcattccaacttagctcccaagtctagcataggtagatggtttaattctatagcaaaacattagggttgggtcatcctatagcttctgctatgttagttagccacaagcttgtaaataccctattatttatgtaaagaagtcaccttcggagccttattcaaatgtatgcaatgaagatccagattgttgaacctgtaccaatctactgatcttgggcttgatacagtctaaacatgtcagtttccgaattattagttttgggacccgacaaaatattattacttttttctacagaattagtcaaacatagagtattttgactttgaccaaagtcaaaatgtcttataacctaaaatggagggagtaattattatttaatgaattaaataaatggtaaatcatagtactatattggatttagagaaataataaggacgcagactgaatcagcgtttgtgggtatcaacgtccacaaggggacgttgttcttgcccacgtccatggtatctggtgcaacctgttatgaaacctatcttattgtggacgaattaaattatgagtgggaagcttactacagaagaaagctaacaccagaagctagcttacagaagaagctagcttacggcgcaagccagcttacagaggaagccagcttacaggagaagctagcttacggcgtaagctggcttacgacacaagccagaaggttcaaggcttacgatgcaagcctctaccctcctccgcctataaatagggcccagaaggtccaaggcaaggacaaccgatcttcggtctcctgcttctcctcttgtagcttgtactcaaatccagaagaaataaagcttccactcgcttatattttctgtgttccacagctctgtgtttatctgcttgtgtgctgatcagtagaataaactggtttctcaacacgttatcagcacgagactctatcgagctaaaaaggtaaaccagtgagaaatcagtttctactgatcatcttgctcttgatatgcaaattatccttctgctatagttgaaataagcagaagaacatggtacctgaagtaccatcctccgatatcctctcagcaatacacgataacatgatggctgctctgccgccattatcgttcaattgctaaagttgatacatcctctcagcaacacccagtaacatgatggcggctctgccaccattaccgtccaaaggcttgagatggtacatccccttagcactattcgataacacgatggtggctctgctgccgttatcgcccaaatgctagaggtgatgtaggtgcctgaagcaccggcatggcaacttaatggacggctctgccgccgttgccaccaaatatcggaggcaaacgaaccttctgcacgaccctgaagtgtcgttatggatgtcctttgttttatggatatcacccatatgggcccttgacgcctctaaggtcagctctgccaccatgaagcgtgggcacaatatgcatgaagtgcccatgaatgctcttcattttgttttacatgcttactttgttgtttgcatgactttcataacatttattttattgttatgaaattgatttcctagcatgattgataatatttaatcaagcaatctgtaatcctgaagattacttaagttaatttgctaggaaagattctatgggaaattgtgtgataatcttgaagattacacacactagtaatcctgaagattacgcatgaccaattcatgttgaccctgcacatcgtatttacctgtcgtaaataccaaatgatgttgcaggacatgtcggacatagcaaagaaggaattcgccgagcttgccttggatggtagtaactacctcacttgggcattggacgttgagattaaactcgactccatgggtctcgatcatactattgtgctgcccgaagttggcactgtggagtctacgaaggccgagaaagcaaaggcattgcatttcttgcgccaccatctttacctagacctgaagtctgagtatatgatcgagaaagatccactggtattatggcaatccctgaaggatcgctttgaccagcaagggtcaattgtgctcccacaggcacaacatgactggatcaccctacgcttccaagactacaagtctgtggcggcgtataactctgcccaccataggatcatttctcagttgcatttatgtggcctgaagatcactgacgctgagatgatcgagaaaaccttatctacctttcatcccaacaacatagtgctgcaacagcaatacaggaactcaaagtacccgaagtactctgatcttatctcagtcctgttagttgcagaaaggcagaatgaggttcttctaaagaatcattctgctcgacccactaggtctatggtagtgcctgaagcacaagccaatgttgttggaaactcacatggccgtaaaagaggccatggtgagaagaaagggaaaggtaagggaagtatcatattcaagggcaagagtaagggtaacccagaggtaaaggcgaactcaagaaggttacaggtgaatcatctggggtaatgcaggataactgctatagatgtggaggcagagggcattggtcccgtaactgccatgtccccaagcacctggttgagctgtaccaacaaagcatgaatgagaaaaagagccaacatgagtcccacttcaccattgagcctgaagctcagattgaaaagcatgatgacatgcttatcaatgttaaggatggtggggacatccgtatggacgatgattgagacaaccttcttgaaaaagatgatgacatatttggagacctgaagtaatctcctatatgtcagtcatatgcagtgttcggcatgagtagcacatgtagaactttggtcatgaataatgctcctgaagagcacgcttagtcttttactgggcctgaagtccttgtaatgtttcccttaatagaataaacttactccatgtttaatcccttctttctatataattaagacccaaagctgatttgtggttaagccacgtcacctgtaaaatctcagccattcaatctaatctgcgatctaatctgggcgctcggtcttctcctttctcagccgccgccagatgcgcgctctttctccgcccagcatgcgcccacgcaagttgcactgtgggcccgccgtagatgcggattcccctcgcccaccgcgctcgcttctcttccacccccgtgcgtgtgcgcgagatgcggtgtggtcgattcccctcccccagcggctgcttcccccagcacgtgcaggcccaccagccggcttgctcgcttctcctccccgtgtcgcattgcctccgccgtcccccacgcgccagccacaccgcagcgttgcgcccctgtagccctagcctggcacggctgcaggtatcgcgcgtttgaagagccctagcaccatgccagcttcaaacgccccctccctcatcctcttcagcattagagacggtattcacttcctcccttaatcacccgcatttacaataaaaaccgccaaattaattgggtgaggaggcgtagtggttaatacaagttatgtgctctactccctgcaacaattttactcaagatcgtcgtatcgcctactcatggccctgtataaaacggccggcctctccagttctacatccgtcatggtctctctttgaattcctctcctctcatattcacaacaggcaagttaaatctggctctcagaaccataaacagatattcggatcatgcgagtgtgagaatgtcttgctgtttattctttgcagttgcatatgttgaggctgctatgataattttcttcttcttgatgcagcgttcacattgggaatttgggttaccgtaccatatcctgcacattgcttcttcttcagtatcaaggttggtccactcccactgtgtttcttccgttacttctgcatcacctttttgcttacatacatatatattatattgctgaaaatagttaacccccaatttttattgatccaataatggttaatggtttatggatatgtatttgggctatgtgcgaagggaatgaattcaggtacgtatctgatagtttcagagatttgatggttacgacttaggagcatggtgaaatctgaatcactatttttttttctaaacaagctgctctaggtttgttgacccccctgttcacaagtttgggttgcttagtgcagattgcaattgctgtcaggcaatgctaatttcagcttgaagttttgtttataactaatggccaagtaaagttgttggttgctgaattttcacactaatctttaagttttacatggttagataacatatacatgctcatctctttgttttgaatcatattgagtcaaataaatcttatgtttttggtgcttcctgtgtcatgagtgcaagtcactgaaacagctctgagaaattaaagtttatggtggaataaacatgataaaggtgagcctttttctaaaatcatattagcatttcatgaacgattcgacaaaaccaatttctaggggtctaagatgtgtccggaattggtccttcaaaattgtttgtacttttctgtgggcatgattttataagacttagagttgtttggtctgatcgaattccttggcacatttcagtagctaagtgtaatttgttattacgtgctttactctaattgtgtcctaacaaaaaaacatgtaagagcatgaatggctaattgtttttcagttgaaggtgatgtatccatcaaagaacaaaacgtccttcggtgaccaactaaatgttaaaaatatgctggccctatctctcggaggtgcctcatagagttagagtgtgcatatgtgcctttatagggataagtgtgtgtgtatatgagtttgtatctttttgttgttgtccaattttttttcttgatcctttgacaacaagatacatgttttagggactgttaggtttcactgaattaaaagatcggaatttcacttaccccaaatcaaacactgaatttgaggaggcgtgcagtagactccaacctaacctgaagcaggagagaggaatagtaagcaataagcgagtgaacaaaatatgcacaagggtttaacatttccctttattaagcagagaagatatttaattgttgtactagattacgagtgtgtacgtactgttgaaacatttggtagcgagtatttaagtttgctatatcgattctctctttttctctctacctatggaattagtttattttacatgtagcatattatcttctcttaaaacatcatccatacgaatttcatccaaattatttttacaaaatcccgcagcaacgcgcggggtattcatctagtttcatttatgtttatgttccataaacatacttgggtgggtatcccatggcagaagaggatatatgtctactagacagtgccaccactaatacaatcttaagggaaactagatatttccacaccttaactaagaaaactggaaatattatgaccattgccggaagcaatgctcatatagtaggcaccggaagtgctactctagttctccctatgggtacccatatctttgtaaaggatgctctattgtatcctgattcaaagcgtaccctcttaagctttaaagatatccgtgcaaacggtttccatatagaaaccgagattgagcaagatgttgaatatcttctcataaccaaaatagatggatatcaaaagcaagtggtggaaaggctcccttcatcgccattgggtttgtactacacgtacataaaacccactgaggaatatgttgcgatgaaaaccatatttagaagcccagagtcatttagagtttggcatgacagactgggtcatcctgggttgggtatgatgaggagaatcatcaataattctactggccacaatgttgaaaccaaagacttccctaatcctgaagattttatttgccctgcttgtgcaaaagggaagttgatcattaggccatccctcctgaagattagggatgtgtcacctgttttcctggaaaggatacagggtgacatatgtggacctatccagcccctgtcaggcccgtttaggtatttcatggtactgattgatgcttttaccaggtggagccatgtggacctgttgtccataaggaaccatgctttttcaaagctaattgcccaaatcatcaggctaaaagctagcttccctgatagccgcgtacaatccattcaaatggataatgctggtgagttcaggtcgaaggcttttgatgattattgtttagccatgggcattaaggtagaatattcagtaccacatatccacactcaaaatagcctagctgagtccttgatcaagaggatcaagttgattgcacggccactgttgcaggattgtaggctgccaaccaattgttggggccatgctgtgttgcatgcagcaacactaattcaactcaggccaactacatatcatagtacatccccccttcagctagtgcgtggaaaagaaccaagtatttcccatctgcgtaaattcggctgtgcagtatatgtgccgatcccaccaccacagcgtacttctatgggaccccaccggaagttggggatatacgttggttatgagactttgtccataatcaagtatcttgagcctatgactggggatcttcataaggctcggtacgctgattgtatctttgatgaggaccatttcccagcattagggggagaaaggcatccagaagaatgccaagatataatatggaatgcaactgcgatacagtccttagatccacgcactagtgaagctgaactggaagttcagagaatcataaatttgcaaaatcttgcaaataagttgccagatgccttcactgattacaagggagtgacaaggtcgctatacctgcagtaaatgctccaaaaagagtagaggtaacccataaggttactgactatgctcttacctcccatcctaggaagagggggagacctctgggtgctcgggacaaggttccgcggagacgtccgcggagacaaggatctgagccacttgttccactcaaagaatcagttgaagaagctcaacctgaagttgagaaagccccataagtggcaactcaacctgaaggacactatcctgaagatggaggacccagtgccttacgcgtgcaccttggcactggaagatcggaacaccccaactcggtcgttatgggaaatcacgacaagttggaggaaataaatgaggagatttccactaactatgctgatacaggagagttacatcatagaaagaccactattgtcgacattcactttgcctcaaaggttgccgtcataatggatccggatccagaactaaagtccatgattgagtgctagaagcgctcagattgggacaaatggaaagcatcaatagaggcaaggatgcgctcgctttataaaagagaggtttttgggcctgcagtcccaacacctccaagaatcatccctgtaggatgcaaatgggtcttcctccggaagaggaatggccaggtggtgaggtataaagcgaggctagtggcacaagggttcacgcagagaccggtattgactatgatgaaacttactctcctgtgatgagtggaatcacgtttcgatacttgatctcaatggcaactaatataaacttggatatgcagttgatggatgtagtgactgcatacttgtatggatcactagattcagaaatttatatgagggtccctgaaggactcaagattctgaatccgaaaagaaattgcaacatgtatagtgttcgcctgcagcgatcattatacggattgaaacaatgatgattgtccctgtgtgttcataaagaaatccctgaatggattttgtatcatctcagtctatgtcgatgatcttaatatcattggcaccacagaggacattaaagaagcaatggcttatcttaagaccgagtttgagatgaaggacttggggaaaaccaagttctacttgggctgctgctcgagcatctccctgaaggagtgtttatgcaccagtctacctataccaagagggtccttggtaagttcaatatggataaatgtcatcctttgaaaacccccatggtggtccaatccctggaagcagataaggacccatttaaacccaaggaagatgatgaggaaatgttgggacccgaagttccctacttaagcgccattggagcactaatgtatctagccaattgcacgagacctgatattgcttttgcagttaatctattggctagatatagtgcaaccccaaacagaagacattggattggcgtcaaaactatcctcaagtaccttcgaggtactcaagatcttgggttgtggttcccgaagaaccaagatccatccatggtgggatatgtggatgctggctatatgtctgatcctcataatgccagatcccaaactgggtttgtatttctttgtggtaatactaccatttcctgacggtctataaagcagaccctggttgcaacgtcaaccaaccactcagaaataattgctctatatgaggccacacgagaatgtgtgtggcttaggcggatgatcggttacatccagaagtcatgtggcctaaatattgataacacccccaccattatctatgaggataatgctgcttgtgttgcacaagtacatatgggctatgtgaaaagcaatttcacaaagcatattgctcccaaattcttttatccccatgagctccagaagagcggggagataaatgtcctacaaactaagtcatgcgaaaatctcgcagatttatttacgaagtctctgccagcatcaaatttttacaaatatgttcgtggcattggcatgagacgacttagtgaattgcaaggatcagggggagcaaacaattaagagaatagcccatgattgtgatcctgaagaatcacaaacaagtcctgaagacttgaccaactgttgtactctttttcccttggtgagtttttttttcccattgggtttttctcacaaaaggtttttaacgaggcaacaggtgcaacacaatattcagagtgccatgtactcttttctcctaccattttttcccactgggtttttgggaggagattttgatgaggcatgtgcataattcaaattcgtccaaggggtagtgttatgaaacctatcttattgtggacgaattaaattatgagtgggaagcttactacagaagaaagcttacaccagaggccagcttacaggagaagctagcttacggcgtaagccggcttacgacgcaagccagaaggttcaaggcttacgatgcaagcctctaccctcctccgcctataaatagggcccagaaggtccaaggcgaggacaaccgatcttcagtctcctgcctctcctcttgtagcttgtactcaaatacagaagaaataaagcttccactcgcttatattttctatgttccacagctctgtgtttatctgcttgtgtgttgatcagtagaataaactggtttctcaacacaacccaccatactagcccgagccaaaagggaaccaaacatacatagcgagacaccgccgtggcgcgtcgtcgtcaatctctcgcagtatcgctcccctcgactcccaccgtttcagcttataagatgttttgactttggtgaaagtcaaactacttcaagtttgaccaagtttatagaaaaaaatagtaatattttcgaaccaagataaatttattataaaaatatatttaattactaatttaataaaactaatttggtaatgtaaatatttcaatatttgtctataaatttcgtcgcacttaaagcaatttaacttttgtcatggttacggataagtcatacctcctatcctacgacttatggaatatacgagtatggtataccttcacgtgcacgggttgtgtaacatcctgacaacaataaaaataactaaaatttcgaactttttaaaacttttgcatcatgctagatgttatggttgctattgcttgccaaactataaattgtcacaatgaaacattaaattaaagatgtacaatttgcaagaatacgctatctatcgattccataaatattatgcacaaggcagaaagctaaatgaaggaaaagttaattattagttcctccatttcacaatgtaagtcattctagcatttcccacattcatattgatgttaatgaatctagctagattgatgttaatgaatctagacatatatatctagctatattcattaatatcaatatgaatgtgggaaatgctagaatgacttacaatgtgaaacggagggagtaatttctattggataaattacaaatcaaatattaaatattcaaaccatgtttgattatttaacaaatggaaacagtaagattaaatcgaattcatctgaatccaatctcacatgaaataatgaccacctcattacactaatcccattataaaagagtgtttcgctagaatatttaaataaatatttaaaacactttatcaagtctctcagggcataaaattcattcatataaaataaacggtcgtgtaaagtaatggagcaacacaccatcactatgtctacttagattattttaataaactcctaagatatatcaacgcccccaaaattgtctaggctaatatttgggattaaacctaatttaaataatgcaatggaaatataattgtgccatcacaacttttgagtaaaatctagatttttggatattaaatgttaaattaggtttcctggcaaatttacagattaacccttcctttttcccttatcctttctcttctctttctttttcttttcctggcgcaactgttcatgggccgccaggtgctcgatcaagttgtggcccaaaccgactgagccagccacgcccgtgtctgcccacatccatcccgcacgcgcgcagccgtgcgccaacccaactccacccgcgccgcttctatgtgccgcgcctccctcccctcgcgcctcatccctccgcatccgcgctcgcgcccggacgccgcgcacgcgaccgaccatgccacctctgcaataataggcgctttgttttttgtgccggggaggagggttcccaacccctcctcccgaacacaactttagccgcgtcaacttccctaacctagaccgtagacagccatcgagtgcgccagccgccgattttatcctccatgccattctggcttatccctaagccaagccccataaaaaccccctttctctctgtcttttgccctcaaatacatttcatcgagcaccttctatgcatgatctcaccgctactagagaccaccattgaggggctccccggccggagctggaggttggaggaaatggaggcggagcgacgctgccgctgtcgccgttggggaggttggacgtcaaggaacgctgacgaacactttcgggcgccatcaacgctgtttgcctctgtgccgcgacacaccgagccctactccgccgcgtttcgccgtctcgccttctcacggtacaccctcgcgcacgtagcatcctctaaccctctaatagctagcgccagctccaattttgccaactagtacctgtggccgtgccggcctggccgccattgcgccgtcggtgaggtcgccgtgacaagccatcccgggaactcccctctccatctagctggtgaaatcgaatccccataccccgtagatgttcacgctcccatcaattttgttggatcctagccctagcaccctatccccttgcaacccgagctcgggccatggcgtgtccatgctgcgccactcgccctctctccgccacgcgccgctgccgcagtcggtgggtcgctcgagctcgccgcaccttcctcggccgccgccgtgccggcctcgcgccaacccggccgcgcccagccgcatcctccctcgctacttccgctcagtcgggaggttgaagacgacctccagccgagccactgacgagccgtctccactcctcctatttcctttggaaaattaattatatgaaaaagaaaatcaaagctttgaccccacatgtcagcagctgttagggataaggatatattttggattaaaaataaatgaattatgaacagtgcctttttacaatttctcggattaattcaaatttgaatctttacctagcataacttattcattttaactcggatttgagtgaaacttgaacctaaattcataagctttccaatggtatatactccctccgtttcacaatgtaagtcattctagcatttctcacattcatattgatactaatgaatctagacatatatatctatctagattcattaacatcaatacgaatatgggaaatgttagaatgacttacattgtgaaatggaggaagtaattcactatttaataaaatatatttataattataaataattaatatcatatgattaggttatggtcaacttaaaaatatgctaataaatagaattggtattgtacagtagagtaaatgtaataatatttgtttctagcatgttttgtcacagtagcaaccatgtaaattaagtataagtgatgtctcaaatgaatggatgtataggacaatattagtacttatttaatattcaatggccatataattaaacccatgacttataggttatttaaagcaagtttagccttgtgattatgtaaataaaatatgaatacacatagatgagtctttgacttgtttatgcgaaatgataacagagctagtgtgattaaatcatctataaggaattaattacttaatgtcacgccccatggagtagtatcttttaagttggtaatcaatctcaagttaataaacagtaccaactcgccaaatccacctacatcacatatactgtatagcttacagtaaatagctcatgctcagtaaatatctaatattagtatgtcattgcactcacaactactgtacagtccatttaaatcatacacaagaacaataactaaggagtctatgataaacgtgtatagtagataaatactaattataaatcttgacctcacacaattgtagttcaaccgtgacttagaattatttattgtaaaattatgcaatgagataatctttaactacactattatggaccacactaatctaacctgcggagcacggtaatttgttggccggtcagaccggctagggcatgccagtcagaccgccactatgtggccggtctgaccgcccctggtcaggctgatcacatacaagtgtatgaaagtgagttttagcactagtctaaatgcacaatgacctaatgtggcaatttaaatcatctctttgctaggtcattacccctcttaatagtacagtaaagctataaataaactagcataattttgatcgcccaacgccttgatcaaattaaaatgaaaacactagtttaccgtcttctcttccttttgctttgcgccgtcaattttaatccatcggtagacatccatgcgcacacataatgtgaacctaacttaaaatatatagctcaatagaacggttagtccagaattagcgcttgtcattaattaccaaaaattagcaccaggggcctagatgcttcacccctgttttgactctgacttatacaagtaatatataaactattagcatagttttctcttatcaatcttcccttgggattaaataaatacgatacattggaatactttcgggtgaaatgctacaatggtatatctatgcgcttgcggttcatatttgtaatcgtattatactaggaatatttctgtgccattgctgggaattatatttctagtaatatcgttaagaaatacttatccagggtctactggccgtggaagtctatgtcggtcttctttgtttaggacggtactaaacggtgggttatgccacgatcttgacttttccgggtacctttccggtacttctattcatggctaattgatattgtcaccacaacaagctgtttttgagaaacctgaaggcacagaggatcggcaccttaagccattatatgttaaggcttttgttaatgggaaacccatgtccaagatgctggttgatggaggagcagctgtaaacttggtgccatatacaactttcagaaaactgggtaaagctccagaggacttgatcaaaaaaatatggtgttgaaggactttgggggaattctttagaaacaaagggagttttgaatatggagttgaccatcggcagcaagacaatttcaaccacatttttttgtcattgataggaagggttcatatagcgtgttgctggggagagattggatccatgctaattgttgcattccttatactatgcaccagagtttgatttaatggcaggcagaccaaatagagattgtgccagccaacaggtcagtaactgttgctaatgttgatctatctgtttgggagatggaaggagttgatttcttgttaggaaagatttgggaaggagattatctaaaagtgtctggttgtggtatacaaccagttggagatggagagccccagcttttactttgaaggcatcgtggagggatcaaatttctacaccaaggacagaggagatgatttagatggcaagctaggttaagggtttatgttggccaatgagttagaggaagttcatattagaccaggtgataggcctaggccgacatatattagtgcaaaattattagatgtatttaaaaagaaatagtggaattattgaaagaatacagagattgttttgcttggtaataatatgagatgccagggtgatgagcaccaggctgtgaacgccctgatttttccctctctttcacggtaccaatcagcaaacaaaatataattcaagtggcaacaaaaattcaataatagataactggcttcagcttacaatgtattgcactccaaaccctagataaatattccatctacccgtgcttgaataaacacgatcagaaaggagaggaacctgtggtaccgagtagtgcaaccagggacgaaagaatcacctggactcgctcttcttccaaaccaaccagcggcaagatcttcagtaggaaacatatgggagcgctgtctataccttcagcaggggttaaaccctagaccaaccaaaacaataaccaatctaatctaaattacatgaccacttggcctatttatatgcacaagggcatactggactagtcctaatcgaagcccatgaacatgcactccgggcttgctcgatcaaagcccaaacaaaccaaaataaacccagtataattaatctaattaatgcaactaggtaatgatgccactaatgacagtaattagctaacacctaataggagcccacactgataagaaataaatatgaaacctatgccagctttatctcaaccagcatagagccaattttaacaattcgattcagcttcaactgtttactttcattattctctgttttatcttgcttcacaagaacagcatagaaccagcagtggtcttggttagggatggcaacgggtcgggtcaggcacgggcagagagaaaccaggcccggcccgagacccacgtgcccgtgcccgacccacgcccgcaaagcatatcgggcaaaatcccatacccatgcccatgcccgtcgggcacgggcatgcccgacggatacccactgggcttgcctgccatgctccgccgtgccgccggccgccgctcgtgcgccgccgcgtcgccggtcaccgctcgggccgccgcgttgctagccgccgcctgcgccgccgtccgcgctcgtgggccgctgcggagccagccgcgcgccagccgcctcccgccctcgtgcaccgcctcatcgccaaccactgccccgccacccgcctcaccccagccgccgcccgcgctcgtgcaccaccatgtcgctaggcactgcccagccgccagccacctcgtcgccagccatcgccgcaccgccacgccgcgctgccagccgcctcctggttatttcccctgcgccgccgccgcgtagaaccgatagaagattgagaggttgggtttgggagaaggataatgctagggttttgagtgaatgtatatattgttgtatgcaaatgggccaaacgggctattgggccatgaggggaggttaaactattgaggaataagttcatctgagatccctgaacttgtcaacgaggcatgaccgcatgaaggatatacatgggctaaaagattttcgggtcgggcatggattatccacggacgaaatataaaacccacacgtgcccactaagttcacgggtatcgggtcagacgtgcccacgggcaaaaaaaggtgcccatgcctgtgcccatcgggccgggtatctgcggatacccgaacccatgggcaatactgccatccctagtcttggtcacatcacaggacttagccgatctatagttgaacatcagttgtctattaaaccaggatatcgaccattcaaacaaccctagagacgatttgagtctgacatgtatgatcctattagggctgaaataacaagactttatgatgccaaattcattaggccatgctgatatgctgaatagatttccaatatagtgccaatgatcaagaaaaatgggaaacttagggtatgtgttgatttcagagatttgaacaaagctactcctaaggatgaataccccatgccgattgcaaatttactagttgatgcagcttcaggatataagattataagttttatggatggtaatgcaggatataatcaaaattttatggcagaagaagacattcacaagactgctttcaggtgtcctggtgcaatcggcttgtatgagtgggttgtgatgacttttcgtctaaagagtgcaactgctgcgtatcaacgtgcaatgaattatatatttcatgttctgatcgacttgctggttgaaatttatatcgatgatgtggttgtgaaatcaaagtagattgttgcacatctagcccatttgcgccaagtgttggagagaacaaggaaatatggtttgaagatgaatcgaaataaatgtgcatttggtgtatcgtatggacaatttcttggatttttggttcatgggaggggaatagagataactcaaagaagcttgaaagctatcaaaaatatcgaacctccagtgaataaaaagaaactacaatccttgatcggcaagatcaattttgtaagaagattcatctccaatttatcaaggaaattagaaccatttactacattgttgaggattaaagccgatcaagaatttgtttggggggagaagcgcgacagagagctttagatagtattaaggaatatttgagttcttctctagtcttgattccaccatagaaaggagtaacctactagctgtatttatcagctgatgaaaaaacaatcggctcagtgttaatccaggagtttgaaggcaaggaaagagctatattttatcttagtagaaggattttggatgctgaaacaaggtataccccagtggaaaaattgtgcttaagtttgtatttttcatgtaaaaagtagaggcattatctacattcaaatgagtgcacggtgatttgcaaagccaatgttgtcatatatatgctatcggctcctgtgtggaagggaaggattggaaagtggattttagctttgacagaatttgatctaatatatgaatcggccaaagctgtaaaaggatgggcaatagccgatttcattgtggagcagtgaaatgattcaattggtacattaaattagtgccttcgactttatttcttgatagattagttcgcactcatggttgtgttatcggcttagtaattatactgcctcggggggggggggggggagggagggcaagttttgagtttgctttcacaattataccatattatactaacaatcaagcagaatatgaggcaattttgaagggattacagttgttgaaggaagttgaaggtgacgctattgaaattatgggtgattcattattggtgatcaatcaattatgagagtatgaatgcaagaatgatgtcttgagagtttataatgtgaaatatcacgagttgatgaaggagttcaagatggtttctatgaagcatattcccaaggaacataatgttgaagccaatgatctagctcaagtgcatctgcatacaagcgatgttaaaagatatagagattgaaattgctgctatacaagtcgatgattggaggtacggaatttttgagtatttaaaaaatccttctcaataagcttcaaggaaattgaaatacaaggctctcaaatatgtgatattggatgatgatttgttttatcagatgattgatggagttttgctcaagtgcttcaaattagaagccaaagttgttatgtgtgaggtacatgaaggaatttgtggaactcatcaatcggctcataagatgaagtggtcgattaggagagttgggtatttttgtccgacaatgctagaggattgtttcagatattacaaaggatgtcaagattatcaaaagtttgggtcaattcagaggacacctgcatcggctatgaactcaataatcaagccatggccgctcagaggatggggaattgatatgatcgtccagataaatccaccatcaagcaaaggacataaatttattttggtggctacagattacttaccaagtgggttgaagcaattccattaaagaaggttgattctagagatgtgtggacccccgtttttataacaggaatcaatcgtgtaaacagtaccattttcctggatcaagtagtctggtacacacgagttaatagctgaaataccaaatgcacatacacgaaagtctagtatgaattattacatcaaaagcccgcaggcatagtcttaaatcctcggaccgagcggtccggaatacattccaaaaacagaagtagataaggcagcggagttaaggcagtggcacgccattgccacaggcaacgaccataactaagacctactgagcgccatcgtcttcatcaccctcctagtagtaagagtagggatcctccgaagcttcatctccgacctctgattaagtttgtatattgcaagggtgagtaccaaccgtactcaacaagccaccacaacaacaatgcacatgacaggggtattcaaaggatggctatggttcttttgcgcaaagcaagttttataattcttttcacaaacctaagacctagcacacactgatcaaattttagtaccagtgttcatattaaacaatgacggttctgaccaccatccattgtgatcccaaggatagcttcccgccattgagtcatcatggttttctgaggacgtccacattcccgcctctcaggaagtggctccatcagtatagaaatcatcatgcaatatcccatcccacacaagttaagaatttagagtctagccaagtgtaatacatgtctcggtgctcaataaccgcgagcacggctattcgaatagatttggtttactcacactgcagtgaatgtacactttacccgcactccgcgactgcccaacacatgagcctcatcccaacacatgagacgcgtcatggcaaagcttttcgataaccttgcattggcagtacccgctccatgaactttacatcctcatgcactctaggcgtacacggtttctagcagtgagaggagttctggcgcacccgggaagggaagactcacacatgcattaagttataattatgtttagattctcacatggcagtcctaccgatggcgacaccactgtagacacccgcctcgcggtcctaccaatggctgccccaccgtagagcccctgcctcacacatcaagaaaccactatgcatggatactgcctccgctcagctatctactccgctaggtctatacccatacgagaagtgcggttgtacggaggtcgtttcatgcttaacttcatggctcggtccttaattgaccggggacggtactagccttttccggataccacccaaatcctccgtccgccccagtcgaaaacagttgtttaattttatttctcctttcacaactcatgtcatcaacatcatggcaatgtggcgctcatgtctccacatgccgcatctcaattacattcccaaaggtaattgcccaagcatatagcatttgataaatatgagtatgcatgattctagaatagcatctctaagcatttgtcattgttgactagggactcatacgtaatcatggttacaagggaataagggtaaacaataatcaaggtatggcatattcacaaataggatgttcatcattgcatgcattcttatttgtaaataaaataattttgcaattgggatcaacatgttcaagggatagtgatgacttgccttgctcaaagtcttgcgggtcttgaccttcgcttgtatccgcaactccctcgggctctataattacgtgtgaagaaacgatttgaattcggttagaattcaaataaagatccaagtaaatccaagaagatatcaagcgcggaagtcggtttcttacattatctattttcgttcgtgaaatagagctactccgtttgtttaactctatccatccccaaactattttgtggcataattattttattagcacaagtttttaatttaatccgcccgggtattacatccatataataggttagaaatttctatcgcgagctaaatatcggacaaaatcctaaaattatcttataatattgtacgatttaatttagtctatgactaaacgattaaatataatacacggctaaaatcctagtaattaaatccgaatttctaccgtgaatcgatgacttatagagattaccaaaaataatctataagaaatcatctaattgtttagttattaattacatctaaattactaccaattttaatctaatccgatcaagaaacctatttctataattaacccggaattttgatcgaaatactattacactctaggaatttccaaaaataatctatgattaaccccgaccatttttttatttcctaaatcctcctaatctctcccctaatttctcttctattttctccttttcttcttttctattttctttttctttctctttctctcttttcttttcttttctttttccttctctttctctcttttcttttctttttccttccctttctctcttttcttttctttttccttctctttctctcttttcttttctttttccttctctttctctccatcggcttctcccttcctctctctctcttggctcttgctcacctgggtggcgatggcggtggatgcgaggggggggggggagacggcgcaccggcggtggcggtggcgacgatggcgacggcggcgcaagtcgcggcacggcgcggcggcctcgcggcggcggcgcggcggcttcgaaggcggcggcccggcggcacgacgacggcggcgcgtggagaagggggagagggagaggagggaatggagt

SEQ ID NO: 73876 - DNA, 10778 bp, Oryza sativa
aaccggggccaaagatcccgggggggcctgacaagccctgacagcatttgaaccgggactaatctgttaccaaccgggactaaagatcaaatatgcccgttaccctttttaaccgggactaaagatcatctttagtcccggtttttgttgcaaccgggactatcgtggaattcgaccgaccgacgaaagatggtttctccaccagtggcacgtacttcgtactgatgtactccctccgtccgtcctataatataagagattttttgagtgtttacttgcgctgtttaaccactcgtcttattcaaaaaaatttagaatcattatttattttttttacttactttattatccaaagttctttaagcacaacttttcgttttttatatttgcacaaattttttgaataagacgagtggtcaaacagtgcaagcaaaaactcaaaatcccttatattatgggatggagggagtagtagttatatgtggccttctttaaagttacactttaatttggacctattcttattacgtaagttgcatattggactaggtgatagcaaatccgttcactttatagaccatatctattctattatatacttaaaagtccattaaacttcttacaaacgctcttaaaccgctacgtggcacttttacaaacgttcctagaccgccacgtgacagcgtctaatctcaccgtcgatttttacttaaatcgatggacccgataatttagaccattagattagattagatgtattttatttaaaggaatcaaatactatactgttggcaaaaaaaacaaaaatataagtactccataaatacgtacgtacgactgaaaaacaatcaagcttacgtcactcccaagccgccaggtgggactcagctcctaagttatcaaatggcgttataataaattaaaaaaatctgttgattttttattaaatcggtggacccattaattttaaccattagacctccctaaaattaaaaatccggtagccttcacctccactatacgtccgcaagtacgtactccctccccttccctctgtccaacctccaactctccccttctctcttatttttagctaactttcttaatattaagattttcaaattacgttaatctaaaaaaaatcatacgtagaaaatgtgctatatctcttcatgtggacgtgcacgtacatatgtacgtaccctctttgttctttctttcttttttcttttctccccttcttggttagatgagatagaaaatcaatattcatattaagtatattttaagttgcaaaaatacagtctaaaaaaatctagaaaatgtgagaaaaactaaaagatctaaccattattttttatttaaattgatggatccgttatctcggaccattagaataaatctattaataatctgtcctaatctccatcaacgtaacgactagagaaaggtacgtgcgtacaacttataaaaaaaccgaaaatacatatacaactgtaatgtaacgtacagtttaaaaatataaagtgcaaaaaacataaaaaaaatcaattacttatatcattaaaacgtacatttgcttccttcttctctcctcacgtatagatgaaatcgtaattattattagtgataataaattttaagaaattataactttataaacataaattatacatatcatcatatatatgtctaattagctccacaatgtttggaaataaattttataaaactatattattttacccatgatattaacaatataatattttttttgtttacttaaaccgttgtacctattatatcaaaccattattttgtatcaaaaattttaaaaacacgctgtttaaaataaatgttatgcaattatgttttgtaccattaacttaccaatttatgatctatattaactaattttaatttaattagtgaacactgtattttatactatttttaataaaaatatcttgcccatcaataattttcaaatacttatagtttcatttattaccgttatatcttatattatctcagctatagttgtagtcctgtagatgtgatagatggacgcttaaagttttttttaaaattttctattaaagtggaaatttctagagttttctctaattaatgtgggaacctttagcttttgtgttgttgaaaactgatgttggggattcttatacaagcatttatgaaaatctatcaaagcttttagaattgaaagtttagcttgttttctaactagttcaagcaaatttcaattgaatgtgaaactataaattatttgttagtgatcgatcgtttgattgtaggtatttgtcatgctaatatttcgtcctctagtaatgtgattaaaacttcaaagatctttgaatttgagttattttctctaaagttatgtgtatcatttgaaaaattactaagacattatctgttttcaaaaaaggctcaaatttaatctaaatgtgagtatttgaatccttcgggccccattgtatatatagtattttatatatatctttgttactgcttggccagaatataaatgttcaataatatatattttttaaaaaatggaacagggtatgaacccactcgaaacaggcagaattgttctaggtcatgtggcaatatgactattcctttccccttcgggctccaagaagaatgctccgcaaatagaaaattccttctgaattgtacttccaagcaagcatttattggaggatcatacacgcaatatcaagtgacgaatatttcactagatcaagggcttctgtttgtcaacttttctcagcacgaagaggcctactcagaattggtagaaataagcagagataacatctcacagtgggtggagtcctggattgacgaattcaacgattttgacgtctctcagcattacggtatttggaagtggtttgtgaccaacatgacttgtgaaaaggctaaaaaatcatctgcttatgcctgcattagcaccaacggtgagtgtactggtgtcacgcatggacatgtgcatttgggatatcgttgcaagtgctctactggctacgaaggaaatccgtacgtacataacggttgcataggtaagaaaccagtttgttgccaatatcgacaaaaatcgttattatgaacttcaattagtagccattgtatatttgttttgcagatattgacgagtgctcgatacccaatgattgtaagggaatgtgccacaaccaagcaggaggctacagttgcactcgttgccctcatggcacatctttcgatccagccgaaaggaaatgcacttccaccaagcaacataatattgtcttgggtatttctcactttaaccgatcccttttcaataagatcacagtcaagtacgaagcataaccatattaattacctatgtatgtaggaattgccagtggacttagctgtggctttggagtgttaattcttaccttaagtgtgacaatgttattttggaggtggaagagaggcattcaaaagaaaattagaagggattacttccataaaaataaaggtttactattggaacaattgatttcttgtgatgacagtgttgcgcataagacaaagatattttctttagatgaattagagaaggcaacaaacaattttgactcaacacggattctcggtagtggaggccatggcactgtttacaagggcattttatctgaccaacgcgtagtagcaataaaaaaatccaaaattgtggagcagagtgagattgatcagtttgtcaatgaagttgctatgttatctcaaatcatccatcgtaatgtggtcaagctttttggctgttgcttagaatccgaggttcctctacttgtttatgagttcatatcaaatgggacactatatgatcttctccatggtaatttgcaaagcaaatgtgtattaacatggtggaatcgcatcagaattgcccttgaggctgcaagcgctcttgcctatctccattgtgctgcctcggtaccaatatttcatagagatgtgaaatctgccaatatacttctcgatgataatttcactacaaaggtttcagattttggtgcttcaagatctgtttctattgatgaaactcacgtggtcacaatagtgcaaggtacatttggatacttggatcctgaatattatcatacaggacaattaaatgagaagagtgacgtttacagttttggtgtaatacttattgagcttataacaaggaaaaggccaatcttcctcaattcaattggagaaaagcagaacctgtgtcatcactttcttcaaagacagcaaaacaataccacatcagaaatagtagatgtacaggttttggaagaagcagaccagtgggaaattgatgagattgcttcgcttgcagagatatgcttgaggcttagaggagaacagagaccaaaaatgaaagaagtggagctaaggctgcaacttctgaggagtaaagtagcaaagaagaagaatagagtagaagtaagcagggaaaatgaaattgatccattactgctttatacgcccagctctagttccgtgaacccaagggattttaattcggcaagtcacaatgatgccactcgatgctacaccatggagcaagaattggtttcttggaccaatttacctcgctaaatataacattactttttaagtaactcggtattttttaatagctaaacatacaattcaacacctaccttaaataatacttaaaatgaaacattagattactctctaaaatttgaaaacactattgtggtgtttgtttattgtatcagtctattggataagacaaaattatcattttttgtattattctatacactaggaaggtggcccgcgcgcatgcgtgggcacttgtattattgaaaggtaagtttagtgtttgttcaaaaattttgcctcaaattaagagcaaactaacgttcggataatgttattttataataatttaagagttctatttttcttaagatattttaaaaaaacattcacaaacttttgagtaggagatggattgagtacttgacttttgaatcatggttcattttctcgagtaaataataaactattgctagttaattatcagacagttcatctatatacataccgtgtagtttggccacaaataaaaaatgctagagcaaactaatcaaaattcttataagtaaatagtctcttgaaggcatatgatatagtaaaaaatggagagaagtgtatgcatggaaaaagaagaaggggcaaatgacaaaaaaggaaggggaagcatacatacccatgtacgtaggtgcatacctatgccacgggaggagaggtgggactgtgaaggtagagaggtcggacctcgtagtatttagtttgttctaagatcaatttaatctaacggtttataatataggacctaccgatttaagtaaaaatcaagtaatatatactttgctttttttctcttagaatttatgatattttctctaatttattagagcgccatgtggtagctcgagagcattttaaggaattttaatggacttaacacatgtaattcgtaaattaaccgtgtaatatatatgtatgggactacggtaatattcgttctagctttgtccatgtttatatatatgtacagagaaattaattatgttgctagcaagccattagatgtctaattaatagcaattaattgtgacacatatttacaattgttcatagtagctcttacatattcatcctatgactttgattatccattgatcaccatgactcacacgaaaaaagaatgtactacttaggggtttaggacagctgaaattgatgaattatctaatttacgtgatagctatttgaggatataaacgaatgatttgacttctaaaaagttaaaaaattgtttaaaaaacaccatttagaaatttcaaaatatagaatcagaaaaaaaaataaagccttaaacttcattttagcactcttgtcttagtaagagttctatcgatattcgttaatactattctcatatttataacataatgatttctttcacctgtacgaacaaatagtacaggatccaaatacgacataacacaatacattataattattatgtaatcaactctcggtttcagcttaaacgaagctatgtgttggaaaaaacacaatggtgcttaattcttctctcgctgcataacacctttaatttttctttttatgttattaacaaaattaatcatatccatatataatttgatatgtagcaaagctgtagcgctgcaatggtcgtgatcaccttagatgcctcagacatgatgctttgtcatgcgtgcaaaaggtaaaattacagatgtgcattgtgcaacggaccaaaaagagaactttagacgttttaattattagcaaacaatagatccgatgatttaaataatcggtacacgggttctaatgtaaatgtaaattagttaatatagattttaaattcttaatttaatcggtgcacagtataatggtgtaggctttattttaaaatagtgcattatttgagaataatagtccaaagtaataaaaggatagatccaataatttaaataatgggtccatcggtttaactgcacgtataaattagttaatatagatcttaaattgtttatctgataggtacactataattatgcaaactttattttaaaatattgcattatttgaaaataataatacaaagtaatgagtacactagtttaggtggaaattatcttacattaatttgatgggtaaacatataatggtctaaattttattttcaaaaactgtagagctaatttagttacctgtgtttataaagagttatatgatggtatattctttgtatgtaaaattatgattattctgaaaaatatataccaattatgtaaatggaaaaaagaagaaaaaagggggaaaaaagggaagggagggaagcgtacctccctatgcgcgggagaaggaggggaggtgggacccataatatttggtttgttttaaaatcaattttatctaacggtgtataatattggatccactaatttaagtgaaaatcaaggaatagatgttttgcttttttattagaatttctaggattttctctattttataaaagcgccacatggcggctcgagagcgtttataggaagtttcatgaacttttagtatataatttagtatataatagatatgcttaaatccattggtttgtggaatatatcttcggacttgggaataatggatttggtaagtgctgggactaatgcatgtgcgcacatatataacttgactgcatcaactcagcaataatttatctgtatgagatagagaatggtttgttgacagtgattgattttacttgtagtatcacccacagactctcagtcctcataatgtaagtgattatgccttcttttttacaaaattaaagaaatatcaaaagaacttatgatgatataaaaggtgatgtcggtgatatgggcccgggggtatgtgaagtatggggaagtctccttcccgtctagtcacgtggccctacagcctagctctccccccacacctcgaacgacgcagaggcagccagggggcctcggggtgccacgtcacacccctcgggtcctcgcgctgcctcgcctcgaggccctcgcccgaccgccatgtggcgaggggagtgagtggggcggagacccaggctgaaccgccatcaatgcaagggcggatgtgcggcgctgcccgattgacccacgtcaatcgggcgtgaccggattgtgaccggcctgtcgccggtcacgtccgatcggacgggcggaggtgcccccacatcctaccctgtgctcggtggagtgggggcaggtatgccccgtcccatcaaagcatcatctggagccccctccacgtgagatgaaccgccgaaagtctccattcatttaaaggagaatgacaaggatgtcccccatgtcaggcggggggcggcgctgggccccactcgacaacggacggctgcttagcttccgagcgaaggcacgaacggtggtccgatccaggcggagtgggcctcccctcccgtgaaagggtaggtagaggcggtgcatgtggtatccccttgaactataaaaggaggaccttacccaccgaaaaaggggacgactctcagttagcctaaaccccaggggaagaagagcgagagtgctccctggagtttaggaacctttgtaacactcaaccttaaaatcccacgcacaggagtagggtattacgctccatagcgacccgaacctgtataatcccggctctcgcgcgcggtctcggaagattctaggcggacacacgttctcgatcaacgcgccctttcccccagccgaactcacaaaaggggggtctctcgatctcccgctagagaggatcattcatcgacaggtgatatgtgagggaataaagtagtataaaaggtgtgttggtggtaggtcatcaggcactataggatgaggatatccaactttgctaatcttgatcattagcaattggtttgcgataattattcaattttgttgttaattactgttgaaattataagcacataatgatttaatttattccataaataaatcatgacattgcagatgtaaactagattgaacgcatcattagatctacacatgtaaactaagaagtaaaacatggacagatcaaatatgcgcaacatgtcgaacacgtaccgaggtggcggaaagaccggttgctcggtaggaactactcgcggttgtaagcgtcgacgaagttgcgaagcacacgagtggagaggaaggcgagctgtcacggatgaacagggagcagtcgcgcgaagcgcttcccaaaaaccttattgccgccttctcccggtgcaggacgtcgaaggcagaggttccggagacctgctctcccgatcgccggtgcacgccggcgagcgggatggagtagcctacgagcgacggcgcagtacagagtaggaggcaaaccctagattgatttcgtgtgtgttgcgtgaagacggcgactaggtttatatagagatagatcgcctaatcagggcgcccgcgtaaaccgaaccggataagtcgcgcgtaacttatccagactccatgtcgttttcacgcagcggatttttcggaatgtttccaaaacaaaacaaatccgaatcccgcagcaaaacaaaactgcaaaaggaggctgcatctgagcaagggtgaggagccaattttccggaccattcgacgcgtacgtcgtgcacgcgcgccgcctgccctgccaggccatgccagggagcgcacacgtgtgtttcccctcttctctccaccacacatgcttcaagtggctaggagggcatcctcccttttaaggaggtcccgctctcctaaaataagcaaggtgatactaaactccacatgcatgtcatcccatgaggtgggcttttgtaattttccaaagaattaatcttcgaatgggctaaggcccatccattaattccaacaattactcccttcgtctcataatataagggattttgaatttttgcttgcaacgtttgaccaatcgtcttattcaaattgttttgaaattattatttattttatttgtgacttactttattatctacagtactttaagcacaatttttcgttttttatatttataaaaaaaatgaataagacgagtggacaaacgtggcaatcaaaaactcaaaatcccttatatcgtgggacggagggagtagtaattaaattgtcaatgttgactagatatagttagtctattttattgttaattagtacaatttatgataagattaatgataattaacgtatgttattattagttaatagtttattgttttcattcatttaatcatcatccatctaaccaaacaagactctgctcctgagttttaccctttcaataactaaaacacccttgttgtggagagagaggggagcgtggaagaggggcgagctggatggcaacagagcctattcctcggcagcagctgtgctagagatggcgagcacgcgggcgagcgagcaagcggcggtgctagagatggcgagcacgcaggcaagcgagcaagcggcgctggaggcagcgagcagcgagtaggcaggtgtcacacctgaagttcttctcccaagccaaaattgaatttataatttgtctcgagaaaataccggcgtaaaagcaagagtgaaaccctaaacaaattaatgcaaataataatcggaattggcatgtggaatttttcttgagttctacatgtcgaaatgtgctaacaagatttttagtggaattttcagagctccagaaataattttaaccaattaaaattgagcacaagcaatatttaatccctgaaaattcatttctttctttttctttttcttttcccccttttctttttgaatgggccgccggcccattttcctccccctcccctccccgctgggctggccgaaggccacggcccaactgagccggccgcctccctcctcccttcgggtcgccgataggtggggcccatctgtcgggcccgtctcccacctccagccggcgccaccgcatcccgcaaccgccgccccgctcgctcccgcgtctcccgagccacgtcgcccacgtcgccgcccgcgcccgctttccccgcgcccactccctttttctcccgcccgcgcccgcgctcgagacgggcgggattcaatttttgaatcccgcctctctctcctccccac

SEQ ID NO: 73877 - DNA, 25449 bp, Oryza sativa
ttcctctcctcccctcccctcccacctctcctttcttggtggagtggtggcgtggtgcgggaactgccgttgccgacgaggccagctcggagtggcggaccatggcgcgagggagtgtccaacacgcaacccctcccatctgctgcctccgtgcctcctcctcctgtgctgacggctccggtggaggccctcttcgatcgccaccgccaccgtgccctgctacccccttccgcttccctttctccacccgtgtccctctcctccgagtagcgttaccggccgcagcccctctcctccgagcagcgttaccggccgcagcccctcctcctgagctggctgtcggtgccatgccgcgccgctcctcggatgagtcgatgatgccgcgacactgagccttcgtcggagagcatctgatttggccctttgtgcccaggtatgctcagcccaagtgttgtcgttgacgccggattgcacgtctccttcctctgcttgtcgactatcagcaggtcggtttggccactgcaggtggagccgtgaaggtaatggccgccgccagccagtggaccaccttcttggtccccctacgacctgcgcgcgtcgatctactaccggggaacgccggatgcaggccgtcgtggctggatctaccagcgctggtgtacgacggcacgaagttttgcaatggcgtcgtgcttgggacaataggagttggtgcgattttgcgccttttgccacaaccaacctcaacatggtgaatttcgatgctttgcttgcttgcgcaaatcagcagatgtctttgatggtgagtcccaacaacccgtgcatcatcgaggacaaggatgatttggttgctgaggatacaaaccacgcactttagttcagttttgtactccaatttgattttttttttgaaacgaagggttttttttattattttttttacgatgcttgcagcttgcagggtacctgtgcgtgcactgtgtatttgtctctgagaagttactgtgaaggaggtgacatgtaagatgctctaacatttttcactcttcactgatcctacagttttatcttccaatgttctaagtcactggaacaagaacgacatggcagagaggataagaagagaaggggtgtccttttctctgaaaagataagaataggttagtgtaagtagttgaaatggtggtgctaccaattgcatcgctttgatgaatccctcatttacctttttttaccctataaataagatggcatatccattctttagtgatgctttaccaagaattagttttcaccagttactgacatttcaaacttctttaagtaccaagtgcacttttttggatttgctatctactccacaatgtcttacctcatcagttagtgctaaagataattctttgtttgtttttctagctctcttcaagtatgttcaagtaggctagcgtgaaggttctcaaggaggtgaccaagacgaggaaggtgcctgtgctggaggtgcccttggcgttgaccaagatcaagaaggcaaatcttgagacatcctcattctttgagactcttagagggacagagttcccggtcaggacatggatgcgcatctttgtgaaggttagaaatagatgcatgattgcttgcaagagcagttgatttggtttttctaaaaggacttttttttgcttgcttacttgcttagttcgttgggtaaaaatgtcaggatcagctgaagaaagggtagtgtacaatgtttttatgctgcatgagctccttaattaatcatgttcttcattatttgtcatggtagtgaaatagtgatgatgctttagcagcccagttgccatgggcattcctgacattgagaactaactgttacagtgtattactgcaccctgtttgctgaacactgcaagaactcctgaattcaaactgtttgtgatagtgtgatggccatgcgatattaaccaaaacaaggaactgacatacctaattttaaattgttgtgtaaggctttattttagtcggaataaacaaatgtttggaaccgtggtctgctatatattatgtgtttatcatgcccaactcctaaacctgtatttgaactaaatgaatttgtattcttgtattgtttatcaccacagaaagaggattgagaatggtgtgtatttgtgtccttaacctttaaggggagactcatgaaagaagaaaaagattctagactttatggcctttctgtcccctcaatttctgccattgtttggatgccatgggaccatcaccagttcaaagctactgacagtgctctttgtagtggttccagacgttaccattgtatatatgtatctatttacatgtctaacttgatgcttatagagattatatttgttgtttatgtattttttttgtgagttattcccatatcaaactaatttagttgcgactttggagttgctggtatagtagagaattgaatggctctgctttttgtaagtgcaagcaattgtgttctttgggttttatactaattctcgaacttgatgatgttgggccggtcgttcatgactctatatttgctaactcaatacaactcttttatgttatatcatctttattcccaaatttttgggtttgtaatttctttctctatgagcaattctggtactacatttacgaatgtaagagacatggtcctaattcgtgtatgtctagggaatgggaattggttggaaaaaaaagttactccatggacctcctttttattaggctcatgtttaacttgcccagctggtagtttcctaaaactttcgttaatactgtgaatacaccaaacttgttgcccatttttattgtgaatacaccaaacctgcttcccctcgggtagtggttgccatttttattgggattttctgatttttatcaccatgctgctgctcttgttttttaacaaaaagaggttgctatgtatgtatgggttttcagttcgtagtgtgtgttgatttctgagttgttatatcttccgtactttctgtttgctttgacctgttagggttattttttttcgcgtgagttcctgattagattggatgtttatttgtacactgaattaattgtttgttccttacccgttcctgtatatatgtattgtgtgcttgtccatatcaattaccatataatggataaatgcgcaaacccttatacaagtattaacaactcgctgtaatttcatttggtacatgatctgcatagtaaacctattggttatcattgctaaacccatttacgactaaattctacttttcgaaccaatctctgctgtcctcgcatgttaccgcctactttctcaaactgtaccatttttcatctactcttagatggaaaaaaaatgtaacacagttcttaaaaaaggggccccatataataatctgatgttaaatcaaattaatatgcacataatatgccactccatgtggtcaaattaaccttaattacgtgtagttctaaccacgtaggtgttagcgtgcgaggcgtggcgccgcgctcatatttctagtgttatgtcaaaccttcaccgttattccaaactctgaacttggcctgaaattcggcaggccatggagcgaacattatcacgaatgcagggagatcttgactcgagaggtcaccgtctgcacgtcgaggcagtagagagcatcgatgagatgcatcctgagagaggcgggtcccttggcgccagactccatcccgatctccccggccaggccaaagacagcaagggcgcacgccgccgcggccatggcgtcggaaggctcctccaccaccgcgaggaaggccgcgatgagggccgtcgcggcgcagcccgtcgccgttatcttctgcatcatggccacgccgttgctcactccgaccacccgctcgccgtcggtgacgtaatcgacggccccggacaccgcgatgacggcaccggtggaccgtgccagtgcttttgcatcttgaagagcgtcccctgaatcatgtgtactgtccgcgccctgcaaaatcgatgggaattgattggaacattgtacattatatactagtatcaatgtactagtaaattgttttggttagtcagtcagttttgattcttgacagaactgaaagatcaatctgacattagccatcaatctgacattttggataataatcagtcatggaacggtctgaactctcgagtaacaaaaacaggtgcatcgattgggattcagattgtgaggacagaagagaggatttattttcctcatcacaatccatttttaatccattttctaaaaaataaatcacaatcaagttcagaaaattgttaatcgcggcactctttttctttccagtagagagcacgaggcagttcacaatcaaaccaatccatctcaatcgtatcaatcaagatttttttttctataacttgttcggatgggtaaattaaagcgaagacaaaatggttgcaataataagcgagcaaagctagaaatggtaccttgaaggtggtggtggaggaggaggaggaggcggcgagcgagcgagaggcgagggcaaggatctccgacgcgttccccctgacgacggcggggcggagggcgaggagggagaggcaggcctccatccggaactcggaggcggcggcggcgacggggtcgagcacccaggggcggcccgcggaggcggcggcgcgcatggaggggagccagccctcggacagcgtgccgacgttgacgcacacggcgtcgcagcgcggggtgaactccgggacctcgcggagggagtggaccatggccggcgacgcccccgcggcgagaagcgcgttggcggcgatgtccatggagacgaggttggtgacgcagtgcacaagcggcgcccgcgcccgcaccgccgagaggagctcccacgcccgccggccccaccacgccgccgtccgctcctcgtccatgttcctcgatccggcgcgaccggaggtggggagtctctgaggaattcgatggaggagaagagtcgaagtgggagcggcactaggcgcggcggcggcggcggacggcggcggggtcgaagaggacggtggaagcctggaagaagaaccgtcgagttgtcgtgttcgcggcgcggcgcatcgagagacctcttttgcgctcaagtgggggatggatggatgcaagagagccacgcgtccgaatccgggtgcccagctgccaatccgacggccaggccaaaggtcagggtttataaagaaaggtaaattggtttctatgaatttcgtggcttctatccattactttagcatcttaattgtttgtttgacacatgagcatttgactcctaggtgggtacctttttctgtgttctatgaaaaataggtgtaataatgttgaacggttgatggtgctaatctaaaggacctatgggctgtttggtttgctgttcaaaccaactacactgagaatttgcctacatatcaaaacaatatattcacatgtttttttaaaaaaaaattggcgctgccaacattaaacaaaagcttataagcaattgtacaaaacttttaacaggaaatagaatgcctatgcttccctagaaattttggtactactttttttccccaacgatgcatcctcttttattattaaacaaacttgagaaccaaacacttttttctctattagtacaacctataacaacaaaatacatgtatgcttcaatgcgaaaacttttaacaggagacagaatgcctatgcttcactagaattttggtattattttttccccaacgatgcatcctcttttattattaaacaaacttgagaaccaaacacttttttctctattagtacaacctataacaacaaaatacatgtatgcttcaatgcgagggccccattcaatagggtgggtcagctgacccatctcgccagggcatacctcctaacctaaaggaaaaaaaatgttgttgtgccatcttcaaacacgggtttcaccataatgccatcctgcattttggcttcaccaaattgccactttcaaatgatatctatatgctagatactattatagatgaaaaatgcccttgagttccttttctccctccctcagcacgccgaaggtgcttgccggtggccaccaaacaccatggccatcatcccaactcgccagcgccagtatgcgctccactaccaccagctcaacccactattgcttcccttcccccccgtcaaacctcaatcgtgccgcctaattaaagccacaaccgtcgtacatccgtcgtcatcccgcgacctccctatcctctctctttggcatcccacaggttgcggcagccttcacagtcacgctgatgcaggaggaacaaggaagatagaagagccggcttgtatagctgggtgacacgacgatggggtgccagtgatgggctgtctaggcatgatgtacccatctgtatctctctccgcagcacgccatgacgatggtctaaactggtgtggtgaggccaccagagttgaaagagaaagaaaggatgaggggcatttcagtccattcatatagcaaagggtattctagcgtgtagcatttgtttgaaagtggtaataatttagcgaagccaaaatacatgagggcacgataaaactcacgttaaatttgaaacttacaacaatgtgttcttcaattcttgatcaactctatcattgtgagaatgggaccaccatgagaatgaggtcgttgcttgcattcagctcctagcggtaatgcacaagctttggcactggccacagcttctagctttcgagccgccaagtgtttgtgttccatgctttgatgttgtatgtgttctcagtttctcataatatttctgatgtgatggattaatattatatatgttacaaacattgtttgcttactatttaatctatatgtacatcttatatgtatgcagacatgccattaatttatcgtaattcacatgatctcaatataaataaatgcattgcgtgtctgacctactatcttgccatgaacatcttaacattgcgaggaagagaaaaacaagcacactccgttcattcatagttaaaggcaaaagccaacccaataatactaatattgtacatatcggaaataagcaatattagtgttggaaagtaaatagacgataatgtgtatggagaggggggaggaattggcattgatacttagtgatggttagataccttacctacacggaaggacttccaaagtgaccaagctacctaacataaaaatatataaaaggagtgaaagaaaaaaaaagggacaattgcttatttgaccacgttttgaactctaactaccaatttgaccctactttttagagtttgcttacttgaccctccttttcaaaaatgaagctcccgtctgaccctgtttctactagtccgttaagttttgatttaaataaaaaaagaaatgcaactaatattcataatacccagaatacccttagaaaaccctatccatccacccaaccctatccacatttctctctctccttcctccttcctgctcactcgacttgtggcggcggcgctgagggggcggcggcggcgactgagggggcggagggagggagtggcggcggcgacgactgaggggcgcggagggagggagcggtgtcggctgaggcggcgccggcgcgggatgagggaagcagcggcggcggcggctgaggggtgtggagggagaagatccacgacggctgaggggcaacggcggctgaggcggcaccggcgcaggatgagggaggcggcgccagcgcaggcgtgcggaaaaagggaggaggcggcggtggcggcaccgaatccgctgaccgcagctcgagctccaccgcccagactcaccgccgccactcctcgtcgtcgtcgtcaccagggccagcgccgtctcgcctttcgccacctctccctgtggtggatacgtggaggagaggacaagaactcgccgcggccactcgtcgtcgtcgtcgtcgtcgtcatcaccagggctggtgtcggctcgccgtctcgcctttggccgactctccctgtggtggatccgtggagaagagagaagagaggagaggaggagaggagaagagaacttacgtgtgggtctcacatgcaataaggtcaaatgagtaagggcagaagagatattttgtgcttcagttaaccccgttagatgcccttaacaaaatatggtcataccatagcttcgtttttgaaaaggagggtcaaataagcaaacttcaaaaagtagggtcaaattgatagttagggttcaaaacggggtcaaataaccaattgccccgaaaaaaaaacctcctctactactattgttgtttcttaggcccttcacagtgagccaccatgtcacgtagattcgttgtgccacgtaggatagatgatgtggtggaagagagagaacgtggggtgaggggggcattgctttgtgaggttttctcaggtccaaaggaagagtcgagttcctcacctgcaaaaataactggtgataggcaaaagtggagcatgtgcaagaaccaatgccgcaagcaacctgcgcgccgctatcctgccgcccctatgacctcactgcctcaaccaaaaaaagggaggggatgccctcgccacccactagaggaagtggaggagccgatgacggggctgatctactgcgtcgccacccggcgcgcccgatctatgttgccggagccaacgtccggagaaggagagcagcttgagcttgtcccatcgctagatttgcctgccgagcttgccgctgacctcgtcaccatctcccactttgtgctgcagagcttgccgtcgtttcccattctgtgccgctcacctcgaggcagccccaccgatctcgtgccccgctcctacgctgctatcattgtcgccgtctcctcctccatgccgctgacctcgaggcggtcacgccggtgccccatcgagctcggcttcctccgagcgatctgcgctgcgatggaaagacacttaggcgtggtggctggagtgggggaaagagagggatggtggtggccataggtgtcgatttcccctccgcccagtgttggggagggaggtgtggttgtggttggcggcagtggtgtcgtctacggtgtgaagagtgtagaaggggtcaaggggctaacagagaggcgacggtccaatctgtccagtgccgctagggagctcgtcgcgagctcgtcgccgcgcagccgagggagctcctcgactgccggcccaccacccttctaagattctccgcactgagatggtgctgacgtcgatgccggtgccggcgggagttgagaggagaggaaatcagatgattggagaggttaggtggggatggattagattttatattattgtgtagattttagggttccaagtgtaaacttttgcattaatgtaaatttaaagatagtagggactgtaatgcaaaagtatataagatcccacaataggttctttgcattgcggagagcgtgatttcaaagtgcttcatcctatttagtgcccttaggttcctcgtatgagtagcttgcattgctaacaaccttctatagttcatttggtctctaacttctcagctggctttatactttgggatatctttaaaatttctgcggtagacttaggatcaaaacaaaaccaataaaataaagggtttgttggaaccatgccaccttaattttgcaaaatttgagatatgccacccgtatctcaatgacatataggacccacatgagttaatgacatgtgggtcagggtggtatatcacaaattttgcaaaatttatgtggcatggttcaaattttccctaaaattaaaatacacccatataaaagatcaaggggctgtttggttgcttcccaaacgttgccacactatagttaggcaagtttgacttttggtgtaaatgtttggttgaagccaaagatttggcatgccacacttttctactctcatggcccacatgtcatacactcatttaacaaaaatttgccacaagtgtggctctcttttttggtgccacaaaaactatggcataccacacttgtagcatagaagtttggtaaagtgagtaatccatccaaacagcctccaattcttttcaacatgttattaatcacacaccccattaaaaataagaacgcagaaagagccaggagtaaacacaaccgcctcacgggccagtccaccgaccatttctaccccttttctcctccgcttccttttacttggcttgccccctacttctcctcagtcctcacccactctcccctcttctttcctctttcttcccccttaaacccacccacaccaacgcaatccagcaagcccccacatcaacgccgctccggccgcgcgcgacgccgcccaacccaaaccctagcgcgatcccgtctccccccggccaccgcgccctccgccgcacgccaatgcgccgcctccgaaccctaacttactccctccgatagcactcccgcccacccgccgccgccccttccccttcgctggtggagatggcggccgaccccgccgtagcgtccgccgtggcggcgatctccgccgtgatggactggcgctcctcccccgacgcccgctccgccgccttcgcgtacctcgaatcggtccgtgtgccgccaccccctccctttctcgtctcaactgctgtggatgctctttttttttttaaaaaaaatggtagggtggggagcgctttggtgatgcttcgctaggatgcttgttgtttagctttttcctaattttgtgttctactatttgtttttacgggttgatgggaatattgatgcaacacggccattttttctgttgattgtatatgtattcaacaatcacgagctttcacgagttttgatcttcgtcaatttgcacacgattggtctataagtgaactgcccacacttttccatttgctgacgcattcaactcaatatgattttagaatactgaagcatgcaagaggtctccacttggaatgctggctgacgaaattaaatgaaaagttgcagttcacttcttttccatatctgaggtctgagggaacctctatgtgagagcgattgttagaagtattaagtgaattcttcgcccttctctaatcagcttaagctctttggtgaactaactggtgcattcaactcaatattctaatctctactctttcagttatagtgtgtaaccgttactgctctgattagttagttcatttcatggataatgtttttgcacattttcgctggtataagaaaaatcctgtgttgcctccttgtcccaaatgtaatgccattgtttgacaatgagacttttgaaatgcaggttaagacaggagatgtccgggcattggcgaacacatcatttttattggtccgaaaggaccagtcttcagaggtccgactgcatggtttcaaaatgttgcaggtgcgcttgttgtagcttgctatgccaaacagtatcggcataccagttaattgccaaaagctacaccacacaattgaatatgatctgaaatccagaagttctttttttctagtgatcagcatgctgttttgacttccttactagaatcaatcacatggccaatcgaacatatgattgaccatatggtctaaactccttgtttctagtaaatcatgtacatttggtatgcacttttccttgtaggaacatgattcttcttatcactaataaattgctccatcttgcttttgttactaatatctacagcagctcatttttaccattggtgtgttagtgctttttctcacttctactactcaacttttaaccaatttcagcctccttcgacctacaccatctgacccccttcctcgaaccagttgatctattttcatggtgaacgtgactaggatatccttccaggctgagacctttttaggatgaatgaccattctcaaaagaaaagggccagtcattatttaccctcgtaaacatgacgcctcatttccatagcagtacacatctacaattgttagtgcatcgcagaaagtattttctataaaaagaaaaaccactagtatggtcaacttgattttccactgttaaaaaaaaaatcttacatacgacgtgagttttccatttagaaccgttttatcaatctcacagtcattgcctcagcaatgcttgtattgtaattctcttagagctctaaacttgatatcctgtgatgactgtggccataatgcattatttactgctatttcggtgtatgaaaaatatttttctctattaggagctattatcttcttgtattttagtatggtcataactaatggttctgttggtaacttttacagcacttggtgagattgagatgggaggaactcagtgttgcagaacgaaatgaatttgctaatttgactgttaatttgatacctgaggttgttggtcctcatgaggagtgggctttgaagagtcaaacggctgcattagtagcagaggtcccttacatggctattctcatatacttttgttgaaacctttgtactgcgacaatatttgtttctttaggtacattcttttttagtgaccgtcttatcttgtaggtagttagaagggagggagttgctttgtggaatactttactcccatctattgtttcgttgtcaaacaatggtcctattgaggtatgctccttgcagctttgcagcttttttctgtacctctaccagtcgatatattaaattgcattttattttccttccctataactgttaggctgagttagttgccatgattctgaggtggcttccagaggatatcactgttcacaatgaggatttagaaggtaaattctatttgcttacttctctgtcctgatcacttgaaactgtattcacttgaagtgtcaaactccaaatagaaactttgtctttctcctgttaaattgttaattacatgcaacaggtgatagacgtagggcattgttacgtggtcttactgagtcgttgccacaaatcctgccgctgttatattctgtaagtttttcctttatttgtcgaaaaacggaggctcgtcatttttacaacatactaatgtaagcatcttgtaatgtctcattttgtagctacttgagaaacactttgtagctgctttgagcgcgcacacgaatcagcaaatggagttggctaaacaacatgttgggacaataactgctgtgctgaatgctgccaatgcatatgctgaatgggctcctgtgacagatctcgccaaatatggtttaattcatgggtctgtatgcttgaatttttcttccatgtttggatggctttctttcccctttattttaccagcaattccattttgcagatgtggatccttgttttcttacagtgattttcgtctccatgcttgtgaattctttaaaattatatgccagaggtactgagaggctgatgcatttttcttaacctatatttcattctgtcggcaccttttctgatatgttattggcttgtccaatgcaacctagctcaggaaacggcctttggatgtcgcgattgtggagtatgatgcagcaatgagcaacattttccagttgttgatgaacattgcacaagattttttagtgagatccaagatgcagcccaacgttattgatgttaatgaatacgagtttgcaatgtgtatttgtgagacaatggttgctctcggttcttctaatatgcagtgcatactagctgatgtagcaaggactttgcacttcctacaacaggtgcgcagttcaaaatacacttctccatatatttcttacacgagattaatgcttaatgctgctgtgcagcaccttctcctctaactatttagtaacataaagtttagttactactacctccattccacattataagacattttggcctctccatcactcgtctagattcactaaagtacatatgaatttggacacatatatgaagcacatacatggatccatgcactgatctattgaaaacccaaaacatcttataatatgaaatggaagaattaactgattcacgtgtgcatgcctaaaatttcataacaccatagtttgtcgtgtctacatgttgcatcattctaatgttaatttattttgtttcctcatagatgctggaatattatcaacactacaagatcacgcttcatttccaatctttattattttggctggtatacctctggtctcttcttgcatagttaacatcaatgcaataccatttttacttagaatgttaacatgagctatgtgtaggtggtcttgagagaaccatcaaaagctaagtctgttgcacgtgtttctagtgacacccctgctgccggtaattctgcatctactggtggtggttcaactgaaagggagaagaaaggggtgtcagtattaatcactgatgaaatgtacagtacaattttggatgttacgttcaaaagaatgcttaaaaaaagtacgagtgcatcttcagggctgttagaactatggagtgaagagctagaggggaagagtgacttctgcaactaccgtgccaagctggtaggtcttgttttctcctgacatgtaaaaactgtagttgctgttgcctcttgcttaacattcaacaatttcatgaagttgcctcattcagtcgttatatccttggaaaaaattaagaaaaactactgacacttattttggcatgcaaacctgatgtatcacaacacaaatatcagtccaattgcactcaacttttctggaatagcctcgcaaacaccatctgacatctacagctttagtccttgggttgtgttctacatttggttggtcccttggttgatgtgtatgttagacaaggatattgacagagttcagacacacatgttgttgatcaacatccacataatttcagctgtttaggagccaagggacacgggacatcgtgagtgcctgcctgcctgctacttggagagtttgcctgttatcatagagcttgtttaggttcttaaactatttatcaactagagcaagcaaactgccaatctgcttggtcagtttgttaccaattgcaatcagcatgttctttgtttgacgcagagcagcaaattctctggcattcatcaagttctatgctgcaatttgttttagttcaaagtgcaaattttcctcagtcgaatctgattttactttaagtgcaagttatttgttgaggcactggagcagtgctgctcaccgaggcagccacataagttcatgggtatgcctattaggtattctagctgaataaaagcatgattgttattcttttacgttcagccacgaggcagccacataagttcatgattgttagcatgggtacatattgtcatatgccatttcatgctacaagtatccatttgtcttttgtgacaacatgcattctttttcgcagattttcaatatggacatgtgatttgtggcaatgcaggatatttgccatgcaattaattttgtacttccacaaatcatttactacttaattaacaagttccctgaattcttcctgcagctggatctcataaaagtcattgcatctcaaaggcctggtattacagcaacaagcattgtacagagaataaacattgtatttggagatgctaatgaagcaacgaaatcatcccaggttggatacattacctacatatatttgcgacatcaatttaatggagtcttgcaattttgctgaaagaaagttttaccttctatttttttgttgttgttgtgtaacttgagttaaatatccatgccaggatcttgatgcaatggaaggtgcgcagctggggctggaagcagttgttagtgctatattcgatggctcatctgattattcaaagattgaccaggacacaaaattccaaattcacaggatctttgaaggtttcagctgtctttaaactttaatttaggtctgctgttggatacttggatatacaatgttcttactttcattttttttttgtgaccaggcttacttcagcagcttctttctttaaagtggtcacaaccaaatcttgctgttattcatggtcactatttggattctttgggtcctttcttgagacattacccagatgcagttgcctgtattgtgaataagctttttgaaatattaacatctctccccatcacaattcaggtacattttctaggctgcagcaaaatacctaagcaatacacattaaataccctgatgttacgatgtggcaaatcagggactttgaatccttcactccaattcaatactatagaagacttcacagaaatgaatatagatgtggacttttcatgcgttttatttctctcctgttgcttgtcaattgctatgttttgagttacctggtaattaataacatgttatgtatttacatttttgtgtcattttctgtatcaataggacccttcaaataatttccgtcaagctagactgcagatctgctcatcattcattcgtatatcaagagctgctgataaagcacttctgcctcacatgaaggttaggatttgtccctaattggtttcccatttgatctcacatgcagttgctttgagctacatttagttgtatggtagacaacttgccattcttccagcgcagttgtgtttttggacttctaatatgatgtacttcctccgtttcacaatgtaagactttctagcattggctacattcatatagatgcgaataaatctaggcatacatatgtgtctagattcattagcatctatatgaatatgggtaatgctagaaagtcttacaatatgaaacggagggagtagtagttacaagtagaaaatgggtcttcatgatatttgaattgcaaaatgagggaaatttacctgggaagtacattgctcttatttacggtcttgggttgtacatgctctcaagttttatcaatacacggttattgtgacttgataaagaatcagtttgtgagtacaatgctgtgttgcaaagtgaagtcttgcatcatacatcataatcccggacacctaggatacaaatagctgtagtacgtggatgattttccactttttttgtactaattattctagtaagaatttattatggatcaaagaagatactcttttctagtgattaataacttaatatcgataagtagaagaacaatccatcagtgccatactaagattcgattaatttagttttgttaaaattttagtgtgatcttgttgatgtgactatctatttccacttttggcatagtgtaacagtgtgaatttctttatgaccattgtaaagacatttaagtgcaagcaggtcattaacatcaaaatacattagttatgcaacatagagcaacagggataaatgctgcagagaccaatagtgacaatttgaagtatggtgctttgaggcagtgtcatgggcattgggccgagagactgagccattagcagctcagtaccaggtgagttaaacataagattagatcgagtccttacttaggggccaagttattccatctatacaaggatgggattgtgtctattatcattaagcaatgaatcagaattagtctaatctctccccaaatgttctttcaccaacctaagtctacataccttccttagcagcctacgctgcctggctatcatcctggcagtgattatcccatcgtggcctcaggtcgtgacaacttggtatcagagccactcaccatggcttccgatactgagtgagttctttgtatcatggtgagccatctggtgtatccggtggatgaagagctactccacgagctgtttgatggctatggagcagaaaagaagatccacatactctagatgggaacacatgaggaggcctctgtttggtgcctgttagtcagaccagttgttgaacaggctggactgtcactggtctgactagtggatcgctagttataaccgtgtttcatacaagctttaaatatatttgtgtatgagagtaactagctttaaatatggaagcatagaaatgattgtgtttaatggggctaatcctagtgttgtgtgtggtttttggtgcgtggctggagcttgtgagttcagtgagtttcttagtaggtctctcactctggttgcgtaagttcgtgttgagttaattttgttttaagttcaagacttgtatgtttggggtgagtgggggtgtttcagcttcccttgtgttttcttctctcttaatgaaatgatacacagcgctcatgcgtattcaagaaaaaaactcaaaagggagataaagagagggagggagatttatggattatatggtgtagagctgtcctgtgttgatagtatgatatgtgctagtatttctgagttctgagttagtattcgtatgtaaatataacaagccgagctagctaggtggtacccgaggcaggattgtgctctgctgattagagattgaatccccctgcatgaccctttattcatgcccatttaattaatggtttgactatgcggtcctttagtggcccatgtgttccactcctgtgcttgagctgcttgctgagaatttcctggttaactggttttcatgtggaattggccagttcaattgttttttactggtagcatgtctttgaagcaaattgagctgtttgagatttctgtttgaggctgtctgatttttcttactatggctgggtcaaggtaaactagcctaaagatagcaactcgaggctcgagggatttgtgacagatgatgccagctagtccctgagaacctaatctaatgtttccaattaatcatggtaacactttgtataaataagatcctatccaaagtccaatgtttatcaaggctttacccacaaatcatatgcagaccagcagctataatctaatcagtgattaggaggcctagacgacgttaggtggtgcgccctttagaacattgatcctatcaaatcaatgtgtttactgtacttgatagcttaatctgcagctagacattagctgatagatcctatactctctctagcttgttgcaaccctagtgtgccatcttggccctaatggaatgcatgtctattgctggctggcagctatagcatgtacatgtggcagtagtttatccaattacgatcccactgaactacataacattttttaaaatcgtcgttgcaaagatttattgctacagttctacaatttatgttaacaaggtaagaaatgtgtgttgatgaactaaggaaatcagtgtggcctgtcttcaatgtagggtagcaaatgtgtacatgaacaaagtaagaaatgcagtgtgctatcaagattgccttaatttattttggcctgcatatttttgcattctatagtcctgctcaccaagtcaccatagcatctattctcttgtggtcgctgacaatgattaccaattatgcagaacattgctgatacaatggcttatcttcaaggagagggtcgcttactacgtgctgagcataaccacctctgtgaagcgtttcttgtcatggcatcctctgcagggtatttcggtttctgcaccttttcagatttatgtcttaacattatgttattgtgacattgtcaatgtgggttccatcatatgtttggatcttctaccttatttgtaggattcaacagcaacaggaagtcctggcttggttactagaacctatcaacaaaatgtggacgcaagtggaatggcaaaatgcatacttgtctgacccatctggcttgacacacatgtttgctgacagccaatttatgtggtcaatttatcacaacatcacattatttgagaaggcactcaagaggggtgggtccaaaaaatctgcatcagctccacaagcactggccacaacagtggtaactgctaatctgcatccaatgtgttcacatctaccatggattctgccccctctgttaagggtaatttggcacttctttcttgccaacacatcattcttttttttgatgtaattactatgtattggttaagctgatagctaactatagttttgacatcactatttttccccttctccctgatcttcagctgttgcgatgcatacatatgctttgggccgagcccttttctcagtctctggcaggagaagtcaaagcggcaaaaagcatgactgtggcggagcagaccagccttcttggggagacaaataaactcaccaaaggccaggttgcatctgctgatggattgttggatgttcaaagggagggagagtctaaggaaaacaccataaggaactggttacgcgggatccgtgacagtgggtaaaaatttaacctaagcatctggtctttcatatgatcaaatttctaattcctattgatagttatactggctataatatcaaatagcccaggtgaattcatgggattaacatttctgatatcccttaaaatatgagaatggttgagctacatttatctggaaaatttgcatcttacactaagacccatttgtcctgaaatctgtctttgacccatctgaacatatcatactgcaggtacaatgttataggactatcggctagtcttggggatccatttttccgatgcatagagggttcctccatcactgctgctcttatggagaacgtgcaagctatggaatttcggcatttgcgccaacttatccaccttgttattattcctttggttaaatattgccctcctgaactgtggcggatgtggatatcgaaccttttacagccattatttgtccattgtcagcaagctcttgatttctcttggtccagtcttcttcgtgagggccgggctaaggttcctgataattttggtaatctttctgggtcagatctgaaggtagaggtaatggaagagaaattgcttagagacttgactcgtgaagtatgttccgttctttgggttttagcatcaccaggcttgaatagtggtcttccatccttagaacaacttggacctgccaaccggattaattcttctcttaaggatctggagttgtttgtttccagctctatcactgggtaatacaaaaatttctagccagctgtgtgctacctctcacctcaacaaaagactgatttgctatccttttgcagatttcttatgcttaatgtctccactgctgttcctgcattgaggataactgttgaagtgttcagttggacagatagtgaagcagtcacaaaaattattcctttttgtggtgcattgattcaccttgctgttgcaacaaatcgggctgagttgagtcagtttgttgcgaaagatctattttcttccatattacatggcttatctgttgagttgaattccattacgagttcagaacttgttggactttgtcgagaaatatatatctatctctcagatagagatcccgcacctagacaggtatttttgagatatataattgggcaaaagtaactgctgaatgaaaatgcgatttaaatatcttgatttcacataattggctttctctgcaacagttgtgctgtcgcctttttgaatttgaagctatgcatatgtttttacagaaacatgtattatcacaatttgaaatctacagctgcttgcttatacaataaaataattacaccacttatagcagtggctttcatagaaattttgagcattgggactaacaggaagtgctttgcttgtaggttcttctgtccctcccacacatgaagcaggaagatttgctagcctttgatgagtctttgagcaaaactgcaagtccaaaagatcaaaagctacttatgcgaagcttacttttgcttgcttcagggaacaaattgagagctcttgttggtcaaaaggctactaatgttattaccaacgttacaagtgagaactgacttgcatttcttttatggtaatatgtttattctattattgcgtaatggatgaacacaacgttgttttaataaacggaaataagtacattagctgaaaaattgaatcatttttcttgtcgttgcctttgtttcatagtctgccactactcaaggatttttaaaccgagtaaagtggagatcatcctgcttgtactgttttcattcttctaccaactagattcttctattaactgactgaatacttttgagccctccttgctaacttttgataattccattgccagctttttgttataccatgcagattgagcacttgtttagttatcatatactcagagctagttttgaatatggattattctactctgttaacaaacgttgctttctctgatgtccagctcgaaaccggagctctgctgcacgccatggacttagtgctgaggaagatgaccacattggattagctgcactatcatcatagaactgaccagctaaagttgttttctgtacagaagggtaatgaccctatagattggtaatgtggtggcaaatttaaaggcgaatatcatatccttgctgcattgtcaaataggaacgtatgcatggttgagtttatacacaaggtgccatcatgagcaaaagagaaaaaaaacttgattacagcttctttccccataacattgtatatgcccttgtgcatagcgcttctatgcagtatgtgcagaacagtggaatgtacatgtattactgatttgctcctaccgaccacgttttgccgtggtttaaagaaggaattgcctcaatttagatttgatccttaccaatcatattcgagtacaaatttgtttgactgaccttttttttaccccctagctctaggcagttcttgagtataatatgctagcggttagtaccatactgccagctctgatacattactgcctgttggccgtggccacatgagacgatgcatgtgtcccgtaagttatttgaaatcacccatttgtttctaaggaggtcagcatgcacgaattaagttggcatcaaaagcaatgctcagttttgtggacggcgtagagttttgtggcatgcatgaccggatttatatagttacaccagctgaccagtgagtatgtgctggatttatatagtttacaccagcgagttcatgcgtgtaaaggttactactactgctcgcccgtcaaggaaaattgttactggctgcaaatgactaataattttggcgatgatttgttgcgaggcttcaagttacttcccaagttaaaatcaggattctagctagtgtcctgtggggccttgttctgcgacgttccatgggttgatttgactcaaatctcaggacttgaacaactctactgagtgatcactgagtcgtaaatgaaaacattagctcgcgaggttgaaaaggtccaaagattcttcttcctatcgtgcggaaggagacttgaccgaagcagtacgtagactacgggtatatacgctagctgcggccgagaattacttgtaggagacccctacactcgctggccctctctagctaccgccagccattgctcccagccaaccatctcctcttgctctgtctttgcagaacacaactggaagagaggaagaggataagaaggtgacaggaattggaacatcgaaatcgaatctctgccctgcccgtcacccaaggtaattttgttcgaaatttatccattttggatttgaatccgtcgttctttcctcctcccttacagtctgcgtaggtaattcgatacattacgcatcccgctgagatgcttacaacctctttttgcgtcttattagatcgatccaatcctttgaaatcattttgcattatctgacgaagacattttgtcattaaaggattggttagggaaatgtcagagacgctggctagagccgtcggatcgtactgtaatatagtattgatatgaccttgttcggaatacatgaataattctcttgatttatacatcagctgaaatatatcatgtgatcatcgttcaacattgttgtgttcagacagcccagatactagtactaggtatttgcaactcaatatctacttgacgagatcaccacaaaaaaaaaaaaaaagagagaagaaactcactgaccatttgtacacttccaatatccctggtcttcgccttagccagatcccacagattcttgccagttttttttttactgtacctgcaaggaacaaccacaatgttcgcttaaaccatgaggttcattgtaagataacccaggaggtgacattactcctatacaagttatacaaacaagaaacgtattacctgatcatctctgaccatgaaaccatgaccaagtagcagtgttcaagaaggtgctaggcgctagtctggcaccagggtgatgcgtagcgcctagagccaacttgggagggagaattgaccaggtcctagatagtgagttaagtatacaacataacaaattgcagcatgccaacatccaacttgtagaaaatacatgtgtttaggatttgaatatttgattctaccatttgtttgatagttgccaacatgccaaaggctgaaatcggcaacttacaccacagcagcaacatgcatccaactatccaagcagccgccagaaccagaccaccaccaccaccagtcagccgcctagttgactaatcgctgctgcacctaggcgccaacgtggaccgatgttgaccatcgcgctgacgtggaccaatgtgctattcgcagcgctgagctggtgcttggcaccgaggtgccgcctctaatggtgatttttagaacactgccaagtagcgctaagcctgccacaaaacaaaaggtagcacccaagaaaactgatggtatatggccaaaacttggcaagtactgtcctaatcccatagcagttgaggcagagacagaggattgcttaattcaactcactgtcaatgctagtacttgataaggatcagaaaaaaaatagagcaattaaattggataaatgtttcactgtcagttaattttgtttaataataacttagtgcaccataattaatcctgtacaacagttattatttaaatttgaattgatatttgcagtaagagccattttgcggcccttgaccgtaattaattgccaaaaaaaagacatacaactacgattcagtacagacaatatgaaagtaagcaaacatttgttcactattgtattttctttttctgacagacaaccaagatatgaatatctattgttgtttggccttatatgcaaaatgaactaactatggttgtacataacacatggttttcggaataaatgccacagttggtaaaagatagtttgataccactgaaagtttactcgtttagctttagagaaaacaccatgaaaaatttctggtcatgttgttgcagcttttcatcaccattgaaagccacgttacttttagattttgaacttaatgctctcggtagagatggctttcccttataacattcttgcagtcaaatattaaaagtta

SEQ ID NO: 73878 - DNA, 80286 bp, Oryza sativa
gtaaagaaacaacattgtttgccaaggatggcataataatgaagacctatagattttattttaataacaaacagttttcaagtgcaaaatggactcagttttaccaggactcgataggagagtcagagtctgattcggaatctggtgtttgatctggcaaaatatagaaaaataggattctagaattctcctaaaataaattatattatcataaaaaatagtaagaactaaacatactcccatcaaataaagataactaagcattaatcatattatgctagtataataaggacagcagaaagcctcaggctgcagaagtgaagtgcacaaacatggagctgataaaacaggtagagaaagcacaaagaagcagaggaacctcgtgcataaagaaacacaaccaagactatgagtttggcatgcattcataaacacattaaaatttaaaatactatatgtccttcagaaataaaaagcaaataggcttaaaatggttagcctcaacacatcctgaacaaagagcacagcaaaggaccctcccccagcttcgacactggtatgtgtcacactgttggacgtgactcaataagccaatgcgtgtcaacctgcgaaaattattttggacacgtgccctggtagcactggtgctatctccagggtatggcttgctattagcatatttgctcaggtttatcaccagaatagtccacagacaaaaccaaaccataaacaagccaagcttcagttgatttctcaaaagaaactggtttttttgggaatgtcataatgacaaataatattcaagggcagaaggaatgctgcattcaggaagtatggatttctccagaaaaggagttcattgattctctccaaactgtttggattgtaaaatgacctagttgtgccagagaaaagaatagaagaagcatctaactctttcatgctacatgtcccttaacccaagtacaagataactcatcatacatgatgtggaactatacactattgtgtcaattactaacacaaactaatcttaagcttgaattaacttcatcagacaacaaaggggcatattctaataaaagcgtacctttgcgagccaatattgtttcccacaaacgagttgccttagacaccaaatgggaattctgtccagatgaacttgagatacgttcatcccaaagttccccttccagtttggatttgtttcgcatgtcttgcagcttctctaactcctgctgtaggtaggcctgaaaattccagatgaagtgataataagaacaggatgcaacacaactatctgaatgaacatcacagaagtttctgtgacctcttcagcacaaagacttcggaattcagctgtcatttcatgggctaaatttgaccaggttgtttgcctttgaacagcaatatttgcattttttagaaatttacgcctctcaagagctatccttgcctgtttggaatagcacaaggagaacataatttacagtttaaaaatctcaaataactaaatctggattgctatacaaatgtataaggagaaatatgctcgtgtatcatgggaagtttctgctacaaggaggaacaacagacacattttgttccccactaatagaaatggtgctcctcatattcagacaagttatcctaccaactatggacataagaaatatttgattgcctaccacagtatattacaatcatcacacactattaggctgcctcttactcaaatccatatttgtcttatgtattcatggtctctgtatgaacattatgttttatagcatacaaacatcaaccataatcaaccttccttatagacaagtaaacaagtcatcaagaacacccatttcaaaaaaaaaaaaatcaagagcaactaagaattggacttgatatggggcctactggatcaccattctcaagaaatgaagcaatagaatcttgcttcagctattgcacacatatcaataaactgagactaaggtgttattttgttttcataatgtaacacctaacaaaataacacctcagtctcagttatgttctctacaaataatctatgctaggtgtcaaatgtcttgagcattgcaggagtatacaagtatgctcacagggataaaaagcctcaaaccaagtatatcctctatgaaattatgttctctacgaataacctattttaagactgatgaacatctgcggcagggtcatcttaagacagactaaacaaccaaccagttttcagaaaattgaagagtcagccatccttgccttagtcacagggagtaatgcagcggcatgtagataagagacgtctgtgagtgctgcaggcagcgggcttgatgcaacatcagcagcaaatgttctcctgtggacttctctcaaggcatgcacagagagttgccacaatagctcaacaaatctgcaccgatatagggtagcattacatcgacgatgatgaaaatgttccaatttatatgatatactggagcagaaaaaaaaactattgaatagaactgcagtcacttttcgggtacattgcagattattacagagatctggacttagaatgtggaatcacaaaacagaatctaataaagagacaaagagaatgctacgaatgtggaatcacaaaacagaatctaataaagagacaaagagaatgctaccatatagtattaggttgtgctcttccccatgggttcccaacccacctccctcattttccgcgtgcatgcgtttcaaaccgctaaatggtgcacgttttgtaaaaagtttatataggaaagttgctttaaaaaattatattaatccattttcatttttttatagctaattcttaattaatcacatgttaatctatcgctccgttttctgtgtggaggggaggggttcccaacccctccaaaagaacacagccttcggccattagctatcattttttctgataaaacacccaattttccaaggttaaatcaagattattattttttgaagccacatcagcttcactaatgttaactaactactattgaatttcatgtgttgattgcgaaaatgcattacacatcaaatatgatctctgcccttgtttggtgaaacaaagaaacactaaggatataacaacctgaaacacttgatattaggaatggcaatggcaccccctacccaggtacaagacatagaattcccgtactagggggtgagggcaaggaaaatctattcctacaggagcaaaaaatgggtggacacaatccccaacagtcctatgctatgtggtttcctatctcaaatgtctcatttgactttactgctacactctacatgctccattctgacccacctaaaatgttcccacccagcaattctagcataaccctagatcaatacctcatgccaccaggaccaaccatcgattcaagcaactgcaggagtgacgccacatttatcttcttgtgacaatggtatgccccttctccattactcgaattcagggggtgagggcgggaaattttcttcctacagtggcagtaaataggcgctatgtgttgtcctacctcctatgtgtcatttcaatttaatgctctccatggtccgaaacaacccatttcaaatgtagaatatcctaggtcaataccccaaaccaccaggactgatcaaccgactcaaggcgttgcagcacagataacacactaagcttctcacgactcgtaacaacagtatgctccttctgcactattccaccacagctcatgtgtccagcctcgccaatgtcaccacactgctcctgccctctactcctttggtcaactagagcgaccccatggttcttctgtcttgtgtctggtagctggaagcagctacccaaatcagtatgctgcccgtcatccttgctggccaggggcctagcatggctgttcctctcctagctgcataaagttcagcacaatcaaaagatgtgcctaattgcatggatgaggcaatacccagcaagatgccttacttagctccttgagaagcacatcaggccagcaagaggggatatgtatttgctgatggctccaagccatgtacctcagggagctcgagggtttaaactataaaaggttgagatcaacgcaaaagatgtagaacacggtctaaagaagggcaaatcaaccagtgattgatacgaactctccacaatttcaattatgaaatgaaacgtttcatacgtttccagaatacaattaagctgcattgctgctgaaagctgcaaaaatagtactaaaaggtggttcaacccaagaaaatgcagctgtgtgcttggtactaacctcggcccacagcaggtggcgagtgaagataccctggagttgctccgtggcagagctccctgctgctccagctcgctgatgattccttgcacgatctaaacaaccaacagatgtcaaggtcaaagcatcaatatgcttctgcacgtagtaaattatccgagaagcaaactagatctgcaaaatcttaccttcctaaactctctggattgtgcggagtcgaagatcggccacaccttatcaaagtcctgagagtccaacgaaataaatcaaatacgatttacagaaaacctagaaacaaaatcaaaaaagaagaagaagagggcatcagtgcacgtgccttggcggactgcgcgggcccgcggagcgaagagaggaggaagtagaggagctgttcaccgaggcggggattggagtggcggaagaggccgacgcgagggccggcggcgggggacgagggggaaccgaggacggcgagatcgaggccgaggaggaggcagttggtgtacatggcgctctccagctccgcttcccgctccttctcccgatccgtcgccatggccgcgcactcccgccgctgctagtctcgcgcgggggtggatgcgctgcggctaggtttagggggcggctggcgtaatcggagtcggagatctcagtgaggccgaggtggtgggatgggagagaaacaaaactccaaaaagcattgcgagccgagaggagcgggtccagtcgcgaatatcagatctatgcgagggggacgcgataactttggatagctccgcctccgcgcgggggcgggcacgacgcgagacggcaacgggagcccgtgaaggcgaaagcgcgctgtgtgcccggcgcgcggcggccgtcgcgggcggcagcggtgaaccctagcggcctggaatgggggtatgaccggctgcgcggaggtgggagaaagctgcggatgggttgggttgggtgcgcagagggaaggaggggagggaggggaaaggagtccaaattttattacaagtataatatgtgcgtatttcgaaacgacctttttgagcggcatggcggcagatcaaaaattcgtcccgttcccaaagggaatttcatataagagtaaatttcctacgtaccctaaaaactcactcaatccctttcatacctctgaaatttacccgatctcttctatacccctgaaatttcaatttgatcccttccatgcccctaccgttacattttccatcatttcactgttacatttggttgcaaatgtcctttttgcccttgatgctttgggttcaaatataagcttaaaaaataattaaaaattttgtttgagtgtacagtatgtgcattttataaatataaagagactaaataattagtgcaaaaaattttgacataaattttgaaaataaaataaatgtaataaattaaaatttttatttgaaattttaatagtacaatggattttttttatcgggagcattcattaaaagaatgttgtgaacattggtagttctatttttatatgaatgctcctcatttttatgacttttttttaaaaaaataaatatgtatttttatttcattatctaacaatattttttgggataaataatgcatcgaataacaaactcataactataatagtctcatgcgagaagcttttatatttttaataatgtaactcatgaatttctttgttcatccaagggtaaaatggtcatttttatggaaaatagacggtcaactaacggtcaactgacgggaggggtatggaagggatcaaaatcaaattttaggggtatacaaggaagtaagcaaaatttaggggtatagaagcgattaggtaaaatttgagggtatacaagggattttctcttcatataaatatgtcgatatttttaaataggtccacccagatttatagcacatgattcttatttttaagaagtcattttaagatattttatgaaccgtgaaatttattgatcatattagtttttcaaaataatgaagattttaaccaacaactttaatcaagaaatccacgattaaaaaatttcttctacactccatattttaaaattttaagtaaatatgcgctgaacatttgcaaatttataaggatggggatttataaaactttataatcataatgtccttttaccactgtcccatctatactcatttctctgttgccattatcatcagctaacgttagttggttgttgacgatccttaaatcataatatatgaccgtcaattcctacatataatagaataaaatatggtattcaacttagtggtagggtttattactaatcatttccactagtgtggattaaaatatgtgtatacaggtattttaaagagaaaacacacctgtcatgcgacaaaatgcaacttcggacaattaggacgcgtttgcatgaattggagggcccatatgtcaataaaaccacttagaattgggccaaatcataatacatgatgttggggggccattaagctacctcccagccaaagggagggtttttgggtttggccgaacacatccggaggccgctgatcgccatcttccacatgtacgctcctgatttcatcccaataggtgtaaccatcatttggagcctataaaaggaggagctcacttcattccaacacccacaactttgagctgaattacaagagactctattgtatcttttgtatgttataaaataggtagagtgaagggaagctttggaggagtgaccggaaggttggcgctctctctgacttctacctcggctagtgtagctttctaagaggaattctagaggagtaccggagttgtcgatacactctactctgggttcggagaaacttcttctataaagtaagcattcgggatcatttctgatgttatttaattactagaaaatatgtccgtgcgttgcaacgagtgaagtctattttaatcttattattgttatatggtttggttaagatgaaattcactgtgggagttcgcttggatatatctatttttagaaaatcatgagctgcagttaggagtccgatcgtctcaagttagtatgcgagtttttttaaacagatttcttatatgattccttctgtattgctaaaagtgaacgatcttaaaaaccgactcaaatacagatatatatttccaaaagcaaacgaacttaaaaaccgactcatacacggatgacgtaccaaaataccgacaaaacatctccaatttttgtaacagtagagatttagtctaagtaagatagatttccatatttatgggttcattgtttagtattcatactaagtactctagtactaggactccggataaagaaggaagttcctaggcaagtattagagtagtaattaataacttaaatgtggtgtctaagttacctttatttgttgtgtatcccatgaatttgtcagaggtaaacgacaggtggtgacaaccatgaatcccgtcctagtaaccctccacgttagggtacatcatagagctatagcggaaccacgctggcagaccagataggaatttacctttaacttaggttggataactaaaacacatagaaagtcatctctagcctagctagcctaccaatagttgttgtccttggatagtcttagccttaagtagattacacatgttccctgagtttgatatccttttggggtcacccgaaggtgaagtgctacatcggtattccgtgcgcttgcggatttatcaatggtcgtaagaaataccaacaagcatctctagcgtcgttgccggggaacggttgctaatttatctgagtctaggtcatcctcgtatctttattttttatttcttcttcttttattcctttccttgatgaagcaacccacaatttaaaacctttctgctcctcaggttgatctttgtgagctgtcctgttcttcaaaaccaatcatttcggatggctacgaaatcagtcctagctttatagccatgattcaagagcaaaacttcgctggtagtcagggttggcaacggggcagggtgggggcgggttggacaagaatgcccccacccccgatcgctagctcttccacccagccccggccccgaagcagaaatcgaagccaaagttgccctcgtccgtagccccgtcgggcccccgaaacttggtcgggggcccgaaggtagggagcctgatgaccggcgacgtgttgaggaggggagaggctagcgaggtgcgaagagagaaaagaccgcaagtaagggagagggccaacatggtgtggaaggaaagaagttgtcgatgagctttggacggagaagaagctggagcgtggagcggaagcgagacctgctctcgtcatcatgccgtgggagagagactacaaaaataccgtgggagagaggccacgccagcagcggcgcaggcgcgcgatgctgccgagatgggaagtcggcgacggtgcagaggtggatgggacgcgatgatgcagatgttgatgggatatgacgacgcggacgcatggagcaccgagtagtccggagtccctcgatagaagatctgcacgagtggataaggtcggtgatgtcaagggatttcttcacagttgtatacatgttcaccaatttgggcctattgggttttattttgattgggccatataatgggatatacactttcggggccccatagggtcacccgtgggttaattttcacaacccgcccccacccccgcccccagtaacaatcggagccctgacccgactcacccatggggcaaaaaacagcctcatccccggccccatatgtgggtgttggcatatattaaatgccgattctatactgccaacatctatataaagtcccgataataaagcatcaaacatagtgataggtgttaaaatctcacatattccacaagtgttggtgtatatttgtatgtaggtgatgaaccccgaagttgggaggaaaatcacactaaagtgagagaaaatatgtatccatacaaggatagattgtggacttcatcaaaatacccgagagtcagcccaaaacttcgagaaatggataaaggagggccagaagaggagctaggccaaaggccaggccaaggggtcccagcccaggttcggcctaaccccctggtttgggcgaaccctggtgatcgccgttgatcccaggttttggcgtggacgctccagatcaccccctgatgacggttgcggggcagttcggacaattccccttcctataaccgtcatacctatcctataaatagacatcactttattcactctcacaaacactttcaagcttgagctgaattataagaggctctatcgtactatattgtatactagaataggaagagagtagagtagaagaagtcgaatgaattccggagttgtcggtaatcttctctcatttcttttattttgtttattactctaatttcaatataatattcttcctgagtaatttagatttatcttgtgagaattatctcttggttagttcctaaatagcatacgggattattgttcactataatcaactaaaatatagtgattgctttggtgagttataaacactaaagtagatattaattacttagacgtggtgtttaggtaattgttatccagtaattgctgcgtatcccacagtacgtttaaggtaggtgtagaggtggtgacagccatcgagatcacttaagtcctccctgtccgagtacgtagtagagcaatatctgggaacaacaggttgtcaatgcctgaagtattgcgttaggattaaacttaagctttcactagacactatttctcaccagtaaatcatctatatcctaggctatcctttgcttggtgtccttggatgaaccggaggaaaatctgaccacacacgttcccttggattcgataccctttggaatactccgtagggaagtgctacatcggtatatctgtgcgcttgcggattttatctgcgaccgtaagaattaccaacagtgggattctagaggcatttcataaaggatttctccaaaattgctagacccctaattgccttgctagctaaggatgttgttggtatttcttaacgacattactagaaatataattcccagcaatggcgcagaaatacttatggtatattatggttacagagttcatccgcaagcgcacggatataccattatagcatttcacccgagagtattccaagggtatcgtatttattttatcccgtggaaagatcatgtagagagaactcaactaataatttatatattacttgtgacaatcatattctaagcatgggttaagataatccaagggtagagtgacacataagcattaactactcatcctcataatatatcatctaagctaagtggaaagaaaagagaaaggaaatctattcctatatttctagtatacatagtatacatacattctagctaactgatatactagctaataccctctatccgatgccctcctggtacttcgagaagccaccctgactgccgagttccttacgacagcccgtcatgaccatacaaccggggctaaatacggaggaataccctccctaggaaattaacttaggattatatataggcgcggaggaatacccatactgagctgtcaccatcagcggcccacctctcgaccgcaatatataaccccaaataatgatatcacgtaatctagacaccacgtctaaactaccagatactactctaatatcatcgtcatgacatagagtaattgcataagcaaacactatacccgcaccaaagcatctcccagataagctagccgtatattcagtataacatgaacataatataaagtaggtacttatatactcggaaagtatttcaataccataaatgtatatagaagagtattctaataaaagtacaaggcttacaaaagaggaaaggaaagctgctagagccatacccgaactcttccgaagacttctggactcctgattcctattctaattctattccaccagctagatactactaaactaaacttgagagaaatgagagatctcttgcttgaggtgtgttgaagtgaagagagtgagctccttatatagaggtagttatgacggttgtggaaggggaattgtccgaagtgcccttcaaccgtcattgggatgcaatcctggacgtccatgccaaaacctggatccaatggcgctaggattggttcagccgaacctggggatggcccaatccagcccaatttcagctggtggcctcctctattgctcccctccgcagaccaattctaagttcttggcctattcacacacaagtctggttctcgacatcgtccgattgatttatcgtctgaattgatgtcgattctcctctattttatgatcattctctgcaaaaggttagtatacctaatactagtggaatattattattctaacaaatatatgtattgctagcatcactaattctcccctattttggtaatattgatggtcgaaactgatcgataacgaccgtcaacagatgccccgtttgactttgatgatgagtgtctaaaatcatttaaaatctttaaggaatcactcatctcagcactaatcatctgaccccctgattggtcgccgccatttgaaatcatgtgcgatcctagtgattttgcagtgggtactgtccttgggcaaactaaggataggaaacacaaagctatcgcatatgctagtaaaactttgactggagctcagcttaattatgccacaacttaaaaagagctcctagccgtagtgtttgccattgataagttcatgtcatatttagtgggagctaaggtaatagtttacattgaccatgctgcactaaaatacctgctcactaaaaaaatatgcttctactccaaaaattaggagctaccgataaatgactatctgcgtgacggcatgctgttgaaagtcacagactctgacccgtggtatgcaaccatcgtcaacttcatggtcgcgtgccatgtaccaccaggagaaaataagaagagggtgatctacgagagccgcatgcacttgtgggatttaccttacctttacagagtctgttcagacgttctactacggagatgcgttccagtagccgaaggcataaagatcactgagaagtgtcatgttgccccatatggagatcactatggagcattcaagacacacgcaaagatctggcagagtggattcttttggccaacaatgtatgatgcaaaggaattcattcggagatgcacaaggtgccagaagcatggagggatcactgctcgggatgcgatgccactaacatataaccttcaagtcgagctatttgatgtattgggcatcgacttcatgcgacctttcccaaagtcctttgagtgcgaatataacctggtggccgttgactatgtgtccaagtgggtagaggcaataccatgcaaggccgctgacgccaagcacgcccgctggatgttccacgagattaccttccctcattttggaactccgcggatggtgataagtgacggagggtctcatttcatcgataagaccttctaaagctttttgcaagagcttggggctcaatacatcattgccactccattatcattcccaaacaagtggacagacagaaacgagcaacaaacaaatcaagaatattctgtagaagacggtcaacgagatggggaaggcatggaagaacaagttacctgatgcactttgggcatataggactgcttgtaagacacccatcggtatgtcaccgtaccaacttgtctacgggaattctaatatatattaaattctaatatatattttttcagcccaaaagaagtttaatgtaattcctataataatattaggtgcaattatgaagtaggaacacatatacaaagaaaggttattctaattctttaaaataatctatgcaagatgaaatcatggaaaaatttatgtaaactatgtttagcataagcaattcactataatattggtacaagttaataactaagtttaataccacaaattaatcagtcaaagcagaaaactaaaagaaatcaaattaaattttaatcggctaaagccatacttcatccaaaaagtacatttaactgcacataagtgaacatggaaaataatttattcaaatactagattatttatcatgcctaaatataatttttctagaattttcctcctctgtttaggcttcctaaaaattcaatctacctttctaatagcccatctttgtttaatttctgtgagcagtctacccattatttttgagtgaaaccaaagaaaatggaatctaggttaatcatttacctccagaaaaatcaacactaattaatttgttccacacattaagttatgaatctacaaagttaggggaaagaaaataatctaaaaattcgtctaaaaccgtgttcacctagaatcttacccacacctctctcttccacctagagcacttcgtcctgggcccacttggcagcctctccagctcgccctttctctgtgcctcaccctcagccgaccaagaacacagagagggagagatcgagcgaaccgacgcgtggccacaacgtgtcgacgacctcgggctttccttttctcgctctcttctcctccagtctgagtcgccattcctcactcatcactcagagccgaagaagccgaggggagcaggtcctctgcctctccgtcaccagcgacctcaccactggccatggaggtgacgaccatcgccatctccgtttgagtcaaggtcacatctatctctttcgcgtttccatctcttcacacaatgccgaacctcttctctgttgaccacctcccattttgtgcatcacagccaccggaatgtgaccacgccaacgatgccctagagcacgcaccggagcgccgccgcttcgacatcgttgtcgtccggccattctcgtccatcccgaagcaagccgttgtgccaagaatctcgcgtcgaccacctcttcaagacgcctcaagaaacatcaagaacacggagaacacatccttttcttcctcgacgccgatccgaactcgcctccgcagtcatcgtcgattaccactgcctcagtgagccattgttcgatttctcgcgcatacaccatctccttgacctcacaaccctcgtgcatgccttcctttagcagctcgtcgtcccgttcgagccgtcgccgttcacccgaggaggagcaccgccgttgaaccgttccaaccgaagccgctgctatccaagcttcggcgatttcttcctacagcttggtgagcctcctgacctcttaggaaacacatgcatggatgcatctagcaaaatcaaagcccctaggcaacatgcagtaacagctcatgtataccttccgctcaccctcaccatcggcgctactccgatgtctcctagccacgaaaactagaggaatggaatcgtgagagcattctcttcattttatcttttgacctcattcccaatcgagccaccaatcgtcgccgacgagctcgccaaagccatggccaagctcccagtccatcgggctgctggaggttgaagatgaggactttgtcctgtaaatgatcaaaaaaatagggttcaaactataaaacttcagagatttacatgtggacccacggacctaaatgcagttcatataaagcctagggatctttttgtatattggttcagccaccgatcagtggacccatgtgtataaaaatctgaaaatgcaaaggaaaaataactaaaacattaaatgtttaacaggaaaacacccaaacttgtaaaatccatataaaatcaaatgtaactcattttgagatgattccagttgctgtagattcttaaagttatgaactctattttagaaatataaaacttgacactcactgtacaaaactacaaataatgtctctaaaatttatctaagataggtcatacataaaacatgtacaaacttataaaatacatagaaaattcatctcaactcattttgaaacaaaatcaaattctacagattcatcatcatgcactctctgattaggtgaaataaaagtaattacttactttgcatcaaatgcctctaaaactattatctctagaatgattagtttatataagctaaactttagaaattcatgtagaacccaatttagcttaaatttgagtaaacttaagttctataggatcacaaaaacatgtatttccatgttatgaaataagattatatacttactgtgtagtaaaagtctctaaatattcatataaggatttactaacatagagcagcctttaatttgtaaaacttgtagaaaattcatttttagtccaaatgaaatgaacaaagtttctatagaaccagcaaatagttagcttcaacatagtaaaataaaatttggcaccttttgtagagaacatagatcaaaaccttaatctagtgaaataagaatttaaacacagtgttgtttaagtaatacataaacatgtataagtatatatacactttaggtctaattaaacctaaataaaaacttgattgaccagtgaagccatagttccatcctcatccactaaaacttagaagaacttagttcatataacaatttctaggttaatataatatattgttagtttagattagagcatctctagtttataaaatatgaaccatagtagtaaagaccataaacatgtgaactaaaaatgttttagttaaccaaactacttcttttgctcaacttaaacatactgtagcatattgtagcatattctgaacctacaactaaaaagtcatgaacatatgaaacactatatgcctaaaacacgttgtaacttgtaaaatctataagaaaatcattataactccaaaaattgtgaaaccaaatgagttattcttataaaacacacctctacaccctgtgaagtctaatataataaaaatcactttacaaaagtattttataacactacctaagactatactactataaaccgataaaacttctaaaatttataactccctaatggaacaagataaaataaaaattctttcacctaaattcattttagaccagtacctaatcactgtgcataaatcatgcattttagagcattttagattttcagctctttcggtgtttaattgcataacgtgtcctttatctagataactagacgaaacccagcgtattgctgcggaaaactaaggataatccatagaaatagcaagcaaagatatatcccacaatcaatatagtattttgtcaattcatgcaaagaatgggccaatgtatgtacaatgaacaaatttgagcgggcactgactggatccatgggatagaggaatgagtggataaaatttcctccctaaaacaccatgggatcatccaagatttctaagggtgtatttgcactgacaataagtaaatgcatgtgcgtccggtttataaaagttaaagcctacgaaaaccttttaatatcttttttgatttatgacaggttctataacagaacttgggcaaaaagtatatcaaatagcaatcaaaagaatggaatgtatcaggacatatataatacccatattaacctgattataagcataagtgaaaatatatgcatgatgataacttttgtaacaacgtcgtcagatatctgtaggctcgtaaacttaacttgtttaaatcctgtgtaacataaatctgatagagataataacaaaaaagataaccactattctgtactaactctataaagaattggagtaaacacaaattctggagtataaggagaggcaaacccatatccagatcagcacgaacagggcagttgcaacaatccagcgaccaagcagtaaacaacacagggcgaatgcagaagctaaaaattattgcagaaatgctgaaattttttggtatacatacctcagtttttcaatacgcttgaatgacgcctagtagagttcagaaattaactcaattttcaatattgtcatgtggatgaatgggaactaaatggatttcttgacactgtcatcaaattggatgtgaataaagtagcgcgtagtgttaaaaataaagcaatagccctgtaaaacaattttagtcaaagaaaaccacttatcatcaggactaaaaataaaaatggataatgaattagattaacccatgatgcttaagagcagggagaacctacgctgcgtagtgtttgaacagtagtatacagctcctatactgcaatggcaacagtaagatcagtagtagcatcgtctcctcttactggagtagttgtagcagcagcagcaatattagcgtggtttctggatgaggttacggaggtcaagaacatagtgcatcatacctgtagggaggatcggaccatagtgattccaccagcttccgccccgcttggttggtataaccaataggctctggcgcttctccattggtgtccagtgcggatgatcaccctgctggcattggggatgaatcgagagtcctgaaagtttacgacggagtgtggtttttagaggaactgaaagagggaaataaatggaattaatcgcaactaatggaccactcattgttggtgaccgttcctggtgataaatgctcttgctcctagagggagatgatgggtagctcaacagccgatcagaaggtgaatagatcaactctggctattgaagtcggagatcaacatggagagcgcacatctgatatcggatggttaggactaaaagagatgacgtggtttactcacaaagcagcaaattagctagtggggatgactcctataggtatataggattgcataatcggtgaaggagtggattaggtgctaacatttctctgatcaaggcaagttttctcctcccatcctttgaacacattgaatcccatgatttgaggaatgaaaatatttgtttgtaaagttgcatgtgaacttagactatatcggtatttaaaattgggttaaggtagttgtgacatatttgctgcataccccaccttgaataattgatcctcttgctgtttgaacccctagaaatggttagagtacactctttgtgctcaaatgggtttatatatgctctatgtgcaactacttgcttagccatgcttagaaatatgcaaatgctcattccatctataattaaaatgtggttttgatacttgaacctttgctggaataaaatgaatatgatgggtatttgcgaattaaaatgtgtaaaatgtgattttatacttgggcggcaagtggtgtgcatatggtgttagttgcataccgataggggggagtgtttgcccaagtccataaggaccgaacttgtgtcacccatttaaagttattcgtacatccacatgtgctagtatgggatggcctaagctgattaatctatttaggactagccttgcattctgttaggccggtatgtatgagttagtcgataattctgaggaattagtcgatgattcagaggaacttcctatttgcgccgacgtggtagtttaggtgactaagtctgtccaatacaacggtattgtgccacgtgggtgggttctcgttgtgtccgccaccacggcgttaagtttaaggcgtgggcccgccacttaacggttctaggcatattccaagtatgcctaggatggaggaacacgtatcgtgctagtgcaaggctaggctctaagtagtgtaaaggctacgttatgacctctagatcacattcaacatgaagagtgtggtggagtcttgcaaactcaaaacaaactagagcgttcatatcatgtgggtaaagctgtacaaactttgcagagttctttaaactaatcgattagccgtgctcacggtcatgagcgctttggtgatgtgtcatgagtatagactttatgttttaaaatgtgatcatgtgacattggtttgaaattgataaatgtgttaagttgtgtgtgtgaggtgatatattatgacttgttgtcaaaggatgacaacaagagattgattatgatggaattatgatgaacttaatattgaaacttaaaatttgttttgttaattgaagcatcaactcctttacaaaagaattgcgaaacaaaacttgctttatgctgaaattgaagtacatattgcctttctttgaatatatgccttacatgtagtatggtaggattgacttgtgcttgccagtacattaacttgtttaatgtactgactcttgctgttgatataacattttgtttgcaggtttagatttagtcttttgagtgatgtgggttccgattgcttcttctaggatgagaacttaatggggtaaacccctagtcggtgtgcttgtgattgggtagtcaagcttccgctgttctctaatatgtctatttggccggtcggcctatgtagttattaagttgttgtaagtcttaagtttctttaatcttagttgtgtttgctatgtataatcatgcttaagatgaaagtgtggatctagtgcacatcctgggaactagattcacatgagtatgagttaggaatatttgagaggttgtagatctttagccatttttgtcaagtctcctgaatgtgtaacacatctggtcaccaccttcgagtggtttgatgggcacatctcaggctgaagttgactggcaggctaagggctcagcaatgtctccaatattcctctctcgaggcgtcggatgtttcattatgcttgtttgatgacttaaattattcacttcatctctcaaatataatggaaggtccgaagtgcctacgacaacgcactaggctatccggacttggaacatggacctaaagggagacggacatcacaggaagatgcagctctctgagctggaggaatggagggacaaggcctatcacaatgccaagatctgtatggacagaaccaaaagatggcatgatagacagatcaagcacaaggagttcaaagcaggggataaggtgctgctgttcaactcacgggtgaagctattcggacatggaaaacttcgaaataaatggatgggcccatatatcgccgtcgacacttcatcacatggagccgtcatacaataaaagtaatatctttaagataaatggctatcattaaaaagtttttcttgatccgttagaagttgatcgtgttagacgtagtgaatttagtcgcttctagcttctacccggagtccttaggcccccctgatccgttagttttcaatgccctgagtccttaggtccccctcttgttatcttaggtctaggttctaataggtgcacttaggtctaggttgtttagcttatttttatttcatttcattcttgtaatgtgcctatcattgacgaccgtatttgccggccgaaagaccattatgcacttgtacaactaaaatggtataagaaattcataaaatcaaacttttaaaggttgtaaaagaatgttctcgaaacttttcaattagtcgagggggcatatttagaggaggtttagatttcgagaagagctggttggaatccaactagtgaaaatctagaaaagctgggaaaaccactttctgtcttctagttcattttcaagattccgcaactacaactttatagaatctacaaaaaggtggatattttaggggagctttcaattctaggagaaactgtagctattagaaccttccctaaacatgttttagaatgtttctacatgtagctcaaatgaaatattgaaatgaaaaaaaatattttatgactcacaaaattagaaaaaaaatacaaaatatccttgtgtatattgactcgacataaattattttgtgaaacatttaaggattaaatcattcccacgatgcaatttagaaaaaccacacataattcacttattttatgttcccaggaaaagttaatatctttaaatgaaaattgcttccttcatattatgtggcatttgttaaaaaaagtgttatttcattacaaaacatatgctagggcataaatggtccttacaagcaaacttaatggtcaattgtattgtggtatcattggaattaagatgtttattgtaccgtttgttagttgacggataacaatatcatctctgttctttcttttcctccacaccttaaaaaatgttaaatgacatcttatcaatagacaacacctcctatggccatatgaagtgttgtcgcttcttgatatggttacaagtgatatttgctatccaaattgaaagggagcataatttgaggatcatagatctcgcctagatggagatgaataggtgtttcctgcaattacaaacacttgcagcgaaaattagtattgaccggttaatcaggtatcattgcggataatctaacaatacacagtgtcagaaaatctaatcacaactagacagtgcaaccaaacacagagaatataggaattcgcctatgcacaatatagacccgtacaatccaactaagagtggacaaccttggccttataaagagagtgaaaaccgtagggagatggagcactttgcacactagatatgagcaagaccaagaggcatcaacaagagataagcatgcaacaatatgatcaccaaatagctcaacaagaaagcggtaagtgcagagtaatgagagataggagacattgcagttcaagtcagtcgatcctacgtctccgttgagggccccgaaaggccaagtctctcttaaccaactgcaaccaatcatgcattggtctcttaaagcaaccaccaagagcaagctcatgctccaagcgacccccaccggtccaagctcgaatgtcacacaactttcgttcgacaaggcgaagctcgatttccactatttaccttttctcttcttgaggtaaggtgtcaaccttcgcaatcttctcccaaatacacaccacaccctcacgagattctctttctcctcttacaattaagagtggcaatttccccgttggatctgggtccccgcagggggctgccacaacgagggtgtggacggatgcagattttctcccacgggtctgtcgggcggggccctgactttagacatgggcgggggtcacgcccggaaatatacaccatttccaaacgctcagtgcattaatcctcgtcccaggaggcgaggtacacatagacatttttgattattacaagccacacttgcagaaacgtaaaggaaatactccatctatctacttttgatagttatatttcatcttgacacacagaccaaggataaataattctacttattatccatttaaacatgctactagttattcctcgtaaacaagcaattcattaatatttacatttctcgatgcccatgcagccaatcttatgtggaagaatggaaagtcacgtattaaatccgagaaagtcattaagagggtaggttgttggattaaaatatgcctatcaaaaataaattttttagatttggaaatatgcctatcaaaagtagatggagggagtactttattacatgggcgactctaggccctcacactcaaagataaacaaataaaacagcagaagactacggaacagcagcagccacaagcactcgacaacggagcgaactagagatccaagccttcatcttcttcaggtccatcctctggattatttttgtgagcaagagtgagtaccaccaccgtacttagcaagtcacaccggaaatgcaacaataatgcatagggaaatcaaggaaatggcctaatagggtttattttgcataaaaccatagtttaaacattttaatcaggttaaagctcattttaaaacacgatcctgttctaagccaatattttaatcaccaaggtcgcatgagcctgcgaacctgccttagcccaggctaatctccacatgactacaccatcatgatttcaccctcccaaggttttataaaacaaaactaacttttggtacattactcagcttgcccataaccgagggcgcggctattcgaatagtttttaactctaatcagaggtgtacaactttacccacaagacacaacctcaacacgcgttgccacgcgccgggtaccaccacggtactcggataaaggtcgtgacaagactatccatctaggtctacccaaaacatgagaacccgctgaggtttcaccgcccgctggtccctgacaaggtaaaggttgccggatcttacagagaatcaacaatgtccaccccccttacagagaatcttgttctcgagattcgaagacgcttccgatgaggtgaggatgggtggacttcagttcgtcttctctttcccatgttgcttcctcttctaaataattgctccattgaaccttacaaaaacggatcactcggcttcgggtatgtctttcagatgtttctaagatccttataggcttctccacataagtcaggtcttcctgaatctcaatctgttctggatctgcttgctctatcgggactcggaggcatttcttgagttgtgacacgtggaatacttcatgaactcctcccagagatgccagtagttccaattgataagcaactttccctcttctaccaagaactttgtaaggtcccacaaaacatggtgccaactttcccttggtgtggaaacgacgaactccatgaagcggtgtaactctgagatacacaaagtctccttcttcaaaggctaactcccttcgacgcgtatctgcgtagcttttctgtcgggactgggcaactttcaggttcgcttggataaccttgaccttctcctctgcttcttttagaatgtcagtcccaaaaacttgacgttctccggtctggtcccaaaggagtggagttcgacattttcggccatagagagcttcaaaaggtgccatttgaagactggcttggtagctattgttgtacgaaaattcagcatatgggagactcttatcccaacttttgccaaagtccagggcacatgccctgagcatatcctcaagaatctgattaactcgctctgtctggccgtccgtttgagggtgataagcagtgctgaagttcaaacgagttcccatttcttcctgcaatttctaccagaacttagaagtgaattggctgccccgatcggaaacgattctctttggtaccccatgaagacaaactatcctggcaaagtataattcggccaacttactaccaggataagtggttttgactactatgaaatgtgcaactttggttaggcggtcgataacaacccaaatagagtcatatccagattgggtccttggaagaccggtgatgaaatccatcccaatctcttcccacttccattttgggatcttgagtggttgtagcaatccggttggcctttggtgttgggctttaacccgttgacataaatcacagagtgtcacaaactctgctacttcacgtttcatactgacccactaatatttcattttcaagtcttgatacatctttgtactgccggggtgtattgagtattgactctcgtgagcctcttgcagaataagcttcttgatctcaggatcattgggaacacaaacacgtccgccgtaccagatggtcccatgttcatcttcagaaaacccaattgcttttcccctcatcatattcttcttgatctcttggataccataatcacctttttgggcttctcgaatttggtaaaggagtagaggtttcgcccctaaggtcactatttagccataactaactattcccaaattcaaggcctcaagctctcagcacaatccaggaggacactgttcatagatgatagcattgcagtaactcttccgactcaaagcatcaaccacaacgttaactttccccggatgatagtggattcccacatcgtagtctttaatgagctctaaccatcttctctgacggagatttagatctggttgagtgaatatatacttcaaacttttatggcccgtatatatctcacaacggttaccgataagatagtgccgccagatctttaaagcatgcaccacggcagctagttccaagtcgtgcgttgggtagttactctcatgaggatgaagttggcgggaagcataggctaccacttgtccgtcttgcattaagacacaccctagtccttgtttagaggcatcacaatacacctggaaatccttgtggatatttcgcaataccagcactggggcagatactagcttctttttgagcaattgaaatgcctcttcacactgcgaggtctatatgaatttcacttctttctttagtagctgagtcattggccttgttattcttgagaagttttcgatgaacctgcgataatagcctgcaagtccaaggaaactgcgaacttgggtcactgatttgggttgattccaattggtcactaattcgacgttagttggatccactgccactccttgagctgaaattacgtgtccaagaaatttcacttctgaaagccaaaattcacatttattgaacttgcatacaattgatgttctctaagcttctctagcgctaggcgaaggtgttgctcatgctcttctgctgtcttggaatagatcaagatgtcatcgatgaagaccatgacaaacctgtctaaatattccatgaacactttattcatcagattcataaagaagactggtgcattcgtcagtccgaacgacataaccttgcattcatataacccatatctggtcgtgaatgccgttttagggatgtcttcctctcggatccttagctgatggtagccggatcgaagatcaatcttcgagaacacggttgctcctttcaattgatcaaagaggtcatctatcctcggaagaggatatttattcttgatggtgacctcgttgagtgcacggtaatccacacacattctcttagttttgtccttcttttccacgaagataactggagctccccagggtgaagtgcttggtcggatgtggcctttttctttgagttcttccaactgctttttaacttcagctagctctttggcagccatgtggtacggtctcttggagattggcgctgtctcgggcactaagtcattcgaaactcgatgtccctcttgggcggcatgcctggtagttcctccggaaaaacatctagatactctttcacgatgggtgatgaggacataactagctcggatataaccattgaaagtgcattgatccccctagtgggttttggtgattaatgacaaatgtggttaagggactaatgagttcattgagttactttcaggtgcattagcccaaggtgtggaagatggatgcttggagacccccccaaaagtataaaatcaaagcggaccggaactcgagaagtgcatgggatagtttatttattgcaatcgagtttttaggaaaaaccgtactattaagaggggctccaggtgatgctctgagatatgtcaagtactcttagtgtgaaccaagtgtcaagtttccctaggagttatttttacaaatactccatctgtccaaaaatgcaagtccggaacttcctgtcttctaggtccggaagttccagtttggtgaaaaagattttcctaagtgtagtctagaagttcctgtcttctaggtctggaacttcctgtctagtttccagttcaaattgtgagtaacggttagatgacgtcacctcatccagtccgaatctgattttgagttttgggccttgtaattgtgtcgtgggcttagcccaaaggggtgtgcgccctagggcaaccctaggatgtccccaatcacttttattcaatagccgtcatcgtttagagtcgggttttgcttagattattctgttgagaacagtttcgctgctagatcggtttgtggaaccctaaattcgtgtgcttaatcattcatatgcaatttgcttgcaatctatcttgttcttgcttgtgttcttcgattcacatgcagggattagccttctcggcgaggtcaaccaggtttcgacacggttgataaccagagggacgtggtgctgcgattgcggggctcagtagcgtgttcgttcagaagccggattaagttgtaacaggaccatgcactagggttcatatacttctggtcagcaccgctttgatccttgcaatcgccacatcacgtccttcaaggtgtcacgaaccagccaccggttggaccgtccttagcattgctggtaagacacttgtaagagcttggtaagatgctccattgggctgagttgttgaggggcaccactacaccgcgtagcagattattagggataaccttcattgtttgttttttttgtgtttgcaatgacaggtatgagtggcactcgaaatcagcgataccaacaagatgcacgtaatgacagtactttggtgtaacaagtgctaagctctcaaatggagaaagcagagcaatggcagtaccacgaattatttgaaacaaagtttatggttaaggatagagcatgtcgtactataatcgatagtgagagttgcaataacatggtgagttcagatttggttgagaaacttgagttgcctacacaaccgcatcctcatccatattacatcaaatggttcaactcttgtggtaagtttaaggtaaatagaattgtgaagctaaacttttcgattagaaattaccatgatactgccaattttgatcttgtccctatgcaagcatgttctttgttgtttggtcaaccatgggtatatgataataatggatcgcataattttgttgctaatacatacacatttagacataatggtcggaaaatgaaattggtacccatgagttttattgaaattttcgaagataatcttgaaaggatgaagaatggaatcgaggaaaatttcaaagatagtattgaaaggacgaaaaatagaatcgatgagattttcagagataccaggaaagatactatctttgaaagataccagggctcagtagcgtgttcgttcagaagccggatcgagttgtatcgcgactccgcccaaatcgactgtttgtcaatacctatcggaagatcgggacctacattcctcatcagtttcagaagaatatatatggagcttgggaggcacaatatatagtagcaaaggaacgtaattgtactaatcagaaaatgcaaagttgaataatagttcaaagtattagtcaatgtgctggcctagtctagactcaactctagctcaagcaagcacccgacaacactaaggactagatatgaatcaatgcacaactctgcactctgaaaacatactccaaggatgaatggtttttctttcttggtgtggcttttttaagcacctttctgccttttttttcttttttttgtgcggctttttctttcttttttttctttgcacctttccgcccttttctttctttatttatttttttactttttattcaacaagaaccgaccactgacctcgaacatggactcaaaatataaatatcaatattacagggactcaaatgtaaaatgcaaaactaaaattagatcatcttaaaaatggaatgctcacatcatgtaggttccgtttttataaaaatatctcaaatccactacttaacaattctagacagagaaaaatatagatagtcacagatagatctgatctgatccctcccctcaggcgcacagtactcccctcacgcgcgcgcacagtggtacaggagctctagaaatcgagtaactcccaaaccgttggataaaaatttctccaaaatacaaaaacggaaacccgacgacgaaacgattcaatttttcaaggtcccggcaagaaccgacaagatgcaaaactggacctaaaattgacgtacaactcacacgtgataaatcctagacccaaagtgatgaacagatgcaatactcaaaactaaaaattaaatctaaaactaaaccagcactcaacatgacgatgcaatctagaattcaacaaagcaaaatctaatagaacaatgcaacggctcaaattgtctaggtaaagaataaatatttttatgtggcaattttctgattatgggaagataaattacctaatgggcaaccgcgctatgataccaactgatgagggatgtaggtcccgatcttccgatagatattgacaaacagtcgatttgggcggagtcgcgacacaactcgatccggcttctgaacgaacacgctactgagccccaaaatcgcagcaccacgtctcctctggttatcaaccgtgccgaaacccggttgacctcgccgagaaggctaatccttacatgcgaatcgaagaacacaagcaagaacaagatagattgcaaccaaattgcatatgaatgattaagcacacgaatttgagattccacaaaccgatctagcggcgaaactgttctcaacagaataatctaagacgatgatggctactgaataaatgtgattagagacgtcctagggttgccctagggagcacacccctttggcctaagcccacgacacaattacaaggcccaaaactcaaaatcagattcggactggatgaggtgcgtggcttgttttgcagattcccggcaactcggtaggagttttgacgtgggaccaaaaccatctgaaagtagacttcataagctttccaagaagtacttatgggccccgaaattccttctagatcagtgagtaggtccgtttgaagttgatgctgtcaggaggcccgaatccgaatccaaaacgtgtagaactttatctcttgtcttctatggaccaaaagtgacgtggtgatatgaaagaagacttaaagaaggtcttggtttggtccccaatcaacttcttcaatcatccatgtattccttacgctcggtctcttttctttcgcccaagcaagtacctctgcaaacaaaaacacacaaaactcattgtgtcgcaacgtttgttgaaatatataacaagtaaatctaatatagaacataagcacctttatttgattaatacataaggtagtcatggttatatccgagctagttatgtcctcatcaatgggtatttcatccatactgacgtggttcagaacttgcttacaaggaaatacaggcttggcatggaaagtgactcgctggccagtacccctagtcatagatgtggatcagctggcacaatctataataccactgtgcttggtcaaccagttcatgccaagaatgacatccagattcttagagcttagaaggatgagattagccagaaaagtgactccttggatctcaatggttaccaatgggctaaagagcttagcaggtagttggcttcctggggttgatactatcataggtttgctaagatcttctacccttatttggtgttttgccacaaaatctcttgatataaaggaatgcgtagctcctgaattaaaaagtacacatgcatgaacagaattaatcaggaacgtaccaagtatgacttctggcgcagcctgtgcctcctcagccgagacatgattcacacgtcccctcaccaggttgttgttgttgcagttgccattgttgttctagttggcattgcatgcagatgcaggagcttgcggacgctttggctttgggcacttgtcggcgaagtgtccaggctcatagctgttgtagcacacaagtatcttcccagagctatctctgcgtgtcgatccaacctgggcaggggcagaacgctgattgttgttccatcctgagttctgcagcttgttgttcatctgtggacggggtgcacgctgtgctaccgatgaagaaccaacttgagggggaaacgcataacgtggtttctgacttggtccttgaaacatcctagcattggccaacttacgcttcttgctttcaatctttcggtgcttgtcctcctggcggatcgccttgtcgactagcatttggaaatcttcgcagtcaccagagatgagctggactaacaactcgtcattcaacccttcaagaaatttctcctgctactcttcattggtgcgaacgtcctcaggagcatatcgagccaacatgttgaagtcgtgcaaaaattcagttacggtcctgccatcttgcttgagttcacgaaattctttctttttctgtgctacaactccaacaggtacgtgagctctacgaaaagcagtagagaaacgagcccaagtaataacttgtccaactggctgggtggcctggaagtggtcccaccactcggaagcaggtccatgcagttggtgagcggcgaaagcgactttctcctcatcagtacactggatgaggtccaacttcttattgaccgcgtgcaaccagtcatttgcttcgacagggttggttgtgcttgaaaaactaggaggtcggactcggaggaattccgacagctttgactgcggtggagcgtgtacgtgagcttgagcagcgggtgcttgcgggttttgcatttggtggagcaaagctgcgatgaattggttttggttggcgagcacttgtgctaagttggggtgatcatggattggcggaggtggcggcggtggtggtggaggggcgtggccttggtcctaattctggttctggttctgattctgattctgagctgaattcctagcacgagcattgttagcagcagtactccttgtgttcaccatctgtagtaaccaagataagagggaaaagaagaagggagagatcaggacaagaacacgagctattaaaccaacttatttaaattttattaatgtgatgttggttacatagagttcaagttgcttaagcaccacaaaggtatagctatatcacaacgggccgatatagtccataccaaaaagcacacaaggcaacaaactccagcagaagataaacgataaaaacatacgcgcactaagacttcgcgtctactcttgagaacgactcctagaggggctacggtccacaaatggctcatccacgttgctgatgccgtggcgaggacaggcgcttgatccaacaggtggtagggtcttgacgacggttccaggcatcccactcttcaagtccttcagctccttgcgtagagcgcgaagctcattctccttgtcacgattcttctgaagcactgcctcgaacatcctctccgtcatcctgtagtagaccatacggtacttgtccatcgcggccatcatcttggacatgtgcacaatggtggtgtccccttcattgcgggcatcgcggaagtcagcatcttctgcgaaacccaagcgagcagggtggtagtggaacagagtggtcttcaactggtcggagtgactctggcaaagggccccaatggcatggaatgcagcttcttggcaggcagattcacggctgtcaccttctcctgtgaaccagcaactttctagcatcatccggttggagatgatcatcaccttggcactccaaagtggttcaagtacaccctcgtcttcgaagttgagaaccacgcggtactccatagtgatacagtatccgacttcagcggccaaggcacgaagttgctccacaaaaccggccaagttgaagcagcgggtagtctcgaactcaggcatctacaacattttgaaataagagtcaatgaccagttttgtaaagagtggacaggtgaagatagaataacgaaggttttcacaattaaagaactagtttctaaaaaaaatatcatcctaaggcttagaccactggctcgtcctacggtcaaggtggctctgataccaacttgtcacgcccggaaatatacaccattgccaaacgctcagtgcattaatcctcgtcccaggaggcgaggtacacatagacattgttgattattacaagccacactagcggaaacgtaaaggaagaactttattacatgggcgactctaggccctcacactcaaagataaacaaataaaacagcggaagactacggaacaacagcagccacaggcactcgacggtggagtaaattagagatccaagccttcatcttcttcaggtccatcctctggattatttttgtgagcaagagtgagtaccaccaccatactcagcaagtcacaccggaaatgcaacaataatgcatagggaaaacatggaaatggcctaataggatttattttgcctaaagtcatagtttaaacattttaatcaggttaaagctcattttaaaacacgatcctgttctaagccaatattttaatatcaccaaggtcgcatgagcctgcgaacctgccttagcccaggctaatctccacatgactacaccatcatgatttcaccctcccaaggttttataaaacaaaactaactttgggtacattgctcagcttgcatataaccgagggcgcgactattcaaatagtttttaattctcatcagaggtgtacaactttacccagaagacacaacgtcaacacatgttgccacgcgccgggtaccaccacggtactcggatagaggtcgtgacaagactatccatctaggtctacccaaaacaggagaacccgctgaggtttcaccgcccgccggtccccgacaaggtaaaggttgccggatccccctggacgagacaggctccccttgcgccgggtaaaagaaacggcattaatcctggccccacacccttccaaccaatggtctttgttttgagaagatctaaactttcagtcgggccttacccactagacttgtggttgcacaaagaccggtccttatattagccggggtgcgactaccaaagtaactagcttgcaccctgagcccagcccaaaaatatattttagttgcacaaagcattttatcacccatccattgacaaaccagtcaatagtccataactaatcaagttttagttgttaaccaccatagtctagtttatccaaaagttctaggttggaactaagcaggactatgcatttacctaaagcaactagtcagtccatcatgtagggtactagactagtcaagttataattttactagggttcacaaagattatggatatcaaatcaacataatggccataaccaagagcataggaataaataataaaacaatattaataatgaacggtataatttataaagcaatgcaatataagtaaaacaacataattttcacaatatgggattcaacatgtttaaggtagatatgacttgccttgatcgctcacaaagtcttcaatgtcaatgacgatgaagagctgatcttccggaacggcacgatctacacgaccattgcgaagaaatacaaaaaggctaataaaatccatatgaacagaagcaataaagcacataaatgggttctactcattttaaggagaaattagagatttgaacggatcgataccgagttcaaacggtcaagatatggccatttgaagtttaggtgttgtttaaacggaaatttgtaattttgtgaattatttttctaaaggaaaacttgaattattgagagagagcgcacgcggactgggtccacgagcgggtcccacttgccagccgctcggtccactgtgagccgagcacaccgacgcacaggcacggcagcaaccgagccaggcggctcgccggcgacggccaatggcgtggcggcggtgcgacagagcacgggaagggaaaaacggaaagaggaggagacgacggttctcaccgagcagacgcggcagcgagaggttgacggtgttgccggcggtgaggaagaaacggaggggtcgttgtcattcccgccgtcttcgtgctcgacggaggggtggacggggaagaggaggaagcggcgaagcggatggtggcgactccgggctccgacgaggtcccaaccaccagcgaggggcggccggagttgcaacggcggcggcacaagaagagagcggcgcggcggctatggagagaggagggagagggcggcggtgtgtggggagagaggagggagtcggggtcccttttataggccggaggggagggagagagacgccggggagggagatcgatgccggccatggtggagctcaccattaaagaacatcatcgaaatccaccgcgaataatgctggatcgagtgggaaattatgggggaattggagaggatgaggtgggaattaattcccctcaattaatttgatgaaacggcgagtggaggaggcgaatcggaggttgccgtcgcttggaattcggacgaagagagagaggatggctggaggttagggatgacgagtgggacccacctatcatcgagaaggagcacacctgtctctgactgggcgcgcagagaaggcaaaacagacttcggtctgtgggagggggaatgagctgggctggcccaaggagagggagggggtggggagagaggaggaaaaagtacaccgaaggtccctcaacttgtcgtcgggatataaaatcgtactcgaaccacaaaagcagacatgcaagatcccttaactatacaaaaccgatcaccccaaatcctttgtgattttgaccccggttttagtctacgtggtggctgagtaaatgtgagacccacgtgggccccacatgtcaggtgtccacatcaccctctctctttcccctcttctctcccttccttatctctctctcacttctctacaagctagccggggcgaggcgggagggcggcgccgcgacggccgccggtggaggcggcgggcgaggggcgagctggagcggtgtcgcacatggagatggccgccagggtggatctgctcaaggcatggcttccagcaatcttcaaggtacaagaccccggatgcagaccagggcagccgcgcatcctcactgtccccgccgccatcgccattgccatcctgcgagctcggtccctcgtacttccagatcaagaagcatgccaggaccatgcaggagtagacccagaccgcgcagagcatgaacctccagttcagccaatactcaggagcagtggtgtcgacggccatggctgatgatggcattgctgcagtgacgaggcgttatgcagccagattcataatacaggatattactactcaaaccatgtctgttcttcaactgcaaattagattcttgcgccaagataaagagaggaattattattgccgacgaagggagaaatgatcagtactacgattcttatcatttcaagacacacaaaagaaaaagaaaatcgacgctagccagatgctatatatcctgataccctgcaacctggatccccacgcatgcagatggtaaagatgcaaatctttatttccatttccatgattccatgcacacaaaaaagaaacgaacaaatgccccacgcatgcagatggtaaagatgcaaatctttatttccatttccatgattccatccacacaaaaaagaaacgaacaatatagagaagaataccaagaaacacgcattggcgcagaggagggtggaaaactaacccaatctcaacggtgattgggttcttgtttcttgacttctccaatgcctccccttctccaaccttttctgccgccgcctctctctctccatcgattcctctccctctcgcgacctcgaacaaaccgagaagaagccaacgaaccaaccaaccacgtacgtgctgcaacgccgccgtgttaggagaccacggccggtacatctccgcgagcacccggcaccccaccaccgcgtcccaccgcgcgtacgcgtcgccggcgccgctgccagtgccgacgcgttcgccggcgcgcgcgacgacacgagcgcgcccacgtcggccgagcgggacgaggaggcggagaagccgcagcgctcgcacgccccctccgccggcggccgtcgcggcgccgccctcccgcctcaccccggccagcttgcagagaagtgagagagagattaggaagggagtgaagaggggaaagagtgagggtgacgtggacacctgacatgtggggctcacgcgggtcctacgctgactcagccaccacgtagatcaaaaccggagtcaaaaccaccgaaagattctagtgaccggttttgtatagataaaggaccccgtatatctagttttgtagttgaaggactttttttatcccgacgacaagttgagggaccttgggtgtactttttccgagagaagagaggggtggccgggctgggccaagagagggagagatgggctggaagcagcccaacaggaggaagatgatttcttttagcttttcctttttataaaattctttaattgtttttgttgccctaaaattatttaaaattcaagtaaaaattggttaaatatttttaagcatggggaatttattaaaaatgtccacaagccaattttatataaatcttggtgagttttaattgttggaggctcttttaggcttttaaaatttctagaaatacattaaagcacgatttaaatttagggcgattttcagggcgttacagtggggatggggacaggttgagatctccacccgcgggtccccgtggggccctggaagtactaaaatcgatgttgagttccattggtgagctctagcctcgactctagcatgtctgcctcctcttcttctccaaacatgtgggtcctcgacttgtaactaaccccagcccaagtagggtctatgtggggtgcaccctaatctggtggagcacggtcttagggacctcttggtcgtcctcccatctctttaaatagctaggtaccacttcaaggttccttagatttcattagattaatgttttagccattgctactttaccttgtagttacatgtgtcggctagaccacctaattactcgtctttagaaccccaacttattgtgagatttaattccttttcacaatttagattacttttatcttgttcttgcttatttctttgatttacttgtaaaaataagattgatctgcaccgatttgatcaacaacccacggagaggtatatcgatcgctaaggtgcaacacaataatggcctgtacggttatagtccgaccgtcaacttctcttccaaatcatagttatctcaactcactgaaagatcgagccaatcaaaaccgtgatcgtatcaaatggatctcaaggtttatcaataacactacctatttatagccccaactcctccatctttggtaccgttccttgagtctaccaaaagttgtatagggtcaaagaaaatctggtatcacactgaattgtctaactctttatgctttttgaacggtaaccgagcaactagctattatggtataaagaggtggacaatctagttgctactccctccgtatcttaatgtataacgccgttgacttttcgatcaacgttggaccattgttttattcaaaattttcgttcaaatatgaaaatatttatatcatgcttaaagaacatttgatgatgaatcaagtcacaataaaataaatgataattgtataaattttttgaataagacgaatggtcaaacgttggataaaaagtcaacagtgtcatacattaaaatatagagatagtgaggtagtatgtgattgtccaattgtgcttctcagaaacaatttggaatacggcagaggaccctaagcctaagggttttctttttatggcttggggttcatcttccaatccaaccatacaaaaaaaatttgacactaccaataagacggtttcatctagtttgtaggaggaacaaaaagtagtattgccaaaaaatttcaaaccaattctaataaaatcgcacattttttttaaaaaataaatggctaaaattttgttaaggttacattgttaacgaacaaaggacaaaccattagaatatactagagattggggcgcgcctttgcgcgccgcctgttcacacagtgtgctcgctatgcaagaattttttagggtgctgcatacacataaagataaaggtgaaacagaatatgatagcatggttgttcatacaggacagggtgaattgtctttggttgcatataagtacaagcaaaacaaccaaagacagtacgtaaggtaccgtcagctcctgttctgtaacagcacgctggcataatagtttgggcgtgatttttacatggaaattgagtacccatgcaaagcatacaaagaatgatactaacagctatagaagtagcagagtgaaaatatagcctacgatattaaaaggataacagcttgtgttgcatgagcatcttgctcacagcacatctattgttgcttgcagctgattagtctggtggaagtgaaagatgcagattgttccaacttgtatgccgttgcttgttggaaaatgggtccatcctgatttcaggttaaagcgcttttctgtggagtggtgaagaaccatggtggttgaggagtgccctggaatccgtacttcgatctgcgatgtcttcttccgcacgattagtgcaatgtatgtcatagagaattgctttgaaaagtgctgcatgataagtatatgttagtttttaaggtaagaggtatataaaggggtagtggtgcagttatcttaccaccttatcctgcttcatgaaagttggatttatggttgtgacatagaattcgtttgaggggtgcagaaattgcgcaatatctttgaagtagtctttgagttcagttgatagattgatgtccctccccggtgcagaagcacatttcattgatagtgcgtttggtgttgcctttcgaaagaggagtgaatgaatacatcaatgcacattaaaagagacgcaaatcaatggaactgaaaatagaaagagaagtatctgtacctgtacaagctgaccctatatcggcttttaatttctgttgcatggggtgttgcatgtgtggcttagtcttggttctttttttctgcaggtgaattggcgttgcaagcattaacggaaatcaaaagtagagagtggaatcagtaatgtaatagtttcagatatggtgccatagatgaaaatgatttgttgtcttgataggagacggaaagtgggttgaagatcatttacctggtggttttggtttctgaagcgcgtttttctttagctgtgagttgcttggtttgcttggcactggacatctaagataaccactcttggcttatatgatgacatgcatcttggagcgtgataagactttgaaaaccacatattctttaagctgcaaaccagtggcttctatgaactggggccatcctgtagtgatgtatattttgccagatgctctctttagttcaatgtagaccattaggttatgggttgttactaatttgagtctctggccatcctccagctgatatccttgtgcgattgcagctggtctgcgctgcagaattgaaatgatgtattaagactggcgtgtattaagctagactgtatatgttatatctgttggtaaggttaccacatagcgctggtttgctgtggttagtctaaccgtgaaaaacctaggtggattcatggctgtatctgcaaaaaaaaaaaggtagttaaaagaaatttataagtgcaaatttaacagtggtagggaagttgcaatgtacacagtgataaacaaagggacagataacagagctgagattgcagaggagagtgttaggtgcttgttatagtgtagtggtaatgagcactgatctttgttcttcggtggatttattcagatactaaacatgagttgtatattgtgatgtataatgggtcaaataggggatgagtaaaattatacagcagtcttcttattgttgaaaaaggctctgttttaagggctgctatatggctaataccatttttatttgttgccgaagtattattttctttcggtttgtatttgaaggaatggcaggttaccaatgatttaagggctgatatggttaggtttaaccagggcatgagccatgcgcaaagaatgttggagtttgcatggacatgtagtttgagctacagtgatctgtaaggtaggaggttatttatctggaaaacaaactttagcattgaaattaatccttgattatcctttagcgtatcatctctatgcatagcatatttatatgaacacacgaatggtgtttcttcatagcgcttatatattctgaagggtataaggcacggcctacattcgaaattgttactcaggctagctaacaatattttcaggtccatttggcacatatgacatcgcaccccaccagcatgtgtgaaatagaacaataatttacctccctggaagtatcagcaccaaaattcatctttgtggatcaggccatcgtcgatgatggagcagctgatcttctactccaactccaataccgtaaagtcagtgacctgcactgaaaaacaaataaatctagaagatgtaaaacagcatgctaaaatgtttaccagaaagagttgtgacttgttaggtacaaacgcagcagtacaattttattaattgcaacctaaatcctcctttacatcacagcagaataaataatcaatggcaatatattttgtccctctgaatcagaatgtgggtaaatgcactacccggtaataacccacacatatttactaacccacatatcatggttactgaaacatctagcattaatgttctgaattagatgaccatcctaaagatttcctatttttttttttggacaggctcccagtttgccccaaggactgcccaaactaaactgaaataccatcacatattctcaatttaaaatcagttccattcaatcatggacctagagctaaatctttcgaacttaaatatatttaaaactgaccttcgcgtgaacaagaatcacagaacaagagcagagcacataactaaggacttgattcaaacgcgtccattgcctgtaacacacagagagatgtagggttacatatatttaataaaaagctgtcaattgaacaccatagctaaggaaatgcaagagagcacagaccagtgaagaccgatggcgtgaaattgtagcttctatttcatataggaagctcttgtcctctgagcaccagcaggattgacggtgctacgaaataaaaaaaataaatgcggtgagcaaagcacactaacggtaatgtgactgaaaagaatacgtagataagaagtctataaagcatggcatcaagaatgctgtaccccttttttttcccatcaatggaggctaattctgcaccctgagaataacagcacaaaagttgttatatctatcaatgcttagtcaatagccgacgataaatagtatatttcatgtgcaggtaaggaagcactgcatagcggaaaaacataaaccacataagccctgcatacatatattaatgcagcaaagaaatacaaaatcacctttctgaaacaacagctgtatctatatcctttccttcggacgcgcccacctcaaaagttagcttcttcgatgcacctagaggctgccacaataatgtataaatcagaaccttgaccgaataacaaaaaaaaaacaaatggtctgtctttcctaaggtaggagcagaacatacaaggcgcataatggggcgtcgtttcctgctatcagcatgggctttctccatatcacccacaggggtattagaagaagcaggcggtgtcgaagtatgatcaggacactcactttctctacatatacttgaaccaccagcaaaaggtgaaatgacagatgatgtgagttgcaatgtctgatccctaacctgtggaatagtgccttgtctgccaaagaagtttcaatgctattgacttgaaacgcgatgttcctctgcatcaagctcctttcggtgacagaaacgcagaaagtgaatttttgggacacaacactcgcaatctctcgaggaatattgtctgatcctcgttccaacctgacaagattcattccttgctattgttgcacagatcttccaattcttactcgtgggagatatatcacagaacagatcaaaaggcatctgaaaaaacaggaagaaacaattcgatgtacataaaacgggaaagtattaaacaaggaagtaaatgcgatgaattacctatgggagcactgcaacacaagacaggagaggaatcacagtatagctaactaagggttgctaattttaaaacagctgtacgactccaaaaatgtgaacaggacaatgatatctgtacagaacagctatagtataggcaaaaacatatattattactatctaacagcagaaaatatctcgcggtacacgatgttccaagtgcgagtagtgcaattgccattgtcatcttcaattaacacctttaagcctgcgcgagaagtgactcgggaaagagcaacgtataactggccatgacaaaaaacagggtttttcaagtaaataccaactgaacgtaacctttgtccttgacttttatttatagtcatagcgtagcagacacggacagggaactgccgacgttctaatgtgaagggccattttttgctggtcgcagataaggttattcttgggatataaacagtttcccccgcattagaaccagttataatacgcgcttcgatcaccctatcacccaagtttgtaacaatcatccttgtcccattgcaaagcccagcggtctgatctaaatttctcaaaagcattatgggaacacctatttttaggcacaattgatgttcaggataattgttaactttgatgctattcaaaaattcaattgggtataaaacatctaaatcatcagacttttcatttgtttttgcaagacgatcaaagctcaagtactctcttgcttcaccaggaaaaagttgtaaaacccaagagttaatagcagcacacacatcattcgtaggagaaacaatagcacggtcttgcagatatactggatcattgtactgttcagcaaagttggtgtaaactgcagctacaatagctccaatcttttcatcattattcatgaccaaaagatcatgagggatttcaatccaagttggttcaacatcgctgccgtaactacacgctgctgctgtgccatcaccgatagaaaggatccaatcactgaattcagcgacttcgcgttgcatatcagaatctagagaggaacaacgtaaacgcatgttgatcgatagctctaaaacacatacatatgaccaaagaggagattttgatattgtagcatcaattgttttcgatctaacgcctccttcaacaacaggcaagatctggcgaaaatccccacccagcacaactaccataccaccaaaaggaattgatgcagctgaatgatcatcttcagaaagaatatcacgcaatgttctatctaaagcctcaaaacatcgccggtgcgtcattagagcctcatcccatataataagagaagtggatttaataaggtctgctaacattgtaccacgctttatatggcaaattgttgtttcatcaatttctatcgggattttgaatcgtgaatgagcagtcctaccacccggcaaaagcaaagaggcaactccagatgatgcaacagcaagaacaagctttttttcagacctaaggtaggtaacaatacaattccagagaaatgttttcccagtaccaccaaagccagacacaaagtagaaagcaggtgattttgtcatgacactctgcacaatgcgttcatatgcatttcgctggtcagtattaagcttgctacataataacggagcattagcacacaaatcatctatatcataagacatttcatcatcgatcaatctatttgctgatccaaaggaaccatcgcaattcacagtaggtaaattaaaagatgacatagcaacaccattgcgaagaaaagcatgtgtaattcttgcagaaccatatttctaagttcattatcagggacagaatatgcagcattatttaagctttgttgcaaatcaaagagaatatcatcagacatcgcatgccaatgtttattgaaaaatgcagctccatcagcaataccacaatgaacaaccatgagcacaaagagcgatctgagttgcggcccggtcccccagctcacagcctcatcaaatgcaaatgaccactctctgtcatcaccaagcaaccctctagcagcacaagcctccttaaatgtatcgtatacgacatcattgtatgttctaatatctgcatagctcctagcgcctctcacatacataagcagcattctcatgaaatacccttcacctgcagaaggatggacatagtacattcgaccgattttataaccatgccggctttctttccagctccttgaattttcttcccaagtaaatcgagtaggatactcgcagtatgttaagtcacgtccttttgggaacaaatcattagcaacaaaccattcagttaatgttgttttttttgtaagaatgcatttgaaaccaccgatgccaggtttgcgtctgatctaaagctaaccgtgttcatgtttggtaaatggcatgctaaacgctcaacaggagggttcctaaagtgaataacatactcaaacaatctccaaatacattggttggcacataaatatcgacactcaatgaagtcagctatttcatctatcggtgctggcacagtaaaatcagaaccacgcatcttttttctagaacctgatgaaccagtatcatcaatcgcaacgactcagctttctttttttgatcctagaaaattttatattggcatgatcgggtccttttgttacatacttaaatagatacttgatcatctttgatttgttgcaccattcaacatttatatgagcctcaaatttacgcagcaatgacacattgtatggcacgaccgaacgattatcaagcttgataccatttttaagcacatgcgaaccattgtcacgccgcctataaacaacaaatcccttgtcatctactgttgtttcagagttaaaatcctttgggtattttttagaacaggatccatttctcatgcaagggcattttctattgctatcaccgcatgggccatgcatcataaattctttgaccaacaaataatcaagttcgttttcgttaggatcagggagttcagcactgatgtatgtgtcgacgatagatggtgttgcatcggtgcttggcgcatcacgccacaccagtatatggacgtgcgggaggcctctcttctgaaactccacgctgtaaagcactacaccatatggtaggaaaaccaaccgaacaaaattaataacacaacaaaaaatgcaaaccaaagaaatagcaaaaaagggaactaaccagcacgcacacgcccaaagggaacaccagacataatgtcagaaaccatttcatcaagtttcattttaaaaaccctggcctggttcgaactgcaacgcatcttcaatttcttgccactttggattgcaggtaaaagttgtaaaaatatcaggtgcgccataggcacggcaaatagccactacatcctgataattctggtacatgtatcgcctaccaccagtgaagcttgcaggaagtattcgttgcttacctacgctcgcaccatctaaggaacccttagcaactgcatctgtaattccttgcatgtgttcgcatctaagttcacgttgctggtcagctatgaatgttaatctaccctcttcaacacaagcataaccatctacttggccttgagaggataaacgaccgcaacataaataaggattaaattgatctcgacgataatggcagcagtaacagtaatgctcttgcatagaagcctttgttcgtatatcggtacgattcaagtctacccctcttaaatttataaccaagctgaaagccacgctcaccataaggaaacagaagtggatactgcaaggccatataagcaggatgtaagctagaaacatggagtgggccaggaatgctttggacaattatatcgcgctttgcattctccaacgaaaaatcacctacaattaacccagcaagttcatcggctgttggcaattcgtactgaacaggcccattctcatctgaaccgactattctaattgcgaactgctcatcaccattatcagctaaacgatctctagcaatcctgaattgcttaaccaaaggattacaattgtccagcatatctagcaattcagcagcaatctgaggatctaaatcacagtcttcgacttcttcattaagaagagcacgcatcctattctcgatctcgttttgagtgtcataataaatatatagttgagcaaactttagtggggtttcttcgctaggtaaaagtgagcctatacgatgatgtacttgaccatttattttaaagacataaggaccgccaccgcgatttaagctatcgtcaatatttgcacccattgaagtgaaagcaaacagcgaattgtactgccttatgtgctgcaaacaatgcctgcttcgagcatccccatcgaacttcaaaagcgaatttaaaggttctggtggttgtgcaaatggaggaacaaaaattttgccgcctttgcaacaaagactataagacatacggcgctgagttatagctgaatctctcttgcatcgttcttggtaccagaactgagcaccacacatgcggcactgagttatatccttcgacgtctctatatgcacatgcaggtcaaaaacatatctatatttagatataatgtcggtgcacgataaactaaggcatggaaaggggtaaaataaagtggaaataactttttaaaaatttgccgtaatcactatcaaacctattggaagacagggacgatatacgagaaagccttttacctacaggaaaaatcaacagacaacctgcaaataagagaggctgacagggacatatgaagggaagtaaaaaaaataccaagcataaagacctgcagccaccagtcgtttgagagccaatttttttgatcgtatctgtcgtctcttcgaagagtaccaagcaggataaatagggaaaaacccatcatctagtggagggggggaaatcacataaacaaacagaggggtgagcagcgatggggcacaacagcagcacaataggaacaaacaacgcacatacttttacgctgcgtagcaactgtttcccaggcatattcaccaccagccgaaacaggagagcacgctaaacaggaaacaaacaatttaacgatgacacacaacaagctgtggcagatcacaaaccagctacaaaggaacaaatgatgataaagcatacatctaagagaagcactatggcgttctagcaatcggcggtcccgtcgacgaagaggtgcaatcacatgacccccctccatagagcgactaaacgcaaagagagtaacaatgcaacgaatattaaaacaacacatagccaacaaaataaacataatggatgaacaattgattaacacacaaaataacagagagtaatgtatatacctccgttgatcaaataggatagcagagagtaatgtatatacaaaagaatgctgggagatataattaatatgctaataatcagacattttcaaggctagctttttacctgtactcttgccacgtgaacttgctgtgcaagctggcttagcctaatcctacttgacttcaactgttgaatgtaagcctgaacaataaagcagtgtatatatatactcatcaatacaaatagtatataaagccacattaaattttagcagaacttatcaacttgtgctcgtatgtgtccataaaacaaacatatgaaatgaaataatatataattcatgtttcaaatagccagcaccctaataatataagactcaccgcataatacataagacccatgtttcaaatagccagtaccatcataagataagactcatgtttcaaatagccaggaccatcataatatataattcacacctgagaccataaagaaattggaaatgcacatatgaaaagtgataatgtttcttgcattggtaggccggtcaaattcacaataaagccagtaaaaataactatgtccttcagcacataagtcccaaagaaagagccaaaaacaaccgcatcacaaagtcggtcagcacatttaatcgcgagctagcactccatgcatgcatgtagcaaaacaaataaagttgataacaaaagcacatatgacagcacttgcgtgaacaacatgtacatgtcatatacactaacattattgttaggatatatgtttgtacttttcgtaaagtattgtacgtttctgcaagcacatatatatacaaaaacacacacacacagtacatgcaggagagattcctttctgctagcttgaattaataagctgttgagtttcttggttgaccgactaaccttcttactaaggctacttttccttggtgcctctctattctgtgcaagcctcctcagtgtctgcagaatgtgcatatatatacacacacatattcacacaatcaagctgtcagtctcaaaaaaaaagtcataaaatatgcaggttatttcctgcagacagggatcgttcaacctcctaattacttttttatgcacttttgtgtgctgttgaagtgctgcggagggagatcatcaaatgtatcaaaggtatggctggatggatgattgactcactaaccttagggtctagtgtcctccttccttctctttctagatcattagatgttgctgcacccttcccactgttgcttccttccttctgcaaggcacatttttttggccccttcagaagacacacagaggaaaaaatatatatacatatatacagcatatatagccggatttctatccactgtctaaaaaatataatatgagagagagagagagagagagagatgaataccttaatgaggctattattcttgttatccttgacagagttaggcaagggaacaatcgatcaaataggatccgccatacaacctgcaggcaatataaacgtgatctagatgctatagcatatagaacaaaaaagcacaccaaattgtagcgcacaggtaagcaaaaaagacaacaaagatgctggctcgaagaagataaatgggaaaggacctaacccgaacaacacacaatgacaaggatcgaacagaggttcttcaattactttgatagctcaaacaaagactctaccataggtagaacacaaattccctagctcaagaaaagctaaactgttattgtgtcctattttgcagcatatgcatcttggtaacctagcagtgcactcaactaaattctgttgggcctaatgtatgtgatacttataggcatcaacacaatgcactgaatttagtatgcaagtgaattatgatgaattttgtgcatataatctccagtaaaaaggactccaggatacacctaacatatactgcctcagaaagagcccgccgatcttcatgtaacacaagtttcttgaaatctccccatcgggaacacttgccttcaacaaaggctttgatctacctatctagatatttgctttaatctggaagcagtgtgccaaacaaatagtggaacccttacgcaaaggtgccatagcctttaaattgtaaactacattgactgtatagatgatgttacaaggcataaactttatattttcactgcactatatagaacaaccaaatccatacaagctgtagaaaatccaggccatgaattactgtatggtggaaggatatgggctgaataaaggtaattagccagagaatcacatgcaaaaaggaacagaacacatttaatttgtctaggacagtaaactatacgaaggattgaattagacagtttcatttatataaactcgcatgtaacaggaataagggccaccataaatcaactcaagtggtggttttcaacatgaaacagtgggagaattaactatcaaatctgtagttcagtgacctaatgatcaggaatacccacctcttgatgcatgaaaagcccaatagtacaaccttatacttccctttggcttcttgcatttaccatcctgctgtaatgatagaaggggaaacattcagaacaacagtaaagcatatataccgtctttcatagtagtcatcatgtaacaatctacctctaataaatcaatttcctggtgaatacattcagataacaagtgcatcccctaaatcaaaagaaggattggaggataagatagttaagcaaaacaaatctgcaatcacaaggatttttttcacacctacataactattctaatctaatagttaattaaaataaataagcaagctgatgaggaaaccaagataattaactgtagaattcccagaggataatctagcatgttatggcaactctatgctgtacatgtgaccacactgaagcactacatgcactgatgatcttgcataatgcagtatcattttattaagtatgcacctgccctcagcgacctgatcactaacccaaaaaaataaaaagtaaggtggtaacaatattcaatatatcactgcttatttttcttgtcaaatatctgataactgctcagtaacatgacataggaatagctcaaatgttttagtgatcatattcctcatgcagagcgcccaaaatagatattttgagctgtgtactgaccctgaagctatataatctgcagatataactgtgcctcaatgccacttgttgcaactaaatgggcacccacatgattggaagtaatcagtgcctatcaacaaagataatgcaggtatgaggtgaatttacagttgtggttggcgagggcacccattgcggaagacaaagggaaaaaaattagactatctagggtagcaaaaatctagctaatgagaatctgattttcctaacctctgacttttaatttattttattgatttaacaactacaacttcttgaaatctgaataaaaaaactaaattatttaagagaacttcaaattctaggaaaagttgtagctgacaaaaatttccccaagcatgacaacctcatgaatctactccaaaatctctatgtagaattgtcatttaatatcagaagtttcaaaatagaaaataatatgtaatcttatgtttcaaagtgatctatagaatattcttttctaatgggttggaatcatataaaactcctataatttccataaaaatcggaatgggcataaatttttactcgctctgatctaaaatgtagttaatcttatcaaatttatggtactacgcatcaatattctacgacgaaggcagcatagttttacttctgtataaatattcaggagtatcgtgcccgcactctacttttcaatgtaatatcttcgataagctgacccatttcaactaccacctttattaaaacctaataaaataaacatttcacacaatgtggtgcatacttgcttcatacattgacttgtacttgtactgtctacaatatagttcatattagcccttaaaatgtaaccaatgaatccgaaaaccagaagttccagaagggtatacaagcgcacaatatcagactatcaactggaaaatagcaacgccatatttaaatataatcaaatataattgccctgaatccacaagatgctgtcagaaatcacaaataggataatatgacatgaatatgccaacatggcaacaactaaaaaagaaatggtagtttagtgctaccagccctctggacaaacgcattgtgtttagtgtttactcataagtccggaagataaacgaaagaacgagggcaacctgctcatcaccgggaatgtccgtgccaccatctcgtccctgcctcccttgacctccacatctcgcacaccgccgtcaccttgacaccgcaaagccacacgagtcaacaagccaaaacgtgattcgaacaccaaggaaaacgaccaatggggttgcagggagatgcgcttacggattcgaagaggctgggatcggaggcggggttggcggcggcggcggagtccctggatgcggcggagagggcgctgaggtagaagtcggacggagacctacctcgaacggcctcggaacttagggcggcgaagcggatcggatcggcggcgcacgccctcgccctcccccgggacgcccccgcggcgctcgctcgcacgcacgcactgctaggctaggatagggttcccctcgagctccagcagcaagcaagggcgagatgggagggagagagagcagctagcgcaagcgaggagagagaaggaggtggacgcggcggcggcggagctggacggggccgccggggcggaggccaacgcggccgccgcaacggtggtggacgcggcggaacaagggcgagatgggagggagagagagcagcgagcgcggccgcgccggagcgagaaggaggcggccgccgcggcgggggagctggatgcggccgccgcggcggaggtgaacgcggcggcggacgcggcggcgcgagggggaggcggcggcaacggcggcgtgagagggagagtgacggcgcaggacgagagggaggagtcgaggagaggcgggggaggtggctagggctggggttagtgcgcggaactttttcgaaaaagaccctcgactttctatttttacagaacgctcctatttcgcgtttgtcccctcctgcgcatgtaatatccggattttagaagggcccttacgcacaatatcgcctcaggggcaccgttcggcagggacctactcggaattacgaacaaaccgaagggctttctcgcaaaaaaaccaacccgggcactgtaggactagcttttcgctgacgtggcacgccccctcgctcgccactcatgccccgcataatatttcccgatatggaaaaatgatagcaaaatgttggttgtgccgtgcgcttcctcgtgcaggaaaatatcatatatccatttcggccgagattaaggagtttagcagatcgtttgtcttttgatattaattttgttagtcaccatcattttttttcttttgatattaattttgttagtcaccattgtatacttaggctcatccttgtgcaaagcaggtttcacaaggtttgattgagtgcgcgcgccaagaaacaccgtagttgagattttgctcaaagacctactttaattaagttagtaaaatctccttttgctctaaatcccaatgaacaaggaactcaacaacttgtaatttggtgcaaagaattctttatgtggaaacccatactcactcaggccacgcagcatcacacggtgagagggatgaactggacctgatgcattggagtgcaatcagggcagcagccatgttcgagtgacctatcacaaaggaggctggatcgtacgaggatgcaatggtgctagtaacaggatactgggatagaactgattgcggcgtaaccgtaaatccatgagtattttggatacgtgattacacgaacatgtggccctgcttgtgattggagggctcgtagcatcgactactccaaaaatcatacaattgttgtaaaatatatacccgaaccattatgtcgaggggattcctccggatcgatctcacattgataacgcgcccttttccacctatcggtagtttgagagaagtttcctagctacattctcatcagccaaatagtaattagtagctacaaatcaaatactccccaaacaagcaaagtctacatatgtcccaaaatataaaggattttaatccattatagaagggaggtagtaaaaactgaaacaaacacagttgtccttgtccatgaggctatgtgaaccactcattttgatgcggacatcactccttcgggaattgaccgaacaatttgacgtttagaatctgttccggcgctacgacgtcgtatttgggcttgtgggccgtgtatcatgttggaacccattagggttgcatcaagggttgtttgcacaaccctaaactctatatatcaatacccgtcgtcatctctagggtttgggtttagcaatttgattgtaattcaattcatgatgatcataagtagaaagttcatgttcttcagtcattgataaacaggacagtactcaacacaattaccacaaaatatacaaactccgaaatcaatactataattaagcaattgtttccttttaatatccttttcaaatctccaatccacaagaggtagatctatagggcatacgcgaacacatacttcacaagcaatacatttatcaaattcaaagtggattcgcccccagaaacgctccgatgtaattgatttttcataggggtagtgaatcgttataggtaaacgatttgtgtgggataaggtaattatgaaactttgaccaatgtaccttgctgtgcgtattgtttgttgaccataactcatgaacccagttaccatagggaacatattcgaaatatctatgaaaaaggtatgtttctttctcttgtttgagagaacttttgtgttgaaaatattcttactgttattgtattatcttattttatagtgaaacaagttgggaagaagttgttaataagagattgcccagggaaataggtaaaagaaatttccatccaagatttaataactaatccattctcatcctgggtaaagtccatcttattgtgatagaaatgaagagaaataaataagctttagttaatgtaataaagatactcattgtcatttctaaaattccaaccattttattcatttggaaaaatccaaaaaaggatatatagggaatagacaaattccacccgcctaagcagagaactgttacaaataaagaggaaactaataaatttaggtaagaaacaagataaaataaaccatatttgatagcagaatattcggtttgataacctgctactaattcttcctccgattctggtaaatcaaagggtaatctttcacattccgccaaagaagaaattagaaaaatcagaaaacctataggctgacgccaaagattccatcaaaaaaaccatattttgactgtgcttcaactatatcaactgtacttgaactgttggataatcatagtcgacgataacatcccagttcccaccgctattccaaaaccgtacatgaaaccttagtttcatacagctcctctatgatcaggaaaaaaggaaagtattgtttcatttcgttattatcttcttgggcgtagttagaattatctaagataaaatcgatttcaacgtcctaaattagaccaaaggaattctatctgctagaataataaaaaacgcttcggaattcatctcatcctttataatataatggtactttttctttgttcaacaataacttaatcttggaataaaacactcgttataacaattaataaacgaaaagagttgggtattagttcatgaagaattctgtatgaatatggataaacgatggaaagaataaataaagatcttttttttattgcattccatatcttttgtcctattcttctttccccgaggagtatttaaaaagaaaaaaggaataaagggttaattcgttcttgatagccatttccttaacaagtgaatgggaacatactctggatcggaatccgaagaaagtactacttgctcatttccaccaatttcaagtccttattatgattccttttatgaggaaaaatatctaatgctttagattccctcattactaatcctttatgtactttagtgtttctaatccctcactaacttttgatggattcccttatgattacaactttctgtatcaggaatctcttattattgcccgcttcaagatatgatgactaatcaaaaaatctcaaccttggggtaaagaatttacaccgcttatgtttacttccattttttcttgtacataggaaatgagattttttctttttactacaaattaataagcagttttgtttcactcatatagctatctagtttaacttactaacctgaatatagaataagaaaaggaggataaatattcaatgaatttcagaggaaaaacatcctattttaacgaatcgcacgtagagatattgctagtacacaaaaagttaatgggatttcataactaatagattgagcggcagctcgtagaccacctgaaaaagaatatttattatttgagctatatcctgccataagaagaccaataggagcaatacttgaaatggcaatccataaaaaaacaccaatactaagatccgctaaaacaaagcgatatcccaaaggaataactaaaaaacttaataaaattgatatgactgctatagacggtccaatgctaaataagggaatatcccctcgggatggcaagatatcctctttaaaaagtagcttagttccatctgctatagcttgaagcagtcccagggggccagcatattcaggaccaatacgttgttgtatcgatgcggatatttctctttctaaccacacaattacgagtactattctattgtgattcccagtaagagggtcaaaatgggtagaatccatatcagtccatagacttcttttaataattccaagttcgaaaaagaattgatagcttctacatgtaccctgtctattatcatttcaacgatcaacttctcccataatgatatctatactacctaatatcgtcatgatatcagccaatttcattttttttactagctgaggaagaatttgcaaattaataaaaccgggtggacgaattttccatctccaggggaaaagactatcatctcctaccagataaattcctaattcaccttttagattaatctatcaagaatagtttcgccgctagatcggtttgtaagaccccaacttgtgagcttaatcattcatctgcaattttggttgtattctttcttgttcttgtttttgttcttcaattcataagcagggattagccttctcggcgaggtcaaccgggtttcggcactgttgataaccagaggagacgtggtgctgcgattgcggggctcaagaacgtgctcgttcaagaagccggatcgatttgtgtcatgactccaccaaatcgttgattatccgaacctttcgaaaaatcgggaacccttgtccacatcacatttcctcgtgaaaatcctgccaatctaagtacatatttatcgtgtagctacaaaagttgacatatcatctgttctagtaatataaacataaattgtaaggtatagatgccacactattaatatctagcacaccactctcccacaacttgttagggctcgtgttaagttgggctacaatttcactgttttaccatgccatctgaggtagggagacaaatctatactcaactctcctccctttgctagctgagcacaaatctaatgcgatattaatggtccgcttacatcgtcttactgtattcgctctaatacaactaagaatgatccgatagttgtatttttatatcggtaactggcaatggctattaccctgttgaagtcgctcaatgaggttagtcatgttctcttgccaataatacaagagccgaaatttagggcttagaaatatgatgattgctgtcatatttatgtaatattatgttgctgtactgtttttgatttcatataagagaaaatgttggaaaatagagaggaggatcaaaattagagaacttaggagtgaaagactattccagcttattcgtgagagtgatattgcttgtataagcgagctccgaatggacaggaggacatttcacattctatgtgacatgcttagagacgtcggagggatcggtagcttcattcttatatatactatctcaccatttaaagaatagaacaataggaaagttttttttaccgaaatggagagactgtaagtaggcatttcaatttatgactgctagctgttctgaagcttcatcaacttctacttaggccttgtttagttcgctaaaagaaaatttttggatgtcatatcggacgtttgaccgaatattggaaggggttttcggacacgaatgaaaaaactaatttcataactcgcctggaaaccgcgagacaaatttattaagcctaattaatccatcattagcacatgtaaattattgtggcactaatggctaataatggactaattaggctcaaaagatttgtctcgcgattttcatgcaaactatgcaattagtttttcattttatctatatttaatgctccatgcatatgtccaaagattcgatgtgacgtgtttgggaaaaaaaattggaaactaaacaaggccttaagaagccagaacctatacctgaggacaccaccgacgatagatggaagtatttcaatgcaacccattctaaaaaataaatcacatttcctttcaaaaaaaatcacatctcaccactattaattgtaccatattttattgatgtggtgttctagattgtagaattgcctaggtgcattggatggtacacacataaaagtaactgtcccaaccaggataaaaggaagatataggtcaagaaaaggagacattgttgcaaatgtattaggtgtttgtgcacccgatatgcagttcatttacttactacccagttgggagggttctgaacatgatggctgtgtccttcatgatgcaattcacaggtcggatgggcttcgtgtccctcaaggcgagttttttttccaataaatttattttgaagtgtgacactccacagcctgaattatactgatatttctttttttttaattttaaaggttgctatttttttagggaaacactgtaggggaagcccccatagtaaaattaattaaaatataaagaaatatttacaacaagttcaaccaacccaagagcagatgtctctctattacattcaatctatgaactaacaaagagagatcacttttaaaggttgctattactttgttgatgctggttatataaatgcaaatggttttttagccccttacggaggccaaagatatcatttaggtcgtttcacagcacttgaccgaccatgtagtgcagaggagtactttaacatgaggcacacaagtgctagaaatattatagagaggtcttttggaagactaaagggtcgttgagcgattttgaggtctccatcctattttcctatcaaaactcagtgttgaattataatggcatgtgctttattgcacaacttaattttgcaaaagatgtctagtgatccatttgaggatgaggatgagatactgtcggatatacttaagggagaactcgctgaacctgagtttatctcagctatttcgacatctgatgattggacgaattttcgcaacactcttgctcaagggatgtataatagctatagggctcattgaggtttgtgttttaaatggaatttctaattgattgcaaatcagaactaaaaacaaatgttggtacaactatggacgctcactgatgttagttttctgttgaatttctaatattgcagttatggagcatcttggaagctcaagcattgtgcgtgggagaggcaataacaagaggatttggacgtacttcgaggatgaggaactgatcaaggcactgttcgagattgctttagatccaagctggaaatcagaagggggtttcaaaaatggatactgccaagttctagagaacgtgcttgctaagaagttgccaaattctggccttactgctgttccgcacatcgagtcgagagtaagacactttaggaccaagtttggggcaattgaagtgatgctaaccaaaagtggcttttcttgggatgacaacagaaagatgatacaatgtgagaaacaacaatacgatgatcattgcagggtaagtcatcaaactaactatataattatatggaatacaaaatttatttattgattcattagtgcattgaattgaaatatgtgaaactaactgtaagatattttctgaaattttgttccaaataagaggctatgtaaaattcctttgaaatgtttgcgaagacaacattatggttttcttgtagtatgctctctcataaatatgttctcttgtgtttttcatgtaattgttgcatttttgatatgtcacagtagctgcataggtctctcttctgcttgctaaaccatgaccttaattttgtgtcattctttgtattttacagaaaaacaatgaggcaaagggtctgtatggtgtagcattccctcactatgatacactagctgcaatttatggtaaagacattgctactggagaaggtgcagagggttttggtgaggctgttgctaatatggagaaagaaattgttcgagatattcaagatgaagaggatgaggaggatgaagagagagtgtctagagaaacgcctcgacggagcgttgattcatcagcacctcgacggagcatcgattcagctgcacctcggcggatcatcgattcagctgcacctcggcggagcatcgattcaactgcttcaagctctaagaagcggaagaaagacagcaacaaactgaaacataccttgtcaagtgacccttttatggatgtctttgccaatgttcaaggtgatctgagggatgttacaaagcatgtgggagcaatggtggcatctatgcaacatgaagctgagatccaagagaaggcaatggttgaggaggacccactacaaaaaattcagaatgaagctattcttgagtgtcaaaagcttggattgactggtactgaagttgtcaatgatgcagctgcttttgtaaaagtgccggctcaaatgagtatgcttcttgctcttccagaatctctcaggagggagtacgtcctgaaaatacttgctggtaattccctatacacatttgcatgttgtattacatactttattttgaggtcattaattgtaagcatattgcattttactactttagcatttcatatatgcattcactgtgaacaaattcgcatcaaataccttttattgccttatatactatttgtctgaaaccatgaacaattataatgcatgtatgggtccagctgtccagctcaatgccataggaattaacctaaggaggcataattcactccaaactactcctagctggagtatgtgcctatgcctttcttgcttgcttgcacctataaaaaagtggttcaagaaaacaaagcttttctaccaattccttgtacatattctgtgatcaaagtactgtcctatttttaagacaaaagtactaccctagcttatttgttaactaatctggtagtttcactcatgtcaattgttcatccaatcctttatcgattgaattttgaaggtgtgccattgattatattttgcaaaatattatctcttgtcttgaattcttgctgtcaaaatttgcatccaaatagaagtgacagtgttgtgcttgttcactgcatttgcatccaaacagaagtctccatattatgtattttctcgttgtgtatcagtttcagaatttgatttctcaaccgacacatgttttgcttgcacctgttagtctgttacctggctgcctaaccaaacagcgcgaatgaattggtatccgttacagcaactatccagacaaagcacgtaatcggttaccggcggaagcattcccaattacgtttacgttaacattattgaaccaaacaccaccatgttctcttgccaataatacaagagccgaagagttgccaaatgttactctgctatttgcaagttccgcaagggaccgcataactgcaaataagcctggagctcaatgcttacatggcctgaaaaggtggccatactctgaagaatgattataatgtatacatatctatgtgctgagaaatataaaaaactataggacgagaacagctaaaatacaacagaaaaaagaacatcttgaggccaaaggaagcactgagctttacaggaggctcgccaatccttgctaatagttggtcaagattttatctggtgatacaccatctgctacaagggctgatgtgatctcctgtgaagcagaatacatcatcatcatcatatacaattaatgaacgggaataatggaactcatcagattttagttaacgatagaacttaatgagataactcgtaccaaactgccatccaaaagaacaagacaacaaagaccgataaattcatctgtacaatcgaaaatccgtacagtgcacgggcaaaccgcaaactaatttgtaactttgcaccacttgcacccatgtattggtagccaagagcaggctggccagtgttgtgtgttgaaccaaacaaactcatcgacaatgaaatcgacatcgcagtgctggccatcgtgttgaaacaccatggtggtttgagcctaccacagctgctgcaatctccaccagaaacttatcatgctattgaagatggccacaacccaagcaaaaccagcttcatagacatgaaggactagcaggtccttaccatagatgacccgaaatggagtggaatgcttagctgtctagaaatgagttgcaacgaatcttagcacagggcattcagtgaactcactgtgggccgatcatcagcgacgcagtaaaggtacatctgccaatgggattggggataaaaggcaaagctcatgtgtagcatgacatataccaactggaagagatcctcttaaaaggcactggtgaagatgggatcccttttgctcataatagataacgggatactctgtagctggacgatcgcattggacaaggcccttgcgatggagcttgctatattgggatggtcaagggcgatgaatcgctactgtgtagtttggatgatgttgtacaagaaagcacttggggcggagctatattaggacgttcaagggcaatgatgtgagcgcacttcaagaaccagtccttgacggtaggacggcatacataacattcacctttcggagaacctcaaaaaggggatatgcacctacattagagatgactcctgaaggggttgcatgagactaaaggggtggaggtgttctatattattgttttgccacatgatattcgcctatacaaaagtcctataacaaatgtcgcatgctggcagtggcgtatctaggtttttctatgggtggtccaaccaatatatatttttttaaaaaaccctaaatataacgaagctaggagtataaattgatcaaatgtgcatcaaaatgcattaataagggtgctttttttctttttcccccaaaaaaattcatttttgtatatatatgcattgggctaggattttttttaggtggtcccgggaccacccttggatctgcctgtgcatggtggacacatgcaaaagtgcaactgtagttggtgcaaggtcttttgggtgtcctcgtcataccatggtgtcggccaacaagttagcgaaattatcaatcgactggcacatggaactttccacggtgccgtaggagaccatcgaccgtgctctaatattacatgttccttgtatcacaatattgcatcgaggcctgcctatactctaccctaaaagcataacagcttacctaattatttggtgggatcgtggagaggcattgatcctagatgtacttcaagctaagaggtaggtgaaaactatggaaaacatcattgttgcttgatgtgtgacaattctcacatcataggtcaacgaggagacatcgagatcaagtcacacaacaatgctagattcaaacagttaccaaatgtgcatacgggctccttttcaggcccataagtacttggtggaaagctcttggagtcctctttccaacagatttaacatcatctctatattccatcaaagttggccacaattaaagaaagatggtgttgtgccacctgtcatgagcctttatgcttataattttgtgtggagactaggacctcggtccaagtggggcccatgtggagtgcccctcaatcatgtggagcacaaccctacacaccccaaggtcatcctcccatctccttaaatagctaggtaaccttcagtatttctcaggttttcttatattaaagttagtcattgctactttgccttgcagttgcacgtgtctgccagaccgcctaattactcgtcttcggaaccacaccttatcgagtgttcgatttatcgtgagcttgaattcctatttgtattatcaaattactttaatcttgttcttccttgtttcttcgatttacttgcagaaataaggttgatctgaccaggtaagatcaacaacagatggagaggtgtatagatcgctaaggtgcaatacaacgtctagtacaattgtagtcgggtcatcaacttctctcccaaattataggtatcatcaactaacagaaaaattggaccatccttgctcatatcgattggaattacagagttgtgagcgtttcactactaaagacaaccttaataagttggatcaactctcactcttaggacaataactttgtgttaaggtatgtctgccctgttgaagaaagcaaggagggaatcaacttgatggagaatctgactgaagtctagacccaaggtgtcacaatcgactgcagaaagtgtgttgatgttaggatctgcaagacaagctagtgatcaacaaaaaatttaagagcttggaatgtacgctcgcctttggtcctccaaaaaactccttcacaagcttggatagctaaacaaagtcgtaatcctagataaacgttttgtagtatccacacaaaaccaccataagatctatcgctgtagaggattaggtatttagctcacatggtgtggcctctaagccatgctaggtgatgagatgtcgagatggttctgccactagaaggacatgggcgagccatcaaatttccatacatgtgccaacattttaaacaactatacattgacgatgtcgaatcctccaagaggaattgtcacccttttgctaagccaggtgcttgtcacccaattgttattagtgatgccaagcttacacgcattgtctcatgcacatagttgtgtgagttgtagaccatgagtgcaacacattggaggtgcccttgatagagactagcaactattctacttgtgtggatgatgataacattaagtgatacctagatgtcctcggttggcttacaaggctcttccaactctctatagtacagcaccatgggcgatgtagtggtggatgagaccaaaattcctaggcaattctaacatagccgcctgggttcgattggtcattttcttgggttaattagatccatgccatcacaaatttcacgatttagaaaaataccattactattcacctatttttaactatgccactgcaatacatctgaaatcggatccatgccactctatacaactcaaacatgtttgaaacgtatttttgctactgtattttcgtagggaccaaaatacccctcgtcctatccccataggacccacctgtcaagttcatcttcctccacccttcccaatcttcctcttcccactctctccacaagctcttccgatggtttgcagggacggctcctgatagtggaggcagtgacaatagtagcatccgacgaagccgcgacctgaattgtgctctccgccaggctcgaggtgcagtggaaacgaagctccaaccagcggtatcttctgaagaaaacttaaaaaataataacggtagcttctgaagaaaactagaaaactgaaaaaatattaaggggaaagggacaaatcagatgacgggagctagcaaatctcctctcctgtccagggtgcttctgcaaaggcagacctcctcccatagcggccaggtcggtcagcttgtcggcctgatcctgctactactctcagccatggctccggcagcgcgcgcggacaagcctgcgaggggctggctggcagtgacggtcgaggtggacgagtcctccgctgtgtactacccccatgggtatggcttatccaaagaagagaggcagagtggaggaagatgatggatctgacatgtgggtcccatgtgagaaatgggaccaggggtattttggtcactatgaaaatacaatagcaaaagaacatttcaaaacgggcctgaagtgtacaaagtggcatgaatccaattttatatgtattgcaatggtatggctataaataggtaaatagtagtggtatttttccaaaccgtgaaatttgctatggcatgaatttaattaaccccattttctttgggtgagttgattggaccaagacataaggccttacattgggggtgagggtcgctagcgccctgttagggcattgctgtaagcattgaaggtggctcattggacgcagttggcttggcaactggtttggctgtgatgtcctctatcaaacgccattggaaagtgtgagtgaggcacatggccacatggaggttgtttggcatattcctccttaaacctcttaggtggagtaattccaatttgccaacagattgttacacattcgtggtccatgtgcatattatctaaaaagtgaggtcatgaaggactcctcatcacgctcaagcatatggtaacattattgtgctactccggagaagtggtgcaccgtggtgcaaccaaccacaaccctactctgaaaacaaatgttcacatcattaacacaggagaaggtcgtacttacgttagaaacttaagctatctgcgtagtgctgctttcttaaccaacaatactaacttgaactagatagaactaagggtggtagtttctccattgggtctagggcctaggcaattttctcacccacgagttgatcggggtgaggcacttactgcttccgaggggcggaggcgggttatatgtttcatccacggtgatcggcaaggccccgtatacataggagatgagaaaatacatactccacaaaagcccatcaagaaaaccctatcccgttatgtcaatctctcggtccccacaaatccatcccacaccaccatcgcagacctccccttcgacatcgtgtcccttgatctgcactagaacgcatgtagccaaaccactatgctacgttcgtcgttgcggacctatcccttgaccttgactctgcatcccgatgaagtagcggccagggctcctacgacactgcagctggcctcaacctcatattcctctatcctaaagcgtggtggtcgacggtggctgatggctggccttgacctcctattcctctgatgtgtcgcttcatcttccacttccgtcctcagagtggccagggactgatttcgccccactcttcaccctggggctggggttgttcttgtccaatccacacccgccccactccgttgccaacccctagttacatctattgtcaccaaagaagatgacatcaacttaccacaaatcgttttggacaatgacatggtctccaaaaaataactttaaccattgttttctattataatatatataaaaatatcaacaaatatttagctttgcttctcaataaataatattataattattatagttgaactaaattcaatcttcttaaaattttacttaccacatgcacattgatggtataatacttcctctatttcacaatataagacattttgggttttgaatagattcatgcatggatctaagtatgtgcttcatatatgtctaaattcataaggatgttagtaaatatagacgagtgatggagagaccaaaacatcttacattgtggaatggagagtagcattttgtacccaaatctgaattttatattgattaaacgtatgtattggacacttcatgatgtggattatactccaattcataagtgtgcaaactaacattactagctcctgactgcaacttgcagagttcaataaaatttcagggtgaatcaaattagctttatctcaagatgtaatacagatctgagcacacaaaataaagtgcaagagctagtggtggtttgatatagctatatttcttgcaacagacagcattgggtttatcacaattatgataagaatctaggaactacactaagcgcagggcaacatttgattgctacaaagtgcagggcaacatttgattgctacagtaagtgtaaattatttttctttttttgggaacaaatagctatcggcctagaaaaaaaaggttcacttttggagtatttactgcacagtattgaattatatccttaaggtttcagctctttggccagaagaaccaaacataatatttgtaacctgtagcacacataacaataggaatgtgcaaaagtaaaaaaaaaaaagagaggataaacatgcctcagacatttgtttttgtccacagagcactgccccagtagaaaaatgatttgctatgttctgggctttcaagaaagcatcctggaaaatgaaaatgatatgatataaggttgtatgtacctatgaacatataacaagattatagtaatgttggagttttcatatattacctgaacatatccccgttctcctttccaactatcatctgctcgtgacaataccggtattattttaagcccagttgactcccagtttgtaaacctatcctgccagagagaaaaggtttatgtgaagatattgtttacatagagcagaatgaaggaaagttccaagtctcaacctgatatgccattgtttggagatttctggcaccgtaataaagtcgtacatcagctctttgatccgcagcaaaaccaaactcaataagtgaccgaaccggactgcatgattaacatacaaattaacctgggtaggattccatcaaaaggatgccagactatacttgatcaccaaaaccagacagtcagcaacaatatggaatcagactaaattatcgtaaaagatgtatcagcattcaagacatatttagccctgtctttcctatccagcaaataagataacagcatgctgatctcccttagaagcaaggaaaccttttcctgctcttgggtagttacaaacaaaatacacgtccttgacaaacgccaactaacatcatgtacatgttagtgaaactatcatgaaactccaacatctttttttcgattgccctattgctaggttgatctggaacattgtcatgtgtgcttttaatttgggacctatcctgaacagtaatcagttatttggcacatggctttctgcgtttgggaaaaaacttaaaaatctggtagtcactggggtggctgcagtgttttgggctatttggaaaacaaggaacaaaaagcttgttttgacaaaaaatttcctaatgatccaactgatgtagttttctttgtttgccattggattgaatcttgggttcctttgcagaaagtggaggtagatcaaagaaggctgctattgggggccaaactcataagacaggtagcaaatgagatcttcaattccaagtatggattgagaggaggcgcaagaaggattggactgtgaagtcagcttagatttgaagacctgtggtggctgctgccttgctatggtctttggattcttaggtgtcttagctttactttaaaactgcagggagttgagtcctttgtgtcataggggagattttggttggagtcttctggaaaaccgtattttggatgtagtttcctcagaaaactagcttgctggtagtccttgtttcctttgtatgaaagaactctgtagtatgctcatttctagtaatggaaatgggggcttcatacccttggtcaaaaaaaaaaaataaaatcatgtacatgtccttgccaaacgctaactaagtttgctttgatggtgaggaaagggaactaaacattctcacaatattctaacaaatgtgaagcaatagttcattttaggtccagtaaattggtacaaccattcaaaaacatataggagcagaaagagaaagcagaacccttactactatagtacaaatgcatttatctatttaactttatgcattgttctctttactactacagtacaaatgcatttttctatttaatctctactattataaaaattgaagatgtttatgccggtcctttggtatgtcatccgtgtttgagtcggtttttaagttcgttcgcttttagaaatacagaaggagtcgtataagaaatctctttaaaaaaactcgcatgctaactaagacgatcgaactcctaattgcagctcatgattttgtaaaacaaatatccaagcgaattcccacaggcagctatgagacattaacattggcatctactccctccttcccaaattgatcatcacataatggaattcaaaatttctcaaattgatcatcatataaccgcatggacacagatttcatcagaatacaattaatacaacatgggagaatgtgtgcatgctaaggtgtaagagcaggtacaataacaggctataagccagctataaacatattttaatgagataaaggaagagagagaagagcagcgggctacagatctgtagccagctgcagcacagactccaagacatacagtgtgtaggatcatgtattaatagtgttgtaagcaactattgtatgaattggctattacattggctataaatgatatggagctagtagttagctatactattaaacttgctctaactggaatgatgttttaatcgatgcatgcattgtgggagaatgtgttcatgatgacttgattgatgtgatttaaattatcattggtcttgatgcataaaatatgatgatcaatttgggaaggagggagtaatgtttttctttaattttctttttctttgctttactttatgtttgcctctatggcttcttacgaataagagactactttgaatcttcaatactcttaaaatttcacatgaacagatattaaactggcaaattagtttaatgttcggttttacatgctttatatgtaaaaactattttttttttacttttcctaatcaatttcgagtagtgacatatgatataagttttcccttgaagaaaaagtattgctatattataagcttagctttcacagaatacgatatcttccatgataactgccatcgccattttgggcccatgggccatgagacaaagacatgaaaatcatgattcttttaaacccttgattacatgatattaagttagcttaagtcctactttcttacatgtttccctacaagaatatttggggctaaatggggggtgatggccaagcagatcaacaaaaccaagagtgctgattaacctatacaaatttcgtactaaaaattgagaaagccaaaggaaattgcccactatttggcttattaaaaaaattggcatgcgaaaggaaattagtaatactaagccaaaactagccaatctgcagaccattcgatgggaaacaaacagctcacaatcttttgctgcccaatcagcatgctggggcagctgggctgacatggaaggtggtgattggatgcatgaaatatgctattggtttatttagtactaatgcttaaaagatcatatattctaaactaaaagtatttattttgtaatccatttaggaaaaatctatttctcataacttagcccagtcagtccagtcatagaaaattcacttttttttacatagagagtaatagaaggaaggtagaaccaccaattcgtcatagtcatatacatattggcattttaccttgctcaagccaaaggctacccgctaccctacctatttgccaaaacagcatgctatctacccaatccttcaatgccaaacattttgtcatgcccagatatcggttgtaaccaaatcttgatatggtttatcaaggctagcaatcaaacagtcaacacaactaaggtttggctatttcttccgcctagccaccgctgcaaattttggcatgactactgaccagggatggtggccagagggtgtgtgccccaacaggcccaggatcacatgctgtttaacaagccatctcaacttgtgtcacattgcatatgctgtaaggcaaagtgcgttgcctcaccatactgctgtagtaaacatgccatttaaataaaagtatgtaatgcagtatagcgtaattgctaatcttcgtacacataccatccatttctcatgttaatttttcatataggtaattcttttgtgatctatttcatctgtaaggaatgtttgatccttagcaaaacaaaaacaaaaggcatttttttaggaaagaaccaaaggtgaggtactaattttctaggcttgatttatatgcataagtaatagataacacaattatgtcagcacctacggttattattagagatactgttgctcgacgatactgttattttctcatcttgcattcttccgctaagtcagcctttatttattttagcaaactggattatagtaagtaaatgagtcgtccgattaatgagatacatcaaaagaaacaagttgcattacagtgacaacatgttcaaaattactgaagaacattgcgatatctctaagcttatacatatgaaatttgttatagctcagaactattttaaaagcttcactatgtgtaaactgcaaaatgctactaataaagcaatatgtgtgacaactgactattgcagtgttaaccacattaaactcagctcagcatatatacaaaaacaagcattcatcagagagagaagcaatcacctgatcccggtccctgtagcaaagaggagcacagtttgcgcctcatcgggcggatttatcctgctgatggggaacccattacccattatcgcgccaagctccagcacgtccccgtcgcggagcccacacagcttctccgccgtggtaccaggtacggtcttgaccaagaactcgaacgcggcacccccaggcggcgaggcgatggccatgaacgccggtttgagctcatcctcgccggggacgcggattaggagatactgccccggcgtggtgtaggatgcggcgaggtcggtagcgtcggagaggtccacggagaagtggacgagcgagccgtcggcggtggctgggccgaaggaggagacgggggcgggggtccagacggccgcatcctgctggacagcggcgaggcgacgggagcgcattcggcgccggaggaagggcagcgagcccattgcgggcacggcgaaggcatgaggggagggaaggagggggagggttgtgacggtgttggcgaccgcagccatggcgaccggtggcggtgggattcttgttgggagcaccctggtcgactggggatttgaggcgccgataaatctggaggggatagaatcatagaaatatagaatgatgaggtggggttcactggatggaaacacaaagataacgggtaggagccaattggttgtttggaacacgtggattatgggggggggggggggggggggctatttgaaccgaattttttggtacagtgtttcaggttacagtacgttttgaatttggtcaaagtcaaactattttaaattttactacttttatagaaaaaaaatagtaatatttttaactcaagataaatttattataaaaatttattcaattgtatatttaataaaactatattgatgttataaatatataacatcccgaaaattaattattttctaattatgcatcatgttgattcttatattcttaataacctcctaaaccaaggacattataattataattagagggaactcctaaaactaagtcgcataaaacctctccttttatttaatttctttcgtatttttcatttaactagcaaaaatacccgtgcgttgcaatgggtaaaaacattctaatgaaaatatacgtttttcatgcataatcatgtcaatgacaatgttttattttaatgagcggcttgttttttataaacaatgtttttttcttgcgagattttctcaaaccatttttcagaaatggcgtatttctttctaacagttttttcctagcattttttttgctttttttactgacaaagaaaaccatatttttctcctttttttgcttttcttttctcgtttgtttttttgcctgttttctcgcacgtttttttgcttgttttttttcgaatgttctttttttcttttttctaatacaggagaatatatgacaaaataaaagccgtgtagtagatggcaaaaaatcgatgaatcctatccgactcaagtgtccatcaatttagcttttttctgatagtttttttagagcgatttattttttaatagacggtattttttcttgcgtggttttttaaaaccattttttagaaatggcatgttttttctgacagtttttcctcgcatgtttttttaaaatttttttaccgacgatggaaataatttttctcgcgtgtttttttatttttttattgaagatggaaaacctttttagcgtgtttttttgagctttttctgacttttgcctcacgcgtttttttaacctttttttctcgtgtattttctctttttttaatagttagattagattagagatagagaagagatatatacttgttagaaataggattttttccgccctttccaaattttttttcgcgtgcattttttattttatatgaaccagttttttattttttaagaaccatttttttcgccactttcttagggaatcggacgaacttttttagatgttttttcggatttttttcgcctttataggaattagacttttttttcctgtttttaaaggaatcggttctagccttttttttcaccacttttttttgccttttatatgaatcagatttttttttatttggatctacagtttttttggccacttaggggaaaaaaacttttgttatcgttgtttttctttattttcttttttgtgcggcttttctttttctttttatgcacctttctgcctttattttctctcttttattatttttttaacaaaaacgacctcaaataccttattgcaagattatagggactcaaatgtaaatataaaaattatagagactcaaatgcaaaagtacaaacccaaaaattaaaatcatataaaaatgaaatgatctcgacctgtaggttctattttttaaacagattttcagttcggctcatcaatttttttcaccaatccagagtcggactttttttcgtttctaaaagggaatggatataggagtcggacttttttattttttatttttcgctattgtttttgttttgacgggagtcggactttttttattttttttcgctattatttttgtttcgacgatgaagaaagcatctcttattttttttaagcagtagagaaatatatttggttaaattgaggtatttcttgatggaatcctacattaaaccttctttcgactaaaattcttttattgaaatttagtttgaaaaccctttctacttttatgaattatggtccaagaaaatcctccaattccaattttgaattaattgttgacccatcctttgattctaaacctatccttatccaaattcctcctttttatctagtcgccaatttaatttatgtggcttaatttcctcctcggttcaagaataacagtattataaatatcagaatgatttctcttgtgctaagaagaatagatttttattttattcctctcttccaaattaattccctattagccacaaatatttcttcaaatattcatactaccagtttccatctctcaaaattattgcactcaaataattaggaaatctctcttttgaaaactatttctaaaaataagttcatctcaaaagttagccacctaaatttcttccaaatattaatttggattcaaatttcatccttcaaatctaattcgaaaatacaaaaagattttttattcactgtgggccaaaaaatttcaatctagcccattccttttccccttcgcttggcccagagggcccaagaggcaggcgcctctctccctcctttgtgagcgcgcgtggtgcatgcaaacacgccgctgccttttcgccgagccgacgcgccatcgctgtgcggccttgttgctccttctccaccgctactgccaccgacgtcagccgccacctcacctcgctgacgtcaaccgctagccgaaccgactccatcgtccaatcggagacagagccgccgccgtgctcctcttctccacgccgccgtcgccatgtcgtccttctcctcctcctttacgaaccaacctctcgctgcctataaatagaaggcgagccctccccttttctccacacatcaacaaagcctcaagctcttcctctctctctctccccaccatggcaaccaccaccggccgccgtcgatctccttcaccagagacacgccggccaaaccctcgcgccataagctttgcctcgacgaggcaaatccattccccaaattcatctaaattcaaaatctacattttgatactaaatttactattttaatattttatttgaatatccaatttaaacatatatttacctttcaaatatttccctttatcccaaaatacctattagctactaaaaagccgccggttggaactttacgtcttccatggggacgttcatgcggtctacgggtcccgatgtcagatcattggttgtaaagcccggtagaaccaaacccaaggtttaagtgctgctcttggcaccccacgccttgatgcgtacagcggtcagagcttcactattcccttgacctccaccgcacgctgcacagttagctctcgggctctgtgtgatcctagccactccgccgccacccacggttgtcggagtaacacttccgccccgctaaacctgcaccaacctcctattcctctagccgatatgctatctgttgacaccaactagagaaaataccaaacctagtcgttatactgcccaactctagcaacgactagtaaacaaccaaaccctagccgatatgcttccctactccacaatcggcttaaatataaccaaaccccagacactatactacctaaacctatcaccagctaatactagccatatgcctacttagccagttcaattacctaatatactctgtatctccaaacaaccaaagcccatacataaaatgtaagcaacaatagttgcttaatcctctatccaacctagcctacaaccctttagaacctacatatgaaatataatccctatatcctatagaagagatagattataccctaaaccctagccctcctagttgtttatcgttctcttgttattttatggcttttattgaatttggttcttcctcttctttagtagaatctattatattttggatgacaacctgtgatatttcgaggatcggataatcaggttgcttatctcggatttatttgcgttggagcaaggcaagttattattccccccctttgagcataattgttgtcgtgacctaagggcatggacaaagttgggagatagaagggaaaatgtaatttcccgtctatcctaagagtgagctcaaaagacaaataccaaagtgaatgaatgtgctttttctatattcatctcctcccgtgcttacaggatcttggttggcttaaatagtgctcaaccgcatgtccaagatttacaagtttgtcattacaggcttacatgaagttaccattttacccctataaagtttatgacctataggggcattttggtacattctggtggtccctaaatgacatctggtgctagctggtgagagtggttgaggtggtccccatggtactttcccaaattagaccatttgctcaatggcacttttcctcaacttcatatgctcgagtgagatcacccgtgctaaggctcgaacacattctcccacctttcaggctccttgtcaccttaacctgcctgaaacacagcttcattaattagtgatgttagtttgagcaagtaactttactcgaatgctttttccttgggacagatcctttagggtgaatacatatatattcccatacctaaaactactttttgggtggaaacttcattcgagtcaataaataactcgaacacattttccttcttgacatatgttttcggccgggcatgggggatggtgtttaccacctgctacaacaagcccctcacgggtaagggcgaagtgttttcggccgaaaccgtgctagatcaaaaatgcaggggagtaaccgccgtccccctgttcggtcgaaaacatcattgagatagctgcggtggaactccgcatggcggggaatttgcatatttccatatcgctcggcactacacaaagcagaattctcagtttgaatgcatcaacttcatcgtcgcaattactttttagttttcgagctcgaatttgggtaaatgctttagagctttttttatgtcgtgttttcgagctaaggcaaaaaattgctcgaaaaccgccgtccccctaacgtttcaaaggagtgacgaggtcgaacgtgtttccctcgtcgcaattactttttagttttctagctcgaatttgggtaaatgctttcaagctttttttatgtcgtgttttcgagccaaggcaaaaccttgtttgaaaaccgccgtcccccttacgtttcaaaggagtgacgaggtcgaacgtgtttccctcgtcgcaattactttttagttttcgagctcgaatttgggtaaatgttttcaagcttttttttatgtcgtgttttcgagctaaggcaaaaccttgttcgaaaaccgccgtcccccttacgtttcaaaggagtgatgaggtcgaacgtgtttccctcgtcgcaattactttttagttttcgagctccaatttgggtaaatgctttcgagctttttttatgtcgtgttttcgagctaaggcaaaaaattgctcgaaaacccccgtcccccttacgtttcaaaggagtgacgaggtcgaacgtgtttccctcgtcgcaattactttttagttttcgagctcgaatttgggtaaatgctttcgagcttttttttatgtcgtgttttcgagctaaggcaaaaccttgttcgaaaaccgccgtcccccatatgtttcaaaggagtgacgaggtcgaacgtgtttccctcgtcgcaattactttttagttttcgagctcgaatttgggtatatgctttcgagcttctttttatgtcgtgttttcgagctaaggtaaaaccttgttcgaaaaccgccgtcccccttacgtttcaaaggagtgacgaggtcgaacgtgtttccctcgtcgcaattactttttagtttt

SEQ ID NO: 73879 - DNA, 17575 bp, Oryza sativa
cctccccttcgccctcctcccctccttatccaatatagggggtcgggaacgggggaggtcgcaccacagcgacgacggcggaggtgccgaatccagccgcggacgtagccgcctcgccagatccggaggggagggccgccgacgccaccgccctcacccctcccagcggacccaccgccgcggcgtccacccttcgcgccgcctccgccttctacctccgcctccatcggatctgggaggagggagggaagcccgccgctggctccaccctccgcgcagccaccgccttgagccacctctgccaccgccggtagccgccgccgccctccggcggcagctccggccggaacccgcgtcgagagaggagaggtgggaggggaggggaggggaggagaggagagggaagggagagaatggggagagggtttcggaattggggggttagtgtaggacgttttgcagaaaaccccctatagtttttatatttacatatctacccctaaaagcggaattttctcttcttcgcattgtattttcctgaaagacgagcggttatatgaaagaaatacaacgggatgtcaggcggtccgaggacgtatgcgatattccgtgaaaacacgaggagttttttacaaaagttcccagccctctcaccgggagcagcccctccaccctaaccgccacgcatgcacaccaccacagcgcccaaattttgattaaccggcgcaccgcttatgggcggttggccccgcgcacgcgagtagcaggagggattagcagcgaggtgtaaaactataagatagcccaaaaaaaattcaagaaaataagaaaaatggtggagttagggaagttattgattgatgatttatcaaaaatcagattgatcgttacttgtccatgtatactgtataattataccggtgatctttctggactgtactgagtattcggttgtgatgccaaaacagaaaaatgctgaacaaaatagattgcataaagtattttcggcaagttgaaagaaagacaattgtgtatgggtggtagggatggcaatcgggcgtgacgggcacgggtagtgcctatccatacccatgcccgtgagattatttgtgcccgtgggtatacccattactacatgacgggtaaggatggttgcccatgcccattgcccgcgggcgccttatgcccgcgggcgtgcccgtttacccgccacaacaaaagcagtggaacaaaaagtctacaagctactaacttcgaatcgaacttaaaacatcaaatattctccgcctcggtgtcgtgtctctcctctgtcggcgatagagtaagaggagagaaataataagggaaataaaagggaaaccgtagaaaacaaagaacgtggcttatgtattctagtggattttactcctagcctacatgtaagttagatttcgcgggtaaacgggcaaagcgggcatgggtagtgattacccatacccatgcccatttacccatcgggcatagcttttgaaccaataagatacccatgggtataaaatggagaacaaacccaaccctaataggatttttacccgcgggtaaacgggcaaacgggcaaacgggcataattgccatccctaatgggtggtgtatgtatcgctgctgatgtttcttgaccgagttaaagatgaccgaatcactgcatgttccaatgttttgttggacaggatcacgttacttatcgtgttgccggttggtaaattgaaaaaggtgctgtgaataatagacacagggtatctaaataaccttttggattcatagacacaaaagttgagatggccgagttggtctaaggcgccagattaaggttctggtccgaaagggcgtgggttcaaatcccactctcaacacatgattctttttttttaactttcctcaagccttcaattcctgcagggtagttttaagcctacacctccttcataatcatctcaaattcaccccaagctaaattaagcctcaattcaaattcaccttacaacattgtaaattttgtattattttcttttaatccatcagttcttttttatactcatctcaaattcaccttacagctaataaatgaagcctcaattactacttcagtgaacatgtcaacgattaaattaagacggcaagcaggcatcatctcacggtgatcactgacagaggtaaacgaccactgttgcctctaattgactaataatcgcaatataatcatcaaatcagttaatcacacatgacatccatatcgaagacccatgcaaagcaaaatagagtatggctagtagtaggaggaggccttgtggatggtgaggatggtgagcatgaggaggacgaggtcggcgaaggcggcgatgagggcgacgacgacggcggccatggcgcgctcgcagaagggcccgtacacgtcgcacaccttggcccacctcacgtgcgcgttgccgcgctcgccgaggaggccgaactgcgccgccgcccccaccgccgagaagagcagcgccatcgccaccaggtcccccaccatcaccggcaccaccgcgctccgcctccgcaccgccgccagcgccgccgcgctgaacgcgaacaccatcgcgttcgccaccacgaagtacctgcatgcgtgaattcggagaaatttgttcatgttttcggccaaattttcgaagaatcttgcacgcttcgcaagtcgagctctcggatacagttcgtccgctacaggccggggttggaatcctgaattctgaaatcgacggccattagcgagtgcgtgccctctcgaatgttcagtgcattcgtcgcatgaagccatcgtcgcatgaagccatcgtatacggccccaccgtgtattcgtgaaataagccaaacagagcatatttgtaaacaaaaaataatctgtgaataaaacttatatatatatatatatttagtgatataaaagtattgacttaaaaaataaacttcaataaaaaaactaaaaatcaactcaatttaaaatttaattgataagtatgagtataaacgaaaagatgtggccgatagataaccgtcacagtcacgctttatcgtttattcaacatcgttcttggcgtgacgctttcgatgcaaaatcgagacaccgctcgctcgtgcatgcacgtttgatctctagctgcacaagtaaaagactttctcgaagaaacaggggatcaaagggagtagtacaattaggtagctttgcaaactatgggaaattataaacgggtggtttatattcgctttgttaatttttggtttcccaaatcaagcagcaaacactgctcctaccatccgaattaacgtaggctacatttgcacgcaactcaactggcatggcttgcatgattgatggaagatcaattaagatgaggatcaatggacggacaccgtcgatcggtctcctgttctccagtccaggctccatcaaatttatggataagatgcatctttcagtaattgcgattgttcgatggctacgaccactactactacccatttgcaatggctgggattaaactgtactaaaggatatatattatatatattccgatatagtagagcattttcttttccttggatggatgaataaacggtgttacggtggtgatcttgataacgaagaaagcatcatatccattttaccttctccaaatctctatccgtatcgatttctctcgcctttctgtaaaggccaaatcaacggtcgttaatttgggcctctcctcatccaaatcaacggtcgtgaaggaaagaaattttctgtggctgctgctgctatcaacaaacaatgtcacccacagtgccacatgaccaactcccataattttgcatagattggcaataagccatggttgtgtatcactttcaaaaatagtaggaacactaacaccaaaaaatatttgcgaaatctctttgtctatccatggatgaacacgtcaatgaaaaatagggtttcaaggttcgccacgatgctagaacgtgatttgtatgtgtaaggtaaaggtggcaacaggagttgaagtggatggtactagtggtaggctgctggtggcaatgcttgggttgtccttgtctaattctgtcctgggttttctttagctaatcagtgtgtccactactatcaaatactaccacgggtggataaaccttcttctgtcccggtttgcaatcctctatagtcccgggttataaactgggaccctgaattcgggactaaatatggttatctttagttttgagcgaaataattaggaaaaatgtggttttcggccgacccagtaaagatcaattcttcagtagtatactacaagaaccgtaatttacataaataatttaattatttcaaggaaacaactttgaaaccacacagatatatatcaatcattaattaattaaacaagccatgcatgcatgcattctactatatatatattattccgatgctgaaaaatttcaccatcagattactaatgaaaccgacaggagtactaccaagcataaaaaagaaagtagagcatcctgaaaatccctaattatatagtagtatctgttgtggcatccttgtctgttgtagcatatcataaaagttctttccattaattaggtaggagaaagagagaaacagaaggcgccttgtttggacgtgtggaattaaagcagaggccagcggcagagaatggaaggtagtagtaggagtactagcaattaggacatgcatgcaaagacatttcttcttgcgtgtcatcgtctttctcctcaaaaaaaccattccgtttcttccttccttcctcggaatcgatcccggaaagatctaccgtacaggcacataatgacgctaacacttcactagaggctaagagcatgtacgagaaaataaacctataaacaaatattgaaaaaataaaagagaaaaaaaaagagtagcgagttataaatttataattagctgtagcacggactgtaaaacgcaatatgtatatgacaagtgagactagtgtagtatatatttataggtaactattgtataaattgacgagtaagtagttggctatactattaaacttgctctaatattaaacttgctctaataataaagatgcatgtgtgcttaatttgattgtgttctatgctggagaatgagacttaaattattcaagaaagagcttgttttgttttcgaattgtgagggagaagtagatcgggatttggaaattggaatacaggtcatgtgtaattggcaagacatgcatgtgcctgtttggacccattttttttcaaacctacatgacatatgtgtactccttgtatactttgtcctatgtaatgagtgtgtcactggggctagctactgttgcatcaccaaagtagagtaatcacacacgagagaaagaacagacagaacaaaagagaacaaaaacacaagaaggatgtagtagagagaagagagaaatgatcatgctagctgcaactgatatggtgaattaaggagtggctgcagttgattaaagagcggcagtgtactggaataattgagaaactaattttgtaggcgcatcatatatcagtgttcatgcacatgcttggatggaaatcaatggagcagtagagagagacttacacgaaggcggaggagtaggtccacttggccgtgacgggcacccgcagcggcggcgcgagctcctccccggcggcgatctggacggtggtgctctgccggtcggcggccatcaccacagcggacgccagcgtccccagcaggacgaacacccgcagaaccacgcagcacgggtccaccggcggcgccctggaaccagcggccaacggcggcagcgccgcgccggcgcccgtgtagtagccccggcggctgctgtagtcgaaggcggcggcgccgccgccgctgccgttcaggccgggcttcccccgcgacgactccattgctggcgcgcggtgcggtcagcggttgccgcgctccgctgtgcgggaggcgctcttctccttggaatcgtgggtaggcgagaggagcagagcgcgtgtgtaactactggctggctacgtactactgctacctgtgtgagagatgtagggtacggtattgtggtgtagatgtacacaagattttgttgttgggtggggtatttatggtacagagaggtggtatcacctccaaggtatggttaccctcacatgtgagtactatcataccgatgctcttctagcgagtataataagcgatagaaatggattttcatctcttgaggagatgtctcctcgttgtttgtatgtcatcgaaatagttataaaaaattaaaaatttaacaacatagattaatatgaaatatatcactccacaaatatgtaagaccaaatttaacttttgcgagttgcaacaaaaagaacaaaataaactgaaaataaactgaaaatagttatcgtacattcgcagatatatttgttatttttattataacttgtagaagtaaaattttaacttgcatatttgtggagtgatatattttatattaatatatcttaccattttgtttcaaatttttttatgactatttaggtggcatgtacgaaatgagggatttctcctcgagggatgaaatcactttcccataagtgaagtaattagcgaactttaaaaactatatccatcagatctatgtttagatacaggatagaggagggggaaaaagaaaagcaaactacagatttatagccaactgcaacatgggttccaagacatcatgcgtgtatgagagttgtgccaggtattaatcgtatagtatatatttatatgcaaactacttagtccataagattggttattggttaaatcttagagctattaattgactatactatttaacttgctctttcttacctttgatgactcctgcgatcaaagatggtgtgggatcttgcggctggccaggcttgacgagggcgctcatgcggcggcggcgaccagggctggatgaggacgtttgtgcggaggacgtgagagacggcggcagccgagcaggatgaggacaggactccgatggtcgcaattgtcgatgaacactagtgagggtggcatccatggcggatgcaggaggcagccgagtttcttttccatctatgcccccacaaccttaggatgcgccatacaaccaggcgataaattagtcgttggcttgttccatgtcattacaaaatcctataggaagttggtatcatccattatatatgtgctctaagacgctaacaccattgggtttggtttgaactgaaaggtatgaggtctcaaatcaaacatgttcatgctctggccaagcctaacccaacccattgttatccctgatgactactataatttagataacaaatcaccaacaaattaaattgtaatggtgtttagcattacatttgtttatatttggagaaaaaatacattttttttagcaaagcactaaagtgaattactcaaactaacacaaactagattctgattggagtgttaagtatgcatgtgatgtgttgatttaatgagttcgggtgtcatgcctaataagcgtgcacatggtgtggagaatgaatgcaattaccttcatgcataatttgcgtgcagcatgattgggatatcttcattattattaaaaaaatccacaaatgaatcataatttgctggcattatatattttaattacttctattaattatgctgtcattgtgaactaaattctacaaaagatgtagagattaaatcgatgttacataaagcaagcaaacatgcgtccatggaggttctagagcctagatgcaccaacatgaaataaatctaaacctgtcttttcgtgatccttccgatatatacactcctttgtcccccagttccatgccttgccggcctcctcacacttgattgtgtgcccccgcttttaaaaaaactcgtacaaatatagtgcgactcctctttgtctgtccatgacgctgaaccttctactgatatgacggtgtggctgattggattgaatccgttctgctcccgcaccaccccctcctctgtttcggccattttctagtgccacttggtaaggaacttgtatcatatattcatatgattggagtatatgaggttgattgtctagtttgacgcatcttctgttagaattgattatattttagaacggggaaaatgatgataaatcctctctcccaccacttagacgatttgatggcatgttaattggaagtacttcataaatatttattattatttttgataatggaataaaatgtatacttattatgcttgattattaatttattatagcgagaaaaataatagagattagtatatttatgaattatatatatgctttcattaaaataaacccggtgatcataaagattgttgtaagatcttatacaacatgctttgcttaacacaccctcctcttttattcaattctaacaagtactccatccgtcctaaaatataacaatttttagcactcaggatttgtcctaaaatataacgatttctccaccaacattcccttcccaaccaatcacaactctccaccattcacttttcccacctacctccacttctcaaccaatcacaacctctttctattcaattatacctactttcttaataaccgtatccaactctaaaccttcttatattataggacagagatagtatgtaattaacataaaagcatctctaaggaagtggctatttttgactctccaaatgtcctatttggcaacttaccaaaaatttagagagccaagtacgttttactccaacaacatgtccattacactctccaatttaatagtgggtcccatatgtcagtctctgtgttgttcttcacccacctctctcctcctctcttctctgcagtgcggcacggctatggaggtggcgccggcaggagtagcgcgagcgacggaggacgacgggagctacacaggtggcggaggacaatgggagcggcacaggcagcgaaggccggtgggagcgatgactatggcgacgtcgaatccatgcgcgcgaggcgacgacaatggcagatccgttccttgctagcctcgtcttcctcgacagccatccgccatatagcctccctccttcccttgctactccctcgccgtcgcgccctccctccctcaccgttgcgccgccgcctccgctccgctcgttgcactggtcggccggcggttgacccgcggcggtggataacgacgaggcagcggacggcggaggatgcgagtgagcagcgatggaggcgcttgacccggcgacgatggcgagcacgggcagaggatgcaagcgagcgacggtggataacgacaaggcagtggacggcggcggcctcggcagcggtcgacggcgtggcggacaaggggcagcgctgacgtggtcaatctaggaggagggggatgttgctcccggagggagagagaatatgagacgggaggaaagagggagaggggaaaaggcgtggggcccacgattggctaggcaattttagctggctaaagttggccagtgcgaggaggagtttggccagctggatagccatgctagtctgctggagtgtgtttttatccgaaattactaagttttaatttagaggagatagagaggcggttggagatgctccgctcttctcctccacctcctgatctccattctccagtgcctccgtcgcacatcgtctcacatctctgcccttgtgtttgatcgcgccgtcggtgtgccacgtgggaatcgaagaaggataacaccatcgatcggcgggcgtccagtgtcgtgccaaacggctgacgtgtgtagcattatcttaacatacttattaatttcagggtgcgacgatgaagtacgggacgtacgacggccgcgcggcgccgaacacggacacacgcgtacgtacgtgcgtacaacgtgcaacaaccacgcgatcaaacacgtacgcacgcggcggcgcgataggaagctcctcgtataacatcagatcgagccatccagcgcgggggtgaccaactatcaccgcccgcaaaacggcgggtcggcatcggcatgggcagcatccggtgaggcccgtgcacattacgaaaatataccgttaggaattacttcatccgttttagaactttttagtattgtctatatttatattgttaataaatctaaacacacaagaactttttagtattgtccatatttgtattgttaataaatctaaacacacatatatatgtttaaattcattaacatatatatgaatatgggcaatgctagaaagtcttataatatgaaacgaaaaaagtatatatgtgcagtaaaaatctaaaaactattgttgtattaaaaaaatgaacgtctgatattcgtccatattatcatgagtaaaatttttactcgtaaatttacttatgataaaaattttactcatggtgacatgaacgagtctctgacgtctatttttcgatttaagggtagttttcaggttttcaatatatatatggtttgccccacatattttcatgtgcacataagcacaaggaaaaagtacgaatgaccttgtgcatgtaaacctaaaaatatcgtggtcgatcgaattaaccccccaaactcgaaaaaaccaaacattttaattctcaactcttcaatctggatgaattacaccctccagcactattttgaatggtttttggctaggctgcctgatgtggcattttgaacgtggaaaaaaatatttctaaaataatgggtccacctatcagtgctccatatctcatgtgttcttctcttctacctccccatctatccctagcgtgggcatcgacgccaccgacaagccctctcgccacctctgccaccagcctctccatcgccggtgccggcagccacattagcacctcgacgccctccttggagcagcacacaccaaggacatttaggtacgtcttcttccgcttcctccctccgccgccgtcgcctttgtccccacacctctttgacttgggcagcgacagtcttgccttgagcccttccgcctcatcctttctagccatcgccgattcaagagaaccaaatggggatcaagaagaggtgatctggatttgctgcaaggaggatgaggacgtggcggtgtcgtcgacgatagcgacgatggcaccaaaagatttgtgattttgtaatcgacgggcagctaatccggcaaggttgtgtttgtcaatgaggatctcgagctctctcagggtggcggcagaggctcgagacgtgcatctagtggtgatgggcggacgcggagctaggggtgcgattggtggtgatgggtggacacagagctcgaggtgctggtggtggatctggctgcaacagagggagaaggggcagatcccgttgtcggcgccatgagactccagcttaacggtagccgctgtcgctgtcggtcatcagcttagcttgtatggttgcctccacactgccgaccccgacgactaggatgacagagtgttcgccgcctccaccatgtcagcaagaaaagcagataaggggaggggaaaaattgcagcattgacaactgggctccactgatttgttttttgtttttgctggctaggctgccatgtgtattgtctgcattccatcaattttggtctgaaatttatttaaagattcaaatttcagttgtcaaatttgtgatcaaataattctaccatctttgtttattttgcaaataagtgtttttttttgcattgagaattttgttgtcccaaataggctagcatataagtatgagataagggcaacataggctcagtttgaaagttcgtttagcttttgcaattctatcatttgtcgtgatctcattttctaaattgttaaacggtgtgtgtttgcaaaacctttttacatacaagtttatttaaaacaatactcatttttcaattttatatttgttaatatttaattaatcattcactaataacctcctgtcttgtttcgtgtggaacatatcagtttaccccaaatataggttggaacgcagccataatcattttgaaggaaaattacacttcaatatattagtacaagtcaactcacgatcaaaactatttggacgaggcaaaatttatgtgtatagcaaggtttgagggaaaatttatgggctaatgttctaaaaaaagaactaagccgaagttgcctaacacgtttgaaaacgatactagtggtgatatccgtaccactaaaatatctctaactagcgcttgtctaaatttagagttaaaatatctttatattttatatttcaagatgaatgtagcattattctagtactccatacaacataacctctccatcccataaaaaaaattaaatttaaaaatatactgttcatccaagttttttttaaaataccacccgcgacgtcacgcccacgtcattttcgtgcaatggttgtacgaaatcgacggtatatttttggaaaaattgtgcatcccaaatatcctagaaattttttcaatgaacagtatttttaaaaatttaattccaaatatgacacatcctaataatataataatatgagacgattacaagtcacaaatcgtattattattattatatttttttaatggaaggagcgatgcacaatctaaacacatcgcaagtcaaacagaaaaaaaaggataaatgaattaccatgaacggttgtttggaaaaaaaaagcagcccaaatgcgacctgggcctcatacttcatcgatcccctcccgacttccctcgacaagaaaattgtgattttgctatcgcaaaagaatgatttcgctggaatactattctttcaaagtgattaaatgctattttgggtcttttggttagaaatgattttgctctattttaatttttgttttgaccaaaatacccttgtctcttttacctgtttgaccagatcgaatcgatctcatccagcctcttcggctcgaggagggaagcctcgccgccgtcgcccatggtggcctacgcgcggcgccgccggcgccacacctggctataggcgggctgaagagggatgcgctctgccggctagacgccacggccgagcacaagcaggacgagagtggcctgccgtgccgctgcagcaggggcggacggcaacgtcggcgaagatcgagggcacccgccgccgcatgagcgactctcttccacgccctgccgagaagcctcgccgccgtcggagcccacgtctattgctcccatggtggtgctgtgcctgcgtgcggcggcggcgtcgccgctgcaaacatcacgccggcgcccccgcatcggctccggctctggtgccggcgcctgcctccgccgctcccccacctgcgtcccgatgccgacgtccctgctggaggaaggcgccaatcgcgtgcgccgtggaggtggccggcggtggcgtagacgctggcttgttggagcgagcaccgcatcgggatagtaggggaggaagaggggaaagagagaggagggagtatgacaggtgggaccacgtcgagggtattttggttagacaaaaattaaaatagagcaaaatcgtttctaataaccaaaaaacgtatttcagtgaataccccttagtttaggatagcattttaatgaatcactttgaagatagtattccagcaaaaccattcttttgcgatagcaaaatcacaattttctctccctcgacggcgccgcttcccaacgtccaatggcgagcagccggctctcgatccggcgggtgtagtctccgcggcgtcggcgacggcagcgggaagcttcagcttcggccagatcgacggcaccctcgccgccggtctccgatgggaccaggtatgcccgcctctactcctaggtctgtccgtgcgccgcgcttcggtgccgatcgatcccagtaactcgttttatcccacatcgccgattctgatcaagcgcgacctctttataaggtcagttcgactctacttcatcgcctcaccaggggcacccgccccgactgaatacagcgaaaattatcgcccctgtgtgcatcggctgggcatgtttgtttatatacccccttccggttaatagctgtaaaaagaagaaaaaaaaggagcagtgaaaagattcaatacggcaacgataaggttgtgtcagtcggtcctctggttggaggcagcgctagacactagcgccttagcttttttaaaatttggattttttttttctgttgcatccttttttagtctgtcttaagccaagagaagcttaaataaagtcttaaaacattaagatggagtaggagaggaattgcatacagctgtttcgatatgcccttactgctagcagtttcgccttaagatgcaaaacttctatacattgctgttttgatatgcccttactactagcagtttcgccttaagacgcaaaacttctaaccgactgaatttccatgtttcgactggatgccggtcagagatgacttggcagatgaataattttggattcgtactctgcagatacgatggttagcatagtattagtagtgccttgtcatttattcactgaattttggcttatatgcagttctatttttaatagtaaatttctctgtaaaatttgcatttatatctgaattaatttacgctgcaggactatggcagtaaagatttggctggaacatccaatattttcagccaattgtctgaagatgtgattaccaaggatgcaaataactagcaacaagagcaggtatgtgcagagttgcagacaaccgctgagactcaaccgaattcatccaggcatagaaacggaaaaatagaccatagcagcaatagttctgatcaggtagatgaagaatccaacattttgaagagtcttttatgttgctcagggattcatgtaagtaataatttctgatccttaagtcaaatgattttttttccttaatttttgtttgtaaaaatgactgtcctttttttaattttctcagagtacataaatatgctgaaggaaatagcattgtcgcaaagagatgcaaaaggtgaaacatgggtgctgaagaataactgccagtaattttagctgaagctgaccgtagcaaagttttggttagtgtagcgaactgcaaacattaatttcattcagatgagacatgcaaatttgattgagaggaaatgtctcccatgtcttcttaaaaccttgtggaatggctagctggttctttttgtaggaaggacaaatctgaaacaagaagatgtaggtgacaggtacatactcgaatacaaacatttggtattgactggaggactgaaacattttgttctttcccagctttcaatgccatacagtattgaagcatgtcctggtaatacttccttcaaattcgttcttttctcatttgtcaggttgcgagctccaacaaatttggtgcaaagtttgttatgggaacctggtatggagtgtacacgggaaaaaggtatatcaacagaatgattaactgatcatgcttaatttgctgagaccttttacagtgtttgcatttctaaaatagtatagatctaacggctcacgatgaaaggtgccttatgaaaggtatcagaggtagaaaggtactaaggattaaaaggtaattgataacagggcaattatgtctaacaacgtatggacgtaccgaaaggtacggtgtaagtggatttgaaggtaccacaaggtaccgtgtaagtagtttttaaaggtaacgtaaaatatgatttatgtggtggggacaaaaattacattctcttctattcggtttccaatcttcagtcgttctgtttgcgtcggtttccaaactttggtccgattcacgtggtacatatcatattcgcatgatcttgataattatttccagttagtcattaattttcatagcaatttggtgatccatcgtttgatgaatgtaatcaaagatcgaaaggacaacaaattgagaagatttacgcacctaacaagaacaaaacaagttcaatgaggaagatttgcgaaaaaaactaaaccaatcgtctgacagatcgagaccatgcggccgcttctagctccggcgaacataggcagtcctggaccacttcctccgggtcctcttcctccgccgcccctccctccaaccaccgcctccggccacacgttcaccgccagccctcaattctccacctttcaacttatcgaagaacacgtaaaccttacgtacgaatagaacgtatctaagaacgatgcaacgcaacaggctacaagctaattccatcgataccttctcataccttttcatatgtgtaaaagacacatttgtcattctaatatcatcatatttacattaatgccacctattacaatattttctttccataccttgcccctcgcagatcaacggctcacgtcgccccacctccttgtacctcgcaaacatcgtaaaatccctctaatttgttattttctttgagatagcaagaagtaactgaactcactacttgaatttgatattaggcaaacattatctgactagtaccagcattttaatttcttttttctgattgcccatgcgggaacttattattcacttttgatgtttcaaccattttgtacagtttgtccctgcctacataattcctctccatgtttatctaaaaatggaaaaagtattcgccatgtttatattttacagctttctaatattatggtctgccttcacatgtagcatcaattctatagcaaacattttgctctgcacttcaatcagttgggcttgaatttctctcataaatcgattatgtaatggttatgaattgcacttcaaattacatgcagtacctgtccaggtcgttggttatttgcctccataaatcgatccttcgtatttttttgcctcaggtctctgctcttatatagaagtagtgaatttttaattcccatatactacgctatccttcttcgaacatcagtgctaggtatttgtcaactactgctaaatatgtggtaaacattgtttactaattgctatcctgatggtttttctcatggaaatatagctggacttggttgtttaccgtatacgaggagaaccatttggattgaggcaaggtgatccattatcaccatatttgttgctctgtgctgaaggcttttctgctatattactgaaggcaaagaatgaagaaagagttggtggggttaaaatttgccaaggagcaccatgcatctctcacctgctgttgccgatgattctttaattgtgattcgtgcaaacgggaaggatgcaacacaattgcaaggaactccccaattatatgagctgccttcagggcaaatgataaataacgacgagtcggctgtaatttttagcaagaacactagggatcagaagagaagtgaggtgatgcaaatgttgcacataacaaaggaaacacaaaatgagaaatatctggggcttccaatgtagattagaaaatctagagctgaagctcttgagtatctaaaagataag

SEQ ID NO: 73880 - DNA, 70881 bp, Oryza sativa
tgactagtaactgtttttgctaggcaaatctgtgagttgagtgattttaaggaacatatactctttgagcaagtttatagccaatttagtaaaaatctcacatcttatttacattcttacggggatatttctgtgacagacattatattggattatagaaggaatcaaagagatgctagccatgacctttcttctcaggaggtgatgcttcccttttaccagtgacattttctgctttatgaactacagactgagggggagatgcagcagtagcttcccttcctacttcaactaccaactgcactaaaggatccaagctagaaaaaatttcttccttggagatatcatgatctatatacttggattgaactgagttcatattaatgctaccacacctaacattaataaaaaagaaggtgtttgtttttcaagaagaatgcatgtggtaagtttggtacagagtagagatcaaaacagtaaacagcagctgtgatcggttgggcaggcataaacatcttcctaattataattagttaaccatgcatttttgaaacacggtttctttctagaccaagtcaaactctgacccaaactaactctttggattattttagttattaaatgtagaaaagctatattaaataggtagttgcctccctactttcccagtgaacattgttaaacccacaagtcaaacatggatcacccatattttgttaaagaaactatgcaatttagcacgcttgacctaagaagctaagaccaatccttgataatactaacatgcctaaccatgctcctaatgcttaccactccaaattcaagtatgaaagctattttgttatgtaacctaaaaataatttcgaacttgagaatcatcgatatcgacactagaatacaagaagagagaagcttataaattttaagtactaattatgactgtcagaaacaatcagaactaattactgctctaattttcacaaaggaaggatcaataggagaatggaaaaaaaattgctaatcactactccatttcaagactgattcacacgaaaaactgtctacgagagaggttgtgaatcctgcaaaactgaatcctctactcgtcgtctttatctcggctacaaatcactccagcagcagcagcaatcaagcaccaacagaataccccaataaaccaccagatctggtgaaagcaacacatcaaccgcacggatccgcgaaagccagcatctcttctaccgatttcccaactcgacaagggagatgttaccctcacccagatcccgacgcgccgctggcctgctgccctgcacccttgccccgtgccgcgtgcccccgcggcccgcgccacctgcccgcctctcgattgcaagtcgccggccgccgctggtcatcgtcatcgtcatcgtcgcagctagcgtcgccgctgtcgtcgccgtcgttgcagccactgtagctgtcgtcgccgcagccgccgccgccgtagccgctcgctcccgcctacctaagcccgccgccgccgctccggagggcggaggtgggtggatccgtgtgttgccggtgctcccgctcacgccaggccgctcccgagtacggaggccactggattcatgcgccgccgtcactcccgaggacgggaggcggcgaatccgctcgccaccgtccttccctggccgggggagcgacacggggaaaggcgaagaggtggctgggggcggcgcgatggattgaggaggagagggatgttggcggtgggggaatggatggtggcgccggcggcatatggatttagttttggctagggtttggggaagaggttatatggatgagaagcaatccgacacgaatttaccaaactgtccctggtatgtccacagtagttacgaaattgtatgaacaaaatggacatttcaccttaaatttatgagaactttaaatttaattttaggctgatttttgtgtttcaaatgcaaaaatcataaacaacaaaattgtagaactcatcaagatctacaactattatattggtcttttttacaaagaagttcatttgaacgattcaaattttgaattttcaaaatttgataacgtcaaacaaaaattgaggttaataaatgattcgaaatggaaaagtcaccaaaaccaaagttgtagaactcatcgagatgcaaaatttttattttggtcatttctccatctgactctaattaaataatttgaaatttgaaattcaaactttgagaacttcaaatagattttttttattagtgaacgacttcaactgaaaaaatcatcaacaacaaagttgtataattcatctagatcaaaaatttttattttggtcatttgttcatccgacaaagtaattttagtattgtttacaaaatttacatatctcttatatggttttataaactataagagagatatgtaaattttgtgaacaatgttactatcactttgtcggaagaagaaatgaccaaaataaaagttatagatattgatgagttatataactttgttgttgatgactttttcagttgaaatcattcagtatttgaaaatgttgtttgaacttgtcataatttgaaattcaagttcaaattattaaaacaaagtcatatagccaaatgaccaaagtaaaagttatagatattgataagttatacaattttgttgttgatgactttttcattcgatatcatttagtatttaaaaatattgtttgaagttgtcataatttgaaattcaaattcaaattattgaaacaaagttatactgaaaaatgaccaaaacaaaagttgtagatcttgataagttatacaactttgttgttgataattttttcatttgaattcatttactacccaaaaagttatttgatttaagagaagggaggtaaaatgtacttattggtgaggggggagcaaaagggcttggccggtggcccaaagagggaggaggagggagagagaggctgcgggctaagggatggagagagtaatacttgagccgaaaaaggcccaaggacagacagaggaattttaatttgtttttcatttattttaataggttaaataaactttgtggtattaaaattagttattgagctccaaaaattcacggaaaatttaaaagaataatttagaccaacttatagccattttagtttgtttttttaacttttttcattcaatcataaaatgaaacgccataattttgtttttttattcataaaatgagactagagatgacttcaatcctaaaatcctaaaatgagatattagaattaatgtagacaagaagagtccacctaggaaaaacgattatggtctagtagcaatgtagtataactagatttttttttgtttttaaaaaatataatagttctatattttatgacgatccattattgtcatcgtgctatcgtcacagagcccatgcagagtatactgtgacgatgattatgacagatacacggtttggtcataaacaactgtcaacctgtgaacaatcgtcataaacagcctctgtttatgacagatatgtgttccgtcatcaggtaatcgtcatagaagcccatatttgttgtagtgccagggcgccatggcatggacccagcctttgttcgacccatccatggtggcacaccaagcgtcaccgttcggagccgggcagccgaacactgtggcccaacctcacgcgcaaatcatgacttcgccctttgccacgccatatccaaagccaaacaggccttcgcagcaaggtgccgtgaacaaggcaggggcgaaaaggggctaccgctgagcgggggaatcaagattcgtccaatcccactccagttcaagttcccacccgttccgcggtactcgggcgaaacggacccaaaagagtttctgtccatctacgagtccgcgatcgaagccgcttacggcgatgaaaacaccaaggcaaaggtaatccatctcgctctagatggcatcgcccgttcttggtatttcaacttaccagctaatagcatttactcttgggagcaattgcgtgatgtttttatccttaattttcgaggcacctatgaggagccgaagatgcagcagcatctactcagcattcgccagaggcttggggaatcgataagagagtacatgcgtcgcttctcacaggcgcgatgccaagttcaggacataaccgaggcgtctgtcatcaatgccgcttcggccaggctactcgaaggcgaacttacaagaaagatcgccaacaaggagccgcagacactcgagcacctgcttcgtatcattgacgggtacgcatggggcgaagaggattccaagcgaaggtaggaaatccaagccgagtacgataaggcttctatcgccgttgctcaagcccaagcacaagtacaggtcaccgaacaggctctccctaccattcgtcaaccccagccggcgaaccaaggacagccgccaaggccgaatcaagctcccgtaacttggaggaaattcagaaccgaccgtgcgggcaaggcggtgatggctgtcgaagaagtgcaagccctccgcaaggagttcgacgcccaacaagcaaacagccatcaccagcccgttcgcaagaaggtcagaaaagacctctactgcgcctaccatggacgctcttcgcacaccaccgagcaatgccgaaacattcggcagcgcggcaatgctcaagatccaaggccgcaacaaggagcagttgtcgaagcacctcgcgaggttgttcaagaacaagcacccccagccgaacagcgccaacacgtgcagcagagagtaatccaagtaattacaagagccgatccgccagctcaaccgacaaaacgatagaagaagatgcagctgcgaatggcgcacaacatcgcttcggtgggcgaaggggctccacggtacttgaatcagcaaatccctttcgggccggaagatattgaaggagtgctgttcccgcatcaagaccccttggtgatctcggccgaggtagctggctttgaagtccggcgaatcctggttgacggaggcagttcggtcgatgtcatcttcgcggaggtaccggcaaggtacggtgacaagggctgggggcgaaaaggagttgagtccaagctggggggccgcgaagccagcctagcctctggttccctttcgccacacccacgcccttcaccacagtacccgcaacgtacggcgacaagggctgggggcgaaaataagttaagtccaagctaggggccgcgaagccagcccagcctctcgaccacttttgccacacccacacccttcgccacagtacctgcatggaatggcgacaagggctgggggcgaaaatgagttaagtccaagctgggggctacgaagccagcccagcctctggacccctttcgccacatccacacccttctccacagtacctgcatggtacggtgacaagggctgggggcgaaaatgagttgcttccaagctggggggcctcgaagacgcccaagcctttggacccctttcgtcacacccatgcccttcgcgacagtaccggcaaggtaaggcgacaagtggtgggggcgagaaggagttaagtccaagctggggggctgcaaagccagcccagcctctggacccctttcgccacacccacgcccttcgccacagtatccacaaagtacggcgaaaagggctgggaacgaaaatgagttacttccaagctggggggccacaaagccaacccagcctctggaccccttttgccacatccacacccttcgccacagtacccgcaaggtacgacgataagagctgggggcgaaaaggagttaagtccaacctggggcccccgaagccagcccagcctctggacccctttcgccacacccacgcccttcgccacagtacccgcatggtacgtcgacaagggctaggggcgaaaatgagttgcttccatgctgaggggccacggagccagcccagcctctggaaccctttcgccacacccactcccttcgccacaataccgcaaggtacgacgacaaggcaaaggggcgaaaaggagttaagtctaagctgggggccgcgaagccagcccagcctccgaacccctttcgctacacccatgcccttcgccacagtaccggcaaggtacgatgacaagggctaggggcgaaaatgagttgcttccaagctagggggccgcggagctagcccagcctttgtaccactttcgccacaaccacgcccttcgccacagtacccgcaagatacggcgacaagggatggggcgaaaaggagttaagtccaagctggagtgccgcgatgccagcccagcctctagacccctttcgctacacacacacctttcgccacagtaccggcaaggtacgacgacaagggctgagggcgaaaaggagttaagtccaagctagggggccgcgaagccagcccagcctctggatccctttcggcacacccacatccttcaccacagtacccacaaggtacggcgacaagagctggggcgaaaatgagttgcttccaagctggggggcttcgaaactgccctatcctctggacccctttcggcacacccacatccttcaccacagtacccgcaaggtacgtctacaagggctggggcgaaaatgagttgcttccaagctggggggccttgcctatggacccctttcgccacacccccgcccttcgccacagtaccggcgacaagggttgggggcgaaaaggagttaaatccaagctgggggccgcaaagccaggccagcctctggatccctttcgccacacccacacacttcgccacagtacctgcaaggtacggtgacaagagctaggggtgaaaagaagttaagtccaaactagggcaacgaagcctgcccagcctctagacccctttcgccacagccacgcccttcgccacagtacccgcaagttacggcgacaagggctgtgggcgaaaatgagttgcttccaagctgggggcccgcgaagccagcccagcctctggaccccttacgccacacacacgcccttcgccacagtacccgcatggtacgtcgacaagggctgggggtgaaaatgagttgcttccatgctgggatgccgcggagccagcccagcctctggaaccctttcgccacacccactccctacgccacagtaccgcaaggtacggcgacaaggcctaggggcgaaaaggagttaagtctaagctaggggccgcgaagccagcccagcctccgaacccctttcgctacacccatgcccttcgccactgtacccgcaagttacggcgacaagggctgtgggcgaaaatgagttgcttccaagctggcgggccgcgaagccagcccagcctctggttccctttcgccaaacccacgcccttccctacagtagccgcaaggtacggcgacaagggctgggggcgaaaataagttcagtccaagctgagggccgcgaagccagcccagcctctcgaccactttcgccacacccacaccctttgccacagtacccgcaaggtacggcgacaagggctgggggcgaaaacgagttaagtccaagctggagggccgcgatgccagcccagcctctggacccctttcgccacacccacggccttcgccacagtaccggcaacgtacggcgacaagggctgacggcgaaaaggagttaagtccaagctagggggccgcgaagccagcccagcctctggacccctttcggcacacccacatccttcaccacagtacccgcaaggtacggcgagaagggctggggcgaaaatgagttacttccaagctggggggccttgcctatggacccctttcgccacacccccgcccttcgccacagtaccgacgacaagggctgggggcgaaaaggagttaaatccaagctgtggggccgcgaagccagcccagcctctggatccctttcgccacacccacgcccttagccacagtacccgcaaggtacggcgacaagggctgggggcgaaaataagttaagtccaagctgggggccacgaagccaacccagcctctggacctctttcgccacacccacacccttcgccacagtacccgcaaggtacggcgaaaagggctggggtcgaagatgagttgcttccaactggggggattcgaagccgccctagcctctagacccctttcgacactaccacgaccactgcaaaagtacccgcaaggtacggcgacaagggctgggggaaaaaaggatttaagtccaagctgggggccgtgaagccagcccagcctctagacccctttcaccacacccacacccttcacgatagtacccgcaaggtacgacgataagggctgggggtgaaaaggagtaaagtccaagttggggggccactgtcacgtcctgataaattcatcccgaaataaaaatcattccttaaaaggaataatagaattaattaaaattcaaaaagaaattggcaaacattaaaatgcgtacaagaaaatttcgaatgtagcctggagaatttttgttaaattctccttggtctaaaaggagccctcaaattttacttgaattttcagagcaccgaaaatatttattaaacaacaacaacaattaacaaagtttagtaaaaagaaaaaaactaaaattaatccccctcctccctttgggccaagtctggcccaaagtctccctctctccccctcggcccgcagtccaagtccctctcccctccctttgtttttctctctttcctcccgggcagcccactccctcctcctccttcctcccggcctgcctcggcccagcagtccggcccaagccaggccgagccgagccagccgcgtgcacgcgcgccgcgcgtgcgctgaccgcgcgcctgaccggtgggtcccacccgcccggtcgtcgtcttcctcccgcactgcctcctctctctcccgtgaaaaccctagttcgttcctccctcgaatccgcgcgatttaagcgttggattccaaaattaattgaggggaattaatcccctttccttcctctctcttttccccctaatctcccctttaatcgtgcactattttgaccagaacggctgcgccattcatggccgccttccatggccgccgggcgccttttccgccaccgttccccgctcctcccgtgctcggctcgcttccctccgctataaaatggaacccactctttgcgttctatcgttttagcaccctcccgcgctctcccgtggcctcaccacctctccccgcctcctccttctctttcctcggtgccggccaccctccagccacccctaccgcctcgcccacgcgccgtccggccgtgccgccgccttccccggcgtcgcagcagcctcctctccactggcctgccctccgtttcgcacggagacccctggaggtgcgcccccgccggcaacagtggcgttgccaccactgttccacccccggccgcctctgccgcgtctcccgtgcgccggccgacgtcgccaccacctctcccggcaccgaaacgccgtcctcttccccagccaggccacgatgtcgcccgtatttcgccggaacaccgccgtgccgcgccggcctctccatccacctcgccggaatttccccggtcgaccgcgtcgccgtcttctccgtcgcagcggcaaggttgtcctcggcatcgccttccctccatccgaaccccgccggtgttcgtcgtcgtcgtcatcgttcctcctcaccggctcgttctctcgttgcgccgcctccgtcgtcggattcgcagtggcgtgatccacgccgtcctcgtctccgtgcagccgctgccggctgccctcgtcgcctcctcgccggccccggtcgtcgtcgtcgtcgtcctcccgtcgttcccggtcatcgtggcgttcatccctccgtcaagccgttctcgtccgtcgtccgcgtccgtcaagtgtgccgctgcagccccgtcgtcgtcttcgtcctcgcctccgcgtcgccaagcattgcgccggccgcatctcgccttcgtccaaggatcgccgccgaagtcgtcccctcgcctttcgtctccgtcattcccggccgtctccgccgcgcccgttcgtcgttgtcgttccctcgcctcgtcgcgtggtggtaaggatctctccttcgctgccctgtcctcgttctttttgtgtcgcccagtacccgttgtgcggttgtcgaccccggtacccgtgtaccggtgtcggtagtcgttcgcttgtgcgtgtggtgaccgtgttagtgtgcccgctcggtagccgcgtggtttcacgtgtgcagcccgcgtggtgtctagtggagtccgtttgtcggccactcgcctcggttgacacacggggtccgcttccgtcgacccgtggaccgtctctgtatactcggtctaccacggtcctttagttgacatgtggggtccgcatgtcaacggcggagccttcctgtcttttccaggctagtgcttacacatgttttataattgcaaaactaatcacaataatccgtaaatctccatgtaacagcattaaacttcggatgatcatatcttggtcatacgaaccccgaatcgacccgttcaagtctcctaatgtttatcataacctaaagaaccgtgtgctttctttttatgtattgttattgcttctttataggcttgtagctttgcttgtgtgattcgcgtagcttctgtcgttccggaggttcccgaagcgtggttcgcggtcgtcgccgaaggttcggaaggccgttctctctgagcaaggcaagtcacatcatccttgagcatattgaatcccagtttataaaattattttgatttaaattaatgcattatcgctttatttaaattcccgcgttatcactgttttatttagccatgcctatttacctttgttataaccttatcattgttgttattgttattattaccttgttcaccctaggataaacaaaaccccaactagtgggtactctattcatggttccactagtatgaatttaggtagatgcttcgctgattaattaggcaacattaggtggttttataactttagactttgggaattctcatatcatttggacactatggaatggttggcttattgtggaatcggacacacacctccccctctattcaaaacgcccaaaatggttttaggctgggctcgaggtgcgtggttgggttttgttagtcatacctcgggtactataaggattaagctcggacctctgttgcaaagcactaccatactttcacatgtctagtgggtaaggcttagtttgtggttcagtctggttataaacaaaagtacacggatagagatggatgaagtcgggggtcgatggacatctctaggacaaatgaaggttacacgagctgcggcccagtagtcgagatgtcatggcacagggctggtgtcctgctgctaggggctcaatcctgcctgcctgtcccggaggttccggccgtaggtggggttgggtcggtactcttgtttatggctaggatgggttgggaactatgtcacgtcttccgtccgtataccgtggtggtatgtggcacgtggttacacgtgaggaagatgtaggaagatgtgtcttgtgggtaaagatgtacatctctgatcagagtataacctattcgaatagccacgccctcggttatgggcaagcctagcaatgtacccaagttagtgttttaattcttaaaacctgcttaacaactaaaatgtggaatggttggcctgggttggcttgggacgagctgggacccagggtcgggttgccagttcggtctgaatcatcgtaggccttaagttaaggcaggttcgtgagggttcacggccttgattaataacactgtgtagctctaggatcgtctttataaaatggctttgggcaactaagtgacttttaaaagctgtttactgcaaaacttaacccctatattattaccccttgtacccccccttcattaatcatgcatttgccggtgtggcttgctgagtactgtggttgtactcattcttgctcaatctcccccccccccttcagtaagagaagctttggagaaaaattcttaggtggagtcctggcttataccccagttgaacgcctgtgaagatggagccgtaggcccgctagtccgttgctgtttatttttgtttgtcaggcctgaaatgcctttgtaataatgtaaatattatcgatataataaagatgtgccttttgtatcatgtttgtttggtgtaccccggcttttcctaggacgaggattaatacactagcgttcgggaaaatgcaaattttctcggtcgcgacaagatggtatcagagccatctcgactgtaggataagccaagtggataaaacctaaggacatattttataaataaaactatttgcgaaagttcctttttttctccttcccctaatgctatttgcaaaaggtttactcccttcttccttcttcggatttcaactagtactagatggtcagctcagcgaagaagaagaaatcgtcagttgtctgccgaagctccggaaggctgttggatccgttagcaaagtggaggaagcagtgaagccagctgtgaagaagcagtgaagatcttggagaacctgtcgcagaacctaagccaccctctagtgtttcgtttgtcgtgtgtttccttgcttgtgtgtgtagcgcgtggtttgcatcggtgggttgtgatgtaaccatgctaggttgtttgcttaatcaacttgcagaataagcaaaacaaacaacacatcaacaaaaagagttagttcctttaaggtattgtccctagttctggtctattctttccttgtatgcttcctctctcaacctctcccttgtgacagatggataacactggtaacaaaggctatgggaatgatggatccgatgactcaagaacccaagccaatgggaatgagaaaagcatcaacgaaacctcaccagagctaatccaaattgtggttaaccaaaccaacatgttggcaacaacatttcaactattacagaatcggaacaaccccgcaggggcaaccaacgttcaagtacctacagtccagcgacagtgcaagttatcagaattcctcaaaactgatcctccaacctttgccattgccgtcgatcctatggaagcttgtgattggttgcgcacagtcgagaagaagctggggttgattcagtgcacagactaggagcgggttgtcttcgcaactcatcagttggttggaccagcttcagaatggtgggatagctatgaagcatcacggccagaaggacataccatcacttcggatgagttttcagccgtgttcaagagatcacatgttcccacgggaatgatcacactgagaaaacgagagttccgctacctgaagcaagaagatttgaccgtcacagagtacctgcacgagttccatcgtttggctcactatgcaccagaagatgtggaaactgatgaagacaaacaagagaagtttctccaggggttaaaagatgagatcgcagtgcaactactcctagaggaatatgaagattttgagaaacttgcggacagagccatacaactcgaaagtgagcataatcggatgaagaactgcaagagaaggattgtcagcatcccagtatttccatgtggtaaccaaagacagcgcactgagccacttcagatcaccggatcttctgttgcgcatcaagaattcctgccccaagaagatggacacaatgcagacaacaacattagcaatactaatgatgaggataccaccaacaaccgtgcttcttgccccattagtgaccactcgaatcaagcgtgcaatgtcaacatcattcaccaaggtgtcgacgatagtatcaatgatggcacccagaatgacaaccctagcaattgtgactctgagaaagactccaatggtgattgcaactatggtaccaccgatgccaatgttagcaaggatttccaaccatcaattccaactccaagtcagaatgatcgtccccagacggacagctcagtaaagaagacgttgatttgttataactgcaaagaacaagggcatgactcgagggactgtctgcaaccaaggcaaagtcggcctccacattaccgccaatttacatgaagcagacatcctaatcgtattgtggtcactggagcaaacgccatacctgtgaggcctcgtgttaatcataacccatagcagaaacaatgtaccaatgctaagcacctttccttttaggcagtgcttagtattcattaataagggagaaatgtgtaatacagacatgttctatgaggattcttttggaagatgtggatatgggattatgtgtataattgcttactaataaaggagacctagggtctcgtgtcagaggaactatattctaacctcgagttaataaccaacctgttgatggaaaagaaaaccaattaaactgtgttagattaaaaagccagtgagacagtagttggggataagagtttggatacgccttttacggatcaagataaggattgttggatgaaacccataatggtacctaccatgcctctacattgataagttcggatatacctgcaaacagttaagaagatccaggagacatcaatatttgagaacatagtagtcgatggttggtaattagtctatcaggtatcagaaaagggtcaaaggtgatatggcagaagaacaatttggatgctccccatctcgaggaaacactaaagatgatcatcggcaattaaaccctagtggcatagatacagatagcaagcaatgtatttccctgaaggtagtcagtgcagctttttgacgaaccacttcaaggtttcactgaaaggcagcaggccaaaggacctcagttctctagccagaaagaagtaggccgaaaggtgattgataaaggataatcagaagcatgctttgcatcgctcgaggaagacccctgatcaccctgcaacagtcaccttgtcattgaggtagaaaaaaaaattatgagtaagcaagatgacctaggtaaaagtgtttctatgaaggcaaggagtgaaatcttcaactcggtatcagatgctacacggagtgaaaagtgtaggcaccggttaccaggcaatgccatgtcttggaagatgatccaatgggaaggaactcatcaaggtcgaaggtgtaaaggaatacgttgaatgctaaatgatgacaacatgaagataatagtcggaagtaaactgaatgtaaagaaagtgaatccgagctgcttgttcgtgggagctattcccagttatgaaccaagtgatatgttcgaagatagtctacagaggtcagattaaaatcacatctaacaacgaagcttcagatttggcaggataacgatcagacaataaaaagtccagcagtaaagccatttgggaagacgtcaaagcatgtcaagtgggataagttggttcggttgagaaacataattcaaaggcaaagttatcgaccctcgcatggaatagcagaagtagctagcacccggagagcaggaaagctaatatgaggcagttggtggcaagttagaagtaaatgacaagcatggtattctcatgatgacaagcatggtatcctagtaatgacaagctgatatcgacgcataacgtgaagtgggtaacttgtatgaggttgacgccaaagatatgaattataagaagttctagaactgaagccccatcttcaagtgccgcaacccagtcgaagtcagctaaaggttcaaccagggacaagtcaggtgaagagaagattccatctgcaacaggagatcgagccaggcagtaaagagtggagaagttttgctaggcaagtttgttataaaagacgtgacggaagaagttagacaagaagagaagaccacccaacctatattcttgctagcctcctcgaatctcggggacgagattcctgtaaggggggtggatttgtcacgtcctgataaattcatcccgaaataaaaatcattccctaaaaggaataatagaactaattaaaattcgaaaagaaattggcaaacattaaaatgcgtacaagaaaatttcgaatgtagcccggagaatttttgttaaattctccttggtctaagaggagccctcaaattttacttgaattttcagagcaccgaaaatatttattaaacaacaacaacaattaacaaagtttactaaaaagaaaaaaactaaaattaatccccctcctccctttgggccaagtctggcccaaagtctccctctctccccctcggcccacagtccaagtccctctcccctccctttgtttttctctctttcctcccgggcagcccactccctcctcctccttcctcccagcctgcctcagcccagcagcccggcccaagccacacccaccaccttagtcacagtacccgaaaggtacggcgacacgggctgggggcgaaaatgagttgcttccaggcttgggggattcgaagccgccctagcctctggactccttacgccactcccacgcccttcgccaaagtacccgcaaggtacggcgacaagggctggaggagaaaaggagttaagtccaagctgggggccgcgaagccaacccagcttctggacccctttcgccacacccacttccttcgccacaatacccgcaaggtacggcgacaagggctgggggcgaaaaggagttaagtccaagctgggggctgtgaagccagcccagcctctggacccctttcgccacacccacacccttcgccacagtacccgcaaggtacgacgaaaagggctggggacgaaaatgagttgcttccaggcttgggggattcgaagccgccctagcctctggactcctttcgccactcccacgcccttcgccaaagtacccgcaaggtacggcgacaagggctggaggagaaaaggagttaagtccaagccggggccgtgaagccagcccagcttctggacccctttcgccacacccacacccttcgccacagtacctgcaaggtacggcgacaagggctgggggcgaaaatgagttaagtccaaggtggggggccgcgaaggcagccaagcctctggacccctttcgccactcccacacccttcatcacagtacccgcaaggtacggcgataagggctttgggcgaaaatgagttgcttcaaagctggcgggccgcggagccagcccagcctctgtacccctttcgccacacccacgcccttcgccacagtacccgcaaggtacggtgacaacggctgggggcgaaaaggagtttagtccaagctgggtgccgcgaagccaacccagcctctggaccagtttcgccacacccacacccttcgccacagtacccgcaaggtaccgcgacaagggccaggggcgaaaaggagttaagtccaagctggggaccgcgaattcagcccagcctctggaccccctatcgccacacccataccgttcaccacagtaccgactcggaaaaacattttctgccgattcgttgtgctgatacagttcattatcgacaataacaagcggtttgactccgagaagtccaaggaaatgtgcgaggggttgaaacttgaaatcaagttcgcatcggttgcacacctgcaaacgaacagggcagccgaaagggacgaacggcaaaaccctagttaacatgctctgggccctccggacaacgtcgataaaacccaccaagctcttatacggcaatgaggctatgacgccaagcgggctgggggctaattcaccaagggtaatcttcgctggaggtgaacgaagaaagccgacaacggttaaaaacggtcgaagtacctaaaaaagaccgaaagccggtaacggttaaaaaggtcgaagtgctaaaaagaccgaaagccggcaacggtcaaaataatcaaagtacctaaaaatatctttgccaaaggaaaaaaggggaaagtacaagccgaacagccgtaacacgcaccacaccccatttatttgccaaaaaacacaagttatagataaatttcattgcccgccaaaaggcattcggactttagatccgatgcatcagcaaaagtagtcctcaatggcgaaggactaccccttgagcatcttcttaatcgcaagttgttagatcaacaaaaaaaattttaagcggtgaagaaggaaaaacggggactatgcagtgtcgacgctgggcaatggcaaactgacgctcagtcatataaaattcatgggtgtcttcgtcttttttctgtgtatgatatttcgtggaaaaaccccaaagcaaacgcctgatcaacgaaaacgccaggggggtgatacgaatcggccaaagtactgctcgccgaatgttgaaaccgcgacagctcgtttttggaaaacacaccgatcgtcgctacactcgacttatgcaaatacttaagcatttctgaacgtgtatgccaaaagtcgagagcgaatgatgagggctgaaaagtcgacatatcttttcgctaaattacgcaaaggggccgacatgtttcgacctaacgaaaggacgaaagtgactatgcaaacattagcaaaaagaaatttgaaacacacacataagctccatcaggcgaaagcacatacattacaaaaaaaagggagctacagcttcgccataaaaaggcgaaaaccaaaagatggttaaccatcagggcagccaaatgcaagtgtcaatttttttgcaggtactaaagaaaggtttcggtaggaacatcggctgaaagggggcgcctcatgccataccacataatttgcatggtctcggccaaagctccctactcatccttgcccatgaggggcttgttggaggcatgtcacgagggccttcgaccggacctgtcgaaaccaatccacaagcgaggaatcaagccagaggcgtcaagttcaaccgggacgaagccatatgacaaaagccgtatggcgaaagccgtatggcgaaggcgcgtggcaaagaacaaaggaccatgtctatgcctcgcaaccaagaggaccacattggcgaagggcgcatggcgaaggccatgcggcaaagcacgaaggcttcgcccaagctggagccgaggcgaagaaggaggacaagagggccgctaggcccatgggggccccttccgccataaccaggctggcctagttggcccatttagagcacataagtgtaaatgacatattgtgccctcaataatgtccctatcataagggtatccatgtaaattcccctgtaaacataaaccctagaagagggaagcttgcaatggggctataaatagccccctagggccatgtaatggggggtcccaagaaaaatcttaaattactacatctactgtttccaacactgttgagtgaccacgtccttcgacgtgcacagttgtcgcttcgacaccaatcaccacggccaatttgttcatcacaaaacatcaatcatggaaatgattttatatcatgtttatgttagaaatttggtcataattcggcatattttaatccaaaatattaagataataaacatgacatttgcaatttgagttgatctagtaacagtgctagttgtatacaacatgagcatgcttaaggtgaaataagcatcaacatttacatagtaacgtaatgatgccattgcgaaggatattaacaaacaaacatctagtagaatagggagaatagaagtataccccgagaacgtcccactgctggattttgagatagcattgcctctgttgatgaccttcacttctttgtctccaatcttcgttgacatgttagcgaaggtgccgatgcagcagcagtagtcgtgaagaacaggaacagttgcgcttgaagcgctccccaaaaacttgatcgcccgcctacccgtgcaggttctcaagcggacggagttccggaggcacctgctcatcccgtacacctgtacacgcaggtgaacagaactggggaaggattatgcagcgcaggaacagagggaggaaccggaggaacttcggaaatgcaagagatgggaagaacagaagaactcgttattcttctgttcgtccttctggtcgctgcagagtatatatatgcgagcgcaagagtaacgttcggggtcatcaaccgtggtgtttaattccgtaaccgacgcgctcattaatacagaatcaattcatggcgtttaattccgtaaccgacggaattaattcacggcgtttaattccgtaactgacggaatcaattcacaatgttttgttccgtaaccgatgcgctcattaatacggaatcaactctccgtgtttattaccgtccgttatgagagagcaacagcagcaacaacaacagccgcctgcctgccttgccccgccccgtcccgtctggctatccacccaccatctcaaccggtcaacaaagactctctactagctttgtatttcacttgagaccttttcacttagatttccaaggtagtattattacccatagcacttaatgtgggccaatggaatttattaggatttaattgggcctagcccattaatctaacaatccctaccaaatttcatggctcacacgaaatgctctcgattctgatcatgtttgttataccagtgtttcggtggagactgttaagttgaacttccacctaggaaaagagctacactagaccacaactgaacaatggactatgccttgaattattagtcttgtgcaatcaggtttcactcaaacccttaaagggtactgggctgccgtttgcatcccctctgtttggagcgtttaagtcataatcctggccttttcatgaatatctagagatcaccaagatctcatagactgtgactagcagtcggactcatataggtgtattccttctatgatgttctgtagatcaacatctctgctttatgagaagtactcagatcacattaaggtgtataccctccttccatacagaatagaagagaagtgcatcatgaatataagcccattttagggtctcttctctcagctacacaatagtttgtttcgccatccaaattcacgggatctttgatcacaatggacaggtttccactattgtgcaactctaagtggatctcaagcccatcttccttaatgcaaagtctatcacattacatgctagccccttggtaaactgatctgccagatttttagccgtctggacatagtccaatgctatcactccgaagtttttcggctttctgacagacttcagtcttctttttacatgcctggatgacttcatgttgtcctttgaactgttcactttaataatcactgtttgattatcacagtttatcaggattgctggtactggtttttcaaccaccggcaagtccaacaggagctcacgaaaccattcggtctcaactgtggcagtatctaaagttgtgagttctgctttcattgttgacctcgttaagatggtctgcttgcaagacttccaggaaacaacgccacctccaagcgtgaacacatactcacttatggcatttatctcaaaagcatcagatatccagtttgaatcactatagccctccaacatttttgggtacccggcgtagtgaattccatagctcattctcccttttagatagcgcattactctttcaagagcatgccaatgatcatctcccgaatttgaaacaaaccggctcaacctgctcatagcaaatgaaatgtcaggcctcattgcactagctaagtacatcaatgaaccaatgatctgtgagtatctcagttgatcccttgctactcttcggtttttccctaatagcacactgggatcataaggagtaggagctgccttgcagtcactataaccaaagcaactcaggaccttgtccacatagtgagattgcacaagtgtaatcccaccctcatctcctctcagtagcttaatgttaagaataacatcagtcactcccaaatccttcatttcaaagcttttggatagaaagtccttgatcaatatgtcatcgacatataaacacaagatcactccctctcccccaccatagcgatagtacacaaatttgtcagcttcattcacaacaaagccagcagatgtaagtgttttatcaaacttctcatgccattgcttaggcgcttgtttgagaccatacaaggacttcaacagtttgcacaccattccctcttgaccttctagtacatacctatctagttgatccatatagatatcctcctccaactctccattgaggaaagctgtcttaacatccatttgatggacgggtagaccatgagaggctgccgaagtgagtaatactcgaatcgtggtcaagcgagcaaccggtgagtaagtgtcgaaaaagtcctcgccttccttttgggtataaccctcggccacaagccttgccttttactcttcgattgtacattaggcctaagctttttcttgaaaacccatttgcatcctacaggcttgcatccatatggacgctcgacgacttcccaagtaccattagacataattgagtccatctcactgcgtaccgctgttgatgcggaaaacacacactggcctaggagatctgcttagctccagtgcaggtccaaaggatgatgagatgcgagcgtgctagtcagtttgatcctgcaactgacaagatatacaaataacagatcaaatagccgatcggctaaacagccgatggagtaatcccagtcgatgccgataccagccgatagcgatagggtttaagcaatcggctatatgtccaatatagataatgatataaaggcaatcggctgatgatgatataataaaataaaaatatgatccagtataaactaatcggctagcaatgatatgatagaataagcactgatccgaaggttaaagcatacatcggctggaggtccgatgccataaaatccacaagattagattaaacagtgaaacctttgttgcgatcggctaaatccaacttgtatgtatatgtaatccttataagccgatgcaacgtccagataacttataggctagcaccctgatagaacattagcatgaacctatcggcttaacaagacttatattatcaacaacaatctagtaggtcgaacctaaccgatgcagcacgagattgtatatgataatctaatactcgatgagccgatagatctgtctaacgtgatggatatagcaaatctatctagaacgacattgtgattgtagagatatattggctaagacagaagatcggacctaaccgagacagttctaactaaaccgatgagtctctaaacacaatgcaattaaagatagaatcgagatatcaggtaggtacatcaatcaaccaaaccagagcaatccaagatatcagagcgacgcagccttgaacaacgccgacgtagatgacagattcaccagggcccgatggaacgtaggacttaccccttcgccggagatcgaaagccgatgcagcctcgcatcaggtgcccaaatcccgccgaaagataagtaaaaacctcggtaaagagggtggcgatgcgccgagagtattattgattgagagtgatagattacgtacatagaccctaggtgtacatatttatacccatgggttgatacaagtccttgtcggataagaaagaaattatcctaaagataaaaggaaaacataaagtccttatcggacactaaacatacttttctaaagataaaaggaaactaacaaactattcctaattaatagataaactgccatgccgcatcctctttgaactcgattgcttatggataaactttctttattagattgatttccttaaccgaatatagcagggatccgactattggcaacttgataactcccatcggctgattccgtgatgctgcagccgatagtgattttcagccgatgatgactttagggcttaccaaatttcactgttaacaactgcttccttccaatagtcagcgtcaggagatgaatatgccccttcaatggttcttggagtgccatccacaaggtatacaatgtagtcatctccaaaagactttgcagtcatttgtctcttactctttcgagttgctacaatgctatcctcctcaggattttcctcatgcgtttgatcaatgtgttctatcggcgtaaagtgctcaggggataaaataggttcttgactagaggtgctaggtgcatttttcatatgaaattcattctaaaaaatgtggcatctcaaaaaaacttgatagatccttttcggtagttggctttgctgcatcactaaaaccacacgctttcgatggttcaaactataagagatggacatcacgtgcacttttgtggttgacagcgatgcaatgtttctttgtctcacggggcaaactgagtgaaccgcctctctctcctgaggaggaggctaagttcaaggctgcggattgcttgttccctggagcattgataagtgtgctcgccgataatattgtggacgtgtatatgcacatccctttagggaaggacatgtgggatgctcttgaggccaagtttggagtttccaacgccggcaacgagctgtatgtcatggagcggttctatgactacaagatggccgatgaccgttctgtagtggaacatgctcatgagattcagatgatgccaaagaaacttgagaacaacaactgcgagttgccaaacaagtttgtggcaggaggcattattgccaaattgctaccttcttggtcggactttgctacttatctaaacacaagaggcaaaagttcagtgttactaacctcattggctctttgggtgttgaggaaaaggcgagagcaaacgttggggctagagccccagctacatgccggcagaaacccctgccctgcatgcagagcagcagccacacagcgtcaggagaggagcagcgtataacacaagtgcagaacaaccaggtggcaaggaaggaggagcaaacaaagacaacatggcgtggtccatggatgattaagtggactaattggctgttaggccttccttattaacctattagtttttgctttttttttgtctactttaatggatggaacgatcaggggattagggaagcgagtggtttttactcacaaagtaatccaacaattatcaacaattgtgttattaaatttgtggttgtgtctttgtcgtattatgtcttctatcatgggaaagcgttttcatcccttcaggagatatcccctcgttttgtacatgtcatctaaataatcataaaaaaatcttaaaaaattgattaatatgaaacatatcactccgcagacatgcaagttaaaattcaacttctacaagttgcaaaaaaaatataattgtgaatgtacgataactattttcaatttaatttgttaattttgttgcaaattgtagaagttatatatttgcagagtgatatatttcatatcaatccatgttgtcaaatttttttcaaattgtttagaactatttagatggcatgcaagcttccatcatactttgtaaaacacattagaaaggagcaccccctatatttccattctagattcgccactgagatcaagggagattctagcgccaatttggtgcaaaagaagaaccctcatgcatcccacaacaacaacaagaaagtcaaacctgacgtcaaacccaaggctacaacacattttaagaagaacaggcaagggaaaggcaaaaagagattgctttgtgtgtggcatgtctgggcattgggccaaggattgtcctaagcgcaagaacaagatgtctgcaaacatggttattagtgagggcggaggaacatcgagttatggtaaatttctacctacagttctttccatatgtcactcacctgattggtgggttgacactgatgctaatattcatgtgtgtgctgacattttcctgttttcttcttatcaggttgggagaggttctccttgttgatggaaaatggatcgcttgcggctgttcatggtgttggtacggtcgatctgtagttcacttcgggaaagaccgtgcagctgaagaacgtgcagcttgtcccttcaataaagaagaatctagttagcggttctctactgtgtagagatggttttagacttgtgtttgaatccaataacgtgtcgtatctaaatatgaaacttttattggaaaaggttatgacagtggagcttgttctgcttttctttggatgatatgtgtaataaagttgtgaaccatgtaagcaatgatgatgataagtccaatgtgtggcattcgcgactgaagaactgaaccatgtaagcaatgatgatgatgagtccaagtgcaagagacgggaagaactgaagaactcgttattcttctgttcatccttctggtcgctgtagattgcatatatgcaagcgcgagagtaacgttcagggtcatcaaccgcggtgtataattccgtaaccgagcgcttaaccgacgcgctcgttaatacggaatcaattctcatgtttatcaccgtccgttacaaaacaagagagttacaaaacgagagagagagagggagcagcagcaacagccgcctgcctgcctcgccccgccccgcctggctatccacccaccatctcaaccggtcaatagagactctccactaactccgtattttagttgagatctcttcacttagatttccaaggtggtattattacccatagcactaaatgtgggccaatggaatttattaggatttaattgggcctaactcattaatctaagagtttactccaatgcaattggcatatggaatatgggaagtacatgacaagctgcaacatatcccaaaattttgcacaaattttgacaatttgaccctttacaaaaactatttttacaaatgaaccgccactaaaacttatttcaaaaatgacccttttgttcagcaccaaatcgtgtgacgctgaacttagacacctcagcgccaaatagcgtggcgctgaatgttcgttggcatgttgacttagcctcctgtccgcagtggcacgacattcagcgccagtcgacgtggcgctgaggtgtctaagttcagcgccagatgatttggcactgaacaaaagggtcattttttaaataagttttggcggcggttcatttgtaaaattagttttttcaaagggtcaaattgtcaaaaattgtgaaaattttgccttcctgaatcctgaagaagaaagtaaaacagacctgtccttttcttgttcttttttttttaatagaacaagcaataggtggtatttatcttatcttctttcccaccctttctgctgtcaatgttcataaattaatctcattcccacaaaatacatttgaacctaattttcatggttcgaaagtagggatttgagcagtaactccccatgttgcctgataaaacgtgcgcgctgtgatgcttcggtaaggatcttgctctctcttcctcttcagataagacattatattctccacctctgacttgatgtccaaatataattggtttgcactctccctatccctctgtacaccgtccattcctttcatttcaattggttttccaaatagatagtatagccgacctggtaatttaggtagaacagcaggcaagtgtaagacctgatttccttcctctccttttacagtactcctgaaacaaaactcacaaaaggttgcaccctaaaaaaggactcaaaataggttcgtcattaacagggcaacgtatcctatgcacacacctatcttggtgcactcatgcactcggtcactgtcggcccttcgattctaatccaaaggctaaaaacgcaggtgcggcatttttacagaaagctgcccgcaacacctgtgtatgtttgcagaaaacccctcacttcccttcgtcttctctggtccaaacctcctcgatccaggtcgatccccaaatctgctctatcaccttcggtcggggccggcgggactcgtcgtcggcgcctgcagcatggctgttggcgattttgtgtccatctacacgcagctgaacatcgagctggccgagcaagcagcacagtggcccgtttggccggcaagcagcgacatgactggggagcatcgtggtgttcaatcgaggaaaaatggcagcgaggctgccatatcaataattaaaataggccatgtccaaccaggagaaaaacaagaagagaaatcaacaaataaacatggacattatagctgaagaatcgagagaaaaaacacgaagagactcgccggaacgacggcctccatggctccatgcggacactatagatggagacgaaccattcagcgagcagctggacagccacgccggctgtgaaggacagcgccgaggcagccgcagcctggcgtgtcggccgatgctagccctagcagcaggattcaatgaaaatcgagatgaatcgtcgttctgttcagccccatcgcatggagatgagatctggatcgaggaggtttggacgagagaagacgaagggaagtgaggggttttctgcaaacatacacaggtgttgcgggcggctttctgcaaaaatgccgcacctgcgtttttagcctttggattagaatcgaaaggccgacagtggccgagtgcatgagtgcaccaagataggtgtgtgcataggatacgctgccaattaacagtatgctttcctttattttttttaacaaaaggaagaaaagacaaagtacagagatctgaccttactcctggacaatcttggttgaacgactctattgtttctctgatataagggatgttctttagttcattgtaatccagaactatctgtgaaaagtacaaacaaggtataaatacattatccctaaaaaagaacagatacagttttatattccactgagcaccgatcataaattccacatcataagaaagcatatatgctatttggaaaccatattatttcagatgatttactgttaaaagccagagcaaactacctctaacatgtcatcttctcctacacaaccgaatggtatgacagtaactccaaactgtgctgccattcttacaaattctggttgatctggccaaaacaactggtagtcttcatcctgcccaattcagcagaacaaatatattgagaaggaaaagacatcacaaaagtgtagttgataaatgtaaagtttcaagcaaacctttctatgtagagcttctcgaataccaccaggatagaggagaacaaattcatctctctcaaataacctatatgtattaatcggactgacttgtactcccccatacaatgggactacgtcaaaaaaagatagctcctggcgcaaaatctcataattccccacaaaaaacactggatgagccaaagttcgcagaactgctttcttctccctcaagaactcttcagccattgaagtgatctccattgccaacagctgatggtaacccaccaacaggacggggcctttgtcaggaacaccggcgaggccgcggacgattttgccgtttctcagagtagatagcatgactgggctcagcaaatggtgaagcagcctgcagaaattcccagctttcttttgatcaattcaatctgtttaacgaaagtacaattgatatttgagaatctgaatgcatacttgaaatcttcaccaaatgttctcttgaattcacttattgtaggtgggaggaaatcagtgatagtgtccctttgtttgccctggcggtacatgctggctccttttatgacagttagcagattaaagctgctctcctgtggaaatgttctattgctgagattttctaatggacaacacaacagataaataatagtacatatataatttctatacataattaagcactggaaatgaccaatgaagtggagaaatagaagcaattgtgagaaaattattaaaagtatgtaccatgagtaatctatcgctggaagtcctgaagtatcgaactttgcaacttttcagtgccttaaacagtcgatctgcttctccacttggaggaagattgtcattgccactgtaaacccagatatatatcaaatatttatagttcaagaataaatatgtaaatatctaaatacaacaaagagtagaaaattgccaaatatgagatatttttataggaagggcacctggcaagaagcagaatttctgcttgtactgcattaagacgagagtttgtatagtctacacctgacataagaagcttgagcttccacacaagagtatccattcgtacgatatgtccaaattcctgagaattatcaaccatgaagttcgaaagactaatatgacgatctgtgttttcgctgatttctttcattcagtaggatatcaaaacaaggatgggatgcttcttcctactttttatgcaaagattatttgcacatgtgataaaaatatttaagacctatatatcatatttatagaacaaaataaattgctatgttacacaaattccaatgcttattgtgcaaatgaaaacatatataaaatgaaaaaggagaaggaaattatagcttactgaaagtaaaggtagcattgaagaaagactgtctgaaaaactttccagagtatcttgaggagaggtattgttctgaatgctaaccattgccatcttaagaggatcacctatttcacaacaagaacatcttaaaaaggttttgatttctcaagttgactaaaccagctaggcagatccagagtcaaccattgattaacattttagcaccaaaataaaaaagaaaggaaaaaaaaactatacttcaggagctgagctagagtggttcacacatggatgaaaaaataaaaacttaaagaattagaaaatgctgtttgttgagactattttcatttatatttctgcttctattctgctaaactaaattgtatgaaagatgtttattttacatattgatgacctttgcaactcgggataattgtagaaaatgcagaagaaaggcaactttgagttgtctgtaaacatggacgttttacagtatgaaataagtttgagcatgaactgcaaacaaaataattgaaatattatatcttcaacagtttactttgaacataaatctatcaatatcattattaaaacacagctggagttaaaaggtaaaagttctgccatcgatttatagggactagtattccaaaagagggacaaaattaggaagacaagaaaatataccaatcaaatatctgagaaggtgagggagagtgacaggaaggttgcttggcaccatttccaaaagaggcaatattgcctgcaacggagttttcgcaaatgatgttgctgtagaaaacagattaatatattctaaaatctatagtgtaagaaccatattatttttggattgctatatgacactgaaatttaatgttgagacgaaaagggtttcacctgcctggatttactagtataagaaccaaatcaatttctggatttcgtgatgccaaagaaagagccaaacatccaccaaaggaatctccaatgatatatattggtctgtttggtgacaaattgtgctcatatttgacagattcctccataatttgtaacaaccctgtatgaattttacttcaaaacatgttagtgaagggaaccttgattagtgctcgtatttcctttcttcatacctgaatcagagaatactaaattttactgtgttgattttaatcattaatatgttccctatttaaaaaaaaaagatgaactgcagatctctgacttcaagaagaatgagaacttgcacccacaagaccatgacaatgaccacaagcaccatggagtccacaccatatatggcataccacttggcaacattatgctctgctcccctatttagggtaagttatagttgtagcaagtacatatagtcaagtatacttgtcaggacatggacatgttaatctgacgctgataacatatctaaaacaagacgtctattattaccttcatatggtgtacgatcattgaccggtatatgcaagcagcggacctcaaataccctgttgataaaaggagggaatgaaattaaattatttgcacttctaaactccaactttaaatttcaacttcctcattttcgctagcacgtttcccaaactgctaaacggtgtattttttacaaaaactttttatataaaagttttttaaaaaattcaaatgaacccaattttcatttttataacaattaattaattatgtgtaataattaattaattaattatgtgttaattgcttgctccgatttccgtacccctgaaatgctcgatttttatgctgcatcgaacgaagccttatttccctaagagccaaaaaagttggatataagacacagttggcatacgtgaactatctactgtaatttaattcagtgaaactacgtaaagcttgattgtcagttatttagtactacttagctacacgttctgaacatctaactgaacttgtctgaaacttaggagtaatttataaatgtacgaagactacctatatgacaaaaaaagaaaaaagaacggacatgcaaatgtaagtgttttcaccctattatattttgcagatattcaatgatttagcacagtatgttagtaaaataaattgcaatattatattttggcatatcctttagcagtaccattcgaacaaagaaatgcagctaaagtttatcttgaattgaaaaaaaaaagtcttaatccaaacgtgcacaatgaaaagttaaaatgggtatatcttacacaagaagggaacgcacttacttgcccaaagatttgtgctgcatgataagttccattccaacaccgtcgattcctgcaattcagtcaattcgaataacagcgttagtacaaacacattcatgaacacaggcatatgacaaaaccttttaattttgtctatggatttctaacaatcctaaaaccctgaagaagagtgcagcacagaccagccacaactcaaaactgttaaaatcagtttggaacacgaacttgtcgcatcggaaattcagaattcgcaacatgaacatgaactgccattgttaagctatttccagtgtaaatgaaagtaaatggttattttttttgtttctgtgtgtgttgtgcacacaaagtgtttgtttgattgtgtcaccgagcgaatcagcgaaagcaaggagagcggcggggccgtgaccgagacctggcaagaagagcagcagcggcggcgcgtggaccgccggcgggccgcactcgacggggcagaaccaccgcggggggccgccgccgccgccgccgtcgagcggcgtggccctcagcgcgtcgaagtagtccctgacggtggcctccccgaagccgtcgtcgtagagggcctccagccccacctcctgcaccttcttcgctctcctcctcctcctcctcatccccgttccactcttcctgtccgtgtcctcttgccccttctccccgctcgctggcgcctccgtcgagctcgctcggaggcgggtgggccgccgacggggagttgcggctgcgggggggaggacggcgtggagcgcgatggacatggacatggttagcagcgtactacgggcatttggtgagagaaacagggtgagttggagaagaacgagaggaaacaggggaggaggaacaggggaagaggaagcagagccacgtatattgggggtggatcgatggagaggggagcgtgatttgaattgtggtgggaacgagaacgagaggtggtgacactactatatagtggatgtgatactatgcgcaattcgtcccaaaataaatcgatatacatcaataagaaaaatctatataaaggttatattttaaccattaatttattttgaaacaaaaagagagtaccgtggccatttttttaattgccatgagttatatgaaaaatacggtccgtcaccctaaaaatattccaactattatgctgatggtaaaatctgattaaaagtagtgtcgaatgctatttgtccatgttttgcataagcattattcttaataatgttgtctattctgattggtttaggttcaatctctttgttaccgagctttaaatattcttttccttataaatactcctctgttttgtattatgaaacattttgattttttttcttagtcaatttattaaatttataggaaaacaaaacaatattttcaacaacaaacggaaatactattcaaatatatttaacatttgatttgatgatattaatttggtattgtatgatgaaatgaatacagttcaactatgcagcaagcaggatgagtaaaatacacaatgacgcacaaacctaggtataattcctcgtccatatatgtgtgtatttcacgtaatcagagtaaaatataaacagtatatcccatactgacatacagtgcgtgtgtggtcatggaaagcaacggatttggttggatagtcatacaagtaaaatgattttgatttgcgcacaccgtattcatatcattatcatcaaaaaaataaaatatgcaggtatcatatgcttatctcttactgctgggctacgtgtatggaagtggacttctgaacttcctttcagagtgatctatcgatctctgccacgcccacatgcgtgcggtactgcggtatatatgcatttcgtttttgggtcgaaacctcttgaggccgacgtgcacgcgatcctgaccgtccgtgtggacagcattttacagtcgacgacagccagaacgtacgaggagtcctgtagagtaacgctccagaattctgcacgtggccggtttccactccccaacaaaattggagcctgtatcgctacgagatttcaacgctacccatcaagaaccatcatatatctacattggccatatcgtaacttccgagcaagaattgctctatcagagcaagtttaatagtatagccaactactggctccaaatcaactatagctaatctaatagcccattcatacaatagttaactatccccgcaaaaaaaaacaatagttaactataaaaatatactataccattaatatccgatcccacctctcatacacatataacgtcttgaagtccgtgttgcagctggctacaaatctgtagccgctttcttctctctcttctcttttcttctcgatatgtggttgtgctgctctatcaccatctgtattttttttcagatccaaaagtgatccacaaaagtatcttacgctagtaattttatagtcctttaggaggaggtaccaaaaatttaatgtaatttttggtatctcatagtacctaggcactaaaaggtactaaatttataatagaaaaaagtggtacctcatggtatctctttaaggactgtaaaattgctcatattaggtagttccttttctgaccgataattcggttaaccgagctatcgggtcggtctttggtcttgtttgagtttaaccgaacatcgcagcggctccccaaagcccaggcaaccaacggcaggcagcagttcggaggcacacatcggagccgaacaagcaggaatcccttcgactgggatgacgagagcgttcgcagggaagacaacaacaagtggtcgaggcggaaaggatagaggcaccaatgctacctcccggaggctagaacgaggccctgtacgcagggaggctggggagccatttgccgtcttggaggatgacggcgtggtcggacactcggatttgatttcagtcgtatgtcgccatggctgtcaccattagcagcgccgccacacacctaccccgccgcgatggtgcctcgatgggattccccagtctcgagccgaagccgttcgctctatgatgcacagatgtcgtcgagtcaacgagtcatagagatgaggagcagaggtgttgccaaggggataagatcttggggaatataactatttgccactgttaggtttaataattatccaaatacccttcttaaaattgctcttgttattttcctctaaggtggtggcttgttgactatttatcatttttgctcgcatggcatgccaaactggctacctagggtagaaaacagtgcaggacccaatagtcagcctctcacacacccttcatctccccctccgggcctaaatattatcttcatcaggcctaaattagagactgtcaccgatgagacgtatcggtgacgggcttaagataatttttgtcgagcctaaacatgagcctgtcaccgataggtctcatcggtgacgggctcgaaatacatgcatatggataatgtttgtacgagtatatctttgtcggtgtttatttcccgttagagatgatggcggtgtgacggtccgcatgcccccgacacgggaaatgccattacatattagaagttctatactagtgcacggtaggaatataatttataaataactgatgttcggaataaaaaaataaggacaagaaacatctagaacacgagatcaattaaaattcaaaatataaaataaaataaattttaagattagaaaaatatgagagtacaaggaggaataatttattaaattaggaataaaaaatattaaaagaactgtagccgtagaaaaaacaagattaaataaaattaataataaaatataaaatacattccaaaataaaaaaaagagagttcaaatatgaatacaatttataaataacaaaattcaggaataaaaatgaagaatattgaaagaaccgtctgtcttgaacataacagtgacaattgacaataaagagagcagcagcaacgggcaagtggtggaagttgatgtgacatctaaaaactataaaacaaaatcccaatgatgattaagtttgattttcacaatcctaatgacaattaaaaagggagcaacaggcatcgttaaataacatggtcccgacggttgatgggacttctagaaactaaaaaataaccaacgataatcaggtttgattttttaaatcccaataacataaagagagagggttcacgggcgtttgatgagacttctaagaactataaaaaggaacccaacaagacaataaactctaaaactataatatctgatttttaaaggtgccaagaaggatggatagaaaccgtggtacgtcggacaaaaaaataaagaggtgataaagaagcaaggggtggcggccagtgtaaattttaaaaactataaaattaaaaacacaataatggtagattcaatgtttttaagtctgaaacaacgagatggctatttaacattttttaagaaaaaaaatcatgtctaaaagattgataattttgtatggggctagccgcgcaattgattggtcacccagctaattatttggataattatcaaacttaaaagtgacaaatagttaaattgccataagatctaggtctcgtcctcactcctgatgtatggtgcccccccccccccccgggtgggggtgtgggctggaggcctggaacaacgtgggtgtttggtttattcggttagctggtagtaacaatccaagttgatcgtgtgattgaaagaatgaccgaagaaggggaattcaggtttttcaggttcattatttggtcctcggttcctaatctataattatgatctgtgagatcatgatcagtttaacgaaatagtactctctttgttttatattacttgttattttaatttaaattttatgttaaaatacctattgttggctatgactcgaatatatagtcaatcctatttttgataggaccgattgacaattgaattcaaattttaccattagttgactatccataatagcgtggaaagaaagcctggaggaagtgtggcccttgagtttctcgccactttgcattaggatttgttaattctctttctcgaggggacagggaagggatataacacagcagtagagtgtcaccttgagatggtggaagttcagtcgtataccgtcacaactgttattagctcatctgctttggaaaactacttgggatgtatttaatgagggtaccatgtattctgtcacatctccttggtttatatcagatttacaagaacaacaaagataacaatgcctaaaagtacacccaatagcaaaatgactcccgattcataccatcacatatccaaacttaaagattatgtatggcctactcaatgaattttgtgacacgaaactaaaataaattgtttgttccatgtttgaatctagatcttttgaggtgtgcatccatccatgcatgcacatttcagctagctctgctcaaggatcaaacgatgggatttcagagtcgtggccgcaaccaagctggtacagaatcctggggaggatgctcctgaacttgtcctcctccctcttctccagcaggtaggcgatcatggccttgacctccgacttgacgtgcaggtagagctcgccggcggcctgcttgtccgtcatcacggcctgcatccccttcgtcgggatcggcttcccgaaccggtagtagaacctgcccgggatcttcagatacacccccgggaagaacacctcgtggtcgatgtccctgcattttttttcagtaaattaatggttcatggtttggtcagatttgggatgaatttagctgttactgttcaaagttggaatgaaatcggtgtgaattaccttagcttgagatggttgctgtatgcttgcatgatctccttgccgaagggtgcgttcctaatgtcctcgaaagtgcagagcagctgcagaagcaaattaatcctcaggctcagtgcatcgcgatcatgcaaatgcaggtctgaattgttagctgcagagcagtatgatttttttctaagaacagtagagcagtatgatgcgtgtggattcgcttacttccattaggtcgtcctctccgacgactccgaagggcacaatggtggcgttgaactgcgctgccatcctcacaaattcagtctggtctggccagaacagtctgtgctcttcaccctagatagattccagagcacacataagtgcatcatcagttggaaacataattgttagacttggaccaagtaaggttctgctaattatttttttaaaaaaaagacaatattttcgtctggaagcacatcttaaacccctgtttttttccaagtattttggtctaaaattacgaatcctgctatcaatactcaaatcacaaccaaccaattgctaaaattgaacttaaaaatgtgatttgtttatgaactttgtagggttcctgaacgcaattccaaaagataacaacaaatacaccatgtaaatattattcctgccgtttttcaatatacaacaccattgactttcatcctattaaaaaaatatataattgtttttattttgctatgacttgttttataaaaaatggtacaatattaacatatatttttatatttttatattaaattttaaataagacagataatctttgtgcattaaaacccgaggggactaactatatatttatcgataaattttattctaaaaatttgacagatgtaattatagtataatcgtagtaataattacactgtaacttgtatgtaactacagttacacttgtatttaagtttcatgtaattttgaatcgttaaatctattacaacatttgttctggtgaggaagaaaaaaatcacagcacacacatatgtgaaaggatttgttcccacgacctctattttactgaaataacatagtaccgagagattcttgaaagttacatacaagttacattatagttacagtgtaattacatgcaagttacagtgtaattacactacgattgtactgtaattacatctgacaaatttttggaggaaaatttgtcacaaatatatagcaaattcgaaacccgagatagtacatgccagcctaggtagttaataaggggaaaatggtcgaattttcagccatatgatgatgtgtcaagattcgtgtataagttacgttgtagttacagtatatctacaataattataatttattgcaactacgctgcaactacattataacctttatataatttagatataaaaagttacatattttttattatttttatatacaagttgtattatagttataatatagttacgatggaattattatattatagttatatttttgacaattttctaattaagaaacttgcggcagcattttaagatagtctttatatataataaatgacctgaaaattttgggatgaaggcagtagtaaaaagaaaaaagtttgtactgtactaccttgcagtggagtgcctcgcggtggccgccggggtagaggaggacgaactcgccggcggcgagcagctggtagatgtacttgtaggtcatggggacgccgccccagaggttgaggaagtcgaagaagtcgtggccctcggaccacgtcttggtcttgttggggaacagcagcgggtgcgcgatcccccggagcaccctccccttccgccgcaggaactccgtcgccagcgagatgagctcgatccccagcagcatgtggttccccaccagcagcaccggcccttcctccggcacccccgccagcccccgcaccaccaccccgtcccccatcgtcgagaacatcgccgggcacgtcctcgccctcaggtcactgctttttcatccatcccattttcatccatgttcatggatgcatggtgagccactctactttcttactctcaatatttaattacatgttcagagattcagaaatccagaagtgaaccttttcaattctccaagtacatgttcagagattcatagtgatagtaaaaattcagaatttgttttatgaaaagagaaaaaaaaaagaacagtactgaacttcaggaattcagtactgaactttcaagtctaaacaacacttgttcagaaatttagctctgaactttcaagtcacaataacacatgttcagaaatacagaatgatggtaaaaattcagaaattcagctccgagctttcaagtcgcaacagcacatgttcagagattcaaagtgattttaaagatttagaattttgtcttttcttaaaagaaaaaaaatcagtactgaactttcaagtctcaacagcacatgttcagaaattcatagtgatggtagaagtttaggaattcagcaaaactttgaattgttacctgccagctttctcgacctccttgagctcagtggctgatggggggatgtagtcgaaaacccggtggtaccgcctcgagtggcggtaaaggctggtgcatttgatgatcgacgagacatgaacaccgtactcctgaattttttattgagttttaccatcagcagggtttccttcacttctacattttgttcttttcagttgaaaaaaatgtctttctaaatttgcatatggctgctgaacctcaccaacagtaagctgtgcccatggttctcgaagaagaacactttgcatttaggtagcattctctggagcctgtcagcttcagatttgcttggaagtaatctgtcagcacagctgaatgcaaacataccaaagtacgttttcgatcatcataacagaaatgtagttatcgagatccaacagaagcaaaatactcatgttgggatagcttgactgaaactatgtccaagaacggtgaaattgaaaaggtagaaaaccagagataaatgggttgcttaaggtagcaagaaacctgactagcagtagcacttcagctgaaactgattctagacggcaattagcatatgaagcagcctgttggatcagcttcattttccatcctagagtgtcctccggtattttatttagtatgttctacagtgaaattatagaatttgaaagccacattaattaaatataagcagaaaattaaatcatttctactgctcgtccccctttctcctggcttgataaaatgggacatagtagcgggacgcacaaaaaagaacggtacataccgaatgcttcaggaatgatgatatattacttgttaatctgtttagtgcttctaaaggatgtcttccacttttcatgctactcaatgccatgtcaacttcattgtctgccctcatgatcaggaagaacagaagaagcggatgcagagttattaaacaggaaatgtgacaacttatggcaaagtacagaaattaaatgatgaaaactggaaagcagtcctgtagttatcaggttatttcagccaattaaatgtttcattatgcttggttattttcgttcttacatatctttttctaaatcttctgtgctgcaacttaggaaatacttaccaatattgtagttcagaagagatgtaattgcaatccgtgcacgatccgacaacgggctggaaaccgacaggagctgttttatgtctgatttctcaaatgatgttgcttttccagggaaaaaaggaaaataaagttaggtatcacaaattttattcatgcaacagcagatttatttggagatatacctggattaaccagtaccaacaccaaatcgatgcaaggattacgagcagctactgcaagtgctatgcatcctccaaaagaagtccccaaaaggtagatgggcttattaggtgaagtggcatgctctgctctcacaacatcctctaccatttcaacaagttctgaaaatgaaaaacagctaaaaccatgcaatctgagaacttcacattatctgttattcgctctaaataatgaaataagtttaaaaattcatgtatggatggaaatacttcaaacagaaattaattcacagatatgttgataccttcaaatggcgtgcggtcgtggaagggaatgtgcatacatcttagttcaaaaatcctgtgaattcaaagacaacttgtctagtattattacggaagtcgtaaaaattgaacccatgtagtatcattgtaatctaaattgcctataatcaactcctataaaattgtgagctctcatcatattctaagagaaggcctgataaaaattgcagacaagtgaaagtatctagaagtgatctcaccttccaagtgccttgtggtgcatgaagagccccatccccataccatctacccctgaaaagtttccaatccaaatcaaatcaaataaaggctaagctgcaggacaaaactattgaggattctacaacacaaacattcggtataactgtaccgggtaaatacagcatgagtggagcatcctcaatgggtgagccggcatcaacgggacagaacaagcgtggcggtccactgtcatgttctaccagctctccaagtgatctgtagtaataatccagatccttagccttctggtacccatcgtcgtaaagcgtttcaagccccttgtagctcacttgcaatctccagcctgcatgcttgaactgatggcagctgctgatcctctcaaacaagtcgtgtcgtcgtcgtcgctgtcgccacagagctatctgggagtggagaggaagagaaagagtagccattgctgtgaagctacaaagctctcattgaggtatgtatgttcatggtcttttttccaatacctctgatggagttatgcagagaagcatctgcagctgtgtgtaacagaaataactgaactgaattgaggcgcaaagtgtgtgagtgtgaccattgcatgacagctcacaggtttggctaaagtagtgaacgtgtgactagatgataattgttgtatcatgaacagttatgcttaggttgttatagtagtagttggcgttttcttgttctttcgtgtggaaacacaccaacactttgatcacacgataactatgttgttggttttcttgttaaaagtactcatattttctgttggcatatgattgttcttcaagtaatcaagtgtgtgagggcacaatcatgttgctgtgtttggcaaggttgtctttcgtctttgtggttcaaataatccattagagatggaaactaaaagagattactcgttcctgtcttctgtgatggatcaaagcgcactactcactacttcccttaaaccagaaagacaagactgacaagctatgtttatggtttagtccatttgcaaattttcttggtcatgggaggaagagagtagcttgagactggggttggagcttcactggtgggagagggacagtagaaaggcgaatcagcgaccgtgaacacacaggctatgatgtagcctccaaaaagtccaaaatgcctagatacatagggtgtgtttagttcatgtcaaaattggaagtttggttgaaattggaaaagttggaagtttatgtgtgtaggaaagttctgatgtgatggaaaagttggaagtttgaagatatattttggaactaaacacggcgatagtataatgagtgataatgccgccataattcttatactaaggaggttgtgtatatccacttataaatatatagaggccggatttatatctactccttgcgtattaagtctacttttatatatgaatgtggataagcttgtcaagaatctatagaagtaaatttatttttgggatagagggagtattatctctaaaaagaaatatgttcaagactcgggagcttacaaaaggggagaaaatacatttcctgacatcaatggctggtaaaagatagtggaagttgtgttttttatttaaggtttgttctggtctaacaaatggtacaccagatacgtacctagaggtaccaaatcaattatgatagtccgtttatgatgggcaggatgggtagcgaccttgtaacaaaagagagaatatatgctgctcatttattttcctccacgtgtcatgtgaggtccgtgcagcaccgaagtcctttccccacctcatctctctctctctcagcggcgcatatatctcacagcggcaccggaccgcaacatctccccacctgcgctatttgtcgtgtggccaccgccaccatttggtcgctcaagcgatagccggcgcataagcggaagcagaagaggattctgaagcaaatcggcgtcgctgtcgtgtggcataatgaggcacgagatgggaagaaaaaactcaatgataacaaaacttgataaatgtcgatccatgcaaattgttttataacaaatactacaacgaaaagagcatcgtcgaggaacgtggcaagggtggtggtggtgagagaagcattggtggtgacctcagcgaagataccaccggcgaggtctatgacattgagtaccgctacagcgagaagagtgctgccaaggagaagggtggcagcggcaaggtctacatcattggcggcgatctcagcgaagatacagccagcgaggtccgcggcattaagtatttctgcagcgagaagagtgctgccgaggaatgtggtaagggcggcggcggtgacctaaaccctagcatactcgaggatagcagcaagcaaggagactgatgagcgctgtcaatactagggtttcacatcgtttgtggttgatgtgcttaagccgattcagtctatactcttgcgaaattacggcggctgctcttccacgtactagtccaggtgtgacaagactcatcggtctcgatggtaccttgcagcactatcattttttattcattggagattgaggagatccaacggtccatcttcagtactgcggcaccccgctgaactgcaaaaaaaaaatctctttctagtttatttagaaggtgatcccataatttaaaaaataactatagataaacaatgcatgagaaagcagcttctgcttacatgcatggaataaaaaacaagttagtccctagatagtgcacatgctcttaaggggcacacttggaaattttaaaaaaaatctacttaacctctagagtaatataggatttgcctacttaatcccaaaccggtttaaataccccatgtagtggttttgttaaaggtattgcttacatggctgacgatattgcttacatggtacacacatgagcccatctggcctaagttaacataaccgattcatttctctcactaatctgcgagcccgagaattacatatcagcatcaatatgcctcttctcagagtcattatgcttgttaaagaaatacttaacacatgccattgccatgtaatagtcaatgtggccaaaaccacttataaaaccgctctataagtttatttcaactattttgtatacttaacgggatagaatatccatttcataattcagaggttaagtaacatgtaatagtcaatgtggccaaaaccactcaataagtttatttcaacttatttgtatactttacgaggtagaatatccatttcatagttaagaggttaagtaccatataatagtcaatgtggccaaaaccacttataaaaccactctataagtttatttcgattggtttgtatacttcacagatagaatatccatttcataattcagaggacaagccttggtgcatcagaataaacaagatttaggagcggctgtatggacaggtttgcctcccacccttcagatcgagtttctgcggacgtgttagcctctttcccaattgattttcctccaaatggccgcggcttttttatgggtaagtgaagagggcgattttcagcaaagactttttgccagcgagaggtagaggaagaggccgatgagattggagtgagttgttgaagaatatctttgatttcggagaaagtgagaagtggggggaagaggccgacaagattgggacgagttgttgaagaatatctctgattatgtagaaacccgggtcgctcttatccttttttttttcacacgagtgcaactgtctctttttttcacacgagtggagttttgccaccgaattggctctccccgatgaacgagatttttcttgtcctacaaagttaaagcttagcttactcttaaaggctagttttttttccaaacatatagccttgctatataagagcaagtctaataatagagctgactatttactccaaaacaaacacatgaacaaaaactattgtttaaatataacttaggaagtgctcgatctatgtactattctttaaagtactattttttcttgtcacaatatattatcactcctgacttgattggcagtgagttgctcatctgcctaggagcacacaaagcgtcgataagagcaaggataatagtgggctataagcaagctatatacttatgtggaagagagagataaaaaaaagtggggagtgttggctctcatgcaagagctaactgcatacaaactccaagaaatatgtattaaattcatggtgagagaaagagagaggatgaagaaaataaagataaccttatagccaatctactatacatgttaggtttaacattgactaacagtaagtagtgagctctactattaaacttgctctaatatagtcgattaggctcgctggtgttttctctcacctctacgtcactgctacagttgatatgaaaagcttatagtcaattattgtacttgctctaagtataggcttgcctgtgattagtaaccaaactggccctatatttttcagttggaagaacacatagttgctcaccggtttcagttgaaaagaaggggagaaaataaaaagctcaccggcggcttctctcctctcgccggtcgacggcgcgatgctgcgcggattccctcaggcccggaggctcctcaggtgatctccatctccccttgttcttcttcttgtcctgcgcaaccgatgggcgggttcttgatgcgccgtcgctctgggtatggggggttttggtttcaggaggatggggttggagaaggaagacgcctacttctggaagcagatgggcaagggcatgctctgcacctacgcgctcttcggcgccgcctggctctggaacgagacctctcccctcggctggtggacgctcaagccgcgccccaaggtaatctcttcttgtagttagggtctagggatgcatatctgaagatatgatttaactggaaccaagcctatacaatcagtttcttggggggttttctttttcagaatttttgaatacagataactctgagcatggaggattaggtattttgcagatgtttctgtaatgttgattgcacaatcgaccagcatattttccttagtgatgtatgatgacagttttatacaaggagggcctgtaaattctcatttggttataatatttactgttgataaaaacagtgagttgcactgaaaaatatgcgacatcattgggagtccaattaattgataacgagaaggaaaaaccctaagcataatgctgatcctgcaatttatctatgaaaactttggcagcctttttgatctgtaaagacgacgtagaagttgaccgtgcagtgttgttaattctgacattcctctcacagtttgttttcctatctcctatacatcttaatagtgttgttgaatctttcatcttatgtttaggaaatttctaaatcttatttactctgttgaaagaagtaccgtaagcacattgagatattagcacattactgttgattagggaagcttatttatttgaatttattatcttaggtagaactcacatagtcgcaccgatatcccctgtctgattcttcttgcataatactagttgggtgtgagaactctgaaatgagattaattaatagcatgtgtatatttttcaaattaaaactgaactctgaaatctgacaaggtggaaacgaactgatgtggcattttgttttattgtaagatatatgtgcagagaaataaattcatcctgtttttatacccaattactgaaacatcttggttaaggaccaccagtagctaatgccaattcatcctgattctgaactctagtcaagtattcatctttcttttaagaagtcactgttgattttggcaaatcaattgatgagaagcatgttctgtattttgatggtatgctattcaatgaattttctggctggctggatgcatgaaacatagcatacggtagcctcctaatcgtccatatgccacattatactttactgaaccaacaattatagatcttcatttgcaattcctaagcacctctgatatgtatcgcctatatccatctcaattcccaaccatgaaatggtaggatgaaacataagtgcataaacattagaatgatatatctttttaaaaaaatgtattatagttgtgtagaaacaaatagtttgccattgagatctcagaaagatataggtatttttgttaccacgtgagctaaagctcttttgaaacattgtggctaacagcctatggccatatatgtgctaagaacctaacacttctttcggcttactcttattcaagttatcctttctgatatgttatcttccatgtttctcaggaagaaagagaaatggcccacctttacgagcgcaggatgtttccatacccaggtgatgaagaggcagttgaggagttcataaaaagtggaggtgctctaggcaccacaattggacccaaaggttttgctgattccaacatggactctgataacatgcagaaacaattgcagtcaaaaaagtttgaccaagaagcacagaagctctggtttcggatgaggaatgaggtcgtacaagaactccaagagaagggattcgatgttgaatgaaattttacttctacataaacagaaatggagtaaagctgaagtatgtgcaaattgtttcagcttgttagccgtctaggaaattaggagcttagaatgcacgcaaaatgttaaaacacctactttgcaatctggagatttttttttttaatttgagaaagcaatctggagaatctagagagtttactattcaacttcaatttggtcttgttgggtcattgcattccatcagttacagattttgtaccttaaagatatggtatcagttaccagtatctcctcgcgtttcagttttgaagatcatattgtctggtttctataaattttatgcctggatgttcatcaaaaatttggtgatgcttaatcccccccctgctgcaatgtgtacaatccaatggcaaagccgcaaaggtggtcttataatcaggtagttacaacaggttcagctggcaactggacttagcaactccttagttcagagcccaagaatatcacttttgtattatagaaaaaaaaaagatggaacccttatgtatgagcaagaattccattcatcagtaactagtctgtatatcaatcactatacattggttaaaatatataacaaaaaaaaaactgttcagatatatctgttctactttactatacacttgtataatggcctatttgggggtatgttccatcaaaatgtgtaactgattcaagagttgcaggcttgcagccagcctactgaaaatgctatttacttccaacagataataccccctttccatgtttgcttcggaacacaagattgccgatgctcattcaatcacagtaccacgagatcacccaaccttcatggttcaaatgttgggacctctgcagaagcaccccaagatgcctggtacactgcacgctgcgctatgcttctgtaaggatcttcctccctcttcctcttcagatatgacattaagctctctacttcggatttgatatgcaaatacacttcgtttgcacttttcctatctctgacgacattatccatacctttcatttcgattggtttgccaaataggtagtagaaccggcctggcactttggggagcaaagcaggtatgtgaacgtcttgatttccatcctctcctttgacgctatccctgaaacaaattatgtgaacacataatgaacaaataaaagtgtgctcttttgcaatcccatcactttgtggcaagattcttgtagtaatattcttacttgcactatcatgaggttaagttgtggcaaactgagtgatgtttttgtcaagctttgaattttgtagtatttagccgaagttctaaagtcatcgtgatatggggcgattacccctgttgagaaagccaaaatacgaagggatgatagaaatcttaccttactctttgggcttctcggttaatcgactcaatccattcccgaaggtagggaatgttcttttgatcattgtagtcggcgaccaactgcagaaacaagaatgtttactcgtcatagaaacaagatggataaccacaaacagaaactgcatcaccaccacacaagatattgagcaatcatgcatgtgtggttatttgatgactctgcttcttgaagaaaaaaaaggaaacagtgctaagatgcatggcatccttgtttttcacacaagaactgatagagtggtattttgcaggaggtcagcaaaaatcacaggcatatttgcaacatttctccttttttagagagagaatcaaaattttcttctgaaaaagaattagtcgcacatctgaaaattttagatatatggtggaggagaaatagatggaagtttacctctaaaacatcatcttctcctacaaaaccaaatggtatgatagtaacaccaaaacgtgctgccattcttacaaattctggttggtctggccaaaacaacttgtatgcttcaccctgcaaagtacaacagaatcattacagtaagggcaaaagatgttttttttttctatgcagaacactgacattttttcatgactgacaagatcagtacatgtgcgatttagttaattctgacttgatatatttatgaccatatatttcatatttgtcgatgcaaattagagatattaaacgcaccttcctgtgaagagcttcccgcacaccgcctggatagagcaaaacaaattgatttctctcaaacaacctatacatattgatcgcagtgactggtaatccaccgtacatagaaattgtatcgaaccgagacagctcctgtcgcgaactctcatgttttcctccaaataaaattgggtgagccataccacggaaacttgttctcttctctctcaagaactcctcgtacaatggactcaactcgatccccatcagtgcatgataacccacaaacaagacaggaccttggtcaggaacaccagtaaggccacgaacaatcttcccattcttcagggtagacagcatgactgggctcaatgcaaggtgaaacaatctgcagaagttttagttcgctaattactgattcatttatatggcaaaattacatgcaaaagtaaaatagaattttgaattctcatagtgcgttaacatacttgtgatcttcatcgaatgttttcttgaactcactcaatgtcgggggaatgtaatccgtcacaggatcccgttgtctgccacggcggtacatatttactccttttatgactgataaaagattaacaccgtcctcctgtccaaaatagttaggtagtgcttgcatgaggagattcctttggtatttttgtagattctgtttcctaaggatctgaagccaattccccaataaaacaggttactataaaattgaagtgtgatgcgtcataccaacagtagtgtatggccattgtctttgaagtaccgaactctgcagtttttcagtgatttgaagagtctatctgcctcttctccacttggcagaagattatcattgccactgaataaaagtatttagtgtttcagcataagaccgaatttataggattaatccagattatagaactacagaatacatgctgtagtgtcatgtatcaggcattcaggctacctagcaagaagtagaacttcagcttgtacagcatgaagacgagagttagcgtaggctgctcctgacttcagcagcttgagtttccagaaaagagtatcccttggtatgatatctgccaattcctgagaaataacaaaaaggaatgaaaaataattagatgaaatgttttctcaaatagtacgaagtattatgtatctccttgagaatgcccaaattgtagctgatttcagctgcactacggctaaaagaaagagctaatttggttttttttttaaaaaaacaaaaagagctaaaagaaatacatgctgccccaacatttcacgatgtgatctgaaaaagcattactttgtaaaagcatttctttcaatacatgtattctgccattggagcaaaagtttcaaattacaaaaaacttagttatttgaaaatgcttatctggatccatagataaaagtggcaacatttagctagtaatgttttaaaatttagtcattacttttaagtttaaaagcataaaaatgtagatattcctcatgcacatgttgttgtttatgtaaaaatgagtaatagatagaaccagatgaggaaatgaaaataaggtatgataataacatactgaaagcaaaggcagcatggaagtgagactatctgacaacttctgcagagtttttggaggagaaaggttgttctcaacgctgaccatagccattttaagaggatcgcctgttcacacaccatctttagatcaattaaaaaagatacaaaaggaagtgttgagtgttaattgtaaatatgctgagatagaatcctggatgaaaatactaagataaatttccaaaaaaaaaatgtaaaagctaatatgcttttatgtaaaaactagtatgcttcatactagagttgttgatcagtgacccggcatgaattttccaagtttaaggctaccttttggaacattggactaccaaagaccgtttcccaatataataagaaataaatgaacagtaagcaataaaaagatgctttggttctcaggctggatcaaaaaagtgtattgcattacaagcatagcaaatcatccgattggccaaaacacacaaaacaacaaagctagaatgaatgtatattaacgaacttacaagctaaaaagaggtatacccatgacaaaactgagaagatatggaactgtgacatgaagttcacttggcattgcttccaacacaggtaatatcggctgcaacggagtctttgcaaaggacgttgctggcaacattgaaggttgtttgttactacaactcaaacaaatttatgagaaggaacgttaccaattaaaatagaactaaagaaaatttcacctgcctggattaatcagtatgagaaccagatcaatttgtggattacgagctgccaccgaaagtgctaggcatcctccaaatgagtccccgatgagatatatgggtcggtttggtgacatagcatgctcatatttgatagaattttccacaatctgcaacaaccctgtatgcattgtattcacacgcattagcagtttgatttaaattcaaggtcataatttcgctttgaattaatttcctaaattctaataagcctttgggctttgttagcccattcccaacccaatgactaaaatagtgtctatagcattaaataagttgccacatatgataaaaatgatgtgtcaagtgaataaataaggaaagaaaaggaaaccatgtcatgagacatgatttctacataacattcaagacatcctgtgagataagtagcattaaatttaaatatgaaatagtgttgtttgcattggaaaattattgtctagtcctagtttcttgatgacgtggagtttatgaactatatctggtgtcttagattgggaatggccttacatcatgctgaaattaccacggtgcacgaaaattcctaaattccatgcagatgaatagtttttcaccgttgtaatttttttttgtcgaccaaaagatggcatgaacgtcggaggagtctccttcctccgagcccaacgcggcggcgctcgctacctctgctcctggtcggcctcgcctactgcggcggcggcggcggcgtggcaccggcacggaggagggttctggctgcacaaggcgcgcgggcagcatctcctcaccaacccgcgcgtcctcgacgccatcgtcgcgcacgccgcgctccgctccgcccggtcgacgccgtcacagccctcgccgccggcctcggcctcgcgcacaagctcacggtccccgcccacgcgttcgacagaatgcctcaaagaaaaatgaagaaaaaaaaaacgctgatcctctcttcttctcccgttgccaggtgaccacgggcgactccatggcgatcgagctccccaagttcgacatctgcgtcgccagcatcccatacgggatctcgtcgccactgaccgcgaagctgctgatcggctcccaccggttcagggcgcggttcgcgcggcggctgatgggcacgccggggcacggggagcgcaacctcctcgccaccaacgcgcgcctggtcgccgacgtgcggctgctcatggacgtgagcaggccggagttctcctccctcgtcgagatccgccccaagcagacccggcccaaggagttcgccgccggcgtcgagctccacgagtggctcgcgttcacgcgcgcgtgcaccggacagcacaagctccagcggcagcatcagccgccgcccaagaagaagaagagcaagaagaagaggaagacactcggcgtcctcttcaagtaggacgagatggtcatcgagctgctaaggctagcccaaggacacgccggcggcggcagtgaagatggcggcgtcgtcgtcgtcggcaacaatgaggatgaccgcgacggcgacgtcggcgtcgcaagtggtttcagcagggaagaggtcgtggcgttcaaggagaggatcgccggagcattgcggtccgccgcgctcgccggcaagacggcgtcgcagctgcccaacgacgagctgctcaggttgcttcggctcttcattcactgggggatacgcttcggtagaggcgtagaaaacatcaaattcttaacgcaaatagggaaataaaataatacaagcttatgcatattctcttttttctttatgagttacagcttttacttaaacatttaattatctatctatctatctatctattatatactaaaagtccattaaacatcctataaacgctattaagccaccacatagcgctcctataatcgctcctacatcgtcacgtggcatttaattatttagcggtcgatttttactaatataccgtggatctattattttctaccattagatttatttatgtaaatagaaagagataaaaagaagtgcccgcatagcattcgcctgttgcgaacgtctccgatccgtcgaatccctgttacctaatgagcaatgctacacgtaataaatttatatcctaattagcgttaattagcactcatcagttaattagtactgtgtaattagcatacgtaggtgttattaagaaatttcagctccatgcatacaaaagtagcaagcccaccatatttagtgtggtattttttttcagtatttaatagcaacacattatattcaataatttatatcctaaattttaaacatgccattcatattaaagccctattcaaaatttttttaaaaaatatctgctcataaactttgtacaaaaataatcctttgtatccataaactttacatggcaaaaaaattctattaggaaactttcttcggtaattaaaaaaaatcaactcatgggattcaaaaaataaaaaaatgtaagattaaaaaaatccattcacaaactttctatggaaaatgtttatattcataaactttaggaaactttctacaacaattaaatatttattaataggactttaaaaattatacgcaaaatgcaccattttattatatgataaaatcactcaataagtagaaattataattatgactacatccgcatgcaaaattattttatataccgaaacatgcatgtatttccagcttgaaagaaagggacatgtatatatcatatttttttcagatcagatagacttgcatgcactcttctagaatgagcccagcccacgtgtccgttcgtgcaaactccttctcgcacacgtccgcgcaacagccatctcggcccgcatgtcccacccctcccatccatacatgtgcttgcgtacgtatgtgcctcccccatatatttcatttatcttctattttcccttttagttagatagaaaaaatatttaatgatttatacaccgccacatactatttctataatcgctcctacactgccacgtggcatttaatcatctagtcgtcaattttcactaatatactgtggacccattattttctaccattagatttatttatccaaatagaaagggataaaaaggacgcgcatatcccacccctcccgtccagtaggtgtgcttgcgtacgtatgtacctcccctatatatttcctttctcttctattttcctttttagttagatggaaaaaaatattttatgatttatacaaatacaaaatgataaaaaagggcccgtataccctccctgcctgtccagtatgcatgtgtacttacctctcccatatattgttttcctcttttagttacatggaaaaaatattttatgataacaaattttaaacaattatattatctaaatcatatagataatttttatttgcgcacactattagattatttactataaaatttaaaattgaaaatctaaattaactatattattaaagaaattcattattttagtcatatatattctacgaactatagcttttgttcactaattcatatatttttaagaaaaaatcataatagattttaaaccttctgattaataacatgggtggacaattttgacaacaagaaacctaaccagttgaactacgctcactttattatgttggacataaaaacaaccataatttttaagctacattttttaaatactcatatgccttttaaaccggtagaaccactatttctaatcattagatctatcttatatatgaaaaagtgtttattcatggtacatgacatttcaaaaatattactgtgcaatgatacttcgttgttatagtattcctactaggttgcgtggagtctctcatccacactacatgaaatgttcatagatagatcgtctctcaaaatatatcaatcatattaggctatataattaaacccatgtatttcgtggagcttcatgtcccacccaatacatcttttaacatattatgataatatattatacaattaaaaaaagaaaacaccttatttttattttacacttattttactttcgttgacatattttctaaagaaaataaatctaccttcttttcaaatgatgaagaagattataaataattgcttatagatattacttatatatgatatatataagggtaataggttaaaatattattaaacaattaattaatgctgacaaaaaacaatttatggagaaatcgtggtagatgttctccggttaatatctcgcttttataaatacctcaaatttagcgtacacgtatgcccgcgcgaatcttcctagttttgttaataatagtgaagaagcctaagtggataataacataatttatttatttattaccttcaaatggcgtacgatcattcactggtatatgcaagcagcgaacctcgaataccctgcagattcgagatggagggggaaacaattaaattgaattgtggtttttttattcagcaaaagactacagctataacttggtgtagaggacgattgagtactggagacaagtgcacttatataaaaatataaacaaaagtagttttttgtactacagtactactactacaacagttactggcacaaactcagaataacctaagcagaaaaaaaaaaggaagtgtttatatcaaaataatttaatggaactttgcagaaaggaaaccaataaagtcggcaaaggaagatcataagctagttaactccaaaagtgtaaatatagctagagaagtcgttgtgtctttatcagaagaaagaagtcaccttcccaaagacttgtggtgcaaaatgagccccattccaacaccatcagttcctgttgtgcagtcaaatctaatcagaaattgttaacacgcaatactctaatttaaccactcaggcgacagcctttttgggagatcttcctttgtttcttccataccaggatcctatgtcttcaaaatcacggtgattttatcgctgacatgtggaccaagttagaacttactgtatttattttccaagagttttgacagtagtattcctctgtttatccgagttagcatatcgaaatatatatatattcatagctgaacactaccccaggaaatgaaaaaaaatatataatggtataatactgatatgaaaaatgaatatgtggattatgatcctgcagggacatggcaattgtctcatcatgtgatttgctgctaagtctggtttttactctgtaatataattgtagccgcgaacaaacagtaattagctgtgaatatttggacggaagcaacgtaattaacgtatacctggcaagaagagcagcagcggcgcgttgtccaccgccggccggccggcgtcgacggggcagaaccaccgcggcgggccgccgtcgtcgctggagacggccctggccgccgcgaagtagtccttcaccgtgacgccgccgaacccgtcgtcgtagagagcctccaccaccctgcccgtcctcacctccgccgcatcctccctcctcttctcctcctcctccacacccacctgccgctgctgctgcgtctccgcattcacggacaccgccaccgacgccgtccccacggagctcgccgcccgtagcgtcgcggagggccgccgccaccgacagccgaggccgccagcggcgacggcggggagcgtgtggagcgcggcggacatggcggcggaatgcgcggcgcggctttggtcggagaagcaggggggaggagaggagaggagatgaggcgggggaatgattgattgatgcgcgcagagctttttgaggggcgcaaaaaaaaaggggggggcttaaagaggtgacgtcacccgcagattgccatgtaggagtactacaggtgtagcgtggccgttggtgcttttcattttttttttggttgatggtgattctgagtcgtggttggcacgggagccactattaaaagtattaaaagagagaggggaaaaaaagaacagcaatgagaattttgtagtggaaacctcaagattcttcagtaaaaagtggtgatctttcaggatggggtgttggcttggcttggcttgtggctggagaagataaactactgtaaagcattttgtgccgttgcacaaatggacagataccaaatggggggtgcacgtgctttgcatagtgtggtgggctggaatcgtcggtaggactgcaaaaaataatactacgcgtgtgtttagtagtttgggtgtaaagtttttaagtatacgaatacacatttgaagtattaaacgtagattgataacaaaacaaattataaattttacctgtaaactgcgagacgaatttattaagcctaattaattcgtcattagcaaatatttattgtaacatcatattatcaaatcatgtcgtaattaggctcaaaaggtccgtctcgcaatttacatgcaaactgtgcaattatttttttttcacatttagtgtcctatgcatgtgtccaaatatttgatgtgatatttttttgccaatttttttggaatataaacaaggcctatgtgtatttgatttacctacactacacaaagcatgtaccggagaggtgttgtagtaattttagtttccaaaaacaattactctctccgtttcatattataagtcattttgattattttcctaaacaaacttatttagatttccaagtttatagaaaaaatagtaacataacgtatatataatcaaaatatatattcaatattacattaaaaaaactaatttggtgtggtagatattataacttttttctacaaacccaatcaaatctaaaatagtttgactagaaaaagacaaaatgactaataatataaaacggagggagtactatctcaaatgaaacatatgtcgtttacttttaaaactttgaccacatatttgaaatatttgttaaagatgatgaggggtagatttatcgtgaaaattactttcctttccttttcttgataatagttaaaaaaatactttcataatctcatagacttgttagattttacaagttaattgtaattaaaattccgtggttaaagacccgtcctataatggcaaaatagaatatacggtatatatttgtgaccagaaaaatgtaggaatgtcttctttttagttagataattggtaggaatacctggttggtaaacggaaatgaaaagaaaagggcgaaattcaacctcgtgtagggtaaggcacggccgtggaggtgacaagaagcgtggcacagcaccagcagcatactagtactgtacttttgtggtgggcaagccacatctcatcacatgccggcccacgaggctgttgcgtcccacatggcccacggggtcatcgtttggcttgtttgcagatgaaaaataattcctgaataaaacttttacatatgtgtctttagcaatctaaaaataaaaactgaaaaataaattaagatgaaaaataaatctcagaatcaactctaaatttagaattaaaaatttaaattttagtttataagtaattataggcaaaaagatgacaggctagtcgcgacgcgcgaccgtttagatttagaatcgatcgtgtcgactcgcgcctcttggtgtcgatcggttgcttagctcacttggattttgtgcccggccaactataccagcgcagatgccatgtcgacgtgtcactgtcggctacgcggctggctccgatcgatcactgatactgatacttggcgcgagcgtgcgggccacccaacagaatggccaccgcctagttcccatgccaatctgccgagaatgatgtttttgaattgatgttataatatatcctattgaagtaaaaattattggcaatgcctatattcaatttggcactaatctagaatatttttctctattatctataccatcaatatttggcatcatattaaagcaatccaagcatatgtaataaatctctaccatatacttatacacataaacagactctcgcgtcgcccctcccccttggacgatacgggaggcgacgaccccgccggcgtgcgtcccccctccttcctcctccgcctcgccgaagcccgagcggccgtcggcaaagccatgcggccgcagtgacggcggcggcggggcttcattttccccttgttgcgctcgggcaggggggctgcgcgggacggaggaaaccgcctagatctgtgctgctcggccggatctggcggcacggcggtggcatcggagtttgggagtgctggcagcggtgggaaagtccgccagatccgcatttggatctggtggggaggcggctggcggcggcgcacgattgtggtggcaacggcggcagcgacgcccgatggtggcggtggcgggtgaggtctggcccacggcggccggatctggccaaacagccgttggcgacgacaatgactgtggctgagcgacggcggcaagcagcgggcaacgacgacggttgacggaggtgctggaggctgaggcaggcgcgacgtgcgcggaggtgcatgaggctgcaacggcggcggaggcgcagaagggccacgatgacggctgagacccgggaggcagcggcagacgcaacggcggcgcacggaggctgtggatggctggcagggattgcggctggcatggccagctcagcgatggctcagccggcaaccagcatgatgagcgcgtggagtgtggccggcggtgccggtgtggcacgccaaagtgcgcagcaggaggtgaagctggttgagatggagaccggtgaggtggcagcacggggagactggccagcggggggcgctggtgcagtgaagcccatgcgccggcaaaggtgttgatggcggtggagcaatggtgcatttgtagaagatcggcaggtgatggacagcgggtgaaaacccagcctggccttggccggatcgacaacaatgacgttcgagtgccattcccctccttagagcgttgtcatgccatctcacccctcaagggtggctgccaggtgaaagctcagtctcggttctctttgagaccttgacggacggcggtggcggtttcccgtcgcttctctccctagagacatcgtcgaggcatccccttgccgaagcccctcaagcaattggtgcaaccccgctctagattctagtccttttgtggtggcgttctagtttctacaagttggccgcgtaggagggcctagggggagaggagttacattcttctctctcaccctcaatccctaaatcgtgaagacttggatagagtggagcgttgtgttgattgtaagggttgggttttgggtgatctcgactgtcttcctttgttggcctagcggcggtcggtcacgcttagcagcggccggtccgtgctaaccttctcctagatatgtgtgttggcgttgtcggtgtgtaggtggtggtatactttttccattttcctggttatgaccatctagggttgtaatctcgtaattttttcctgttctatcaatagaacttcgcaccgtcttagtgcgagtcgttcaaaaaaaataaatctctaccataccaaagatttggtagtgttaaaatatgccaaaaatttggtactaccaatgatatcattggtaaggtagagaaccaaacggccatatagtacttcctttatccaaaaatcttaaatcttaaaccaatgttcttttctcctggagataaaagataaagatgaaaattaagtgttttacgaaaaataaggtggtattaacatatgattaattaagttttaattattacaaactagaaaaatagattaatctaatattttagagcaactttcatatagaaaattttcacacaagacacactgtttaacagtttgaaaagcgtgccataaatattcaatattttatccactctttgtagtggaaacgaacatgatagtctttatacatctataagtggaggagttgtccttttgttttacaatgctaaattaaattgttaactggaactcgcaggccaggttctcagcgagcagctccggtgccacactcctgaggttggcaacgcttaccgtattcaccaggccgttgattctcttcctcagggtgtcctagctgagacgctggtactcggcggcagaggcagcgctgtcgttggcctccctcgtcgccatccgtgccgtcatgtggaagggcgggatgtagatccctttggccattcgctaaccggggatcatctccggcagaagtggtggtggtgggggcagcattggagttgtcggctaggaataggattcagctccttcctattaggggttcacccgcgagtaggggtgggcaaagaagaccgaaccgaaatgaccgagaccgagaccgaaaccgaactaaccgagaccgaaaaattcgaatcagcactttctacaaaccgaatttagttcggtcaaattcagttttagggctcggttaaccgaattgaccgaaaaaaccgaaatatatcactggattaggcccaatacctcttcctccaaaaaccagaaaaaaacttatcctcacccacgaccccccagtagtccacccccaccaacctcctcctctcggcctctccatccacccccttcccatccccatcccctcctccccagtgcagccatgctggtgaccgacggtggagctcccggatagcctcccgcaggctgttcctctacctcccgtgggccatagcctccgcgccgccgcttccgacgccagcgctacctgctactgctgctcggtcagctggtgactggtgagcggcgtcaggaggaggatgaggaggaggaggaggggggggggggagagcgccgacgagggtaggctcgcgccggcagagagttcgaacgacggcgttgagaggaacagcatggccggcgcggcggcggcagggtgggccctgcctgggattcctctgctttggtggctcgcgtcatcgtcgtatccgcaccccggtggatgggatctggagcttctggtagtcggtagaatggtggagatcgacgggacccaagtcatggcaagatcgatttgatttgatttgcttcttttttttttctgaatcatatgcggcatcatattgtagttcttcatccgacttacttcgattcattgatcttgtatggagtacttatttttgtgtgattaatttttttttgttgttcatatgctgttatggttagttcagtctatgaccgagaccgaaccgaactaaccgaagaccgaagtgctcgaagtgctcggtcttaagttttcttgaaaaccgatcagtcttgtgattctgaagaccgaattttccaaaagaccgaagaacctaaccgaatttatcggttagaccgaatgcctacccttacccgcgagagagtatgcggcgcagcggcggtggcggccggggaggtgggagacagcggggtggcgaatagccgcgacctacgaggacaccacgtcacgacttacgagtgaaaagtcgaaaacttgtactacatacctttttttattgaaacttctggccctaattttttagggtgaaaagctttgacgtattacgttggatatacggacacacatttgtagtattaaacgtagactaataacaaaacaaattacatattccacctataaactgtgagctgaatttattaagcataattaattcgtcattagcaaatgttcactgtagcaccacattgtcaaatcatagagcaactaggtttaaaagattcgtctcgcaatttacacgtaatttctttgcatgcttgcaagcgaccaaggagggccgcggggggatgacttcagtgcgagcaccattaaagagcatgatggcccaacaagtgtcggaggggttggaaaaattcggtgttcgtggccgccttcacgtacggaatccggactcccacctaggggtgcaagtggggcgggctttttttatggcccgcagtcccgccccacaaaaaagcccgtaaatttgcgagcgggccatcccgtatggaccttgcaaaattgtttggcccatcccgcatagcccgttgggcgccaccacattagggcacgagactgggtctctgggagacacgagacaccgccgcagccgagacaggagacggcggcggtgagacgacgccgcggcggtgctactctcgtcttcctcgtcgcccatccatcttcctcggcgagacgacgccgcagcagccatccccaacccccacgtgtgttcggggcgagcctgctacgctacccgtgctgctgcctccaactctctacccatcactggctccatcggcctgggagactgggagcaggtaacttcgagctgccatggaagagggctgcagttccaattggccggccacaccttgtgccgcagcgacgacggccggtcaattgtttttcctccttcaagatttgtttgttcttcaagcagcaggggatttgtttgatgagaagtgatttctactcatttggattattgaataagaacttcagattaaataataagcatttgggtgagatttggttttggatcaagtcgctaagaatggttagcaggccaggactggcttggactatacttgttatgtcattgaaaaatgaagtgttgaacacatgttaatactaacatccttatgtaccagtttgatgttgttaatcacttgtcaggtcatttagcattattagtgtttgtggctctgctgaatctgtgagttctcttgcatgttcttgagctagtacctctgctgaatttgtgagttctctgacatgtttcttgagctagtagctctgaatctgtttcctgttcactgtcctcttgatgttgcaattttatattttcttccctctcttggtaggtttaatctgcaattttatagctttattccttctcttgctaggattaatcctagctaaatttgggacagggagtagttctgtgcttgtgtgaatattttcacgtgaaaatagtacagttttgtttgctgattgatgaatattatgccaatgtgggctgtccagtggtgcccgtcgggctgaaaaatctgccaagccgtgcggggcgggctgccgtttgcccgcatagggagtttgcggctggtgtggggcggggcgggacggcccacaacccatcccacttgcaatcctacaagtcccacccgtcgccgccatcacctgcaagctaaactgggtgctgtgtgtcggctgccgccgacacgtgagcacagcgtcgccagagatgctgcgggagatgggctgcgtgttggaaatatggtcataattcgatatattttaattcaaaatattaagacaataaacatgacacatatagggtatgaactagtgcaattgataaagtgaatcatcatgagcatgcttaatataaaataagcatcaacatagacataaaaacgcaataacattgcgactaacagtagaacttgaggaaataacgtgagtaggttatacactgaggatggccctccactggagtttgaggcagtattgcctccgttggtgttgacgggaacctccttctcattgtctccaatgttgctgtcgtctccggtgttcgacatgttggcaaagacgatgtagaggaagacgaacaggagcaattgcgcatagcgctcccaaaaacttgatcgtccgcctatccgtgcaagtacgcaagcggacggagttctggaggcacctgctcgtcccgtgcacctgtgcacgcaggtgaacaggactggggaaggatcatgctgggcaggaaaagagagagaaaccggcaagaggaatagaggaagaacaaaagaaccatgcactattgaaatcattccctttggcggagtatgtatatgcgtgcgcaagactaacgttcgggaccatcaaccgagtgtttaattcagtaaccgatgcgctcgttaatatgaccaatacagaatcaattaccgtgtttattaccgttcgagaccatcaaccgcgtgcttaattcaataaccaacgcgctcgtgaatattatcgtccgttataaaacgagagagatcattccctttggcggagtatatgcgtgcacaagagtaacgttcggaaccatcaactgcaagagtaacgttcgggaccattaaccgcgtgcttaattcggtagccgatgcgctcgattactgtgtttattaccgttcaggaccatcaaccgcgtgctcgttaatattatcgtccgttacaaaacgagagagaattcccatcattaaaacagaatcaattaccatgtttattactgttcgggaccatcaaccgcagagagaattcccaataaccaatatgctcattaaaacagaatcaattactgtgtttattaccgtttgggaccatcaaccgcgcgtgcttaattcagtaagcgatgcgcaagagtaacattcgggaccatcaaccgtgtgcttaattcagtaagcgacgtgctcgttaatattaccgatacagaatcagttaccgtattttctcaaccggtcaacaaagtctatccactagcttcatatttaagttgagacctctttacttttaaggtggtattattactcatagcacttcatgcgagtcaataaaatttagcccattaatgtaacactgcgttagcgccgtcgggaaagctctctgctgcgtgggcactgggcagccgaatccgacccagtcggagcttgagtcgttcagtacttgagtagcctatccgattgacggtcccagagttcatatggtcactataatctctttttttttaatctaaaatatacccgtacgttacaatgggtgaaggctattttacgtcgtattgtcttaaattacatatgtaactttagtgtatttacaatataagttttaaaattacatatgtaagtttttaaattacatatatatatatatatatatataaatatatataaaagtagtgtataatttaagtgtaagtactatatagtatactatatatatatatgtgtgtgtctatatatatatatatatatatatatatatatatatatatatatatatatatatatatatatatatatatatatatatgggcacttcatatggggcaccatggtatctaatgcacaaaattactcaaatttttcaaaattttcaaattgtgagtatatacctagttataataatttgattcatacctatacttatcaacaaaaaaactcaaatttaactttatttcacaatccatgattacatacctaactaattatatgtatggatgctatatacctagaatcaaaatctaacaaaaacaagttcaaattcagttcaaacttgctttaaactagttagtaaagtagttaatgttaatacctaagtaattgaaaaagtttcatactcatttgaattgggtatatactcaatttcaacaatggtgcccgggcaccatggagcaccaaacaaatttactatatatatatatatatatatatatatatatatatatatatatatatatatatatatatatatatatataggagtaactcttttctttgcctaacacgatgggtaattaaatggtcatacatgtcgctgtttgcctaaataaatatgatgaattcatgttgatgggtaattaaatggtgatacatgttgctgtttgcctaaacaaatatgatgaatgtatgttgtgcaatgttcaatgggcatggcgcatttccccgcaaaaaaaaaaaagggcatggcgcataggagaactacgttagcggcaccagaattatgtcacctggtgataatcgactgtaatctggtgataattatgtcaccagaattatagcaaatcctttttcaaagagatttcttatacgactcctcctgtatttccaaaagcgaactaatttaaaacccgacttaaatagggacctgtatttccaaaagcggacgaacttaaataccgactcatatacggatgacgtaccaaagtatcggtaaaaacatcttcaatttttataatagtagagaagagatgcgctgccacatcggtccttctcctccgtttcatattaagtcaaaattttgactaatttataaaaaaaatagcaacatctacaataaattagtttcattaaatttaatattgaatatattttgataatatatttattttgtattaaaaatgttattatttttaacaaacttgatcaaatttaaggacttttaactagaaaaatgtcaaacaacttataatatgaaatggagcgagtatgttttttaagacttacatgtggatccatctttttaaattctaatttttattttcttattgtgatgccaggtgagtgccatgtcgaaataaaaaccaagttaacctgccacatatgcaaccacatgagccaaaactgatctcaaaactattgaagaggttgatttacactggttttaccagttggaagagatacgaaatacctggtcaagggacgtaaaatgatccatagatgagggacgtaaaatgaacttattccgcatataattgatgctccggcccatttagtaagttaattaaattccaaaagatggtggttggccgttaaatatttgctcgtcttgcaaagttgcaagatggggatgatggcctccgttcgtaccgccgcgatacgcgaggctgcttatcccgtacgtaaaatcatgtcgtccaccggtcgatcgcatccatacacctcggtaactaggattcaatgaaacatatactccgatttttgattaagatatgtctcatcaaatttcaggtaattactccctcccaaaatataagtgtgtccagattcgtagcactaggaagtgt

SEQ ID NO: 73881 - DNA, 5325 bp, Oryza sativa
atcatctttagtcccggttcgaatgctgtcagggcctgtcaggcccccccgggatctttagtcccggttggaggacaccaaccgggactaaagatcttaactttagtcctggttggtaataccaaccggatcccggtgatctttagccccggttggtactaccaaccgggactaaagtcccacccctatatatatgtcttcttcctcctccagctgcccgagcaagcttcaaaatttcttcaaaaaagaggggaggtcatgccaaaatttctattgaatttattttggtgattacatacaaatcggaggtgcctaaaaggtttgcaacttcatcctccaatgtttttttttatcatactacatttgcacctatgttttacacactttttttgtctccaaaatttagttgtaagttgatgagagagaaaatgtgtgtggggaagaaagaatatatagaaatttagttcatttgctaaacaaggttttataaaatagttgagaaggaaaactctagtgaaagttaatcttaaataatagaaaacaaactaaaatgaaaattaaaagaagtaaaacacattaaaattagtttaaaactttacaaatagtttttaaaaattatttggtgtaatattttatgatttttgtatgaataaagatatcttataattattgtatgactgtcattattgtaagaataattatttgtgtacggttttttttgactcatgtagatggatcagcaatggatgtacgctgaccggtggtccaaagagtttattgacggcgtgcactattttttgagagtggccgaagctaacaggcaaaggggttttatttgttgtccatgcaataagtgtaagaatcagaaggagtattctgcatccaggactattcatttccacttgtttgagtcggggttcatgccaagctataattgttggacatcccacggagagcaaggtgttgaaatggaagaagatgaagtggaagacgacaatattccggactttgctcagtatgttggatttgaaggaaatcaaacgggcgaggaggaaatagctgctgatggtaacgacgttgcggatgatcttggtcagatgttgcaggacgccagggaagactgcgaaagtgaaaaggaggcccataaattggacaagatgttggaggaccacagaacttcgttgtacccaggttgcgagcaggggcacaaaaagttggataccactctggagttgttgcaatggaaggcaaaaaatggggttagtgacaaggcatttggcgatttattgaaactcgtcaagaacattcttccggggggaaacaaattgcccgagacaacgtacgaggctaagaagatagtctgcccgttaggactggaagttcataagattcacgcatgtccgaacgattgtatcctatatcgcggtgaggagtatgagaacctagaagcatgccctgtttgcaaagcactacgatacaagattagacgggacgatccaggagaagttgacgggcagctaacaaagaagagaattcctgctaaggtgatgtggtatttccctataataccacggttaaggcgtttgttcaggaacaaggggaatgctagaatgttgcgatggcacgctgaagagcgtcaacaggacgggatgctgagacaccccgccgatggttcgcagtggcgaaacatcgacagaaaatttaaagaatttggaaaggacgcacgaaacatacggtttggtttgagtacggatggcatgaatccttttggagagatgagcagcggccatagcacttggcccgttacgatgtgtatctacaacctcccccctggctatgcatgaagaggaagtacataatgatgccgattattattcaaggccccaagcaacctggtaacgacatcgacgtgtacctaagaccactggtcgaagatcttaaacagttgtggaagaaggaaggtgtccccgtgtgggacgaggacaaacaggaggagtttaacctacgagcgctgctattcgtaaccatcaacgattggcctgcacttagcaacctatccggacagtccaacaaggggtacaaggcttgcactcactgtatggatgaaacagaaagtacgtatcttaaccactgtaggaaggttgtatacatgggtcatcgtcgattccttgcagcaaaccacccggtacggaagaaaggcaagcacttcgaacataaggccgaccaccgtacgaagcctaaacatcgcagtgggaaaacagtgtttgctatggttaaagatcttaaagtagtgttcggaaaggggcctggaagccagcatatagagagcgaagatggtcacgcggcgatgtggaaaaagaactctatattttgggagttaccatattgggaattcttggacgtacgccacgcaatcgacgtgatgcacctcactaagaacctttgcgtaaaccttcttggcttcctaggtgtatacggaaagtcgaaagatacactggaagcatgtaatgatctgaagcatatggaacaacgcggcgaccttcacccggaaccaaaggaaaaaggaagccattacttgagtccagccagctacactcttagcaaggcagagaaggaaagtatgtttgaatgcttggagagcataaaggtaccgtctggatactccacgaatatcaagcgaataataagcacgaaggagaagaagttcacaaacctaaagtctcatgactgtcacgtgttgatgacacaactgctaccagttgtaataagggctatccatccagacaatgtccgggcaacaataacaaagatatgtgcattcatgaacgcaatttcgcagaaggtcatcgatccggatagattagaagcccttcagaatgaagtggtgcaatgtctcgtcagttttgagttgatatttccaccttcatttttcaatataatgacgcatatgctttgtcaccttgtgaaagagatccgtattctcgggcctatgtacctacacaacatgtttcctttcgagaggtacatgggcgttctgaagaagtatgttcgtaaccgtgctcgtccagaggcaagcatcgccaatggttatggaacagaggaggtcatcgaattttgcgtagaatttatcgaagaccttcgcccaatcggggtacctgaatcacgccatgaagggagactacggggaaagggaactctcggaaggaaagcaataacgacggtagacaacaatttattccgtaaagcccatttcactgttctgcaacactcttcattggtagctccttacatcgaggagcacttggctctagttcgcgccaggaacatcggtaagtccgatgcatggattacacggcatcatattgatactttccccgcgtggctacgacaacatctcatgggtaacgagtcgatcaaccaacaacttgccttcctggcgaggggaccgtctgggtcgatcgcgacattccagggatatgagatcaatgggtacacattctacacgagagcccaagacatgaagagcacgaaccaaaacagcgttgttcgtgtcgatgccatgggacacgatggaacaactgccacgtattacggtgccatcgaggacatatgggaacttgactatggtcctctcaaggttcctctgttccggtgccaatgggttaggttgactggtggaggcgtaatgattgatgacagtgggatgacaactgttgaccttaacaaggttggatactcggacgaaccttttgtccttgccaatgatgtaacgcaagtctttttcgtgaaggacatgtctagcaaaggaaagaagggcagagggcctgatgagcctaagcgtcaagtggttctcccaggcaaaagaaaaatcgtcggagttgaggacatgactgacgaggattacgatcagttggatgggcaaccccctttcacggtgacgattgaccctagcatcctcctatcaaatgaagacaccccttactcacgcagcgatcaccaggagggaacaatagtgaggagaaagtacgtgccgtaattattgtgtacacgatgtaaactattttggatgtattgattatccatataaatcaattgatgtatggcatatgttaattacgcacgattattagaggtttcaacaagtttaaatcatgtatatgctagttatatgtgatacttacaatttttaaaagttttaaatcacacgtgtggcaatttcatatgtatgttaattagagtttttaacatttaatttactagcattcatatgctaattataattgactagaggatttttaaaagttttaaatcacgcaagtggcaatttcatatgttaattagagtttttaacatttaatttactatcattcatatgctaattataattgactggagaatttttaaaagtattaaatttaatatatttttaaaactatcattcatatattagagtttttcacaatttaatttactacctttcatatgctacttatatatgactattcgaatttttaaaaggtttaaatcatgcatgtggcatttacatatgttaattagagtttttagcatttaatttaatataattcctacgctaagtacatatgatgattacaatttttattaattttaaatcatgcagtatgtacatacatatcttaattagagtttttaccaatataataatattattcatatatatgctaagtatatatgattattggaatttttattaattatatttgcttattacgatttatccacttaatttattacagacaaaaataatttttcgaaataattgtcattaatctttgtactttaaataatgttaatgcattaacttctattttataaacacatatgtaagcgaaaatcatatgcagtgctataatctttagtcccggttcttaaccctaaccgggtttaaaaagaatttcgaaatagcgggaaaagatatttactcccggttgttgagaacaaccaggactaaagatatctttagtcccggttgttgagaacaaccgggagtaaagatccgggggtatatatattcccggtgcgccctcgtcttcttcaccaacacttagacgttttcggccgatcgatctctctcggcctctctctccttcgccgccactgcctagggcaaatccccgcgccgacgccgccgtatctcgccgtcgtctcgagctcgtcgtcctcgccgccgcctccgcctcctccgctgccgccgcatctctggggtgagagccgccgccgccagatctcccttcatgcatctcgatctctccgatctcgatctctctccgtcgcgccgcccgccac

SEQ ID NO: 73882 - DNA, 36148 bp, Oryza sativa
attgactagtacagaagcaccaaaacatcccctacaagactttggcctaaaaaaatgacttcaagactacaaatagtaggtgcctaacaatgtttggaagcattcgctgcttcactcaacatctcaaccaccatgatattatagcacatagcacatgcatttgcactgttccattcagccaaacatgccggtgtcaaagcttagttttttgaaagttcagtgaccaagcttctcggtatagtctaatgcatcaaacgatggttggttcacccagaggctaaaaatggttgagagcatgatgtaagatgttgagcatgtgaacgagaacttgtactgtcaagcgatgatacttcagagtatgcattactttcatgcaagaggggaacattgccaatcaactttgctgaaaaaaatgagacagctaactgaaatcctatgtagacacataaagaaatactactaatatatattgcaagcaaaatcccagtccatgaatgacttgaagttgtatgtactaactcttttgaattccctcatcaagttggtcttttcagttgatcattactgaatgaaacaatttgatcataaggaataaatattcatcagcatcgatcctgtagtattaccaatacgccacacgaacaattttgcataatcaatattcaattaaaatcatgcataccctcctctattcccacaagatggttggagcaaagctattagcttgaactattcaaatatgtgatcgctagatacagctttcgatgcaattatgcaagtcggaccatttattcgcccaccgaatgttctcaacttgcagtagtagcatgttataaatataaaccatatcatgttattggtctagctaagcaatagtgcgcaaaaaagaggttgagctagctataatatgatagtgcagattatagatcttatgttaaaagcatactcacatgtccatcctacatcccaggttcttctttgagaactgtgtcatttttcagactgaactgctgatttaagactggcaagatagcttttttttttcttctatttgaagaggcagttttcatatgacaaataaatgtcaccaattatcaacagaaaagggtgtgtaaccttaccaagtcacaccttagcaagtaaactctatgtgtaaacctcctaatttttcgtaatgacaaaattcaggtggggaagctctcccccggtgatttagtcaaaaaaaaaaaaacaccttagcaagtaatccagtgggaacacagcaacgcacctttttttgtttttgtttgaggaagtaggcctcgcctcacacagtcacacctattcagaacttcatgtcagtactgtcatttaacttgagaatagaacacagaacaggcaatacatgaatggaacccataagttcctcacacttgtgaatttgtgatggacattcaaagcaaaaacagaaacattatggagggaaaattcaagatcttcaccctcagtcacctgccctgcattccttggcaagatacatcgtcaatgttcaaacctcgacaccaaaaacctccaaatcggtccgagtcaagtatcactcggttgaccactagcagcctcgtaacgtttgcctcatttcatcaggtggcatcaaacattcgattatcaatcagaagcaggagaatcaaacgaaataataagcaggtagtacatcaacgaagagaactccttttccaacctgttaatgggcctgactgggcctgaaaggctagaatcggaggcccaataaactgccacgaaatcctagccgtccaaatcaaatcagtggctaggattgcttgacgcagctctcgtgcccttttatacttgcaactgcgagggattctcgcctcctccgccgccacacctccacctctcctcttccttcccctcgccgccgccgccttctcgtcgacgcagccatgtcggcggcgcagcagcagaagcacgaggtggaccgggcgacggtggccggagccgtggccgcgctgttcaagtggatgcgcgcgcgcgcggcggaggctccaccgaacctcctcgccgacgagcgcgacgacctcctgctcctccagctctccctccgccgcatcccgccctcaccgacgaccaagccgcgcctccttccgctcccccaccccgtcatcgtccccgcgagtcggcctccatctgcgtcatctccgacgaccgccccaagtcccgctccccggccgcctccgacctgctcgacgcgtccaggtcccaccacctccccgtctccgaggtcatcccgctctccgccctccgcaccgactaccgcccgtacgagtcccgccgccgcctcgccgcctcccacgacctcttcatcgccgaccgcgccgtcctcccgctgctcccgcgcgtcctcggcaaggccttctactccaccaagaaggcccccgtcgccgtcgacttcgcccgcaccgggtggctggagcaggtccgcaaggtgatgaactcgacttttctctacctgcggacgggcacctgctctgggatcaaggttgggaggctggacatgaaggaagaggacaccgtggagaatgtgatggcggcggtggaggcggccgtggagaatgtgcccaagaagtgggcgaatgtgaggtctctccatttgaaggctgtggattcagttgcattaccaatttaccaggctgtgccggagttgggcatgaagatcgaggtccggtttgcacaattggagggagaagtcggttccggggaggttatcgatgcttcggaagctggagctgcactgaagggtgtcggcaagaagaaggcgaagaaggcattgaaacatgtggaagaagagaatgctggtgaggaagctgcacaggagagtggcaagaggaagaggggtaagaagcaactagctgaggatttgatggagcaagacatccaagatgtgagtgagaaaaggaagaaggtgaaggagggcacccctgctgccgaaacgccgaagattagcaagaagggtaaggagaagagcaagcgtgcattggacaaggagggggaggatgcaagtgtggaggaagccagtaacaagaaaaagaagggcaagaaagaggtggtgagtgatgttggggagaagaacagcaaggtgaagaaatcaaatggtgataaggagaagagaaggaccagattaagggtataggttttattctctatctcctgagagatgcttgtgatattggttgatcgacagtgtcgtgatgttcatcgtgttgattagctgggctaatctgatagtttatctgctggcagaagaactatgccactgtcaagtttttggtagccttgtagtactttataagatctccaatctaccgcagaatgttctacttttgtgtgcactagaggtgtcttcaaaagttgtatcttttgtttttgttagcttactagcctgactgcctgagccttcaggttaaagatagtatggtaaaactgtttctggcttcatgtggttcgcatcaattttgtgatcatctaagaatatgtctcagttgttgtcttccctgaattactcatctagcatatgctgtacacttggaacccagtttcaataggagctgggctgggccatttgtactctcttactttgcatgacttgtgaggcgatggaatggaattgaattgctgcatgctgtttaccttctcagtgtttatcatcccttgtggcttgtagatcttcaagcaaagagcagaagtgaaactaagacaaataagacatgtataaatggagattagatttttcccacatcatctgttgtgttgtaagttccaaattgtttttcatgtcaagtggttgattacaagacatgaaaactgccaacataggcagtttattttgctccatgggaagcttgaaaagatttgcctgcatggactggtttagatcatttggcaaactagccaccggctggtaagcagtaacctttttttttttgttgttgctgtcaatgctgaaaaacagagtatgataagaaaatctcaaaattttaacttttcaaaatttgataagccagcaagcaaaacattgaagagttggaagctgcagttcctgatgggcaactctgcaaaggttcaaaggctcaaaggttgcatctttggcctttatgttttagctatttaaatgtcaatgctaaaaaaaatagagtatgataagaaaatctcaaaatttcaacttttaaagtttgataagccaacaagcaaaacattgaagagttggaaactgcagttcctgatgggcaactctgcaaaggttcgaaggctcaaaaggttgcatctttggccctggaagagttggaacatcttggaaagccaacttggcaagctcgaactgccctagtctaagagcaaggataataatgggctataagggcacccacaatgattatctataagctctctacaagagatccatgttagcatatttttctacttgaaagaggttaaataaagagaaagagcaaagctaacgaggcaatggattagagagctatagatacctatatagacataccattgaagtggtttactataaatctagtctattgctgagatgtacatattttatagatagcatcttactttaccattgtggatgctctaagcaagctatatgcttatatggaagagagagataggaaaaagtgggtagtgttggctctcatacaagagctagctccacacaacctccaagaaatatgcattaaatttatagagtgagaaagagagagaatggaaaaaataaagttaacctgttgacttattatacaagttaagtaacagtgagctttactattaaacttgttctaagcggcgagccaaccaaccagagcgcgacaagaccacacaacacaagcaaacactggaagcggggtcactgctcattcagataggttcaaagatttccagagaagcttgaccaaaacttttcccggagtatgggcgccgctcccaccggcaccacgcatggcgcgccacggaagccccgctcgagcggaccatccccacgcggcgcccatgcgcctcacccgcgcgtcgtcgcggcgtcacgtagcgcaggcaagccagttcgccgcggattgtcgtgagggcttctttttgacctcgttccctacctccatccatccacgcacgccgccccccacattgggagagacaaaaggcgggacgctgatcgagcttcttctcgggattttagggtatgttcttgctgtgttttccctcccctgtattcgtgataacggtgcgttcttgaggctacttcggtttgcgctccacgtgttcggtgaaatgcctgtgagagaggaggaagattcagtactcatgcctctcctactctcttcttttattctgttgttgttttgataatttgtctggtcttcttgattattttgttagattgcagatgccaaacggccgcaggtctgtgattgtaccagcccaaatattgcattcctagtttctcttaacaaatgccactcgaatgtgatgccaaagagccaatattgacaacaaattaatgttggctcttgccttgtgcaccacagcaatgaatgaatgacagttgtataatagtttgtgagccatatgaccaaatgaagattatagtcatagacatgtaggcaatccatctctcttgataccgtagtgtggatgtatgctgagttgctgacatgtccatgttttgttaggaaggtaaaacaacacgagtgatgctctttgtcattttcatcctggaacacatatggaggactatttttcacgcatcctagaccttgcttggcagttacgacatcaactgacacgattaataggtaccaagcatatagtgcccttgttgattataataaagcagaatatagcctgctaatgtttcattctatattgctgtattttctctgcggaaaggctaaaaaactgtcgacacatttttctttagaaatatatcgatttctgatccattagatcaactgtaagattcgtgctattttggttgacgaaaataaaattgtactgcaaagaatcgaacctaggatttccggtggcttgtccagcggccttgaccaactgatcgagcaaagattttggcttgaattgaaattacatactaattacacttaaattacatactatttacatatataatttagagacttacattgtaaatacactaaaattacatatgtaatttagagacttacatatgtaattttaggacttacattgtaaatacactaaaattacatatgtaatttatgggcttacaatgtaaatacatgccaactattttttggtgaaaaatatggtgccataaatatagctactcccttttctctgtgctaattccgaattaccagctccctgtaaataatggacactttcctttttagtttacacatagagaatttgttggaaatttgattagttcgttagctactagatatggatttaggatgggcaaccagttatgatgaacttgattggctctataagaaacacactctcaatatgaaatttgcatatacttattcggttattcctcttgagttttctttatattttttttacatgctgatactttttttttccatgccagaacatgtgcttgggtatattgattggatcccagaacatcatggattccagttctctccttgttataaaagatcattacctgccaccgaaagatacatccgtggagaggctcccttgctgtctgtcagtaattctacagaagaccagaccccaaatggactatctgaagccattgttgtcagaaaaggcttgtccagtatttgtcaaaggtttagtttttctttctaacttcctaatcagaacgttaataatatacataattatttttattcacattgcaactatttgttctgtctgatcatatggcaggtttcccagttttttgcatgacttcagattgggacaacagttggcattccatttgcgagaactgtgcagtgctgttgcaagtgaaattcatgctaaactagctaggttagttgctgtcttcaaatttccaacttttatgtgttgcatccgttctagtccatgtgatgaatttctgtttgcttgagccaggtgctaaaaaactgctatatgcttgcaggttcttacatcgtttctggacaacattacagggatcttctaaagatataggatggctaaaaagaacaaaaacattgccttgttcagttgatggtacagatcgtttcaaggagcttttgtatggcatcaggtgatcttttgttcatgcctattaaagtaccactgactttatttggagagtactatcttttacggaccctacatgtagaactactcctatctaacaacaatagggaattgagccactgaacatcatttacggaagtaacagatttattcctggtatcaatccatatggaggtccaacattcaattattatcagttcatgcaaagaccaatgatactaaaagaagcttaatgtttcagaaatggcatgcatcatcttcctaacacactggtttacttattcatccctggtgagacattttttttcattttttgcaaatgatgttaaaatgcctagctttatattggttcgctgcccttgtgcaggactttttagtaatcacagtccactttacttcgtcaatacgaaaagaatcttttcgaagatggggcttacttgccatattgcaaggattcatagtgaggtaacagagctcaacaggggtacatgcaaacaattttctcatgtttaccaagctctagattgtagcatttcttctgtttgtccctgtactcacctttcatttcgcccaggcatcagtggagaaaaatgcacgggaactgaaattatacattgaagagctgtactggggttctggtaaacaggtgttgctcctgggccatagcaaaggtggagttgatgcggctgcggcgctttcgttgtactggtctgaactcaagggcaaggttgccggactggcattggttcagagcccatatggtggcaccccaatagcttccgacatccttcgcaaaggccagattgctgataaggagacaaggaggatcatggaactgataatatgcaaactcatcaaggtcctcattatcctggtctctgtgttacctaatcagatcaaaccttatgactgagttattaggcaaatctttcaaaaaaaggactttatgaattgttcatatatcactgttttctcatattcttgtgcatttcatatcatgatcttaacaagtaaacaaatgcagggtgatataagggccttggaggatctcacatatgacaagagaagggacttcatctccaagcacaagctccccgtggacgaactgccgatcatctccttccacaccgaggccagcaccgccccgacgatgctcgtgacattgtcgcgcgtcgcccaagccgagctcctcccatggctcccattgccgcggttcctgtcgtcatcggagtacgccgaatcgttgctcgcctctctgaagctccccgtggtcgtgccggcctcggcggccatggccgtcagcgcgctccacctgaggctgcgctacggcgagaggagcgacggcctggtgacgcggcgggacgccgaggtgcccgggtcggtggtggtgaggccggagaggaggctggaccatgcgtggatggtgcactccacgctgagaaaggatcatgccgaggctgatgccactcagatgtgtgaagccctgatggccatgctcgttgagattgggaggaagaaatgctgctgatcataatcttacagtttcttggttaaattcaagtttgaacttgagtttaaaccaaacttaggatccaatgccataatcatagatgatgttacaaggcagtttacaaatacagaatgatttccactttgaaggaccaatataaaatgctctttatttcccccgaaaaaaaatactacaatatatttcgtgatatgctgtaactgctaccatcatttttactcccattaacttttaacaacttccctttcaatgaaaatcaggtggggctccccggtgaaaattcaaaaaaaaaatatttcgtgatatgctgtacagtttgtttaaaatggacaggtacaatttctgcacttctacattcttgtatgcaaactgcgatgaagatagaagagcaatgcaacatgcaaagctgtaagccgagaatacgcgttctgtcccgctcagttacgccttcacctctagaaagcgtagactcatttgacgtttctccccgatacgtgataaagagggcccactgtcagtgtcacactcctcgtctcctccccttaaaccctcgtcaaaaccgctgcttcagagaatatttccatttctaccccttcctccccttcgcctccctctccgccgccgccgccgccgccgcagccatggcgacgcggcgatgcctcctccgcctcctctcgcgccgcctcctcgcccacacccctcaacccgcgtcgctggcctcgatcgcgacgcgaaccctagcctccttggccaagcccctcgtgccgcaggcatcccgcgtcctcgcctccccccgcctcttcccctcgcgctgccactacgcgtcgaaccgatcctccggcgacgaggaggagggggacgacgacgatcactacgacgaggaggggagcggggatgagtggggggaggaggaggaggaggccgtggcggcgaagccccccagcgggaagacggaggaggagaaggtggcggaggcggcggagatagggtacacggtggttggcccgctcggtgccgacgagaagcccttcaagccctacgagcccgtgttcgccgtcgtccaggtctgctcagtttgtttcccaagctttcgttttgcatttgggcgtggatctagtgggtgattggatgcgttttttttaatccctgcagattggttcgcatcagtttaaggtgagcaatggcgactcgatcttcacggaaaggttgaagttttgcgatgtgaatgataaggtaattgtgcactttgaacgcaaccgatcacatttattatgactgagagtgtgttcgataacttgatctgtaacaagccgcaacttataattgatagggaatagttgaggttatgagatcatgttttaataattaatacggaggtttatcttctttggtcatttaggcgaattgtacccaccagggaagtttcaagttctgatctgattgtaaggcacttgtcatttgaagatttgtaattgcatgcagtgcatgatctgatatttggtatattgaacccaccgtgattcctcagaatttctgctagcactttttattgtttaattatgtttcatttgtgatgggaactctgaacttccatattgatggcttaaatcgtttgttcaatagagtacacaatttttttttggataaacattttccatacataagctgtttaagtcgcttcaaaaatgggtcgaacattgaaatttaagcacgcagagtattttgatgagtttgtggctactcgttttagttgctctagtgccagttctgaaactgttccattattgctggtgccactggttctgtgtacttcttgtacttccattttcatttataactttgttgatgttgtttgtgtgatcacttggtgcagttaattttgaatcgagttctcatgcttgggtcacaatctcaaacagtcattgggaggccaactcttcctgatgctactgttcatgctgtcgttgaggagcatgtaagacacttcttaaactctattactccattttttttttggggagtatgttattcagcctcttcattgaactaaagttcatgaaataactgttaagacttatttgttgaaacaagtttcaagaacatctgctaagtattaggtctgcatttttcaaatcatgctaacatctatatatatttctggtgcatctgaatccatgtttatcaaggaatcattaatatgccttgaaacctccttttgcatgacctaggtttatgagtgattgttgtgtttgaaggctgacaatgctctagtaattgtttattatactaccatcattaaggttggaaatgcgtgctgtagtaggactacacactaaagaactaggtagtgttagaattcacagaaacagcagtgcatatacactctccctttgatatgctaccatcagctgatgattggaacatgcaaaggtatatacatctacatgctttgagcatgttctgaacagtatattggtatcttcaacatatatttgtaatgtgtcagtcgcatcggatgtctactttacgtatattttgtatgtgataatggataacagagttttttttgtcacttctatataccaagagctaattcattggactttgttgttcttattgctacctttcatgattcctctaaacttccaaaatttaactgaaatggaatgcttaatacttgtaacatgatgtacattttgaggttaattctcctacttatgctttggattttcgttttttgtaatgcgtacagaaacattggcatttggttgacaaatgatataccttccccaagcgtgtcttaatcttttcgttaatacacatggctttttttttttacaactagtacaatcggttcacatggtaacatcattacataatttccagctcaaattggattgacattgtttttcaggccctagatgcaaaggttatcatattcaaaaagaaaagaagaaaaaattaccgtcgaacaaagggccatcgtcaggtaattttatatcagctgtttacattattctgtgttctcaaaataaaatatgatattattgatattatcctctgcactatttagttcttactttatgccctgacaatttttaggaattgacaaagctgagaataaccaacattgaaggaatagataagtcagaggccactgctgttgctgcttaaattaagatgaataatgaaggaacatggcttcatgcccaggcagtccttcatactggttttagtgtccaatcaaatcttgatgcggcgtgctgttgcttattgtcagtcactgattgaaagaaccatatctgaaggtcttgtctatgtatccacattttgggaacgggccactcaagctatgccctttctcacaatgccaatgtcttgaccagtttggatattctgatgtggatcacatcttgtagttacagccaaactaactttttgttttctttctccatttactagcgtacctccttgaatgtgttccaatgcatcagtgccatgtataccgttctagccatgaataatgaaactgaaagtttgtggttcccatctatttagaaatctgaactgaaattgtacatgcttatgctaatacaaccagatgcgatgatatataaataatatggaggggtgtcgcctgtgacttgtaaagtgttaacaaaaatcttcaaaacatactgtgacagtttcctgtgcagttcttgcatcagttccagcttcctgaaacatattgcacaagttcttccttcagttccaattcccatgttaactatcccagcttactgaaacatcagatttgctcatgttatagaggaattgaaagtcgatatccatcgatgttatagaggatatcagacttactcatgttcatatttgcagaactgactccacttcgttttagctgctattatatgctctcttttagaagaggatgccacagaagaaaaaccaagtaaatttagtataatgctttgaggatagcaatctaatatcgatcagattactgtctttatcatatcatttttcttaatcgaaacagggttactctgtctgagctatccgttcattgtaccatctagttctgaagttaatctgaacgctagatgcgttgtggttctgaagttgcagtcagtgtggcactaactttagaaacaacttaaaaaaaggttaaagaactcccagtggatgtgttattatcattttgccttctgtcactttcacacaaagtaccatactttagtatgcccatgaaacctacatgaccataagagtttatctacctgtaaataaaaaaaattcatactatcctctcattttctctcgagtcaacacaaccacctttaagggtgaaaacggagcggattcggtcggatagtagtcataccatatcctaaaccatattttttaagcagattcggagcgggtgcggatagcgtacggatgcagagcggatttgtttcggatgtgggaaatgatgcggaatcagttcggaaatggattaaatttatcggatgttataagtgtatgcaatcaatacaacatcgagttagcaatgcaaggaacaataatacaataatcaataaacgacccatcataataattatgtgcttaagtgctaaacaacatgaatacacgatgtccataatataaaaatacagctacgcgagtgtgacataagacggtgaaagcttcggactaagaaatctaggttaatttatgaattagtccattggatgtaccaacttatgttatatgcaataaataaagtggttacatgtgttgataattttggattatccggcaaacggcttatcggataatccgcatccaccggattttagagatattatatcatcatctgtatttgcatcatactatccacatccacatccatatctgccgtatttctaaaaacccataccatatactcgtttcgaacggattcggagcggatcggatcggatattatccgatccgttttcaccccacatcgattctttgtgcatgaattttcttctcaatggcatagactttgcaaggcaataaacatgatgcaaccagcattagcaacaagcaatgctttgttaatctcaaccatgtatctaattgctcatctgctgttcagtaatcttgatttttaataggtatggtgaacttggtgactgctttggtggattggacttctgatttgagccttcttttgggccatttttttttgtggtcgtggttgttcaggcttgcatttgctttagtttacacatgcatatacatgattgcatatttttctgctttatttggagaagaaagctttgcgcatcgatgctgaactataaattgaactgcactaggaagatgattttgctgcctcttcttggctgcctcattctggcaactacagtgcagtatcttaacattttttttgcagctaaattgcctcttatgtagtctgtagtaaatggcaacgacaagtaggctcatattttcaattacatctgttcctggaatgggaccattttctttctaagttctgggtagtttaggctaattaaaaaactcaaacaggtgaataaatggaaattctctgttcattaccaaattttcttttgaatttacttgatattatgttgtgttagacttcacatgtctacttattatataagcggacaagtttggctttttcgaagccgaagatatcaaatattgtgtccacatacgatagcccttttctgatgataacacaaatgcagatcccccaagtttgtttgaatgcatgcaattccagacattcagctatgataaacaatctggctactctgatgttatgcttaaaaacagacaatcaataataaacagggatgtgcactataatactggtggatctccaacctaacatgaagtttcatgaaccatgatctttgaaaatctcacagtgatttggcctgtctttgagactgtttcattaggtgtagcatcaggcatctgcaggaggaggacccagcccaaattggaagccatgttcatctacataagcctccaccaatccaaagttgccacaccaaaaggcaaatgatgcccaaaggcactttgtcaaaggcaaagagccaccattggtgggtgtcaatgctagtcacacataaaaacattaaacacatcccttgagatctaatggaggaactgttctaagcatttactagattggagcatatcctcttcaagtgcatgtgtttttggtttattaaagaaacttgattgtttgtagcctgctttgcatcttcctttttgagtgccttttacccccactttgtgcaatggaaattgatgttagagcttatccaattccttctctgcacttgttgcattcctctcttatctcagcctgtgacacatttctctctttctgaaaaatgtcatgatccttcctaccgatctaccttcttatggaactcaaaaatgtactcagctggaaaataaaatttgcagattctttttagttgagattattgtatcaaatttaagccaaaggctaaaaggaattaaagtatatgctttgggccttttcttgtaaggtctcattcataaaatctcaaccggcctgctgtgactcgcctggaaagtcataacagaatatgctgccatagtgatctgtgctttattcgtgtaaagcttggctcaagaagattctgagactattctaatctcatgatttttgtagcaagtttccattcagacaacattaatgtgttgaattctttttttttttttttgagaagttgagagtacaaatgatggaatatgctgcaagagaaacctatacttttgacacaaaatttggtccataaagacactgaatactttgtatttaagctccatgatcaatgttactgcacaagtagtcgtactaccctcttgatcatacagtcatccactcatcctagaataaaaatcaacagaaacttcctagcatcatctaccgatttggcaatgtctctagactcccttttctcacctttcaacaatccattttaatcattacaaaatctatttataattgatattcaggagaaaagaaaagtcctgtgcattattcagtttaatgtcacaatgaaacatgccaggagagctgggaggacagaagtaacaggcacaccagttgacctaaatgctttagtagtggctcaaggatctagtggacattccaaaagcatatcattggctgcataatggagcacagttcttgtggcacattgaatttggttgagaacagtttctgctgacagctgaaaaactggcaacaagcactattagcagtggcattgcaatgtagcaaacagtcctcccatttctgcagtgcaactgtggatagtggaaggtcagagcttaattagcagataacaagctaacaacataatatatgatctagctagtaaacacctgaaccttttttcctgtccttagctctgaagaattggatgcagatgaggttttagaaaagggctttgctgtatgcatatgcagactcagatatgttgcagtcgtgttatttttgccgcatcacattcaaagtacaaacgtagatgctcaaatagtcaaatagatatgtgcacattcctccctatgaacacacacttataatataagtgttggaggagaatatgggagaaatgcctggtggtcctccggccagctccacaaggtggtgggctagacgatctgagttcgaagtcttatcccttctaattatttggggcctgtttactttgatgtcattttcaaccataccattttttggtaaagttgctaaaaaatatctacatttagtttgttgctaaatttggtcaatacataagaaattatgctaaaattttggcaatattgctatcttgccaaaattttagcattgccaaaacttggtaaggtttattttggctacaatctgaacagactaatattcacctcttcttttagagaatatggacatttttttccttttaacctttggctgtacattttattagatcatcagaaatggtcaggttgtgtaagatatgtgtagttcaccgtgcaaaatattttttccaatcactgatccggtttccactaagactgaagagacaaatgggtgctcatttgctaaaactacccaacaagaaaaacacaatttagagctgatgacgtggcaaatagcagtcttaacagatgttgacgtgtcaatagctcgatagatctgcatcttaatgacagatgctaaactttgccacgttggtaatattcagcacaccatgttctttttaattagcactacgcaagacggctactttcagagaatgatgcaagagaaataaaaaatggatttcatatttggcaaatggggcactaaactatcgccttctcgtcccacttattgtgctagtggagcagtgacgcagctgcaaatgatgaaagaaaaaaaattgccgttcgtgttcataattaacataaattaatttcctaagaacaatgggtgcttcattgaaagatgtcactggaaaagttttcattcagcacatgctttgatcggttgatgcatacgactagtcaaggaatgccttttcataaaaaaaaaggtcggagaaatttcttccgaaaacgatttgatcgattcattgaaaaaaagtaggcatctaaattcaagcagtagattactcaaacttggattctagaggtgataatcactacactcacacaactgtaccaatttaaactaggcttatttcctaagtgatattttctccggccataaatatttactccatccgtttcacaatgtaagatatgtctatattcattaacatcaatataaatgtgagaaatgttagaatgacttacattgtgaaacggaggaagtagtgcttagaataaaatttagttaaacttttaaaattcagagcaccaataacatctcaattgtttagttttaaagcaaaagaaaagatatgcatggagttgcctcggaaatgttgtcataatttttcatcggactggtggcagatgtcctgaccagatttattaagatggaagaaggtttaattgagaagaacactcaaggttgttgttcaaaaacacttccctaccgacacaagtccctcagggtgtaaagtatcataatagtatcatatatttaatagatttgataaatttattttaatataaaattggtggttggatatttaaaagtttgactaacttttgttctgaacatcaaatgtatatacaagaaagtttatgcattgatgatgtgaaatgcaaatattttggaattatacatgagaacatagggactatgcagacaacataatcaagcatgctgtcatgttgcctggctgcccattaagaaactagtgtttttacggtagtctttactgttactgatagtattctaccatcggtaaaaaaacctgccaccactaatattgtcggtaaaaaaattgcttattatgtaaggaaaggagcaagcctagatgcatgggtgagtcgtgatgcctaattctaccaggctccatcaaatattaaagtataatcgtcggacaaatcgacaaagataagaaagagtcatctgtcagccaaacgagaaaaactgatcatctatctaccagacaaaccataaaaggagactgtctctgtgcttggcctcaaatttcaggcaaagcaaaacacctgctaatctgtcagtcaaatgcgaaaatgatatcaccattcgtcacaaaaagtgtggctgtaatcaagcccaaactctctgacagaaagctcgatcagaaatacacaggtatatcctgcaaattatccctctcatttcgctatcagcatttagttcatcccaaccttgctccctggaaaaatggaatatcctgttcagataccttaaaaaagaggcgacacatcacaagatcccttgaatattcagacaacctgcacgagaaagctaagtgcagcaagcaaccagcaatgcagccacattgtctcgggggagagaagggtttcaggttctgatacatcaggatctctaccgaattttaacaggtgattagtattataattattgttcttgttgttgttgttgctgctgcactaagcatgacaccatttggtggatgttttgtctagtgaaaaattcagaaaacctaactcgcatttttgtgcagaaagctggggaagtgaggagctgaccaaccaaaaggcagatgcagatgatgagattgtgctgcactttggacggcgaattcagcagccgtgtggatggatattctgcatgcgatcccgggatcctgtaaagggggatggatgcactttcatgggtatggagtgcagccagcatgctatttctgaatgagatgtagtattgtctttgtttgtttttttttctgttgttacaggaaaataaatagcttagaacttttacgaaaaaaaaacgtagtagtacgtaaaagtaaagtaagggaaaattggaaccatgccattataattttgtaaaatttaagatatgacttatgtttttttggatgagtataaaggttttattatgtgacattctgatttatcatgagtctctaagctatttactacactcaattctcttttaccattttttcctgctaccaatcatctatctcaaaaaaatgacaacctaaaatgcgtgaagtcaaaccttaaatcatcaatagatgtcaaacatcaagatttgaaattaattgggatatttaatgctttccttttcttttataaataaacagcttgagaaaataatgataaaacacgtgcataggagactgtccaaaacatatccatttgagaacagagttagtgtgtgtttagtaaatttggtaacacacgcagataatgtttttttggtttatgaaacacaatacaatttgcatggtattaatcaagatgcttttgtgcacacagcagtacagcacaccgatagccaatattcatgtgtgaaaatcatgtccatatatttgtctcaaaagtacattcatagtattgtaagtttatttgagttttcaaatgttttgaatatttattagttgttaaaactgtattttaaaaccgtaccatagtccaagttgatatatttttatgatcatcggaaatatgccacatctcaagacagtaacataaaaaattgtagccctgttcttttcggactattaactggattattaaaataaactatttaccccatgttttaaagacaatgttttcaaaggaaaaactttctctatagtattacatagaccacttgttttgtactattaatgaaggttatttttgaaaattttaaatttttatataattaaatagacaatttgtgatagtaatgtgctcaataaatcaaacaggtgtatagaaaaagaaaaaaagccatgcaaaatagaattccagtacaaccataccgtctaaacaaaaggagaaactcgacttaaaaaacttaaaaaacaagaatattatagaagaacctaatatcaaataaatagaacgagtgagacttccaatctggatcggctagccatcatatctacctctactctcaagggaaggaaaataacgccacaatggtgcagcatctttagttccattaacttgaccactaattcactgtcttaaattactgctgcagttaggcacacatcgtttcacttcacacaagtggcaggagcaaacagtgagagcatgggaagaaaacgagtaaaaaaaattcgattacgttttccaatccgcacttgaattcttagggaaggaaaaaaaagtaagcacaagaaagaaagcacaaagtggctgtgaggaatcccattagcgcaattaggaattaatttaggcggccgaattaaagaaatcaaaagaatttggagaggagaagaagcaccccaaaaaggcgaagcctttgcgcaccatagaaatcaccaggacccatcgcaagagcagcagcctagcggagcaccgagcaagaacaagcagcagcagcagcagcagcagaagcagaagcagtagaagaagaagcttttcttgctttgcttgctttctctctctctaggctccatctcctccctccaccactgcgtctcgaaatatccggctttcttgttgtgcgatttggtgcgaggtggtggtgattgcttcgtcggctgttgatttcttcgaggaattggagctgtgttgggggattcaggggggcttcatggtcgaagggctcggggatggattgaggcgtgggagaagaggagcttagcttcctcttcttcttcggtgatcgggtttggggttcttggaatcgcgaggaggcgggacatggcgggagattgggcttgtcacagactcaggtatggattgcattctcctctcgaatttggtttctttccggctgccctccgcgcagcccctgccccggcgaggctggccggcggcgactgccaccccgccgccggtgatgtgcgtgcaagaattgcgcttcaatggcgaatttccttgtgttgtctcgattttgaccatcacgtttacatggttaaaaatggtagtagtctttaaaaaaaatggaagattcaggtgttcatcgttagctcttgatagcaatgcgtctgatttttttttctttttttgggtcagtctttgagacttaggattgttggattgggggagatttgtcatatatgagtactttgtgggtgctacgaattgttttcgcgccattttttcttctggtttttgggagagcgtgattagcacggaaggtagtttgttggatttgattagttacgtcggaaaggttaaatattagctgcttatgtcgactacgatgttgaaatgtctgagatttttctgtactgttgtttcaatcaagaaggcacccaaactggcaattccaagtaaaaaaaaactatgttttataacctactaggttcgtctaatttatgcatgattgatcatttcttgcgttaataatatgggcatgattttctgttgatgttttgttttcgctcgtatgttaatcctttagatatggactttcagatgtttccttgtagtattagttttgatttgacccctatctgtatgtggtcttttaatagtaaaatctaaccatataaatgtgcagatatttggagtaaaattcttctatttacatttctttcaacgactgttatctgaatttttttgcgtgcagtttgattttatactctcttttgcaagtaacgttaataatttttttaatcttaatagttttttgtgtcagtttaaagccttaagctggtttgtaagtaccaatgatttagaattttagatacttttactttcgattgactgttacgtagcaggatcatactgcagaatgctcatctgtgagctttctataggctctttactctctcttttaacatctgctatgctgtattgcaaactagctattcattatgtttcctgaataatgaaaatgtgtgtctgccggtctgcccctgtttggataagaaaatttcaagtactggcatataaaggaaaatggactatttcaggcaaatattcatttttgcttgttatgagacttatattattttactttagatacctttactatcaacaagtggtggttgattcatatcctacccttttttgtgtgtagagctgtaaatgcttaaccatgagcattgtagtatgtacatgagttagttccttgtagaactcaaattatcgtcaaatcatcatactaaagtatccgtacaagattcattgtacaaaacctttttttttggtaaaatttttttcgataatgttttggtaaaatttgcatcctatcaacaagcaacatgaaaccatgcatatacatatatgtagagttgtaaatgatcctttttttttatatcctcaaaaagaccaaaacgcacgcatatgtccagcacaaacatttgtagcaacatataaatctttatgaggttgatctttgtgcctaataatgccttttgatgagagtgttctctaaagcatctaagatactaatatttttctcaatttggattgtcgtgaccaattggactgaagttctcaccacatgtttgcagggcctgctgatcaatgcaaatagacttgaaagaacattatattctcgtgatcttatcaagtgaagccatatctaatgaaagcttgttatatttgttgctttcttgatgagatttgttgcttatgaccacttgtgtcctctaatcatccaaagcaaaaaaaatcattcagccggtctttacctctccaggaattaacacctgtgacaagttattccttgttttagggcaaatctcctttggcaattgcaccttcctgtcgatcgattatcctgagcatattcctcttattgagagaacccttcagctgggcaaatctcctttggcaaaatacctatctatagtctgtctattcgggcaaatctcctttggcatttagcttagattgcttccgggcaaatctcctttggcactacctttagcttcagattgctctttgggcaaatctcctttggcactaggtactctactactatccgcattagatatttggatcaaatatcctctggaagttagtggtattacatcattatttcctgcaactatatatcgtggtaattctcctttggcattagcactgtacacacattggttctaccacaatatcgatctcagtgaaagactgaacaccaggaagtccagaacgattcaaggtaatttgtcctcttttatggtgtatattttttatgtgagccgtcattttctataatatttattcacttacaaaagctttcctattttgactcaattttcagaaataatttttggctggtggccgttgtattttagcatcttggacaggaagctttcagattctgattgttcagtctggaagattgttttgttatttatcaactctatacatcagtgcgcctatcctaagaaggtgagcatgtagttaatagtatatttcctttaaatatttctgtgtctattccattatctaaaaaatatatatttctgtgtctgattccatgtgaaaaatgacaacgtactttgttttagggctcggaaagatggatctatatgcaattgactcggacactgagtcatacgctgaaactagtgacagtgaagaagaccaagaagaatgtgaacttacatactgtggtcatgcccagaacatcttgtccagcttggacgagagcattggaaagatcgataactttctaagttttgaaagaggatttctgcatggagacatagtttgctctgcagctgacccatcaggtcagctgggccgtgtagttggagttgatatgcttgttgacttggaaacgagctctggtgacataataaaacatgtcaacagcaagaaactttcaagagttagatcctttgtctctggtgattgtgtggtgatggggccatggattggacgggtgatcagggcatttgacctggtcactgttgtgttcagtgatggggcaaggtgtgaaatgctcttaagagattctgaggtactgaagcccattcctccaatcctttttgaagatgcaccttatttttactatccaggccaacgtgtgagaattgttcatccttccatttctaagtcgggtacatggttgtgtggatcatggaaagctagtagagatgaaggagtagtgtctcatgtcgacgttgggctggtacatgtgaactggatcacctcagtaacaaatgtttggggaggtcaatcatcaagtcctccaaactttcaggacccaaagaagctcactttgctttcatgcttcccttatgccaattggcagttgggtgactggtgcactctttcggattgcgagggaagtctctgggaaaattctgacaaatcttgcttcatgagtatgacctggaagtccagctccgacactcaaacggctatcggaacttatggttcagattattctcaaacatatgttgttgcaaagacaaagagtagtgttgatgttttatggcaagatggaagtacatctcttggtttagaacctcaaagtttggttcctgtgagtactcttggtgatcatgatttttggcctgggcaatttatccttgagaaattgacagttgaggataatggtagatgccagcggactgggatagtgacaagtgtggatgcacttgaacggactgtaaaggtaaaatgggctgtttcagttgatagtgacactgtcagttatggagatggactcactgaggagactgtgagtgcttatgagctagtattacacccagatttctccttcttcactggcgaagtcattattagatctgctgtcaacatagaaaattctgaagcaaatcttaccaatggaaccgtggcagttagcagggagagcttggatacctcctctgccttcttatcatgtattggcaatgttcttggatacaatgatgaaggacttgaagtccaatgggctagtggtgcgatatctagggtaagcttaactttgagaaactttcttctcttttttttgttgctttgatttattttatttacagaagtgttgctttactttataccagttttatttccaaactttgatgaaacatggatcggtccctggtcagactaatgataacataacttatcttgtacaaatttcaggttcagcattttgaaattattgcattagataggattctagatgattctctagaatccatgatcgaggagcacactactgatgatttggtagacatggctgagcaggagaaaatgcaccttgaggatactaaggtccgcttctgtctacaaattccattgtacggttattaaacttatgggttgaaatttcatcgatgatttatcattttcattcagagtgcgctggaagaatctgctggagactgtacaggatccttgcgcaaagccactgctttcctcttttccaagacagcatttaattttctgacaaatgtggcttctagtttgtttggtgctcatgattcaacattttccagctcggtaagttctatttctctctagatgatgcaagctaaatttttatagaattctgagacaacggcattgtttcaggtcaatgcagattctcagtatcaaattgtgacgacagcagaactgcagccatctgcagaagatatctctgaagagaaacagaccatggagctgataacacagtttgagaagccaacattagcttcagaaaatgccatgacaaaaggatttgatgttgtgaccgactgttctgatcaccactttgtcaaagaaattggtcacgaaaatgtaatggtttacttagtgcaactttctttctttatttttctagcaaattgcaatgcctattaatattggagtatatgcaattcaatgtcataataattatttctgttcttctaggtcaaaagaggttgggtgaagaagatacaacaggaatggtcaatcttacaaaacgatctgccaggtttgttttcttctctcattgtatagtttattcagttgcaactcttcattaagtcttgttgttaaatttgatattttggcatatgtttattttaattttaatttctgagctagcatggcttaatactgacgatccttatatcccactatttttttacttgatatgacatgtatatacttgtggtcaaagataggaataagttaaaattttctacattccacaggatagcatagcatgtgagaatcccagaaacaatcaatctcggtagcaagtatgcaaggagatgagtggagttataaaggcaaaatttattttagttttatcatgtatgtgacctgttattatttaataaatcattacttgttaatcagtgggaaaaaatttagtcatggcacaagaattttgcaaatgcaaggacaactgtatagactggaaattttctgccgaaaactcagtaactcattctagtttttagttgcaagtaacatcttcgaataatgatggaatatatagtttcttgtacagcagttatatgatgttctttctttctattacacagatggtattcatgttagagtttatgaagaaaggatggacctcctgagggcatgccttgtaggtgcagctggaacaccttatcatgacaatcttttcttctttgatattttctttcctcctgattatcctcatgagccacctgtaagttcttcatttttcattgctcttacctacatcttctattccagattttcttgctgctgaacagtaaataaccatgttcaattttttcccccagtctgttcactaccattccggtggcctccgtttgaacccaaatttgtatgagtctggcaaagtgtgccttagcctgctcaaaacatgggcaggaactggtagtgaagtgtgggaccctgaaaattcaactgttcttcaactgctgctgtcccttcaagctcttgttctcaatgaaaaaccttacttcaatgaggctggctatgacaaattcatggggaaagcagatggagagaagaactccatcacttacaatgagaacgctttcctgctgtcatgcaagtccatgacgtacattttacacaagccaccaaaggtgcgtctcagctctggaaattctgtacacagcaatttctgaaaaaaagagccattatggtgtccatactgttgttttcttctcctaatttaaatgatactcagaagtcaaatctcctatggattctcagggaaaaagataatttttgaaaatacatttttacacatccatgtttcagaatgattggtatagttcaaagaagtttggaatcttgtgaaaccaaaatctaaacgctgttcagaattaagaatgctatagctttagtttgtaatgcttcatgtgaattactggatctcacaagagtttagtatgtttaatcttatatataaccaagtcagctgtaagagtcacccctttaagaaataagatgtgtatactgatagttctttcttttccttgatctagcatttcgagaattttgtcaaggagcacttcacttgttgcgcgccgcacattctggatgcctgcaaggcttatctcggcggcgatcttgttggacatgctcgtgacagcgcctatatatcggatgacggatgcaagaactcctcaaccggtttcaagataatgctagccaagctcttgccgaagcttgtcaccaccttctctgaagccggcatcccctgcagcccgtgactcatggcattgtgagtttgtgacactggactactgtgtatttgtgacaaaatcgggacaccaatatatgctgtgtatgtactgtatatgtgcaagctttgtgactttgtgtatcccaaaataaaatgctgcctggtttgtatgatacttaacatggtgatgtctgttgtaacttgtaagtgtggttgaggcagctggtgtggttgggtttgtggtcagttactcagttcacgtgtgttttgagcatgtgaagtatgtagatctgcttatctgaaattctaagcagtagctgcctgattgcctgtatagcctgacagagcagctatctgctgtaattgtactactactactgtactgctttgtgaaatacagtacatacatagctgatatatgtaaattggttttctcattttctacagcagtaaatgtgatgtaagatgccaatcatttcatcatgttattctcatctccagctttgtgctgacacaacgaaatctacataacttcctcaattctctgtttaatcgacagtaattttgtggtttgcatcttccatagccttctacccattataaataaacataactttctgggctaatgaagctggtgaaatccagctataattttggccgttaaaaattggggttagtttcatcgtgttcctgaaatgagctgggagagagatccatcgccttagctcgccggagtggcggcgcatggaatcgactcgccgtcgccggtgaggtgaacttgtgctgaagatttgcaggagcctccggtaatttcggctgccctagctgtggctgcggcgcagccggcacgaacagtgtcgcactcactgtgcgcagccgcagtagttggcctaccgaacagacccactgggccttcaggataggatgaaaacggtccgaaaatttttatatttatgaattcaactatttaatgtaaaattcaatacaacgttgatagaaattagacgattctcgattcagcaaaccgatgaagtcacgcagtgtgatgaaaggatgacagctaaaagcaatcttgtggatatgatatcatctcctttggctgtaccgaaaagaagtcacgtttaaattgatctatgctaccatccatccaccattccaccaactagcttgatttctaaatactcagctttacattctgcttggcaatacgctgttgcttctccaacctctttgccagacagagacgcctcagtgagttaaatactacaaggaggattgataattgagtttaacaaaatgcagctgaaaatgaaactagcactaacaagtagcctcacgagatgaggacacagagatacagctatggtttttcttttgaacaacatctccagtttcatgttagaagtaatatttttcagaggacagagaaggagagacatcaaccaataaacccaagaaatcctctcatttttcagttctcctttttgattgaaaaccagtccgatttttttttcaaactcctgaatctgtatgaaatgaaacagtttgttcaccaaaggcatgcaattccagaatccatctttcttatcttctcacctatccaaatgtcacacacattatatatctgcacattgcagcatttactgcccacaccaaactcccctactgaattccagcaaaccactggttccctgcgctttaaaccaacctttggcctggtttacttcacaaatttttcttcaaactttcaacttttccatctcatcaaaacttttctacacacataaacttctaacttttttcttcaagcttcttattttaacgtggaactaaacgcagcctttgattaatttgtgtggatatgaatttaaattcatattcatttgttcatattctactatacatttagcagaaaactatggatccgtgcagctgtatcccgtcgttttttctgacgtggcacgcatgtggaaggcgtgggacccagttgcctgccgaaacgcatgctgggcccacctgtcagtggcttttacccaaaaaaaaggcctattttttcatatgaacccctcaaaaagtaaactttttcctccatgctcgacacctgccacgtaggatttttttcccctttttgggaattgatttgatcacaacaaatagccttcgtctcccccacgctctcctctctacccaaaccctccctttcctcccccaattctccatttctcctagctcgccggaaaccctaagcgggccacctcgcgccgcggcgggccggcgagcgatcgcattgggcggcggcggcgatggcgacccacgcccccaagtgagtcccccctccctccgccgatctgatcggccgcgcgcgccgctctttgttccattggaatttttgtttttgtttgtgacgtggtcgtggttggttgctgctctgggtgggggcaggggctacctctgcgcggggagctcgtcgttcgatgatcccgacgtggtcgaggtgacgccggcggcggccgcggcaggggggtggagctccggccaccagaagcggaagcggagtcaggtgatgtgggaaggcgcctcctctatctcacctttgtttgtggtgcatgattttattattttttttggtgatgttggaattgggaaccgtaggggggactggggcgcgtgattgctcgatgtgggaaggagggttggtgatcgttttaatggttgcgtgttgattccagttatgccatgacctgttattttggtgtggaattgcactagaattgtgtgggcagatgatctttgattgtgccaggaaatggttgagatggactggcagtggcagtttgatatattgaattttgatcttagatgcgctcaatgttgaatatcaagtggagtttgtgttttttttgtatggtgagaagttgggctgtttttgttagatgattgctgaattatagtttatgattgcagtactgaaatttttagagggtttgattgcattgaaatgcctgataaaccaagcaggagagaagcaatctagactgtctagactttagagtgacaccatgtttcagcctggttcatgatggactagaattcatgttgaaggaaatctagcatgggacatctttggttgggcttttgagtggtagtctagcattctctggcactgcttgagtaaaaatccttgtttgtttcttatctggagagttaggcatgtaaatgtgatgttggcatgtgcaatattttcagttccagagtggatgggcagactgaaagtgcatgccatttgattattctgtctgtctgttaggtcaattgttcaattatttgacatctttacctactacccaatattctggtttagacataatctgacatatgacgttggtagtagagactggaagctgtaagtacatgtcatctgattattccagcttagtctattgggttgtttggttctttgatgtctttctataactctaggattatgttttaacaatcatctaaaacttgtggttaatctagagatgcctcaagtgaaatttgtttgtttaaaggtgtcactgggccttctttttctttctgtaacatatgatattttgtgaccaaaagcccatctccatcaaccatcattgttggaaatcaagatagagttcagactccaaagaacataaagaggccaaatataaagatgaataattagtagtaaccatgtcagtttttattctatgaactcagcattgccgtgacgtttctggctttttcagccaccacgatttcctgtataggatcaattatttcccttcaaaacatttttgtaatatcatgttatgaaatgttaaatggtggggcttgagtttttttttatacgctgaataggttgttcctcatgaagtaattgaactggatgctgatgatgatcctgatggagttgtgattattggtgaaaaatcatcagttgataagaataagcaagctgttggatatcctatagactggctaaagcatgcaaaggtaagttttctcatgtcttctattttcattttcctttttcctataccacgtcagtttgacttattttctgtgggaacaactccagagtagtttggctggtgaaattgctggcccaagttcctacccatcaaaaaatcctgatatattacttggtggcctgaaaatatttcaagagaacccattttacaacaacattgatgactatgcttatgaggcatttgaagaagattatggttatgatgaagatgagtatgatgattacgattatgatagtacactttatgaaagtgaatataacttcactttggcttccaagtttgatggtttggatatcccacctggtgtggaggctcctttaccatggttgcagacgactgcggcagagatggcaaataagaccaaacctgtgaacatgatggatgataaaattgatgaaaaatacagtgcatttaagcaattcgatactgttgatgatcacagtgatcattattattcgaagccagatttaagaaaggttcaggtagtgaaaaaggtaaccttttttttgtaccctctgtatattccttttcttgttagttcgatactaagttttcccattgacagccttcaaaagaatgggcaaagcgtattcagcacgagtggaaagttctagaaaaagatttaccaggtagttttgttgcttcatatgctcttttttttatgaacagctaatggtacagtgtttatgctaagtgtcgtgcatgatgcgatcatgctgttgataagtactacattcatgaggtccttttatgattatttactttggatttttgtcctatatttacagataccatattcgtgagggcatatgaggatagaatggacctgcttagagctgttattacgggaccagcaggcactccctatcatgatggtctcttcttctttgacatttacttccctcctcattatccgagtgtacctccagtaagattttttttttgacttaaccagcatcgatgatgtttcactccatttttaagtatcttacaatagttagtaatctatgcagctggtgaactatcggtctggtgggttgcggcttaatccaaacttgtatgcttgcgggaaggtgtgccttagcctgttgaacacctggtctggtagtggatgtgagaggtggagtccttcaaactcaacaatgctacaagtcctggtctcagttcaggctttggtgttgaatgccaaaccttatttcaatgagcctggatatgccatgcatgctaatacacctcatggcgagaagagttcattaacttataatgaagatactttcctgctatcctgcaggacaatgctatattctctgcgaaatccaccaaaggtatggatatgactctgttcttatcctagtacatggagatgattacttattttcataatagtactaaagttgtttgatgaatatctagacatctactgtaaaatctctcttgtttgatgaatatttcatccattaaaggtctctttgcaatctcctctcgaaatatacatatttattgatgtttctcattttcgcactcgtatgttcctttcgtcaatattaattagtaataatttacacagttacactaactattctcaattattttgaagacattaacattgcgatcatctttaccattccttctactagtctttgttattattatagcatccataattaccatgcctaaccaaaatatgtcacaaaaggaaatggagtgattactatgggaagctattgttgtgcttatgtggttgcatgccatggattccccactatgaatagatatacctgtacatcttcttaacaatttatctttttgttgtggttcttttacagtggaaatatgtgttgtttagtttctgttattttggatccaatcttcacatctgcaaatttaatactaatgcattttttttgcagcattttgaggattttatcgccggtcatttccgcaagtatggccagagcatcctgatagcttgcagagcctatctggacggtgcccaagttggatgtcttgttggaaatggtgtgcaggatgtcgatgagggcgacaagagctgctcggcgaggtttaagagcgcgctgaagagattatttgaggaacttctgatggaattcactgtcaagggagcagagtgtgacaaattcctagctgagaaggccaaagccgcggcttctagagctccagcagacaccacattgaggctataagttgatagcctcgcgtggtcgatagacgggagtaataatttcgctattgaaataggatcctcaactcattatgcccccggattctaaccgtttcctggaagtagcctatgtaaatagccttgtagttgccccggtaaacataaacgacatatccgtgtttgtatttaggggctatatatcttttttccccatagcatgagggtgtcgtctacctgcggagccttaatccgctgtgtatgtgattgacgccacaccatcttggccttctgaagaatatcatattgaactcttatcagcagatccctgcttctacgctggaattcagctagaatgctagattatcagttggtttgtgctcgtgcatgcctggctccgttcaatcctactagtatattttatatatatctggtggtggtacggagcatatgggtctgtttggaggagcttctagttgctgcagcttcttctaaaatcaaaagctctcctaaacagtctagcttttggtttagattctaagaagatgttgttgtggaattcagaaaataaactagaagctggaaaatccggttaaaatgattcactgcttttgggggtgcaattcactgctgtgtgatggtatttcagctctaactcatgacagatgccaattaaaatgaatcattcctataccttttctttgtacccatgcggccatgcctttttctgtacacattccaattgcgattctcaaaggttgcacttttcaccctctaaagtgcaaaatataaaccttctaaactagtacgatttgacgatttatagtatggccattttaaaaacaaatttcatctgaatgcaaaatcgaatgtggctcgataatggcttttacaaataaatttgggataaaatttataatgcatttagagacacgctttagggaagtaatgatagtgtattgatggaatcgtgggtatggctgcacctattaaaaaattcaaatcctgaggatcaaaatgtcatattcatacttgatgtgttttaaattggatttaagtagggctagtgaaagaaaaatgccatgttgctcttcatcaccgtcatgatcacttggatgaaaaactaaaaaaaaagggaaaaaagagaaaaaaaattctcatctacccggaggcttaaacccatagtaaaaaaagccggaccggcactcgaaccgtcgtggctgctgggtcaccgggtcagcggtccaaccgccggttcacccgggtcaattgcagaaccggactactaatttctacatatatgttctttcgttagctcattaaaacaagtagcagtgtagcccaatggtaacatgcaagggtttctaacctagccatccaggttcgagtccccacaatagcagtatttttacacatattcttctaatagtaggtattgggccttagaaggtagtgcctttgggccttcgcatggcccatgtctttggcccactaagcgaaccgtcggttcaaaatcagcaggttcaccggttttcgttaaaagccgtccggttcatccggttcaccccggttcaactgtacaaacggtctttgaagcaaaccgaaccggcgaagtccctggttccggtttttcccggtcgaaccgccgggccggtccggttttttgtactatgcttaaaccccacaaagtcaagaggctgatgcgactgcttcctcccctccacctctccatttccttcgggaaatcctccccaccaaaacaaaccaagagagaggagcggagatctcacaactccgcctcctcccaaatggcgccgccgcgccgcgatccaaaccctaaccacctcctcctcgttgccgtactcctcctgctggtccctgccacggtgtgatgaactact

SEQ ID NO: 73883 - DNA, 10315 bp, Oryza sativa
tttataaaaccttgtttagcaaatgaactaaatttctatatattctttcttccccacacacattttctctctcatcaacttacaactaaattttggagacaaaaaaagtgtgtaaaacataggtgcaaatgtagtatgataaaaaaaaacattggaggatgaagttgcaaaccttttaggcacctccgatttgtatgtaatcaccaaaataaattcaatagaaattttggcatgacctcccctctttttgaagaaattttgaagcttgctcgggcagctggaggaggaagaagacatatatataggggtgggactttagtcccggttggtagtaccaaccggggctaaagatcaccgggatccggttggtattaccaaccaggactaaagttaagatctttagtcccggttggtgttaccaaccgggactaaagatcccgggggggcctgacaggccctgacagcattcgaaccgggactaaagatgatctttagtcccggttggtaacacaaaccgggactaaagatcaaatatgcccgttacccttttgaaccgggactaaagatattgcatccgggactattgtggaaatcggccgaccgacgaaagatggtttctccaccagtatacatatactttagtaaaataagttgaatttgctacaagagcgttattttcaaagaaccccctaatgtgattttagctttcaatgtaaccggtatcttataataatgtagtgaaacatgtatttttgaagaaaaagacataatatttctccttttctaatgctattttttctcatccttttattttctgttagtgaccaaattaataaacctgtgaaggagtaagatggcaaatacatacagatatttagtagataatcatatcatcgagctagttgggtattggagaagacacgaatattagggaatgatctaacatcaaataattagaaagggtgatgcttcgaatccaggtcgtctagcccaccaccctgtggagctagccggaagacccctgagtatttctcactagtaaggtattggaacgaccgaagaagagtaagatagttattcatatttataaggctcgggtttttctccgttttagttcagatttaagaaggttctagattttcccttagtatttgtttgatttatctcagcttttgtaagtgccgcgtacgtggttcagtcatcattgggcaaaactgtcggtttgagaataataagattggccaagtgccacctgccaaatcacctgtgaataacacaggagtaagcaggaacgagttaccagctaaacagagtatggaggattcagccatcagcacagcaggccagcagggcttcatggcagcatgggcatatatcacaatgtcagcatgtgttaagcagcatggaaggaaagaaagacgggcataggttggctggacttgttcaattcccctgcgtaaaagaaagcaatacgagcacgcatgcgccacgtcagcattgccagtatggcgctgcttgatctgtctatcacgcctatctacaaagcaactttacctgtgtataatctcgtaagcgcacaatgataattcatacgtaattcatactcttatcttaattacctttcagcagatgatattgaaaatttgaaatcactaccagcgattaccttactagcaaattattaagcagatcgaatgcatcctgatgctggcatttgccgtgggagcagtattactgtcacattagcatgcatgtaatctgttttcttgtcatatctgtatgtagctccaagctcttggtagtagtaactccaatttgcaaagcttccggtatcgcgtatggcgaaggagacgtccccatcaacgacaaaaagcttcatccagcggtcaaaattgatagattctctcttaggaagccggcttgccagtgctcgccactgccagtagtactctggcgtgtcgacgtgttcttcactcgcgtcaatctgatcaacggtaggcgatcactttacagtgcaagcagtagtatgaattttgagacaaatcgaacaagagcaagcacagttgtgtagtaccagacaggatacaacgtcgaacgcagaacggagcagataaaatgtgcttctcatgatcggcaaaatctagccatcgaaagggctcatcatacttgtctgccacgcccaagatcggctccgcccagcccaccaactttatcatcacggcctcattgcgtgtcagcctaatcgagaacgtgaacattctcgagctcaatttcaaattaaccggcgccgaattccgatcggttttgaacaaaattggtcgtgtcagcgtagcgtgcatgggctgcttgctgcatgctcctgtccagtgtccaccacgctcgacgacatacgtcatgggcacgtaacacgctggcatgcacaagctcgtctcgatcgcttttcttttttgccttggaaaaagaaaccttaatttgctccattccattctcctacaagcaaagtgatagtggtgggaatatggggaaatggaatgtatcgatcaacgtcggattaatcgacggcgcaccggcgaaggaaaaggcagccacagccacagcctacgcgaggattggggaagcgccaagtataatacgcgcaatcattgggtactcaacccgcgaccccgacacgctgccgccccgccgcgcgacacgccagcggcgcgtgcggcgtccagggccccgcgcgcgcgcgcacgcgcacgcgcccgagcgcgatggctggtggctagcggccgggccgggccggcgcggcggcttctgccttcttctcttcggtacgtggacgtggctggtggccagccggtgcgtgcaggcgtgcggcgccacagcgagcgatcaccaccgtttttcgctggccggtgggtggtcaccccccaccgcacgccgcgccgaacgcgccacgcgcgtttcgtcggaaaaacggcggcacgcgcgccgcgcgcggctggctggccacctcctcactcgcgtcgcgtggccacgagccgttcggggatgatatgcttgcacgggccgagtgagtttgcccaacggatacgatgcggcttgggccaaagtccggatgggcctgaagcggcgggagccgggagaggtagtggtggggtgcgagggattagtaccacctcggggagttgttgcggatgacgaggtgagagctgctataaagagggagtgctatggaataggtgaaatcacgcagctgcgtggtgagcacaaagcgaactattctttcgccttttactaaagaataccgtgtgcgctccacatatagcagcatacgctatttttttgaggtgtccctcctttctggaagggcgccaacaattcaaacttaaatctttttcttttcctggttgcaattttgcatcttttccttttcctggttacaattttgcatccattttgccaattggtgaggttatcgtatttgtgcaagataataggaaatgtgttgatgaactcttgcctcaaatctaacatgaatgaaagggaatgtgtaacattatcagcacaaaataaatatattattaaaaatatattcgatgttacgtttaatcaaacagaacagtggaaatatctgagcagaataaatagaatagtgtgacagccttgtggcgtatgataaaagaacttgtcaatatcgtcagttttataatgaatggagtgaaatgtcgtcagtcttgtggcatttgacaaagacattgccttcacccagatgcaaaaagaaaggaacagcaaagcaggctaagcaataagcatttgatctcacactggaaaggattatacatattcatcgttttagttgaacaacaaaagcttatagctcgaacaagaggacatattatcatataggtatggcaaatctttcaagttccagcaatcaggacgagctaatggtaagattttccatctcgtttgctacatcatcagctatctccacttctagagctcccagggacttctcaaatctttcaagggctacaaaggcaccctcaggtgagccaccaaggctcctgatttccctccgcattgcattggcgccaccatacaatcttttcactgaggatttcatctcagataagtcttgtggtgggtacacagacgccccgaggtcgttaatctggtcagcagcctgtctgcaacagctcaacaattgttccattgtctcaactttttcctcattagctccacttcggttacctgagatcttaagcaaacaagtaatgaaacgaattgtttctttcaccacaacaagcgcatcggaagccacagtgacaaccaatttggcaacagcaacctcctcttcagtgaagtcctcatctaactcaaggtcacttgacgatccatctctatcagaacaacttgtggtgtccacagctccattagaagatttttcagcagtgccattagaatcaccaattggtagttctttcatctctcggagaatatccttcagatacacacctatctgagtcatggctcgtcctatggcaacacagttggttgttggtaccttgttgagagcaagacatgcttcccatacagttcctgtcacctgaggtatagttgttttccggtcaggactgcgtgattctgcacgtcacaaaaaagctgtgaatgctagtaacatcctcttgcatactgcattactattcaggtttcttactgcttatccacttatgcattacatcgtgaccaccataaggaaaataaaaagcagaaaatggtaaatttgtccttctcactttagtcgtaaggaaattagatcatcaaatttagttatgagggttgtccgcatacattagttaattctgaatgactatttagttatctactcctaatagttacgaagacaaaagggagcttcagacaaaggaagatccttgagaaaggtttttacttaccataagcagaaacagcttgattgaacaatgagaagctggagtcaacaacattctttgcagagctacagatggatttgtgaagtgtgggtcctgcgccaactgtgctgccgtggcaacccaaaaggaaaccctgcaggatgttgaaatatgcgacgatgttctccttgagtgtttctacatcaggcaaatcaccactccagaccattccagctgtattgaaaaacagacatcagcgaacagtgacaaagctaaggttacatcatcacagaaacggtatcagtatatcgcgacaccacattggttggatattgcatttgctaccctaaccactagaaagaaacaaatggccaatgcaaataacatttccctgctatatgatgatatacagcagctgaactataacctaatgctgctacattaattccttgccaagcttaattgggcggaataataaactaacaccttgatttccccaacagttttttctatccaagcgattctttccgctgaaattaaacaatctaaacctaccgacgctaaattaagtaggtgtatagtccgatcaactgagcgcacgaaacgtggggagagaaatcgttcgttcttagacctaccaacagtggcctgcctggagacttgctcgccgagcttgacgacctcagaccactccgtccgctccaagccgccgggagccgcctccgccatcatctgagaacccaaagtaaataagcacgccgccgcgccgtgagttaccgtgggattggaggcttagagccgtgctatgaccccatcgggatagagagactcgggtgccaaacctggaaggtgtcgttgatggtctggaggtgcgactgcaggaagcgggacagctcgccgccgcccgccggcttcttcgccgctccacctctcctcggcatggcaggcagctaccgcctcgtcgcgtcgcgccggcgaagaagagagggagaggaagagggatgcgagccgcggcgaggcggcggcggcggcggcgggggcggaagggtttatttcgttagggcttttgggggaagttgggcttggccggttggccctcctgacattgcgtcgatgtgggccgttcgattgaagttaagattcgtgctggaatacgaccgtgattccccgtcacagctggactagccacttagtcgcacgttgcgcgacattaaatacccgtatgaaaaccttgtatacatgagtcaaaatatatggtatgaaattctactttaaatttgaaaattgacaataccatagaacttaataaataattgttagaaccaccgctgcataggttggaagtatctctctcgcctatcttaagtaataatcgcaagtactgttatcagtacgaaattggaaacaatacctataaatcatctctgcttggtgatgagaggaactgactcatatactgacagagagtagtaaaatctaacaaagtgatgtacaaaatatttctgacttcaaaagtgtatgaacctaagttatcctaccatgtgcacttcgcagagttaacaaaaatgaattaggttgggtttggagtatgataaaagagtaaacaaatccgatgtatatccatacggatttctgtatttgcagctcttcaattcaatctagctttcagcagcaaaatgaaatatgtgaaatataaagaccaattagagtcataggagttattctaaaagaaaatttaccaatatttctaaaaccgaatatgagcatcaaatgaatcattgtgatgctgtacatgcgcatatggaatctgacaatgtagtaaaataggtaaattggcattctgtgagttactttatcatgtgacaaacaatcatacgttttatcaatcgtagaaaaggttggtgcttcttccttgaagatgtatatcagttacagaaaatttcagtgccttctccttctagaccataattgataagtgttcatcactattctcttatttaaaatgatactccagtattaattatttagttaatgagggaagacaataatgttaggacacaccaacagaagagaacaaaaatataatataggtcttgtttagattccaactttttctttaaacttccaacttttccgtcatatcgaacttttctacacacacaaactttcaacttttccatcacatcgttctaatttttactttcaattttagcgttgaactaaacacagccataaaaccaaagcacattaagttcaaaagctacataccaaaagccatcatcaactgacggatgaatgcatcgcttattcgcttcattgcttgagttaaattaatcgcaagtttaagctagctagctagctagctggggagttcccacggactgatcaaatagcagaccaatctcaagtaaacttttcatcgagcaccttgtgtgcatcggccaaagcatagcgaagatcctggcatgcatgcttggagcaatcctgacatggcctctgcagagagaagaataaggatgtggtggcgcacagctagaaggcctaagcatctatggggtcgccggagcatgctctacatgggccacagccgcatctacacggaccactactacgaccccatcgagctccatgggcagccgccgccactgctgtgagtctacatggcactgacctcaatggttccatttgagtttcatggctttcgccgccgccaccgccgcgtggaaccagggcgcctctttgtgatggctggcgacgaggggttagcgctggccggatttgggatgggctgaccggtgatgctgtgatctctttatacctagtggtgtgccgcaatctgtgaatggggaggagacggaggggattgggaggagacgcggtggcagcaacgatgggaggaggcacggagagatggcaccggagacttgaggaggacgcggcggcgagggggacgcgcgctgtctccgactatccgcctctccggacgcgagtagaacgaaaggaaattattctttccccaatagggcagggacgtggaagggcctattttttaaaaagcaacttcttaaaggaatcttgatattttatctattgagatcggacggttgctaaccacggaacgaagaatcggacggtccatgtttttctggtgacgtggcgcattgtggtggtgaaaaactttagttttttcactactttagattcgaccaaggaaaagaaaccgatggaaaaaaggtaaaacagggaaagatcaggtagcacccccgcttttgtatgttttagattttttataatgaaatataaattccggcttttacttgaaaaatatccaagcatattcaaatattgaataatatctataacatttttattaaagctaatatttaatatatttttttaatatgtttgttttgtgttaaaaatattgctatatttctttataaataatgtagttaaacttgtgttttaacttgaaaaaagttaaaataacttattgatatgaaacggaaagagtcgataaaaatcacaggagcaaaatcacgtcatggtaatatttcacttattaatctgaaattagccatccctcttgcgaggcaacaattggctattgtaaaacataatgtgaaatgtagctgaaaattgctttatcctaggatttaaagttacataattacccatcacatttaagttacatcatcacccatcacatatgtacatcctatcaagaagaagaaacaagtttgaagggggtccagagtcgaaaatcttccgaaaaattaatccattatagccgctttctctgatatttcaggtgattcctccaagaccatgcaagcaagaaaaccactagtgctacccccaccgaactccaaaagatgatcaaccaagtaggcatgggatcatgaaacagccctatccagattacaaaaaagttaggcactcttaacatttaatgttccaaatatatactactccctccggtttcattttaattgatgttttagacaatgacacggtctacaaaatatacctttgatcttatttttctattataatatatacaataaataaatacatgtttacttttattatagtgttttgaaagacaaatctatatatgttgttctagtttctttaaactaaatatttttaaagttattgatggtcaaagttataaaagtttgaccttaactttgtccaaaacgttaattattatagaaccggagggagtagtatatatcacgagaaaatcaagcgaccataaggtaatttttcaaatcagatcaattatttcacaagtgatgatgatgtcagaagagagtaactcaccatgtccaaacttcatacatataagaagctctacaatgcatatagctagagagagccagcaaaaagccccaaccttcttcaccggtttgctggtgtgaccatgaaaaaatatatattagcaagccattaagtaaaattgtaaaaaatgtgcaatgctattgggcgtgcagggaaattgggataacctgttttgcaagtaggagttgtactcacggatggttggaatagcaatcaaccaccataggattaatctgtacacaaccaaaggattccttggaggaatccagaggcaaaatttaagaaaaaatgtgttgagctccactgtcatgaaaacaacgcacaggaacaacacttgaacgaaccgcaacggccccatgaaagggtaccattgatccttgtcccattgtgcaggggtgaactggctcagtgatcttttcacctgcatatgcaagtaaaggaaggtcggtaaactgtaaatgggttcaacctaactatagtatgcagtctgaagcagaatgtaactgcacaaatgtgcatatagtccaatcagataaaacacactgaatgccagaatggtatacaacaaaataaattatgaagtcaggtatcaataatggcaattgacagtttagagtttggacagagcaacagaaatcaatacagtcccactgggaaaacctcacatgttgtttggcgtactacagacaagaagtcaaagtgatttacttttgctcagcgactgcattgttatagaatgctcccatggacttagcagtagcaagaggctcttgtaagtcgtaactcaagaaagaatcgatgaggaaattcttacaaaaagcacaatagcccaggaaaattcagcaggtacaaaaaaaaaatctaggcctaagggccatgatgaatgaagattaaaagaacagtcctaaaaaaaggtactaacctatttgcaaataagaaacaatttgtttgtttggtaacataccttgcccatgatgcttggctgtcggctcagcccaacccactcatatgttttaccgtcaaagtaacggactggggtgcaggaa

SEQ ID NO: 73884 - DNA, 15507 bp, Oryza sativa
tgcatggtcggcaccggctccggccgcgccgccgacggcacggcggtgaacctcctctccgccgtgctccgcgtccgctaccccggccgcgccaacctgacgcgccccttcgtcaccggcagcctcgagagcaccgactcccccagcttcttcgagcccgtctctctcgtcacctacgccgaggagggatacgcgtacgcggagagcgcctcgtgcccgccgccgcccaccggtaggctcgacgcgctccaggtgttcgaaggtagtaaattctcatgcgcacacctcagttcgctgttcaaggcgacgttcaggctcgactacaccaacggcagcagcgagtcgaccgcctcatcgctggggcttcaccagaggttcatgttcatcaaccggatgcgatgtgccgacaatggcgcagtgcgagcttatgtggtgttcgcgaatcagacagatgtatcggcatactactttatgcttggtgagaaggccatggtagtggagggtttctgggacgagaagaggagcaggctgtgtctcaaagggtgtcacgttgtgaattcgggaccatcccgtgcggatttggcggtgggcgagtgtgggattgggatgagcttctggtcccccgctgtgtggtcactacaggaacggagctttgctgcaggtttggtctggaacacgagcctgaagagcggtgagggcatagctgcaagctccaacacaatagctccatactttaggggaagtctttcgggtctgaagtataactacaccaaggttgatgaggcaaagaagtattatgagaagtatggcttgaacaagaagagaaagggaaagttccctgatagcaattcatatcgggacttaacattccggttcttcttgcagaaaggagggggctctggatatgcatcaccagtcacaattgggtcaatgctatatgatgggaactctttggttgattcagatcattcctatcatataatgacagagacgaatcataggttacttaatgtcagctatgacattcactatgtcgggaattggtcgctagaaacatttcgccgtcagcatatctctgcagagggtgtttatgatgctaagacaggctccttgtgtatgattgcttgtcgggtggttaatatctcgttggactgtgaaattcttgtaactgctcagttttctcctttggatacaaaagtagcacagcatgtcaaggggacaattagaagcttgaggaagaagactgaccctcttttctttgaaccgctggacattgcttcgtatgggttgtacatagacaaagtggatgagtcgatgtggagaatggacttggaaagcaccatggccctgatctcgatgacactatcctgtttgttcattgctgtgcaactgttccatgtcaagaaggttcctgaagcgcttcctgccatgtcaatcaccatgcttgtagttctctctttgggttacatgatacctcttgtgttgaactttgaggccctcttcaagaacagtaacaaacagacatttccactttcaggtggtggttggcttgaggtgaatgaagtcattgtgcgaatcattaccatggtaacctttctgatgcagttacgacttcttcaattggcatgctctgcacgttccatggatgtaagcaaagatcaatcatgggctgctgagaagaaagtgctttggatatgcttgccactgtacattataggtgcagtcgcagcttgggttgttcacatgcaatttaacaacaaccgaaggatgcttagaaaggttgctcgcttacctcgggttaatagacatgcattctgggaggaccttgtgtcatatgggggattaatactcgacgggttcttgctccctcaggttatcttaaacgcatgcttaggctccaaagtgaaggcactttccccgggattttacattggaagcaccatgattcgtgcgctacctcatgtgtatgatgtgttcagggctaagcattttgtgcccagcttgagaccattttacaggtatgcaaaccctcgcgatgatctcttcagccttgcatgggacattgccataccatgtggagcaatactgctgtcggttcttctgttccttcagcagcggtttggaggcgctttcttcatttgttcgaagaacaggaaggcaagtgaatatgaaatggtttccacagttagctcttaacaagttttcatctgtgcaagagaaatatagagaaggtttctataggctaagaaataggttgcttcttatgtctatgtttgctttacacacttacatacctgccttgttgaagcaaaattacatacaaaagaagctattcaggttgggcattcagcaataatgtttaaaatgctccgttcatttctatgtgctactagtcagtttacaattacgctgttattattctggtattcagaggcagtcgaggtggatttctgacccatgagaatttacatctgcgtgaagttatggcaaatgctgtttttgggtagtcattgcagatcttgttcagttgtccgggttgcaggccatgtgatgcatagtcgattcggtagctcactgctcaccattgattttgtttgccgttgtccgtacgttgcaatgctcaccattgatttgtttgccgttgtccgtacgttgtaattcaccgtacgagtatgtagtgttttaaagcaacaacatttgttagaagcttgacggttctttaggagcacagaaattaggaggttcagccagcgacgcacacgcagatgcttttggtctttgcatgataatttagtgagagagaagaaatttaccgttagcctccgtgttccttttcttttcatatgttaaagaggcgcacatgcgtatgtaagtcgttttcatattttttttagttaaacctatttaagtttgatcaagtttatagaaaatatatagtgacattttcgatacaaaacaaatcaagatattaaattttagttttaaagaaactaattttggtgttgtagatgttgtcaaatttttttatagatttatttaaatttaaaaagttttgacttgagaaaactcaaaactgattataatatgatgaaacgggagtaatatacatacagacaacggtttcagcatcatctaagccctaattttccctgtggtgaaagctagtatattttttattgggcccaacgcgtagtgggctggcccgaagcctagcccaaactatatcagcccgttagtccatcctatctttgttaattgtaatggtaagtttgtactcgctcccttccaaaataaaaaggatattggatagatgagacacatcttaatactacaaagaatttggatagagtctatcaagattcataatactagtattatatgttccatctattaaaaatctttcatattttaggagtggaagtaataacaattctactcgtttgtgtccgactctccgtcaacgagggcttaggtttttaaaactaaagcatattcaggttgatatatgccttcttttttttgttagtcgactagtgtgaattaatatcatctaatttaggtgaatagttaaacgttataagaaaaatttaaacaacatctgatttgggtggaggtactagaaagaaagaaagaaagaagaaagagagatatatatatcatagaaccgcgcccatctctacgccaatccaacgtgcacgccaccatgtggtgaggcagaaacacagtcgcatcgcatggacatgacaacatccaccacattccattccaacctgaccccgtctgcctcacggcccctggactggaccgcgccgatgcacgcataaacccctcgccctcgcccaacgcgcggttttaccctcttttttttttttcttttggccccgtttcctcccaaacttccccttcctccgcgtcggttgactccgaccggcagccaggccagccagagatatttaaccatttgccacatttagatgtggcaattaactttttgttacttgaccccatatatcataaacacatgtggatccacatgtcattgagataggggtgacaaatagttatttgccaaatctaaaaatgacaaatggttaaaagccccggccacccaacccaaaccccgtcgtctcctctcccgctcgctgtccaatcattcacaagcgaaagcgactagccccacctcactcctcccctcgcgaccgcgtcaatggccgcacccacgccgcacgtcactccactgacgacgacgtcccgtccccgcccggcagccaccaccggaggcctccttgactcggccgtcgccatcgttcgcctcgtcctcctcctcctcctcctccccgcgggtagctttcgctgccacacacacacacacacaaacacaacgacctcgccctcgcgaagacgacggacggactagcactagcgtggcgggggacggggccacgccgtttatagcgcgacgcggacgactcggtggtggtggtgatgatgatgagggtgttgggtttcatgggagatggtggtggtggtgggatgatgacggcgcaggctgcggcggaggcggcggtgggcgcgatcgggtgcgggtacgacctcacgagcgacctccgcctcagccgcgtcaaggcgggcgggaggctggtggacatcgacggggcgagcggcgcggcgagacgggagctggtcctcccctggggagccgtcgtggggggcgtgccggtggggatcgtcgccgacaagggggagcgcacccggttccgctccgacgtcctctccttcgctcaggtaacgacagtgcctcacaggtgttcgatcgggtgatccctttcagttcactcggaattgagcttgagagttttgttgtgttgggtggtttccctgccatggcggttcgcagatggcggagcaggtgaaccagacgatgtcggtggcggggaagatcccgtcgggcgcgttcaacgccatgttcgactaccacgggtgctggcacaaggacgcggccgccacggggagcctctgcttcgacggccgcttcatcgagctctacgccgtcgaggccccccgcgcgcacctcgccctgctcgaccgcgtcaagcgcgacgtcccgcccttctgggaccccgctgctctcgccgagtcagtacgccttcccccgtcgcgcgccgcgcgcccggcgttcgtcgcgtttgctgctaccccagtggccactgactctagtgtactgacatggtcgctgccgaattttctgttcagattcatcgacaagtacgggacgcacgtcatcgccggggtgaagatgggagggaaggatgtggtctgcatcaagcagctcaagggatccaatctcacacagagcgatgtgcagtctcggctcaagaaactctccgacgacaagctcgctcaggattcacctgaaagtttaactgcaagagacgacaagttcttgctgggattaaacgtgagctctctactctaacattatatggcttcaaaattagctttcttaggtggtgtttacatccagggacttaacttaagtctctgtctttagacactaatttagagtattaaatacagactacttacaaaactaattacataaataaaagctaattcacgagacaaattttttaagcctaattaatctataattagagaatgtttactgtagcatcacataggctaatcatggattaattaggctcattagattcgtctcgcaaattagtctaagattatggatgggttttattaatagtctacgtttaatatttataattaattttcaaacatccgatgtgatagggacttaaaagttttagtcccatctaaacagggccttagaagcttcagaattactgtattggactttcataacccatgattcggtttctgaagatacaggcgccattaatgattgtaagtagccttgctaattgctgtgatgttgtgcaggggagtttattattgggtcctggatctgctgcttggcggtcgttcagaccatcagtcgtgtcacacaaagatgtaaggcaatcacacatgtactgacgatgttcattgcgtgatttatcactccaacagcaggaaattaatgagagagccatgattaatttgtttggtcgcatgtcctttcgtttcacaggacatcctcagtatccacatcagaagagggggcgttgataatggccaaggccacagtaattggctttcgacgatcagcggttcaccggacgtcatctctatggcttttgtgccgattacttctctgctcactggtgttcgaggctgcgggttcctgaatcatgcagtgaacctctacctcagatgtaagcactttgttagttactgctggtgacaaacaaaaccatgccagttcaaggatcacatcgtatctcaagtactgacatagctaaattactcaggttacaagtctaattatctgtctgttttctgctggtaaattcagacaaacctccaatagaggaactccatcaatttctggaattccaggtgccacgacaatgggctccagagtttggggagctccctctggctttgggcccgagaaagaagaagaacagcctgccatctcttcagtttactctcatgggtcctaagcttcatgtcaccactgccaaggtaacaatcaataccggcattctgcattagtgaaattcgtcagtttgattccatgttgtttgtagtagaactcagctcacagtgtgttccgttttgtttcgtgcaggctgattctgggaatcgtccggtgaccggcattcggctgttcctggaaggcaagaagaacaaccggctgggcgttcacctacagcatttgtcagcgacgccgggcacgatcacgatcgccggcgaggtggcgtcggcggaggacgccaccgtgagggagcgcgactacatcgagcccatcaagtcgccgctgctgtcgcacgtgtgcacggcgccggtgcagtacaacggcgcgcggatcgacgactgcgcggcgatcgtgacgagggcgtggctggaggtgcaggagacgtgcctcaagaaggtgctcttcctgcggctgggcttctccggcgtggcatccaccaagatccggcggtcggagtgggatggcccgttcgtcgtgtcacgcaagtcgggctcgctgtcggcattgttcagcgcgcggctgtccgccgccggtgccggtggctccgcgcagatgatgcagcagcagcagccggtgggggagaaggtggaggtgaactccgccatcttccccaagggcccgccggtgcctctcccggtgcagaggatggcgaggtacgtcgacacaacggaggtgatgaggggccccgccgacttgccggggtactgggtggtcaccggcgcgaagctctgcatcgaaggcggcaaagttgcactcaaggtcaagtactcgctgctcatcgcggaggtgctagactaccctgagtgactgttgagaagaactgcacggtgtgtgcatctttttggctcgtttgtgatgctgttgtgtacagtacagtacagtacaggtaaggtcggctcagctcagcgtatacttgtacagattgggcacacgctagtagtcaggtatactatttgtatgtataaaccacagagtagagcagtacactaccagcaggcaattgttttggtttgcacttggattctagcaaaactaggagcatacacagttgttgaaattggtttccttaggcatgcagctcaaaaggttatgtacgattatttctcacctctggtattgccctgagatgggatcatttttactggcaatgttgagaatgtgagacggtttggtaatttggcatcagcaatcatccttgttcccaacagtataacaggaggccttttacattgtttgcgagttacttagagaaggagctgaaccgttgattaataaaggggcaagataagaaataaaattattgtaatacgatagcaatggaataattaactagtgaaatatgggcatttcatgtgaattgaatacctgctagctccatttatcagttttgttatagagaaaaaaaaacataaatcatagatacttcgttgatttagcgttcaatatgatccgtactgatgaaaaagaaaatcaaagatcgtgtctcatttcttctttaccttcacttcattcttgttctaggatgtaactggttcaatggaaggagagagagaagacaccggcatggttgagggtcgaagaggagacgagatcgtccaatcgatggctagttgcaagcgcatgattagttatttatgtagttcacaaatttgttgaataaggggttgaatcgagatctcctatatgttttttgttctagggtttgaatggtgcacccacaaggagacacggtcgtggaatatttcatctttctaggaataaatcgataaaatgtgtaacttaaatcgatgcaaatcttcggtgatattttaaccaatcatgtttgtgaaacacaatataaatctcttcttgtaaaacaaaatatatatctcaaaagaaataaagggaggagttttgacatgttctttagaatatagagtaatatagagaaaataacgcaaataataaaattttacgctagtaacgtgttcttcgaaacaaaatacaaatatagagaaaatcacgcaaatgagaacattaaagtatacgacataaatctagaaaaaatcacacaaatgagatctactaatctagtactaggcaaatgacttaattggttgattaaaatttagagacaattctaccattttctctcaactagcatatttgtcataaatacttaactagcacataattaattaagttttaatatagagaagcttaattgttactaacatatggctatatgaggaaacttgatttttactctagttattgatacgagctatgctgaaaactacctttatttatttacaaagtgcatgcgcaagatttacttttgaatttacaagataatcatgtgtatttaggcctgcgccactgaatttgtcggagtgtgaaggattcaatactaacctttcatacttcaacctgcatcacacctataaacactctagtcctgcgcgttcttctcaaacttccattatctttactgaggaatacttttggcatttatgtttcccatttaaggtgtttataagacatctgatcatatgtgttagcagtacttttaacaacaaaatatgttatataaataataagcaagaaaatatttgcttaaaggaaaaatagtgagaattcttggagttggtatgattgactatacatttaagaaagcaattagtaatttaaacaatgttgggttttttagagttttctaaagcggatggatttgcagcagatttgaagctagtcatgaaaaactctgttgcgattataacatgatcaagaatttatctgttggagggatgaaaatgaaaaaaaaaatcatgtcattaaggatctggtgggtaacttaacttgaggttggttagtatttcctgctttcaatgtgtggatggataaatttgaacagaaaaaactttctttcgatgattgttagggttttcaatttccttaaaaataaaacttaataaacagaaaaactttatttcgaggatttttagtgttttcaatttgcttaacaagaaaacttaacgtagacgtagaagatttgtatgagataagagatttgtatgagataagaaccgacctacttatcaatatgaatcatgacaaacatttagctgactatatatacagtggtaggaattactttaaatctatctacaatgtggtgaaacatttaatataaactccgtttgaaaagttatatataatattctttcagttttgtaaacagtaataaccttaacttatatttaacttaactcatatttttatgttttataataaataatgcttacagaattgtggttttatatgtgtggacagttacaagttggttggatgtgtgtctcatagtttatttatatgaggaattgacaaatgtatatttaccataatgtaattattgttaataccgtatgccaagttaagttttcgacctaatttcaattgtatgttgctaaaataaggttattgtgatctttttcttaatatttcttttttagatgtacatgagtagtcactgttgcatataattaatatctttatgcaggattttagtaatgtacttagatggagaagcgatggctaactgttgtaacaaataatggacactttctacttgagttggtgtgttctttataaagtagtagaattagctaggatgatgttttaaagaagtaagttagctaggaggatgtttcaaaggtactaatcaggaataacacattgacatatttgttgttgatggactaaaacgtctatcgaaaggtaggcttcactcacaaggtggaatataaagcaataaaaatgtgttgatttatatagtggtaaaaatgtatttcttaaaaattggatccccaattacacaccctttggggtctatttatagctgtgcaggcttacaaccccaggggctagggttactgttcactcgggaattaacttaactatccttataatagggacatttataggggtaataatcgtcttatggcccatcctacaggcccatgggccctaaagggtccttgttgggccatttgttgggcttccagtgtgaaggccccaccgaggaatttgtccttcttcgccattcgatgcccctttgttgcatgcttggtgaagacgcttgtcattggcctagcgaagttacttgccgcttgccttcggcatttgtgcgggtcacatccttcggcgtccgacttcgtgacttgacgggtgtttcaagagtccggtcgaaggttctcatgacatggctccaataatatttttttgcaattagttggaaccctgataatcttggaagcaagtggcgtgtgagtcggttatggtgccaaagtttcaccttgttggcctggcgaagctacttgccgcttgccttcggcatttgtgcgggtcacatccttcggcgtccgacttcgtgacttgacgggtggaaggttctcacggcatggctccaacaatattttttttgtaattagttggaaccctaataatcttggaagcaagtggcgtgtgcgtcggttatggtggcaaagttgcactcaaggtctactcgctgctcatcgcgcaaatggactacccgaagttgagaactgcacggtgtgtgcatcttttttggcttgtttgtgatgttgtgtgcggtacaggtaggggtgaaaacggggcgggtatttcccgaccgcccgcctggccgtattattttgggacaaattcgggtcagaaattcgggtacccgaaactttatacggatatagggttcgaatatgggtttttttggaggatatgagatcgggttcaagagcgcagtatctgacggatacggattatccgggaaaaatacggatattacccgattatatatacggatagtaccagtattatatgttacagccgtacaggcttgaggctagccagcccaaacggccaaccactagccaccaggcgccaccagcccatcaacccactggcccaataggccaatactaagagcaacttcaatagaatggccaaatgggtggccaagctaaattttagcaaatatgaggggaaaatattctccaacagtctctccatccggttagccaagccatctggatggcccaatcgcacctctcactggccaaacttagagtctctctgcctggctattcgtgggccccaccactccccctcccgcaccatctctccctctcctagctagagcaagaaggcgtcgacggtgctgctcgtgaacggcgatggcacagaggagagagacactggagccagctgcgaccaccgccgccgtcctcgccgtcccagagccaactgcgaccgccgccgccgtcctcgccatcccagagccagccgcgactgccgtcgccgtccgctgccgtccccgcgtggatttgactgggcggcgtggattcgggagaggaagagtgagaaaaagaggaagagggagagaaagagaaagaggaagaagaatgggtatagagggctaacacatgggtcccgctatcacctgtcatagactcaaaataaagaggatagatggagaggctgttggagtaaacaatgaatttgacttgacaaatgaaatgaaaaattagctaaatagacatctggagagtcgaatttagagagactgttggagatgctctaaccctaagaaataggagagagcttgagggagatcgagagtcagagagagaggtgtgaggccgtgcggcgtgcgcccgtgcgtgaggggatttccgccgccgctgcccgctggcctgccatgcccttgcgcaggctgcgccaacgtcacctgcgccaggcgccaccacgcatccatgccggctgcgccaccctcgccactacgccggctacgccacctgcgttgttgacctgcatcgtgcagcttgagcccgtcgccatcgccagtgctcgtcgcgacggcgctcgtcgccacctctgctgcacggcctgcaccggtgcccgtgttgcctctccctccatcctagcaaacttctcgcttcattggccgttaaatcatcaggtagcgaatagtgttgaggctgaaaacaactgatgatttaagtggcgctggtacttgtgaatttgtgatatgtttcctggttggcaaggcttatgttgtgagcgatattatgatgacatagtgtactgataagtgatatcaggggcgggcctacaagtctacaacaattcaaggtattcaaattgttagagtgtataaagtgaattgctcgtctttccctatcagcttaggtttttaggtgtaactggctgatgcatgcaacttaatatggtatcagagccagaggtctcgagttagaatcctagcagcccactccaatagtccacgcttgagacttgaattttatcaagaattttggtaaagtatatatacccatatgaatacccaagaattttggccaaaaaaaagatatatatatatatatatatatatatatatatatatatatatatatatatatatatatatatatatatatatatactatgtattttatatgtgtattcaaaaaattaaaaaaaaagacatcaaacagcccatcaagcaaagaaactatccaaccgtgtcctccctcttctttattggcccattagcacaattgattcactccattttacccaaccaaaaactctatatacatgaaattatgctcaattttgtgttatatatgttatatattatatacaactactagtatgtgatattatataaaccaattattatcattttttagtgtagaaatttttttccctctttattttgaatacccaaccttaaaactctgggcccgcccctgagtgatatgcttggcaagactattgttctgagcagtattatggtactatgtattggtgaatggtgacattttggatgatgctatggtactatgtattggtgaatggtgacattttggatgatgcctacttttagcttgtggctgtgaggtacatgtttcctaagcccctaatggcttaatataatcgcattatggatatttaggattgttgaatgcttattgtctatgtggtatttatgattgttgcttcgacttgatatccaaacaagtattggtaaccgatagtgtacatatccatttttttgtacgtattcgtcccatatttttacccgatattatccgatcttatatccgtattcgacactatccgtattcaacccgattccgtttataaaatataggttaggatatgagaagggtgagatccgacccaacccaacccgatttcacccctagtacaggtcagttcagctcagtgtatactgtacagattgtggcattgcgcacgcgagtagtcaggaatgctacacaacaggtcagctcagctcagcgtatactgtacagattgcggcattgcgcacgctagaggtcaggtatgctattggatgtatgaactagactatatcagtacactacacagcagacaattgttttggtttgcacttagattctagcaaaactaggagtatatatagttgttgaaattggtttccttaggcatgcagctcaaaaagttttatgtatgattattttcactgcaagtgcaagagatgggatcctttttactggcaatggtgagaactgagaatgtgagacggtttggcagtttggcatcagcaatcatcctcgttcccaacagcatccactgagttatattacttagctgaaataacagtatcttcggtcgtcaaagacatgtttagcgcaccaggaacacaggtggtacatccatcatctctatttttggttaaccatatacaaaaagccagctgcataggcatcctcagttttctctgggttgcaaaggttagacggcctgtgcttcaggtaaagagttaaaacctctctgccgggacaaccaccggctgtggctccacacgcttcctctcagaaagataaggaccccttttaaccgcttcattcaactgtcacaagatgttttccttggtggtcagcacctcactattcacaatccaacagcaagatcagaaaacaatggaatttacgaggatacctttccaatgagttcagaaaggcttggttcatgaagaagatgtgatgatgataatgccttgctgatcgccagacaacaatcatgccgtgcttccatgcctacaaaaatgaaccaacattactcttttttcatttggtaaacagaaaactgtatgtccacgaccacaatagtaaataagagccactactccattgcattgctaagcgcaattctgattagtaactggtgctaagtgctaaaagtggagtaagaagttgcttaagcttgaaaccatgatcaactctaagcagtcagcaactccaaaagcagttgtacaaaagttctccaaatactaaagcaaacatcatactgtatcacccttgggctggaaaactagaaaaggaggcgctaaatttactgcatcagcatcatcgcaattcataagtcttcctaggtacgtaccaagttttgtcatctccattttgggatctgtaacaaggttgattatgtccaactttgaacaaatttccattaggcaccattctctggcaacaaggccagatattactctgtaaccctgcagacatccaaaggcaattagcatagcctcactatcaagggacagcaattcactttctcactcataacgggtcagcaactgggggatagaagtagatattcagtataaaataagttaagagaactgcttggaatacaggagttccacgggaaatagttaagtcccagctgaaatctgggatgcttcctgtgttccaaacaggttctaacttcaacaagcatgtgctgcttacagttatccttatgtctgg

SEQ ID NO: 73885 - DNA, 37192 bp, Oryza sativa
gctcccatggactaagcagtagcaagaggctcttgtaagtcgtaactcaagaaagaatcgatgaggaaattcttacaaaaagcacaatagcccaggaaaattcagcaggtacaaaaaaaaaatctaggcctaagggccatgatgaatgaagattaaaagaacagtcctaaaaaaaggtactaacctatttgcaaataagaaacaatttgtttgtttggtaacataccttgcccatgatgcttggctgtcggctcagtccaacccactcatatgttttaccgtcaaagtaacggactgtgtgcatccccgcccatatacctgaataagaatattagcatttcagccaaaatatttagatgaagctgaacacataaaacactccatagcctactgctaagagtgaggcttatatggcagatttgttcttcctccattcacatttacttgtcacttttgaccctaacgtgcatatgcaggtactctttcaataactggttactgaaatagaaagattgctttcaacccatgaactgatagaagaagataaattatattacttcataaacagtaagtgtttaatgtcagcagtatgcatgtgcatcaggtctaagttttcttcttaaaactctcagatacatcacatcgctattcattttctatattatcatgttcagttgataagagttagatccaaacaaactgtataaaatatgcaaacccaaaaacactatattattttaatctgcctaactttgttttactaataactttagatgtaaaaaatgtatcatcaatgtcactgaatgtatacaacatgaaagtcagctgtctccgattgtcctaccaaaccagttgcagatcaagatatccaaaataatactatcccaccagcactcattaaagtttggcaacatatgtctgaatgtaagctgcaaaaggtcataataagcacaataccttgttagagataacaagtaaaagataacaaaaggttgagtaaccatatctaacctccattagctcgaaaccaatcgagaggacccaaagaagaagctggtttcgtatcattacggctttaccccaccaacccaaaatatgggcaaccacaaattcgtcaaataatgtctcctatatgtatatcaaaccgtcaaatatgatggggtaataacaatgataataactacaataataacaaaaaccagagcatgaaataggaaggttcaaatgaaaaatcatacataaatatttatgaacttgtttttagggttttccggaacatacagacggcagtcagctccataagatctctccggcaattctgcattagtgtacagaaatgtttgtcagcaccatttcttctacaatatttaatttccagtgtaaatcctttcgatgtaaagatattaccaactccaagatcagggtaaaggtgtttcatgaactggcgagcatcatcgcggttctggaaaacgagaaagaaataagaattattacagtacaagatatccaagatgtagcatatctctacgtagttgaggcccctcgctcaagagtcttgaaaaaatgccatttatactgaattttgataatcaaatagtttggatacaagacttccaacttttttttttgacaagacaatttgcatttgcttggatctcaagttttttctttcacaaatacttgccacttcacgctcctgtaagaacttcccaaaataaccctatgaataatagacatctcccgccattttctaacattttacgtgcatgggatattattgaaagggcattttttgtcctactttatcgatgtatgaatttttcaatagtaacaactaacctggaaaagaagaaaggctagagcgacaaggtaaacgacagccagtccgtgcaccaggcgccagacagcaggatggggcctaataagtatcctgtgacaatattgccagaacattgaatcatcatcatgcaaaaatattagagatgcacagtagatttacaggttctcaaattgttatgaacccaaggagataaagaagacaaaagtagcaagtacaaaaacagcatgagaatggcattggtattgggtccctcaaggtaatttttgtgtcaccattaaaaacaacctgacgaataataagccctacactttcaagagaattggccactatatggtctcactcatacagtaacacgtgggtcacctctttgaagcagaaaaccttcaatttccctacttaaagaaaaatgcctgacaacgacagccactgcactaacatagttccaatgtttgaaatacatataagaagaggggggctaactcacgttgaaggtgcttggagagtgcagtaagcaaggaagactgcaatcatagcccagacacccctggagagtgtcagtgagaaaatatgagtcagtgtcactctctcccaatcattgtgcagtggtgagaggagaacagctcaagtccaaaagacacaatcaaagtagagaagtaaccagagttcccttagatgattgcatcactttccagtaaagtaaaaaaaaaaggttttcggtcattacctcttaatagatgtcgcactactgtgataagaagcaccctctggatcaagcgctccacttgcccaactgaaacgggaacatgattgaacatgaaatcagacagcaccacgagaaagtgaaaaggagaacgccccagcaagttcacaaccaaccactcaacagcctagcctagctaatggttgtttcagacacaaagttatatgcttaatcctttcatgaagcaatagcaacaataaagttcttggtgagccgtttctacagttaaaaaaaagggacgagaggaatgtacttcccatgtaatttgcacctgctaaaaatgatatgggaaaaaatgattgttctagggaagctttcgcacgagattcttgaacatgattccgattctcctcagccactcgtacgctcggttgtttgctagccttgctgaaccagactgccatgctttcatgttcgttcaatcattcagaaacctcaacttgctggcacaaaatcactaaatttcccgacccaaaaatttcacctttttctttcagagaaagtaaaaaaatcacaatgagtactacatgccctgctttcaactctgacactgttgatgcacctgataggcagaagccctggcatctgttgaattgtactttgccccaacacaacaaggcctttttttccagttctcccaccaagaaatttacagccttagcccttaagtcacaggcagaggcagcaaagcgagaaaaaaaaataaaaacgaatttgtgaaatttaatcgtggaagagcacttacattagaaggcaagcaccgacgaggagcaccgagatggtgtgcggcttgtagagccacgccgtccatgggtcgtactcctcggcgccgccatccgccgccgctacgagcctcctctcctctccgtcgcgatgcctcgtcctctgcttcgcctccatgttcccacttccagaaccctctgcgatatgtgacaggagaaaactgccgcggcagccaaacaacacgccaaaccaagcgaagcgcctgcgcgatataaccaccacggattgtcgcggtcaggtcaggagaggcgaaagcaagagacgagacgagacgagacgagacgagggggacagacaggacatgcagaagaagaaagaagcagaagcgaaggattacttcagagcccgagagagggagagagagaacgggtgtgccctatctccacgcgcacgcggaaatctcggcgtcggccgcgatcggcgccgcacgcgcgtgcgtggggtggggaggaggaggaagtaggaagacgacgatgacgacgcgggttgggtacttgggttggatgagacgaagaagtggcggtctcgtcttctttaaaaccaggggagaggagagtggatgatgacgacgacggagacgaggggagggggggtcggcgtgcgtgcggcctccacgtaacgcttcggccttcgggggcgcgcgcgccgcccaacgccgcagcggccgcggcgccaccgactccgcgagaccgagaggaggcgcaggcgccgcggcgttgttgggctggtccgtcgtgtgggcgggtggccaccgcacctgtaacggggctggctggcagagggtcccgggcgggggttcctgggctggcaaaacccggggtacggtggatttcgtcgccgagttccaactacctttgttgtatttttgcgtcttgtatccaaaatcccattcatcgccgtgtcacgtggctggtgacacacggatgtcttggtgtggtagcttctgcattatggcggcttataattgctctgtttagcaaagcttcatatcctttaaatgtttatattgaatataaaagacctgttcggctattatttttgtggctgcggcgtagccggcatgaacagtgccatcctcgctgtgcgcagccgcagctgtggcagctggcctgccgaacactcccaaatgtttataagttaaattgatcttgtttaaatatgagccctagtgagaagataaatttcagatatctcattaaactcgatgaactgaacggtttgagggagcactaaaattggaagaaagaaatttgtagaaaatatattagagaaccgaattaatgcatacaaaaaaatatgtaaactccttgcgtatctccgatggtgcatgtcacgtgagtttcatttacattttttgaaaaaaattcgcccaaaatgcaccaaatactcatatacggcatgccgaacagattttttagcaaacagttgccgaatttaagcaggtttcgaccgtatctctttttttttttgatcattttcgaccgtatctagcacaccatttgtttgtagaaacgatccggtctagatacatgggcagggataaatgacggcaccagtctacctacactgcaattgccatggggtccttgttaaagaagaaaaaaaaatagagtaagcgttaggtaaaagctactatgacgacggtgagctcaatttgttcgattccgcttgttcgttttctcggttagccgcgggtagtcgtagtactagcagataaggagaggaggacacggtggtggcgacaaccgcggcgctggctgtacgatccgcgtccggagcgatccgggccgtacgtgcggcccctgtcccgatcggcacgtgttggcttgggcgtcgcgcccaagcccgcgcgacgcaggcgacggccacgggtggcgcgggcgggcggggcggcatgtccggcttggagccggccgtgccatttgaccggcacgaggcccgaggagaggctgtttgagtcaaatggtgtcacaccgtcgtcacctcatcaccggcgctcgcagcggaaatcagcgtaacaggacggacgaatggacgaggaggacgatgtgctgctgctgctgatacggcggcgagggtacactgaacggactcaccttacggggcgagttccctgttcgcgatatgcaagttgactgtacgtggtacagagttttttttttttttgggtgcgcgcacacgaaagatgcacatatacgattcattgatctcactattactgagagtgttcgtgcgttcgttagaatgagagaataacggaaagcgactgttttccacgcgcatgtttccttagttgttaaatgttgtgtttttaaaatatagataagttattttttaaaagaaatacattaacctgtttttaaatttaaaatgactatactttcaattaatcaacaataatcgctcacctaaatatttttaggtcctgtttgtttcagtttaaaattattgtaatctagattattaagtcagattactctaaactggattataataagctgatataaaataatctacgagttgtttgtttctctgcattattagagacatttaatggtagtggatctttagccactcaataatctagaaaaagctcctctagaggagattatagattatagtaatctagtataataatctgcttgtttgtttcagcttactcctaataatctagattataatatctaagctgaatcaaatatgaccttaatctactgcttttccctcctctcaaacacaggatattgttttcacgactctactactacatcgctactccttcccgtccttggtttatgaatagaaacttgatttgcacttagaaatacttatatttatgaatagattccaaatgctgaaattgctaatgtttataaagagagtagatcaagcagacagatgtgataaaccacaccaaacacgaacacgtcacaaaaaggctccaatcccaatccttcggcaacacatgtagtactgtaataaaaatctcgcagcagtatattcctctatgctttggcatccgattcttccaaaagattcttcttctcctcctgtaccaaagtgccatccagcaatgaaccaaccctagattactaaacagatcgagatgattagccatatctcatcagcatctaccattgttaagcttcccaaaggtcaaacctggcaatcctctcctcgggccccgagctgcaaaaacttaaagaaaccagacttaggacagtcctaatccataacaatagacatggtttccataaactccacatcataaaaaaaaactagtactagacactactattccaatgcaaacaccactattatatacttcaatttaatgctacttatctcacatgatatcttggatgttgtgtagaaaccatgtctcatgcaagacatggtttacttatctttcctcatttattcacttgtcacattattttttttcctatgtggcaacttatttaatgctatagacatcatcttagtcattgggttgggaatgctcttagatgtgatttgcatacagcgcatgaatcggggattaattggaccacgcgtaccttatgcatgaaatggaattggaattgtggcgatgagctgataatgcaagcaaggaacctgatttgcatatggttggttggttcggagatccattgcacgctctcaccggtcgacagcgtgatcgatcgggaccaaatcgcggctggaaatggaccacgaggtgggtgctatcgatgctacagtggaagaagattccttggaaccccgattgtcccaccgtatcttattttttttctgaggatgatgacaattatttgaaggtttttagcggatttggatggatcagccagtggtttagcatttggatcgtgatctcagccgtttgatgtcgtatctgtctatccaaatttggttggcactgctcgtggagtctgtttgaaatcgataggcagatggatttagtggttcagatatgaggtgtgttcaatcaacaaggtgttcattcagagggatagcagctgatacatgattttttccgactgattgctgagtcatgacacagcacaaatgttggtgccactgctgtagtagtgtttaaactttaatccagaatgagctgcgatgatatttttgtcaaatcgatgactgatatgttgattctttccccagggatttgcaactgtcgtgattgatccgacaatgagcattgttcatcttcctatcagtgtagcacgatccaaacgtttattaatacattattattattattattttcacttccagcacaatgttatcttcagttttatctcaaactattattcgccaactttttactttgagaagacaagagtgaaataatttgtacaccaaaatggcattcagttttttttagcttgcagagtagccgcccagcccatcaaaagatatataaatgggccctttctgggccaaagtgggcttcttcagatctgaaatttctaaaaacgaggcctcttcagtccaaaacctcagctcccgcaccgcgtcgaacacactgacaccagagaaccctagcctcgccggtcgccgccatggccgcctcgctcctccgctccggccaccgcctccgcctcctccgccacggcagcctctcctgggcctccttctccgccgccgccgcggaggagctcatcgacgtccgcaagctccccactgactacgacgcctccaccttcgaccccaccgccccgtcccgcccaccgccctccgaccgcgtctggcgcctcgtcgaggacgtctcctccctcaccctcgccgagtccgccgctctctccgccctcctcctccgccgcctcgacgtccccgctccccccatcgccatcctcaactccgccgcgggcctcggcggcggcggcggcgcgggtgccgcgggcgccgccggggagaaggccggtggggcggcggcggctgagaagacggtgttcgagctgcgcttggaggcgttcgatgcggcgagcaagatcaaggtgatcaaggagatccggtcattcaccgacctgggtctgaaggaggcgaaggagctagtggagaaggcacccgctgtgatcaagggtggtgtctcgaaggaggaggctcggacaatcatcgataagatgaaggctgttggtgccaaggtcgtcatggactgatcagcatcctcatttcaattttcaaggttagatgcagatttcctcttcgattttagattcaacttaaatgcacgaatgattgacatggttactgtggataaatcgatgatgtatagtaataatcggagatttactttgtgaaatgtcctcagaatgctgtaaatgtgcatcagttacatgcaagaatgatgtactgtagtacctttgtcccaaaatatattttgggcaaaatccccgatagttacatgcgcaaaatcccctatattttgggacggagttagtacgaattaggatgtgaaagtggtcttgtaaacttttgaaattgcgaatctgtcatgcaggagaagcattgggtttgaaaatagctattttgtaaagctgtgaagttgttattatgtcatgccgaagaggcgtttaggaaattgagttaatataacctcttgggtcagttgtcacttgtcagtaaatgcattagggaattttatcgggaagttgccagactgattttttgtttttgctggcatatacttctatgcactacttggaagttaaccttgtgctgcattcttcgtgtaattttagtgcacgtgtgcaagttttgaatctgctgtctttgccgagtgcaggttctgttcacagtttttaactgtgctttctcatggtttgatggttgatgcggattggggtgccagtgttaatatcctgtcaattggcattttgaaagcccaatgatcttacaacacactggccaatccgatggtgccatcatgtgtttcttgttcggtcgatgaattctctgtcactaacaagaaacatggaataatttctgttgaaaaatgagatcaacagggtgcagagctggagtgtgaccttgagcctggagtactatcttttttggttggcttcaccggctgtatatgtatctcatttttgtaatgttactgaagctactgagctagatgcacgctgtggcgttcaagtttttatcctctgcatttgtgaaatgacctcacatgacggtatgatatgggtcatatggacatagataatccatttatgtgtttcttttttgaaactaccatatagtgaactgatgaatgttgtggactatattttcaagtatggaattcaggaacccctaaaatgacaatgactgatccctgtagggctgtatgctgaatcctcaaatttctcaaataaaaagggtgtgggtagtaggagtgtgtaatgtctaaataaaaagggtgtgggtagtaggagtgtcttttttttttttttgcgggggggtagtaggagtgtctaatgtcttttgtgtagtgaactctagccatgagccaaaagcaaagagaagaaattgtcacgccaggtcggctaagagtggcagctgccgtgtggctttcactttcacaatgggctgcagaatgcatgaagaggcgaattcctgaagaagtttgctgctccaagcagatagcagtctactgacttgatcatcagtatcaccctccctcctggggattaaccgaacaagggtgtgtttagttcacttcaaaattagatgtttgattaaaattggaccgatgtgatgaaaaagttgaaagtttgtgtgtgtaggtaaattttgatgtgatggaaaagttggaagtttgaagaaaaagtttggaactaaaccaggcccaagtcatgaagaaggcaaaggaactatcttggggattaatcgaacaagccctgaaggagaccgaggaactagcaaagacgccatggtctgagagggcacatgcatttcaaggtgaaacgaaagtttcctcttcgattaatttaacttacagatgatttaatcttgttactggggacaaagcaacggggcttttaactatttgccacttttagatttagcaaataactatttgccacccctatctcaatgacatgtggatccacacgtgtctatgacatgtgggtccaatggcaaaaagttaattgccacatctaaatgtggcaaatggttaaatatctccaaagcaatagtctgctaatggtaataaacatcaagataatttgccaaaaggagtgtgatccttggaatgcctgatcatgcatcaattacatgtaaatatgtaattacgctgtatgatgtaaaaaaaaaaagccttttttggtatttggcgaagttatgataagtcattcagaagaggttagcctcattttccgagagaagattagccttttattctttctgtccacgaagagtggaaaatttatctatacttctataggctggaagtattcggaacctcgatctcgtacatacatatcgccatcatacatttcacatagagttcttgatacattctcccggatccaacaaatgcaacagtacaactatgcacactgctttacttcttcagcagattccctacacatccagaggagccagtctcctccacatgatccgatcatccgcttcagttcgcgtcaacggatcaggatgcagaatcagaccgaattcgttgcatcaagcaccaaatgttgcttctctgacggtgtctcgccgaaaattctctccctcgctttctcggcctgcagaagcagcatcaggtcagtaggcgggagaaacatgattcagttttcgagtgatcaagatttgatgatgttggggagaaggcttggagtttcagataaagaaacaaaccatcttttgccagttgctgaagaatgcaatgacggcgagaagcaagaattgtaatacggaaccacaggcgatgcccagccaaagccctttgccttccatcttgaaaccaaagccaagaagtagggctaccggaatgccaaccaggtagaatgaaccgaggtttacataggctcccaggtgctgccatccgcaaccccgagcaatacctgataacaagtaatatctgtcagtgttaagcaatgacgtgtggtgcatctatcttgatataatcttctagagaggagaaacaatagtatgtttccgtgctggagctgaatgagatgtgtgttttcgcaagttcagttcattgtttttggcatgtccacaactgctcagaagcacaaacaatgaaatagacctgtgaagcaaacaccagtgccacactaccagtctaccactagccaggggaaaggtgtaattgcatacttagtgaagtggagtccacacttaagacgacatcgctgatagatgcgtgttgattgtaaacaccaccatatccatgttcacgtaagagcacatgtttgaaggaacaaacaggtaactccccgagtaacaatgtcggcctccacaacacaaaatagcattagtttcattgaacaaaggaaaaacaagaagcggcaagttacctggtatgtctttacgataccggagtgactgaaattaacttgctacctgaggtcttggtagagatttgacaacagcgcacacattgaattaagcaatcaaactaaggggtaaaagataccgttgggctaacaggctaaagatactgaatggtgtaaatgtaatggccccaaaactataagaaccagttatataaaaaaaatgaaataagagagaggcaaggccagttagatcaaattttcgaaaacttcaggcatagctgaatactccattttttccattcttttgaagggaatgaataattaacagataaatcaaatgttaggaaatgtaacctgataaaactccttgtaggctatcagcagcaactgagatgcacacaaaaggaaccattgaggtgaaatatgtgacaacctcctcatcactgctgtaagcatagcccaagatgcgctgtgctgcaaacagcatcccagtaacaagaactgcctctgtcccagcaatagacattacaaggtgaacagccgatcgagctccttcaggattcccagcgcctaactcatttgctactcgagtgctgttcattaaaacaaaattcacaaggctgttaacacatgattattctctgagaaaaaataatcattcacagtagtggtttggcttctaccttgcagcgcctccaagaccatatggtatagtatacatcaaagaggtagtcgtcaagctgcataaatggagtgcttataaaataacaaaaggtgcagctataagagaatatattgttaagtgcgacattgaggactcttattttcttaccatatggaaagaactgaactttcaagctctgggttgggtagaagtcctgacaggagaacaaggatctcaaatgaccaccattcaaaactacaaaataatagaagaaaatccattaatccaataagtgggaattttttaacaggaaataagaaatacttacatataaaacaaggagattctgaagctactgtaattaccataacattagtgcagatggtagtgctattcgcagaaacaaaccgactcctctgaatgcctcgattgtaggaggcgagcgagtcaccttacaagaacatgagaatctgatgtatgcagcgagcatgaatgtattcaaccagtaagatatgctaattgctaaagcagctccagtaaatcccatgctggtcttgaacaccaacagccaagacagagggatgtgcaggagcagagttgcaatggaggaccagagcatgggaaatattagactctgagactgcagaaattttgtgagaggctggcagaccgcgtatgcgaagagtcctggaatcaaccacactatgtatcttccagcttcatgtgagatcacggggtcctgacctattagggtcaagagtttgcctatgaatacccatagaagtgagatgggaattgtgactactgttagtgtgactattgctctgtaggtttgcactcctaacttgtcatactgttttgccccataagcttgaccgcagagagtttctaatccacttgccattccaacctgttttacaagttcaaaattcaaattatgggtggtttcaaaattaagatcacaaactaaaaaggcaatccgtgtacaactgaagagaaaagtaaaaaaaaaaaatcctacagaatatttcgccagagtatcgaagtagtcctctaggctgtacacacttcgcagattctgaaagctagttgaaatcgtgacaattgactagctcaccatctgtgcaggcaatttaaaattcatcctagaaaagcattcagcgtggagtagtagactagtagtgtaacttgttatttatctctatatttaggagaacgttgattttaaattttgtaggtttgcaaactgctacttgtatacccaaaaaaaaaaaatctgctacttactatgctatatccatgatttatttcagaatgtttggaacacgccaaatgttcaaacagtattccagcaaaaattttaggcactgttccaatcaaaatcccccttccaaactaaccagccgcttgtacggctaaactttttgcctgtcctcctactgctaaatttgaacgccacattgaacaatatctgaaaccgtgaaacgtgcctctctggctaaagtgctaaacagttaatccaatgagaccaaatcacgcaggcaacaaatatggatataagcaaatcgaggacgcgtgaacgagtggggaaatcaggatatgcgatgacgacgtacgaggaggctgaagccggagacgctggcgagggaggtggcgatggcggaggcggagagcgggaggacgccggggaggtgccccaccatcatgttggacgccacctgcacggcgttctgcgccacgctcatcgcggccatgggcagcgccatggaccccacctttcctgcctcccgcgccagcccgctccaccacctatctccgccctcctcctccctccctcctcccactccggcggtgccgtccgccgggaatcgtttcgagagcagaggtattctctcctccatggcggccgcagtgcgcgcgtcgtcgtcgtcgcctccaccgaccgagctctctctctctctctctctctccctctcttcttctcagagacggctttggtgtctgtgtctcggcgctggtgggcgggggggttttaatgggaaaggactctcgcgatcagcggcgggttaaaacaggagttatgggaaggttgttatgtcaaagtgtcaaatgtggcgtcctaattttatactgcgggttaaaagtagaatgcaaagttttatacgagtgagcatccccccctcaaaaaaaaatactggctaaataaaacaactacactgtgaatattttaggaatgctttgaaatactcgctctgttttatattataaattatttttactttactctaaatcaaattactttaaatttaattaagtttgtataaacaatataataatatttataacactagattaattttattaaatctataattaaatacattttcatagtttatttgtattgggttgaaaatgttactacttttttctacaaacttagataaatttaaagcggtttgattgtaaccaaagtcaaaacaacttataatctgaaacgaagagagtaaggtttataaaacataaataaagagagtaagatttataaaacagagaaagaaaaaaacatactaatagaatgctatgctcttgtctgcagaattttaggtcacgagaatacgaatcaaacataggaatataaacttttcaggaaatttgtttggataggggagagactagatagagaaaggaatataatgcatacaagagtttgagctcatacttatttttctttggaattgaaacaaccaaattcataggatattcaaagttccattgtttcaatccgaagtataccataggaataaaaatcccaagaaattgaatcctctataaatactatgaaaatcctccaattcaagaaaggcatgttagcattggtgagcgaatcttgttgaggctttttattttttagaaacacagtacaagcgcacatatgttttttataaacgtacatacacatatcctacacctagcatatctttgagattgatgaagttattacggacacatcgctaacgacggatacattgtttaccattgaaaatgtcaaagttttcacctttccttcaaaagaaaaaaagaactctaccaccctaccctggtggtgttttcctagcatacatctcttcatagtatattgcattcttgccaagataattataaacaggctactagaaaagatcaaactgattcagtctctatgtgctagtatgtacccaccccacccagctgacatggtggtcgttctgtcccggcaccagagtacccacgttaacaaccgaagcttaacacactatgatgatcctctgacagctaaaccaaatactctgcactgagacagacagagtagcacggaaaataccccacgcaatgatatgcatcacgaatcatggaggagtttataataaaatctgaatcgaatcgaatagaacagctacagtggatcagtgaacaagtacaggcgatactggcagagatgtttgccgggtcctcttttggattggcacttccgtcagttaatcaaaagttcttgccttttccggcctcctgttatcacttcaccgtcacatcgcttgttgatctgtgtgcagtggatgtcttggcccgggagaggaaaactaggggctctgctacagactacaggccaaagctttccaacctgtaacacactgggatttgtacagtgcctgctcatggcttcttgcaattatgcaacacattatgcgtcgtcttcttcatggaaccagctgaagatgctgtcgatttttatatgtgaggacagagagaactcaagtagtagtagttcggcgtcgactatatgcatatggcaatgttttttgcagggttctactgtgagttacagcacacgcaatttgaagttcaaagatctatagaaaactgaaaacctatgtgacaaatttggcagatctgaatgtctgatgcggcaatgcagaagcctgcatccaccggcggtgccatcaggaattctcgaggaaacagcctgcagccgatggtcgctgtcgccaagacgtcggtttgccgaaaagacggcatgcgagtgcgcgcgctgactcactgcggcagcgtgatcggcattgctaccgcgtccgagcaggcgtgccgatccaaaccaacgcagcgtcagaatcgcctcatgcttcagatggtttatttatagcgataaccggataaggtagcggcgcaggcgggcgaaacaccgaacctttttcacttctccagacaaagagaccatggtgtgagacttcgaatgctggtgccacacagcttagacttgtttatgagaacttaaaattctaagaatctgagatttagagaagctaggctttttcaaaatatggtttctagtttactttttaaattctacagccatagatttttagaatctactaggtaataatatggactgtttatggactgtttagggaaactgaagcttttgtgagaagctgcagttgctaggaactaaacagacactcgattcaaagaccaccggcacaagtagatacaccaaatacacaggatatactaatgtagcatctgatttcagacaccacaatacatcagctgttacactgcatcagacattcagaactatctcatttcgcaagccaaatcatgaaaattgaggctgaacaagcatcccgcttacggatcataccatttaacttgcagaagtgcgcaaaaggattccggttagttacagtaatctagaccacaaacacaggacccatgactaataatgggttctcttggcctattgtttccggatcataccctattgtcacaatttaggggaaattggagaatgaacagttgctattgtgttagcccaaagggcatatatgagtacaatagagataggaaattactaatatacccctaaacacataatactcaacacccctgctcaaatgcaatgtgtatacaatagcattgcatttgaaactaaacacaagataaatgacacactactataaatacaaagtccatgtttgaagatgttgtcgaagcattgctcttgaatgaattagaagaagagaaaaccatcctatcctcaatgaagtagacctcgagccttcacaaactgttcttcagcccttagtaccaaaagccttcacaaactgttctttggctcttcactgattcagagacggtgatgatgacgagatgaaggaccttcacaaactgttcttcggcccttcaatgattgatgatgatgtcaactccgatggggagctggtgatatgacaaagatcagctccgacgtggagcttctggtgatgatagaaggctaacttcgacatggagcgagcgagatagtgataatgattgacaagcatgacttcgacgaaccgatggactttgatggacttgataggaaacataggaaattgatttgtagatgacattgatatactagcaaatgacttaggatactagcaaaagacataagagaacaattgatgcagatgacaagaagcaatatcaaaatcaaaaggacatgcacagggctgtgccttggttttctgttgcctatctcaaactgaagcacaatgatatgtttgcaagaccaaaggatattaattgacttgttgatggcagcagtaagcaagcatagcaaacacaaaatagatctgttgatggaacaattcaacaatcaagatagttgagactatggatggcttcacaaatccggcaagagcagaggccggctgcatgatgagggaagcataactcgatatgggcttctctactgctatttgttgatgtttgaatatggaacaaggtggatctgcatgacacttgcaaattgctgtcgctgctacttgatattagggaagacgatggcttgttgctgttaagtccagtaaccagtctccaagcatctatgtggagaagcagagagaacagagcaggctagaccaagaggaccaggaccttgacctgtgcggcgacgatgcagatggtcacgcgcgcaggcggcggacggaaagctggacgactgacatgggaggaggacggcgctggcggcgatgaagagagcgccgcgaccggccaatgggaatgcggcgacaacgacgagccacggcgagacgcgacgacaagatccgcgacgagtacggcctggctacgactgacgtggtgacgaagaactggatctgaatgcttgttcatgcatccgctgcttgcttgtggatttgattgcttgatgctgcttgttgcttgtgctgactggatctgcttgctgcttgtggacgaacgacgaaacgattggctgccacgattgacggctcgacggtggtggacgacgaagctgacgaggatgtgcacggattggatgggctcgccggtggcgagctgccaccggcgtgccggcgtggactccggatcgacgttagggtttgatcccttgctcttgctctgataccatgtcacaatttaggggaaattggagaatgaacagttgctattgtgttagcccaaagggcatatatgagtacaatagagataggaaattactaatatacccctaaacacataatactcaacaactatagtctagacaaaagaagcatccagcatttgatgaaacagaacttgcgcaagtactcttaaccagattggcagatttcaagagaacatacagttttcagcaaccaccaggaactagggaacaatttgccttccaaaagacgagacaccaatgacaaacctaggagaatgaagaagcataatcaccactctcacagcatcacaagatatcctaaaaggcacgggcatcaaaatgttagcatccccactctgatcattgatcagcagcgggcttacttccttcaccgcctgtgtggttttccggcgaagctgtctgtggctcctgctgctgctgccctgcgctcgtactgggttcaggatggaagttgattgggaacttggtgactcggggcttgtcagccagaatgttcctctgcaccctgtctattagaagctttgccgggggttcctccctcagttgctcatcgtcataatcattgttcacatagtaacctactctcatgaactcctgtcccatgtaggaacatgtcaatagcagcacagtgacgccgattatgtcttcttcacggatctttgagggatccggtgggtcagcctaaaatggtaatggcacatcaattttgagatgcaaaatttaatagttctgtaatctgagtttaaggcttaattgaagcagaaaaaataaacaaggaacgaaagtgtggtagggtttctggatccattgtgcactataaagatattggaatcaaaatattagtattttagtatagcaaaaccaaatttacctggagtacaaaacggtaggtcccaacattgacggggccaacaagcacactctctaattgttggtcataattttcatcttcagcagatccaacatatataagcttccactccagatctaaaaggtaaatcaacaaacctttttatcatcacataccctcaagaaatgaaataggcaaattaaaagcacatatagcatatcttgccactgtccaacacgcatgttactttgtgcaattatcaacaaaccagaaccaatagagtagaggctagagaagaaaagcagcacatttcctgtctatcattgcacaaaagagaaacatctctgaacacttcaaggtcccttgataatgatcaacaccaataacacacaatcaagacagaatgatctcaatcgaatgttgtagaatctcagacacaccaggacactagatgatgtcttgcagaaggatagttaatacagtagaacaatctaccagaatcgatgaagataggagagggaatctgactttttgggacgaaaactccaggttgtgacaggcaaaatatcatttttttttctgcaattgactaagccctcaacaaaaacaatagaggaaaagtataaattcacagtcagctaccaggccttgcccagtagttttttctttattaggaaaatatttataaatatttacaaacaaacatgggaactgaaattacaaggtttgtaaccaatcaaaaaccaattatctgaagggatcattcatcctacacatatgtaggataacctcttttctgaaaccatggagtcaatctgagaaacttgggtctttcttcttaaaaaaattcccaattcgttgttttactgcgcattcaattgatgggcataaatttgtctgtgacatttgcgtaaagtgtgtcagctacactactagtctattatcgcatattgaaaaggggtagcaccaaacatcctgacaacagacactaacaagatcaatctataaactggtaggctagattcgatatcataacatactgccatgaggaacaaagaacatatccaacataataccaatactagagaactccgtgacaattaattttgcaacttgaactgatccctaactaaggcaaaggagaagctaacaaaacaaagagcatcaacttctgtctcggcgcacttctgcaagctgtggccaagcaactagcaaggtgccttctacgagaaatattagtctttcatcaacccatcgactaatttggtcatgaatcaaaagatgataaatgaaacaagtggttccttgagaactggcacatagctcaatggcaaagatcttgccttatatccatgtgacctgcgttcgagccctgctctcggtgctcaccattttgcctatgattaaatgctcagcagaaatattttacttctttcttaatttgatactaagttcctagttagtatcccatataattcttctctcagtggaaaaagagacaagactatgattaaatgctcggcagaaatattttacttctttctcaatttgatgctgagttcctagttagtatcacatattcttctttctaagaaaaaagaaacaagtaattccttagtttcgcctatgattaaatgccgggcaaaaatattttgattatctcttaatttcatactaagttcctagttattatcccacattcttcttctttcgaacaaaaaagaaacaagtgattcctctgatttgtcaagctggccaatgcataagaaacatgctagagtgtgtgcagcattcgctattagcctgccaattacacaaaacgctatcattcaccatgaatgaaatcaacatgatatattaccacccacatcacaaaatttatctggttgtggtggaaaaaatggaacccatggtagagtcatgcatcactccccaacttccggactttacatgctaacgacaacgaaaccaacacggcccaaagcccagcatcgccgaatcgagacggcacccaacgaacacccccaaccacacgaaaccctagcacgccgccacgcgccaacggaaccaggaggaggaggaggaggtaaggggaggcaggccttaccgtcgtcgagggggatgaggcactcgtaggagatctcgaactggaagggattgaggaaggcggtggggttgtccagcaccgccacgttggttatgttcaccgcgctcatcgccgccgccgccgccaacgccaacgccgccgggcggaggaagagaggagaggctcgccgcggaggcgaggaatcgcgcgcggccgcggcgatgggttggagagcggcgaggcgagatggggagggagaggcgagggcggaggagcccttttgtggagggtttatgcggcggcgggaattggggcgggaagccaaatcgggatggcgggagggagccgcctctcgcaggtttggagacgaacgggaaaactgagagggaggagagacttcacgagattccccaattttagtacgcctcccagggtttacaaaaccaaaaccgtactattctcgtagttattacatgcgataatcttatcagtttttaaaattatgatatcacttgtggtaaactggtaaccgtgtgattttcatgataatcacgtggttaccgcggtaaccatcaaactataaaccccccaaacggtttggtaaaccctgcacctctctcggtccggcgattgtaacaataggtccatcctaaacggtttggtaaacccagcacctcccttgctcccgcgattgtaacagtagggccatctcaaacggtttggtaaatccagctcccgcgattgtaacagtaggatcaaacgcatactagaattggagagatttcacatgaattttggaagagtaataaaacaagtttggtaaattttggtgaattaactgcctttgattttggttcgatttctatcctcttatgaatgaattccatgaagagaagttttttctatgtgtgttatagtaacacttcaaaacacaaaacgtgatggcacaaccaaagaactgatgcaatgaatatacatgagaaggtttacatagttcataacagaatgtttgatacgctcttgctaagaattaaactcgcagatgtacagaagacgtcaggttttcgcacgcacaatgctcactgtttcaactttcaacaaggatgttcgcaagtcccggaagaacaccatactactattacacagatgagataaaaataaagggaacagctcgtggacacgtcgaaactcatccatccatcaccggaagacgtggaaaatagatccatggcacagtccggtctcacttttttagaacactgcaacacgaaagcgtggagaaatattagcaaatggtctaacaactatagtaacaagctacctcactagtatgactaaaagaaaatatgcaagaaatataattaagaatgtgggaatggtcttatgtcgtgtaaagagagaatgtcgagaagattgtttacttcggtattgaagcttgtctggaaacaaaaacacttacttgtaaagataagccgcaataccaagaataacacagagcaggacgatatcaatgcagaagttgcgactagatctcagctgataacagttcacgaggagaagcgaataagtatttaactcaagcaatcaaccaagcatgccaagggaagttagtgctaggtgttacctgaagaacggtctcttttagtctgacgttggtattcttcaaatctgtgttggctctatccacctacattcatcagtacaccatataaataagagataaataaactaagcattgctggatattgcacaattgcagaagaggaatccatggctattggagaaccaaccttctcgtccatttcatccatcaagggaacttgcctatccagttcctgatgatcacaaaaattgagcatggtaactatgtttcatataaccattgcatcgtatagtattgtataactcaagatgaagcacagcaaccaacctcattcatatcagatgccatgtttttcagagtttccagcccttcaccgataatatccaaaccttcatcctgcagaatttcaattccatacacaggtcaccttacataagaaatcccacttccagcagtagccaaaaatgaaaaggaagaaaagcgtgttcggggaattaatatattacctgtttcattttgcgcatctcatattcccgacgaaactgatttgattcttctgttcccttaaagtactcatcatcaaagttgccatctgtatgtggcaagcgggaaagtaggtcagctcatggctccttcaagaggaccaacaaaagcatctaacaggatcatgcccgaaatgatgagaaaagaaacagaaaaaccattgctcaaacaactttaggcatgactgcacgcatggttaatcagtcagctcatgactccttcaagaggaccaacaagagcatccaacaggagcatgcccgaaatgatgagaaaagaaacagaaaaccattgctcaaacaactttaggcatgatggcacgcatggttgatcaaaactctgtcaatctgatggttgtatatttcaacactgtcatactgatatagaaacaagagttacctaatcaaaatatacactaacatagtgtactaaaaagtagaagttggcacgtgacattgatgatggtgcggtaccaaaaatgacgtcgtaaaaaagcacatgtgcatatggaagcatgaacctaatattaggattccttcataaattggaaacgcgacctcatacacatgcaggatacttataaaatgaaccgacaaatgcaaaatgtacagcttactgcaatctagaacaaccgatgcgtaggggaagtagaagttggacacatctttaaagaaaaaaaatatgcatattttgtatatcaatatacagaacacacatgtgatatgttgaatgatgcttactaaccagaagtgtcaaacttaatggctccaccagtacgggatcctgaggcgccccaagtcccatttttctttgcacttgaactaccatctggtattgattgtattctatcgggtaaggcagcaaccagatcactacgggtcgcgagttcctcttttgtgagccctttgacctgttgcaagttgcaacaaaatattgaaaaccaattcttcaaaattctaggtgaaaaactgttatgtacaatttatagatatcatataattgaataatgtaaaagcatgttttaaaaatatagtataaccaacacaggcatgtatgaagaaagagtgtcaaggacatcacattgcctagtgcaaacatgcaggtggcgtggacagaaatctttagcaagggaacaacaatcttacaaagttaacactatggcaatgtcaagttaaaatgtagagtacattaagttctgggtcaacagaaaatattggaaggcttaacatcaactgcatcacctttacccaatagcctaattaaaataaataaatctagtctttaataaacacaggctactgaaacgatgaagagacctcatatggattgtgcacagcatatttgacgccaattacagaatacaatgtgtaaccacacgactatgtggtgagttcctctgtgagactatctagaccccagtttcacccgattagtgttcattctagcaatccaatgaaaagtcttgactcgttcatagtaaaatttagaaaagtctagtcccagacagtcgaaaccccaaatttccccccaaaaaatcaaacatagtccaccaatcctaaattccattccatcaacatcaaatggcccatgcaaatcacttcctcaacgacgagagcctccttacagtcatcctaaatttagacatccaccatccgcggtaaggtggaagctactacgagtactacactaaaacaaggagagaccgagtcctcgggccacagtatccgcagatctagcatgattcacccaaactaagaagggggagtgtatagatcagtaaccttcttcagcgcgaggcgctgcagcttgggcaggtcctcctcgacgagcttggccttggttcgccggatctccgcgttgagcgcgaccaccgtggcgcggttcttctcctgcttcgccgcctccgctttctgaaacaaagtgccccccagattcagatcgaggggaggagccagccaaccaccaaatcggacgcggagacagagaggaggaagggaattcgcatccagacctcgacgcattcgttgatgtcggcgtcgatggagccgtagaggcgggcgaaggggtcctcgccggcgacgttggcgccgttgagcctctcgacgtcgtacttgtcgtacttcttgcagatggagtccacccgcgtgaggatgtcgatcacgctcatcttcgcgcgcccccgatcccgatcccgatcacgatccctccgcccgcccgcgagcgagatcgaggcgaggattcgggaggaagcaagcaaccgcgacgctgcccttcctttctccgcccgagcaaaccgaagcagcgcacggtgaaagggggagatgacgagccgaaggtcagagaggctacagcctggccggccggtggcgatcccgtcatgtgggccgcaccaaccggcccggttagattggaatgggccgatttggatgaacttgggttgcatttgggctttctatatgggcctgaatttgaatttccttgggatgcaaaattctctcgaggaaaaaagtacaccgaaggtccctcaacttggcatcgagttacaaaatcgtcccccaaccacaaaaccggatacaacgcatcccccaacttataaaaccagtgcatactgatcccggttttagctgacatggcggctgactcagcgtggaacccacgtgggccccatatgtcaggatgccacgtcggccagcctctcccttcctttcctgtcccctcctttcgtctcgacttgttaggatgcaacgtcatcagcagggcggccggcggtggggagggggttgccagggtgagaggtccgacggccggcgggcgatgcggcggcggcaacgtggcggctgagacacgagagaaggggaaggcagcggaccagcgttgtggcggagaggcggcagcaggcgtgcgagtgtcgtggcggagagggcggaggcggtagctgcggcggagaggcgatggcggcggatgcgagcgtcgtggcggagaggaggcggcggcggcggctgccacgcgggagggcaggccgaaggcgacggcgtgggcgagcgtggaggcacgcgacggcgaggctgccgctccgcccgtcgcctcttctctctcaggtttctcctcgtctgggtgggcaggtcggccggcgggttgggaaggaagggaaggggttggggtgatggcttgctggagctgcttcggctgcagccggtcgatcgcagcaggaggcgaggtccggctgccggagccgttccagctgccggcgcccttgcccagctagccgcatggtctagggacttgttcgctttcatcgttcttcgaattctctccccgtttcttcgtgtactgtttaattggttcttaatctgctcataaattaatcgtcgtcatctatggcctggattgccggatagtatctttgtgcttgtaaattttcagcggctatgcgagagctcgtgccaaatttgatatgcgagagttttgttgtttgtttcgccggcgaccgagcaggacgggtccgggcaccggagcgacaggcaccgcgcgccgtcgcccaccgccacgcggaaacgaccggtgatgcggcagccgcaccggcctgccggaggaccgggcaaatggtgggcgaagcgggcaacgacgcgggccggagtggccggccggcggtgggcaggcacgctgcgggagaggaaggggctgcggcggcaggggcgcagaaggtcaggccgcaccggcaggcggctgtcgacatcgaccatttagagggcagagagaggacaagaacggggagaggagagagcggaggcggatggcgccgacggggagcgggatggggatagcaaggccgtcatcgccgtcgtcgtccatggcgtggggaggccgcctccgctccgcctgtcgcctgcctgccgccgccgacccgcctgcccaccggccgccgaacctcctcctctcccgcctcgccccgtcggcttcctccccaacccgtcggccggcctgcccacccagacgaggtgaaagctgagagagaagaggggaaagagagagatgacgtggcatcctgacatgtgggttccacgctgacatgtgggttccacgctgagtcagctgctacgtcggaaaaaactgaggtcaaaaccgccgagggacctagtttgccctggttttgtaagttggaggatgcgttgtatccggttttgcggttggaggacgattttgtaactcgatgacaagttgagggaccttcggtgtactttttccttctctcgatgccactggattgggccggtttggaccaatttgcgtgcattttgagctttccatgtgggccgtagtttgcattccttttttttttgagaaactaccagaatgcccgtatgttgcaacacgattttaattaattaaagaaaatatcattaatctattattataatcttttaattcaattgatgtagatatttgttcctgacttgtggatttttttagtctcacactctcccttttttttctttctcatgggagtggtcgatatgtgcagcgtctaacaccacatgtcctttttcttcgaaaaaagagttctcccttataacttttataaggagtatagatagtttgcattccttgcttgctgctttttttatagatataatttgcatttccttgttgcactgatcattagctcattagttcatcccatgaggacatgatgacagtatgacactacccagaatgattatttttcacttaatatttggagatttatctcgacgtcactgggtggcatataagggatgcgacaaacactccatatcaatcgaggaatttcctctcgtcttgaattatgactgatcatgacttgtcattagagaagttaaagaaaaagatgggacttatcaggagagactaaaaaaagagtagccctacgagtagtttagtgtgttttgccatactaccatgtgatggtgatgtcaaaaacatggggctcgcgtaaccgcaaaactaaggctgtcccagacacactaatcaaaagcattcgaatttagaactcctataatttgttagtttgtttaatcactctttgtgtctcatgatgattcatgcttgcataattgcatacacttctcgactctaagcttggaccacacaacccgtacataggacgaaaccgaaagcatcacccaaaaaaaaaaaaactaatgtgcccctctttagcatgtcagaataatatggaaaaggcgtcgagcagaaacaaatatgtcaagagtttgacaaacctgacaactgccaatgcagccaatgagccaagcagcaacttgttgatggctggtaggctttcccattatattctggcaaaaactttgcttccatttttctattgacgacgatgagttcgccgattccggccgggccggctcagcttttctccttcggctagcgtttggacgcacacttttgagagaatcgaaacacggagagaagtgctccgatgcatgacacctccttttccacgtacttaacgccaaagggaaacaatgatatgcagtgaacacaaagggattgaccctgcccaggatcatcaatacacgttgaggcttcttcgtgtgtgaaagcatggctaactcgtctggtcaaaggcaaaattgctgctatcctaaaacaaatagtactaggataaataaatgaaagggctaatataacactcgcacacacgcgagacgacaaaatggagagctagcacacacgatagggacggctcgacggtaggggaggaggaataatgcaggcaggatgttactatggccacgtttagttggttagtgtgacaaaaaatttttaaaagtatacagacatacataatatatatttaaagtattaaaggtagactaataacaaaataaattacagatttcacatataaactgtgaggtgaatttattaagtttaattaatccttcattagcaaatgtttactgtagcatcacattgtcaaatcatggcgtaattagactcaaaagattcgtttcgcaatttacatgcaaactgtgcaattggtttttttccatatttaatgcttcatatatgtattcaaatatttgatgtgacggaattttttaaagtttaaattcaaatatttgatgtgacggaattttttaaagtttgaagggaaataaacacggcctatggcgcaaaattgtactacaaactccctttcgcgagacgagagaatgcaacgccgtgccgctctggcggctggggcccaaccgcgaaaggcaatccatccctctctctccccgtcgcgtaaggccgctataaatcaacccgtcgcgggttgcattgcatcggtcggtctcggtcgctgccgtccctgtgcttggagtagacacgagccggtgacgcgcatatcgtcttctgctcgagatcgatcgatcgatcgcttggttggttgctgcgactgcgagggaggccgcgggtggtgaggaggattgtgcaaaaaaaatggggcgcgcgccgtgctgcgacaaggcgagcgtgaagcgggggccgtggtcgccggaggaggacgagcagctgcggagctacgtccagagccacggcatcggcggcaactggatcgcgctcccgcagaaagcaggtcggtattagtgcactgctcgtcgtcgtcgatgctagccggtgatgaaacgccatgtttgtatgtgaattctgatgtctgcgtgttctcttgtgtgattcagggctcaaccgctgcggcaagagctgcaggctccggtggctcaactacctgaggccggacatcaagcacggcggctacaccgagcaggaggaccacatcatctgctcgctctacaactcgattggaagcaggtgatgatttaagccggagatgaatatttcttttttctttcactgatcctgttctgagttcttgaactgactctgtttgcgtgcgttgccaggtggtccatcatcgcgtcgaagctccccggccggactgacaacgacgtcaagaactactggaacaccaagctcaagaagaaagccatgggcgccgtgcagccgcgcgccgccgcctcggcgccgagccaatgcacgtcgtcagcgatggcgccggcgctctcgccggcctcctcgtccgtcaccagctcgagcggcgacgcctgcttcgccgccgccgccaccaccaccaccaccatgtacccgccaccgacgacgccgccgcagcagcagttcatccgcttcgacgcaccacccgcggcggcggcggcggcatccccgaccgacctcgcgcccgtgccaccaccggccaccgtcacggcggacggcgacggcggctgggcgtccgacgccttgtccctcgacgacgtgttcctcggcgagctcacggccggcgagccgctgttcccttacgccgagctgttcagcggcttcgccggcgcggcgccggacagcaaggccaccttggagctctcggcgtgctacttcccgaacatggcggagatgtgggcggcctccgaccacgcctacgccaagccacagggtctctgcaacaccctgacataggaggacacgctaaaacctccattgaattcttgcgtagctgcgaacgcaacggcgatcgatcgatgcgtcgccacttgctactagcataattcttgctctcttttttttttcaatttttttctcttcttcgagtggcccattctctagctggcgttttctcgtgtattatgagtgatcgattattacatgtaaattaatccatagatgtatctgcactgatccaaattctccagcgattacgcttgtcagttcgtacgcgatccatccgttggcttggctctccggtacaccggacaagttagcgcgtcccgaaaacgatacgcccctgtctgtctccctctcgccgagccgaagtcacttcacatgtacagtgtcacagtgacaaatctgacgagacgaaatgttaggtgaggcacaagaggttcagaagaacaacgtgtgcgagacatggaccagttctcgtgcggcgcgcacgcacagtgtcatggacttgacccgttccggttttcgagggccaatggggaggagaggcgtgtggacggttttctgtcacgttacacgtaggagtattttttttcctctcattttgtttttgatttttgcccggtggcaagttgatcctgatcgtatggcctagggggcctatgggccgtggatcacatggtaattgggtgtcattgtttatttgggtagtctcacttggggcatggatagtgtctctttgtaaagtgattgaagacttcaagtgcacgacaaggacgagcctagttgaccctggaaatggagggaggatcggtttcgaagaagcttccttgacaattgtcatgctcgtgatgggctctatacatatgatcagaggagacctctagttaaaagtctctctaactaattactccaaaaaaaagtctctctaactttgctcattgtgggtttatcaatgtctaggcaaattaaaaccatcaataataacatgttaacagtacttaccttgttggattttactagcttagtgtacgccagggatccacacattttccaggtcttcgtggtcggcatgagaaaatccggcaaaagccaagtagaacaaggccaaaggatgggaaaaagccagtgcaatcctccactgtagttttatttggaaagtagatgaatatggattttttttataaaaaacaaacttttatttacatttgaaaacaaaccccaaaataacttattttacaaataaaccatttgtggagaaaacaacaggcaaggtccccttataacgttgcattttttcattttggtcttttaagacaattgagtcgaaaaatcctatataattcaacctaggttataagcggcatctactacacaacggtaatggcagaggattcacttccaaggtgtacatctatctggtttgtcaagcaaatctttaatttcgttgcttgacattgtcttgcgagggatcaagtttcagttttggttaaaaatatggcaccacattttttttacttgttcttaatcactcttcccctatgcgattgttacttttaaccatagttctctttatatagcgtgtattacccgtcaacaacgaggcgtctgtggtgactttgtcaatctccaagatttaccggtccagccttcaaagatgctcataggggtagggtttgtgtgcgtgcgttcataagggtgagggtgcgtgtgtgttgtgagtgtctgcgttgtattgtgtagttctaaaaaaaacgtaattataaaaagacagtgcaattacgtagtaaatataggtaatttattgtgtaaaaacgatttgataatatattttgaaaaatgtggtatgataaatatagctagttccattaagttttagtccatgtttaacatatatttgtacctcgttcgtgtttccttcatacgcatagcagtaacttatgttttgcattttacaaagcagttacgatgagtaggtcattgtagctcatttacatatggagggttgtgattttgttagtaccttgacattgactcaaagcggcacatctcggcatcaaaggtaggtggcaaaatgcattcgtcaaggacaaatagacaaacatgcattgatcgaatagtgccttcagagccgtggacttctgcgttatcagttcgttgaggtatctctttgatttgacatgagaaatggaccatgtgacagcaagaacgaaatgcatggatgcagtgtcctaactggatagcttgctcctttcagaattaaaagctgctcacttgctagctcagataagtgtcaagacatagtaacagtgtcttcagactctgctttggtttgttgctctaactgaagaattattgctcaccaaacggataagcatatgcacatgtatcagcaaccggcattcggttggaccagtactgacgcagattgcaaacattgttaactcctcgcgatgtctaactgtcttgaaaacgtccttagaaatacttataccggtcaagatcacgagtgtattccaaataattaatttcacctacatcgatgacagaggtgtcaacttaaacatccatagcttcacaatcaagacttcaaatgttttgatgcactagaaagcaaaatcagtaacctttactatgatcatatatcacacacgaatggtgcagctgttagtgtaacaccacgtgttgagatttgagaaagcaggcccaaatcaatgcattattgtagctccatttcactatatcaagtaataatagtaatttatatatatcgtagcagcgaacatgtaccattagattaaaatatgaaaggctcagattcattgcagttctttagtgtgcacttgcaatatcgaagtgcaccctgatctcaatccatcacacatgcacacagactgttcatgtcatcgctgatgctgagttggtcgtgaaatcggacgattccacgacggcaagtacagacacacgtcgattgccggcaaccgcaagcaagtgcagtgcagggtgcaagtgcagcagggcccttggaaacgaagtcggagagagaccatccgcccatgccatgtccatgtccgtgtgtgtgcgctcgctgctgttgtctctttctgagctggtactagtaataaaaactagcccgaggattattgcaagaacaaaaggtaagcagcatcttgcagagcatactatcacccaagctcttaaagctgtcggggaaaagggaccctacgttactcagatacatacggatacgcgatacgtcgatacggggatacgacattttccggatacgacattttccaaaaaaaacaaggatacggggatacgtatatatatatatatatatatattgaaaacacacaaaaaaaattaaggaaattacattaatatatattaaaaatacaaaaaaaataaggagcttttataaagaaaaagcgatataatactagtattagtgtagccgattccatatcaatattttgcaattttcttttctataagcaattcaaattaacaagcgattaagatcccaaaaactacatattaatagttcaatcatataactcttgatgactttgcatcaacattagcagccgcactaaccagtaaccactagaattgctagatgcactagcacttgtatctaacaaaaacgatagtactttgtcctaagaaaaacaagaaaggcccaacagattcaagcaagaaatgttcaaagagcatggatttacccggccaggcactcaagcaaacaatgaaaaagctccttgctttgatgttgccagcggccagcctgccaccggcctccgctatgcccggcaacggtcgtggcctccgaggttggcggcgaaggagatgcgccaccgcccagccgcggcagctcttccgtctcgcggagaggacgttgtggcccgcgcacggcaaccaagcgcgctgctgcagccgcgtctctggtggcatcgccgggcacgcacgagagacagccatcaggatgggagcgtatgaggcggcgcatccctgatgcgagcgaagacggaggcacgtcgcggccgtatcgctggcatatctcgatttattttgtttttttaaatcgcgaatatgtgggatacgtacggaatatgtatcggaacatatccgatatgtatccgtatccgttgccgtatcagatacggatacgtcgctctgtagccgtaccaggataacgttgagttagggacctaccttcagaaaatatatattcatggatgctagtacaatccagagtagtgacttcaaaagctgaagatctgagctttttgtaccgctaacaaactcagttttttttaaggctgtgtttagtttctgagattagggagaagtttggggaaagttggtaaattagaaaaaaagttgggagtttatttaagtatgaaagttttgaatgtgatgtgatggaaagttgagagtttgggggaagtttggtgtgaactaaatagggcctaatttgttttagcatcccgtgaaacatttttgctatttctataggccttgtttagttccaaactttttcttcaaactttcaacttttccatcacatcgttccaatttcaaccaaacttctaattttggcgtgaaccaaacttctcaattttctgtgtaacttttggtctcggttattggatatcctgatgcatcatgcattgactgtacatgtcataggtcttctattcattactagtacaatatacaggttttttttgggataaacttggatgctttgttcagcatctgccttttctgtcttgactcttggtaccgcttgtgaacatgtcgacatgttgttcctgctgtttttttttccttttcattttgaggcatgcgtcactaacttatgttcgagtccatttttcagcattattagcttttaaaacaccaatatactatcattaacctattattattatcatcatttttaatgtactatctcttagttgctatatatttttgctatggcatgtggaccttttggctctacagtctacactatcttttttcttctcatattaggatgtgtcctagggcaaaatcttatcttaagttacaatattttgagatggagaagtaaatattggagagttgaggagggtggttaacatgtggctctttagccccacatgttctttttctcctaaagaataagttggagatgggatggtggcagaaccatcaccaccactactatattttaaatgattataggttaataatacatatacataaaagttcatcaaaatattgtaggtcattcacttactcccccatcctaaaatataagcatttttggaacacgacacaatattcgatatgatactcagaccacttataagtttgaagataagatgttttaaataaaaagagttgcatattatgatagtttgtctaataataaatctagtaacatcaattttacatgattgatctttttatttgttttgctattaatagtcaaagttaaaaatggttgacttgacactatattaaaaatacttacattttagaacggatagaatattta

SEQ ID NO: 73886 - DNA, 82152 bp, Oryza sativa
cgccgccgccacgccacgcccgccgccgccgccacgccacgccacgccgtctccgccaaggcctcgcaacgccacgccgccgccgccgtcgccacgccgccgccgccgccgccacgccgccgcgccaaccgccgccccgatgccgccacaccgccgttaatgaacgagaacgagaacgatcgaacgaacgagagcgagaacaaacacgtcaacgtacgttgccgcgacaacgtgaacgagaacgagaacgatcgaacgaacgagagcgagaacgaacacgtcaacgtacgttgccgcgagaacgtgaacgagaacgagaacgatcgaacgaacgagagcgagaacgagaacgatcgaacgaagacaagcgagaacgagggaacgaacgtgaatgagaacaagcgaacgaacgtgaatgagaacgagcgaacgaacgtgaacgagctagggaacgtgaacgagcgaacgaacgaggacgaacgttaacgtgaaatgcaatatatatatatatatatatatatatatatatatatatatatatatatatgtgtgtgtgtgtgtgtgtgtgtgtgtgtgtgtgtgtgtgtgtgtgtgtgtgtgtgtgttacttcgcatttatcctaatacatctttttgtatcttgcagaaaagacgtgttgtcggagtcgtccgtcaagcctgagtggaagagctagccctagaaggaattggagcaggcaagtgacgtaataatataaatgattgttatatttgtaatgcaattaattaagattattagacctgtaattagacttatcatataagattgtgtagtgttctaatattatttgagttttaatataagattattttattgcaaattagacttagtatgacattattgactacggaattggtgcgactcctagcaattgactattgtagtcttaattagacttagcatatacgcacgaaacacttagcatacatgactattttagtcttagcatgtaatattatttgagttttaatataatattactttatttgtaattagacttagtatgtaattattgactacggaattggtgcgacaagtagcaattgactattgtagtcttaattagacttagcatatacgcacgaaacacttagcatatacatgactattttagtcttagcatgtaatattatttgagttttaatataagattattttatttgtaattagacttagtatataattatttactagctagggttgtataatatacgtcacctagacttagcttatatcacgatttgtaattagacttagcacgtaaggttgtgtagggttctaatgtacgacatttacacttagcatacatgacttagattgttaaaacataaatgtctcgtgacttagcagatgtttcttgtatcaacagatggctgaccgcgatgaggaacagatattgtacgatacaatcgcggagggaagcagccagtactggaatgaagaagaggggaacgaggatccaaaccagtacttgaacgaggaagggaacgtggagagggatgcggaggggaaccagcaggggcacgtggaaagggatgtggaggggaaccaggaggaggaggctagtggtagtcaaccctccgttggacagaagagggcacgcgggcaacgaggtgcagcgaagaagcttgagggtcggcacatcataacggaagtggaagaagatggacgtcctagtgccccggccgaagccgccaagaactatgtacgtcacagcggttgggttgtgcgggataacgtgcctgtcagtacggtgtactggcgaagaacaagggcacgcggagatcatgagagctttgtcccagattcggagaaagagatgctgtggaccacaatgctcgagacattcacccttcctgcgggtacagaggacaaagtgaaaaggtggactctgaagaaaatggcagaacagtttcagagcttcaagggagatctgtaccagaagtatatactgaaggggaagacaccaaactttgacacattcccaaagctaagggatcactgggacgagttcgttgcatataagacaggtgaacaagggcaggcgatgatggaaagaaacaaagaaaatgccgccaagaagaagtaccatcaccacttggggtcaggaggctatagcgtcgcgatgccgaagtgggagcagatggaggctagcttgattgagaggggtatcgaaccggcaacagccaattggccggaacgatcgaagttctggtactatgctcacggtggaacgctcaacccagctgatggctcactggtcttcggcgatcagatacgagaggctgcgcgacgactaacagatgcagtggaagcctcctctcagggcacgttccgaccagacagagatagggacgagctgacactcgccctgcagactccagagcatccaggacgaacacgagggaaaggggtgattccttggaagattggtttcaaggaggacatccacacgtacaagagtcggatgaggagcaagagagataccggggcgaagattgcagacctagagttccgagtatcgagctacgaactcaacatgcaagaggaggtggcaagaaaggttgatgaacgcatggccgcacatcggtcccatgatccctagccgaccattcctcctgcaatggtgagcccgtcaggaaaccgtagcagctgcgcctcaacggggcaggtagaatcacagagcatggacgccatgcaaacacaggacgaatcgacctgtcccgttgatgacatcactcagcggacaccatgtgagctacatattcctttcaagaacttatcaataaaggtaagatttagccattccgctagttgctgcttatatatgttgattactaataaataatctctcacaacatgaaggtggcgtcgggcatggccatcccaacggacccttcaggtacttaccactgcaggccgattccagcaggatactcgaaggtcgaagttgagttggtcgaaagcgcgtacgaggacctcgagctggattaccctggaggagacggtgagacgcatctacgagacacatgccatgccattattctatggcgcaggcggtacatcatcctccctgggcgacaagcggcgtctcgtgcaccatctcctccggctccgccatctcctcctcaggatcctgcaccgtctcctcctcatgctccgccagcaccgtctccacctcaggctccagcatcgactcctcctcaggatcctgcaccgactcctcctcgtgctcctacacctactcccccgcaagctcctcttccggcaccttcaaagtcaaggccccccccagctccaccacctgcccacacaagggcaacgaagaaggcgaaagttgacgccgccaagaacaaggacccggggtacgattgcacgcaagaggagcttgacgcttacgttgcatcagaagtcaagagacaattcaagcctcgaagtccagaaaagaagattcctatagaccccagtgtcaggaacttcttcaggggtatgtctgcatctgtcaaggaggccatcaagctatcggactatgagcgaacgctgaagaaagcatcttctggaaagtccaaaccagtccctcagcttagagagcaaccaaaccaggagatcgagccgttggtgaccggtaaagaaatgacgatagaacaatttattactgacaccggtctaactacggatcaattgctaggagtcgcaccaatcgaaaaggcggaagtgaaatacatgtacgaactcggtaaaccgcttgtcaagcctgagctgctgcagtccctacccacacaaatgtacaagttccatcagctgtacatggagatgagcgccaccggtagagagatgatcggagcgaggatcagggacacggacttcttgcaaggagatgacattctctggatcaatttcaggggaatctacgaactataccagctggacgccctcgacgtctctattatgagttgctggattttgtaagtatatcgttcagttagatttcttactatacgtctcctttaattaattaggtccttgtatataagtagactatagaaaataatatactccctttttatcgttgtagaatggagattcaaagggcccgacggcggagggttttcgatactggattcatcgaccctcggaaagtaaacgtcgcaatgctcgaccaatatccacaagaaacagaggacaatctcgtccatctcctgaaggcgcagcattacaagacgttcatactgttgccatacaacacagagttagtttaattttgctgtcttcctacataccaaatttcattcccgtacgaacttgctaagtgtttcatatgtaatgcatcccatgcacattgcagattccactgggtgcttttactcttcgacctggaggcctgcaccgtcaacgtatatgactcaatggataaaaaagagtctacgtttgacaaggttttcgaacttatagacaggtaccgtcataagttcctttgttaattaagaaaatcttgttatgttaattgctactacgaatcatagctttaaactccatgtagggcttggtatcggttccgtcatttggttcgcggcaaatggagagaaagacttaggcggaagttcaaatttcctgtgagtacacatgctctacatttatatttctccgattcaaatacatacaagtgtatattaattagatctctcgttgtttgtcatttatttgtagtgcgcaaagcaaaagcagggaactaacttgtgcggctattacgtgtgcgagtattgccactgccttgcagaccaaatcatcaccacaagagagctcgatgtacgtacaaataaattcaaaatttcattacgtagcgatttcttgtttaattactaatcaatttcatacattcatatagtttattcgcatgagggataacctgaccacacacaaggaatttatcgcggcggttcaagaacaactcatgggattcatcaacgaagaaatccttgatcccaagggtgaattctactacgacggaaacacaattcaccggtccttagcttctgagctagcagcgagtactactatgtcgaaatcgtagctagctaggacatataatggattgtaattaatacatgactacatatgtttctatatgcatgtgtacacattttctataatgtaaatatattttggtcatatatatatctatatacatatgcatttgcataacatatatatgtataaatacatatatattatgcatgtatatacatataatataatataatatatatatatatacatatatatatgtatgcatatatatgtattgaaacatatatatgcatggtttatatatatatatatatatatatatatatatatatatatatatatatatatatatatatatatatatataaaccatgcagcaacagggccatgcaaaaaaaaaaaggtcagcttgatctttactcccggttatttcacccgggactaaagatagcgatctttagtcccggattggtactcccggtttggaaaccgggactaaagggggttacgaaccgggactacaaagggtttctccaccagtggtatatgcaattgactaatggacatataagataaatacatgacgggtcatatagtaggggcgctgattttctataatattccctgcaatgatatgtcttcctacaatgacacgttgtaaacaagaaaaaaaggaaaaatgaacgtaagaatttttacaattctttcggaaatgagttgtttatgaatgaaatcgagatatttcaacgaaatcgaatggggccctggtttggtgaagcagctatactagattgctttcctgtgtttcaggactgcactcttattcattcctgtcttgtgctgtatctagctagggccaattaatagagtatttttcttgaggtaattagtggattatatggattcatttactgttcaactaggggtagtacatgcccattgtttcattgagacatgcacagaggcaccattcgagaggcgttttccctccaatgcattacatgaaagtcatcaacaatccataaacaatcatatgcttctcttcttatcatggggagaatcctattctaaaccaacatggcacttttgtgcatcaaacattaacaaagcaaaggaaggctataaagtaatccaatatacatacactggtaagaaacaccagggaccgtttctctgagcggctaaacgcgcatgttacctctactttgcatgctactccagcatgcagtagaaaaagggggaaaaggatagtgaaagaagaaaaggagtgaagcttccatgcctaggtgagctgataagtgacatgcacatggaaggagttgttaagtccaggcctaagcatgctttaacaaaccctaatcccccactaataagatagattaacgctgctaccattgacaagccaatgagttatccttaattaagcgatcactgtctgcacaaaaggtgcatcatggattacttattgttagctccatgcatgcagctagcgagctacgcaagttagttatgctgctgagaggagttcacgtttaccatcctgttagggtattagggtgagtgatccacccactcaccataaacaaatttacacataaaaatttacagaagtaaatcagaagcaacagtcacacttgcaatttaagtcaaaaaagcaaaaagggcatgttcttataaacgttatcatcacttttgacctacaaacctgccaactttacaaatactctgaatgtaagtcgattgaacgagttacatatgtcaaatttggttagctctatttctagtgaagaacaactgaacaagttcagaagacaatgcataagtagtttgatgacaccgaagcacctgtatctgttcctgctactgctagtactccatattttagtcgaattctttgaccagtttgataatcatagtgtcttttctgcgtgccataatttgctttcctcattcatcaatcattctgatcgtgcacctccctcctctcatggacaggaaagtatattttccttcatcacaagaaaagcaaagcagagaggagagaggaggaggcagctcgacagtgcagtcaaacagaaagcccattcgatccctttctccactgtcctcctctccaatgtaaggtccatttctccctgctccaaaatacaaatgtacacatgcttgctgctgcatggtccagaaggtttgcacacatttataaacattattggtccagtttaatttactgctaattcacttgtttatcagccccaacatgcctcggaagccgtgcaagtgcgttttgcagtcccccacaaacatgcctcccattctctgtccccataaggccacaaccattgttaaaaccatcaactttctccacctcttcagtcttcatcctttatatataagcaaacaactctttcttcttctactcctcatcactgtccctctcctgcttgcttctttctgctccagctaagctcttcctctctggaagaacagctttgcaatcttgctatctctcataagctcaaatggagctcagtggtagctgtagaagtattgtctggccaatgtgtggaggagatacaggtgaggagcctgaagggaagcctcacagataggcttgggagagtgtccgtttgctcccactgctagctaagctctctgcttgctccatgagctgagcatgaggaggaggaagatgcagatggtgtgagcttgtggggaattgaggcttcatggtccgagatatatatatctctctctaggtatctcaaattagtagctacttactaattagtcttcctagttagattatttcttttccttttctttagtttcttcttcttcttcttccttgtttttccttttttggtttcttgagaagctctaagatgaggggcttcttggctagaggcttggggttctacctggtttcagatcttgatgccttcatggtcttctaagtaatgcaataaacactagtgttggaggtagcctcaagcttggaatgaatcgagttacaattcattgtaatgcatctataatctctgtgtttttgcatatgttatctgctgctgcaacttaacactccagtgtgcttttatgctgctcttgatgacgtggtacgagtaatatacaatcatgtggtaatttgattgatttatttattttttgcaagaagaccataccaaatttctttcagaaaaacaaaattcgtctgcagaaatgcagaagcatgtggataacgctctacacttgcggacaaaagtgatagtattagttttaatccttcaaacaattctaatgaaaatctatgctaacaggtgtacagcattaggctgaaaaatgcagttgtacagcatcaaatgcagcgaaatgcaggttttgtagtcgggacaaaagctgtgaagtctttctggtcgccaccagttttaggttgctaatcccagagggagtaaagtattcaacgtgacagagcaattgagagcgagagaaagtacaccagagagagcttaaaaatttgttactcctacagtttggtcacagtacagcaaggcgtcagaaccgttaaagttctctgaagtctgaagcgccccaacggtgaagtgagtggagtacatgcaatctctgcatcatcatcaaatgcgtgcaacgcaatccatctctgcacccaaaacgcaccgatgcttcggtagatcacgcacactgccgttacactgttacgcgagagccttgtgtaggagcagcaaactagactggcaacatagaggcagattcagagagtcagtactggtactacgagtaggagtagcttaggctaggcaggggcgctgggaggcaaaggcaaacgcagcgtgggagtagagtagagagggctgtggggtggcgtgccgttgtcctggcttgcctcaatgcctcccctccgagctctggctgttaaaatggtgcagggaatattcagcggctgctgcgcaggcagtggtcgtcgaatgcatgcactgcagcgccctgtgctgtgttgtgctctcgtatggccccctggctcctgcatccatcctctctcctctagctctagccctcctgccctgcgctgcctgcctgcctgcctgccgctttcgcttttgcctttagctgctgtgacaccactccgcctctctctcgcccgcccggttttgctggtggtggtggagcggtggatgcgagcgagcgagcgcaacaacagcgagccagccaagctagccactgatctcgttatcctcgtcctgttgctatcttgtgtggcgttttggacgattctggatacggggttttcaccccctccgaaaccaagggggccatggccgtggaattgtcatttgtgtcaatcacggcgcattccttggcagccattgttgtacggaatttctatttaaatccttcatagtaggtaggattagggatttttttacatagagatttcggtgtgtatcggcgattgtttccgttttgtgttgttcggaaacaaatcgaatcgatgctaccccgttttaaaatatactaccatttcatgttttaagactttctagcactgtttatatttatatagatgttaatgaatctagacgcacatatatatctagattcatcgatatatatgtaaatgtgggtaatgttaaaaagtcttataatatgaaacggaggaagtaacaattattctaatttgtttcagtatataataatttgtttacatctttattcgattctggttttgttttgttttaaaaaaacggtagcctcgatttgaccatttttccgacagtgtcttcgtcccgacagggctggcattccacagacaacccggcgcgacgacgaggcgatcgaatcgatggatcgtgcggtgacaagcgttcgtccgtggggttggattttagcgtttccctttgtcgagtttccatggatgcgtgcgtgatcttgacatgttgatcgacgccgcgggctgccaaagccaaagctggtgtgtagatgtgccgatcgatgaggaaacccatagcatatggcatggacggcggatcgacggatggattgacgtttgacaccactaactcacggagcgacgggtagtacagtacagtaggggcctcctcctcctccccgattcttcttcgtgatccgtgcacagtgcacgatgccctgcacgacgctacgcgacgatcccctcaagacacgcatcgctctgaacacgtctcatgtagctgcgtggcactgtgcatacatacgactacgtcttaccatatggaaacgaatcaacgatcgacttcgctgtgcgtgaggtggcatcaatagtacttgtagtagtgctgcatgcgatgcatgacagaggcgcatcagggagagacgtgcagggtgtagcgtagtgtatgcactgtacatgcgacaaggagtagcagtacatcgccaaaaacctgcgatcagaaaggacgctagtatcacaattttgatgtcgttcgtaccggctctcaaatttgaacgtacactgatgccctgacggagaatatcagaaattgtatgcagcaatagtagaaaatttgcattcacttcctgtagaaaaaaagtatttcctttcatgttacttatcatctcatggatcgtcctttcagtaatacactactccttgaaaaaaacatctcggcgtaccaaaaatttaaacttaaaattttgatatctcgagttattaagtaacaagaggtattaagttttactgcataataaaatatgtggtatctctcttggtattttttcaaagaaggtggaattaacactgatagtacagtacaaagacatgaagtatgatgcactccatgcatgcccgcccggagttgctggcagtgtactccaattaatcccatctcttttccccgatggtccaagatcaacaaagacacgctctgtgcaatgggccagcctctcgtggggacaaagtgcaaagtagctgaagacagtttgatatagattcttcagttcagtcccgggtgtgcacggcagtagtactagatatcctagtagtagtagaaagatcatgcgtgcttgcatgcatgggtgcagatcagatcagagcaaggccaaattaacacccaacgcacgcagggggagtcaatggttttcctgagcaccagggcaaagccattaagaggaacaggagcgaaaccgcagctgagttgcaacaaatgcgtagcagcagcagcagatcgtgcatgggcatgcaacgcggcctccggcctcggcatctcgggtctcagttgagctagcagacgagcaacagctggccgctaaagctcacggaaacgaaggcttttacgttattacagaagtttgcaggaacatgaagtggatagtagctttgacttggcagaccgtggagtacccatgcagttgtgcacaaggctcttgtacatgccacgagcacgtgaattgttacgagaaggaaatgtgttttggggttccattataatgcgtgatgaggacaaggcattgatgggtggtggcgctgcgtaaagcgggtgccgtaccctgctgcgagcaacgagtaaaaaaaaaagaggcagaggcagaggcaggcagcaaggatgggacgccggagtcagtagtggcaggcggacaagacgtgagatccgggagatgctgctgccgctgcctccgcgctcacagtcacagtagtggtgtgccgcgcgacgggacgggacgtgacaccgcgcgcgctgcgccgttgcgcgcggcggcggcggcgtcgcctccgtagccatacgcgcgcgcgtgcgtgcgtgcggctgcgccgtgccacccgcgcagaattgatgggtgggtcggcggctgcggctcaccccgtcggggcgtagagtattgggcatgcgaccgcgaccggcacgcgcgctcgcgtttcggcggggtgcgtgatgcgtcggcgtgcagttacgagtttgcctaccgctgcggcgcacgtaccgcgcgcgtggctcgcttcatgggagtgggactcgccgtgagaccgcgagttcgtgtcgatgcatacggcctcttctcttcacaatgcgcgtgagagacgcacgcagaaatgcgggagtagtagtttgtttgatgcaactttgcagctcttcgtcagtgaacatacatgaagtttaattttgaaattagttccaaccaagtcgttgtagtatagtggtgagtattcccgcctgtcacgcgggtgacccgggttcgatccccggcaacggcgtaatccttttttccccagttgatttgcttcaattgccattgtctgcccttcttttttcccacttgatttacttcaattgccattatctgccaatatcggattttcccccctttttttggtttacttcaattgctaatatgagctgatttgcttcaattgccattatctgccaatatcgattttttttttctttttttggtttacttcaattgctaatatgagttgatttgcttcaattgccattatctgccaatattggattttttttctctttttttggttcgcttcaattgccaatatggaacgatgaatgcttgttttctgatttgcttcaatgaccaaattatggaatgctgaatgtccgttcagtttagcaaagaactcatcaggcatatacagtctactagctacgatcatccacctgaatgcctgcacacacagcagtggtcaatgcaacaaagacgacattttcttgtcttttcattacaacattttatactcctgctgctgctctagattcaattctgacatttattttgccaggcaaaagggacgcataacaccaacacgcacgtaaaagaacaacagcccacgcgcggttcgcattctcgtccatctgagacaatcaaacgatctttttaaataatacattttctcagtctcagacaccaacggcgacgcagaaacaatttcttctatacctggtattccaaaaaaaagaaaaaaaaagttctatgcgactatgcctaagcaatctagatatgacactattaccaaaataaataaaagaagaaaaaaatgcattatctacatggaccaggcaacagtcagcaaaagctgagcgaattgtaagtctacctcctgagagaacaaagcatggaactttggcacaaaaccaatgcaccatctcctgctcacgccattgcatactccttccaagtggatctccatgttgccatgcaactccgttgctaccacaaactgtagggaagtgtcgtcgtcgccaccgtatttgccatcgaaaagctcaatgtcatcagctatgcggcctgaccgagctgtgcagcgcaaatcaatgcctccgggaggcagcctgagcggctggagctcaacagtggcctcgacgcctttcagaatcctggcgagcttcaggcgcatcattggagtagagcggttgccacaaggtagaatggacagctcattgactctggaccaatcgtgccgatatatactaggatgctctactactccttggatcagctcacggtaactgtcaatgccattacctgttctctttatcttcaggttgaactcgagcaagatttcaggattggtatgaatggctctccgagggctcaatgttggcagccgcaaaacaccctgcagagtaaagcaatatggccacatagagatttcattatttccgcttagagaagaagtcctgaaaagaaatgtggaagagatggagtgcatacatgtcgtgatacgacggtgaaagggtggcctatttctctgttgaaaatgtaattgcgccgtccatcacgtaagtccctaatcgcgacgaatccggatatgtcgagtttgcaggaatgaagagaatcagctacaatgatctcgagggtgtaaacttgcaagatgctgctgggtgcacaagtacaccactccaaacaaacaagtctaggatgcagattcctcttaggttgcaactttgctggattcaaagaattacttaattagcctggattatgatatgcaacatatgaaaaatacaaatcaggccaaagcaaacaataaccagtactcagacctttgtcttacagaaaagaatgtatgatttggagaaaaagtctgacacaagtgaatctgtctagttatttgaattgcaaagttggctccttagcgaagccccaagcggtaaccaaattcctcatgtgacataacacatggcctgatggttaaggaaaagtgcccttttcattttttgagtgttataatatatgttcttttccccctctataacactacatcaaggttggcacactgataactattgcttgcaatgaacacaaaagaaagccgcctattcatatggtaaactggctactactgctgattaacatgtgtagcctttctacctatattataaggattggtaggagttttctatgtgaccacaatccattttgctatatagagtatggtgattaagtccagtaccaatatatactgtattagtcctactgatcagtgatcaccacttttctacccaagataacaagaaatcagtatatatgtgtaaatattagtgctcatggagaagcagttcagattgatataagatgtgcacttacattccgatttgtcggacaaggtccagtagtataataacaccgcatatggctcatccgttgggagctctgcttttgtagtgctcctgctgcctgggttacacatgaaataattcgaacccctccttggttcctgcactggttgtatgattggctccatgaccagcttaagctgctccttgcgccactcttccctcttctgaatttcctcctcagttggaaacttgggtacatatggctctgaaaccttcgcccaatcagattcctcaggagattcaaacaacaagctgtactcgccttctccttcccctccccctgatagtgtcccaggtagagataacgcattaagcctcaactcctcgttttcttgctgcttctgctgatacagaagtccctgatcttcctctgcttctaatgcaaagatggcactgagtccaaaatcatgttcttgccagtctatccttgcggcatttagccggcaaagcttcctattgagctgaagaagcaaacatgaacatgatattgggttgttatcatcaaccttccattctagaacttggtgtgtccagttatctgctgaggtgaaggatgggaatgcacagctgttgtcatcatctccgcaatggatgctcaccgtgattccactccacccagtaagaacaacgccgtcgttgagccatattgctagattgtccactaggaacttgaaactaaaaatctgatccacctgcggtgacatcgacaccattgccacaggtctcaatgcgactgtcttgcctctttgttctgtgaagccatccatctttgggtccaaatagccttccacaaatcccactgcttgaagctccatcgtcgtcaatggcagaacgaacctgtcatagcaggcaagcctccagcgcatgtcgcgaggacattcttgttccacgaagctgcagcgaacttccccattggtgcccactgatagttcgaaccttcggtgcatcgcttcatcaggcgattcccactttatgtccccatggcctagaggaatgtaggcaagaggcttcatctccagctcctccctttccctgtccaactcttcttgcttcctcctctcctgctcttgcttctcgtgaagtatcatctcttcttgctcctcttgctcatacatctggtagagattcctggccagatcctccaatgcggccgtgatgttgatgaattcatggccgaccctagcatacagcttctcctccgtccatttggaggggatacggaaccatcgctcggagaaggcgatggtgactgttgagccgtcggggggcagaacgaacagcttgtcatggaggcgcaccgcgagtcttgcgatccacatgttggtagtgagggcaaggcggtcgcctccggcgccgggaagccgcctgatgacggcgaccaccctcaccggcggggagcccgccgccacgacggccgcgaccatctcggccttgcgggacagcccggactgcgatgtgctgaggcggaagcaggagagggcgcccacctggccgccgtcatcttccagctctaggcaacacccgtcggcggcgaggcgggcgaggcggagggggaacccgccctctcgctcggcgcagaagcgacgggtctccctgtgcgaccacaatgcctgccctctcttggaggagagcttgatcctgaaaagccgatggcaatggcgcggcggcgcggcgtccctctccttgccgtagattggtctagcgtactgccactcgtggagcaccgggtcgcccccctcgaacatgtcgaacggggcgaacagctgatccaatagacgcagatgaatctcctcctcttcctccttttgatgagccgctttctcttccagaaagatgggggatgaacaagcctccatggcttgtcgcccgcgtgtctgctactaccattgaatccgtctccgtcgccgcctccgccgccgacacgatcatatggaattgtttttcagaatctaaagcaaaattagccgccgccgccgcggctgcgatcttgacactgtcgtttgcgtcgccgccgcaaaaccctagaggcctagccgcgctttcggtcaataaattggtcgccacggatctctgtattgttggtcaggttcgctccgattcggaagaagtcttcaaagttttagacctcctcctcctcttgatcagccgcttcgtctttgaggccaatggaggtggcggagaagctctcatgggttggcacgcgcgggcggactatcatcttctccatcgcgccggccgccgcaatgccggcgctggggacgacgccgcgtcgaaccctagccgcttgccgcgcgcggcttctgttaatgcttaatgccagcgcggaatctccggcggatttcggagggagtttgtatcgattcacgtaatcgatcggagtctggactctggactagaagctgatcatcctgttcactggaacggttcgagtgtctcgttttctctcgggcctggtttagagcatgcccaacagattacttattctattccctatccttaaattaaagaaattttaaccaaaattctcatccaacagattccctaaccaacatcccaataatccaggttcccatattcgtatatgtcgttactcatttgcagggaaccattttttcttcccaatcgtggtcgtcgctgcctcgcgcgcgtagggggaaaattgttcccgcgctccttttctcgccctcctcgccagtcgccagcaacaaaattcctcttcctcccaggcgtcggcagcggctttccaggcggtgaagcaacggccaaccccttcctcgtaggcgtcgtcgactgagttccacgcggagatgcagcggtcgtccccttcctctcggtcgcaggggtcggcgtcggtgttgctccaggcagcgatgcagcggccatgcccttcctctcaggtgcaggcgccggcgttgctccaagcggcgatgcagccgccgtcctcttcctcgcaggcgtcggcgtcggcgttgttccagggggcgcccgcacgtcgaccaccgcctcctcgatttggggccgacggccctctgcgccccgcaccgccgcctcgccgtcgtctcggtctgcctcatcctcaacctccctactccggtgtgcaggcgacaaagtccatggagggacatgctccatgggagacactgaatcccctcttacacgaagctcctggcgtcgatttctccatagcttattctgtgagtgatgaagaattcctccataggagcaatttcggtaaagctatccctgattcgttcgatgtttagattaattttcagagtgttgcagcctgatctgatgtccattctgtgactgacttccccggcttgaaattcaggaattgctacggcttctctttggtgttccgttttttaacaaatcgcagcagtcaggacactggttgactggctggtgatgatggcgctaggtcacggcggcgcaggtccggggaggaagaagtcgatcagcgctggtgcgggagggagaagacgtgcacaagtaccgaactgggccccaccttgcttacgtggcaaactaacaaatgacagggaattgatttttaggcatctcttggaggagggggtcattgttgggcccaatttttattttggtattcctaattcagattttttgggaatcaaatattgggtgattgttgggcatgctcttagttcccaaatttttcttcaaacttttaactttttcatcacatcaaaatttttctacacacataaactttcaattttttttctttaaacttccaattttagttaaactttcaattttagcgtggaactaaacacagcctcggatgtactccaatattggaagaattctctagttactcctcctaaaatataagtattgttttaaatttgatatactcttcgagatgctactttgaacaataacatttatcttcgagatttgaacctcaaaccacgctcatttctcacggttgacctcgtcgagcagctagtcgccttgtgggaagcggtccggaatgtgcacttagacactggagaaccggatcagattgcctggaagttcacaagcaacgagcgctacacggcctcctcggcctaccatgcgcaatgttgtggggcgccgagcacaaacttcaactccttgatttggaaagcctgggcaccggggaaatgcaaatttcatgcttggcttatcatccagaatagagtctggacatcaggtcgcttgcgattagggggtggcaaaataacggttgttgctctttttactgccgcgaggctaagacggcactgcacctcgttgccacttgtagatataccaagatgatttggcaccttgtctctgcatgggtgggctatcaacagctggagccgactgaatgggaggaaacccagtctgtcaaacaatagtgggagagcctcgcaaacactcctagtgtcccaagaagggggcttcgatcgctcatcctattagtcgtctgggaaatctggaaagagagaaatcggcggatctttgatcataaagaggtggcaacgagttttctgctaacgagaatcaaagaggaggttagcctttggactttagcaggggccaaacggttgcgtgagttaatcccgcattctgtatagtgtacatctatagtgcttctctttttccctttgtcccttggggttatattttctcatgttcaattcaatgaaaaggcactcgtgttgttttccgttaaaaaaaataacatttataaaagtaaggtgtttatataaaaaaaagttgcatatattatgatagtttgtttaaatctagtaacaccaattttacatgattgatctttttaatttttttactatcaatagtcaaaattaaaaatgttaaacctgtcactattctaaaaatgcttatattttggagcggagaaagtattatgtgcggccagcagccaaggacaaagacaaagcatgttgcaattcttgagtaaagggaaaggagcaaataatgttagattcagagctctatccatgatctgcaaaaaaatatatcaaaatcgtccatataaatcaacaaattgatagccttgctaggtgggaaaagaagggatagccctgtaatatgaagctctgaacttgatcttgacttcttgctcctgtagatttagctgaaacaaaccaaaaatcatgcactggactactggagtaaaaaggtactactagtagccaccataattatcggcgaaagggatgtttagtttttcagcttagctcagaaaattatgaatatcccgaaacgaagatgtaactgaaatcaggagctaaaactgatttgttttccctagctgatgaaagatttggtttcatccattgagatccggagctattttttttttcaggctagcatgtcttcctttctcaagccatcatggaaaccacctcactggtcactgcaaagccagcagggagccaactcttctagcttaaggtattgtacaactctatattgtactcccgatattgaacagtgcaaaatgttgagctcagtgaatacccaattttattcacatatatacatatactgatattgaacagtgcaaaatgttgagctcagtgcttcacttgtttttttttttggcaatattgctgtgtatgaaatctgtgttcaattttgctgtggtccattttggcaataatacacatactcaaggcactataacctcaaggaattcatggagcaactgccatctgaactgcacatgtatcagttttaatcaacaagaatgaatttctcaggcaaaaagaaaacattcagttcactgttgtgtgagttctggcatgcaaagcatgtttggacagcatgtcctgatagaaaaaagaacactgaattctgcacgattcttcactggctcttgttccatatatgccgatttgcaatttgcaaccaacaatacagacagactacagacaaaatatatgatttcttccaattattccaattgacattacagacacaattccaatttgtcatacttacacaacacaaatttgtcaagctcacaagattctactatacaccatccagaatttctaccaaaaaatttggcactacacaaacacttaaatttgcatgctcacatggcaaatttctaccaaaaaatggatttttttttccgaactgtacagtgcggaagccctattgaccagaactccagaagttaacgcctcgaaccattgcatttgcatgttggatgttagaagttcaggttcagattctgaagttcagtttcactgtagctttgctgggacatctgaagagtctacatattcaggaaaaagaaagttcattactccaaggtgaatcaagattcagtacttgagtaactcaattgagtaactccgaggtgaatcaagattcagaacttgagtagtaatccttgtatgcaaagattacaccatgaactattagctgcaactctgatgatttactgctcaaactgcaaaaaatcagcttgctctcagaaacgcggcagcatgagttacaaggacctttgcacattccctgcaatatccaaacaatcacattcctttttttcctgaaaacatgcagtcattgagaagttcagaattcaaattcatgaaaacagaagttcagaacttcgagatcagggaaggttcagaacgcacataagcagcatggtgctcagggtgcattcacacagcagagtgcaattccatggcacacctgctgcatggacaaaactgcggagagcgatcaatctagttctcttgtcaacaacacatcgaataaaatatgtcaaaccaaaaataacagggaagaatgaagctagaattttatattgctttttatatccaccaaatggttatttacaaaagaaaggaacaaatgtgacttcccttcgacaatgaaatgaccaaataagccaaaaggtaacttgaacaaatgtgacttcacatggcaagtgattgatatccgaaatggatagtaggatttggatttgaacccgacaagttcacaacaatgctccaaatgaagttttaccattctttccatagctaaaagaaatttaatgtaaaccagttaactgcaaaaacctcaaatagcagagttttagtttagaggaaggaatgatccatatattatttggaacggcaccattagaaaactaccattgatcttttcatttgtcaggaatggtcctgttgctaggaacttgcaaaatagctgataaaagaatatggcagagcaaattttgtgcattcagaattcagaaatatgcttggcaactaatagccagatgtagcactaaaatcacaacatgccaccaataactcatattagtaaaaacccaaaagatggccatattgtaaaataatgaggcatgagaaaggttgaatctggatagcaacagaaaacctaccttttattttaaagaaacctagcattgtcttctccttcaacatatttccaaaacagattatagccaaaaaaaggcacgccacaaaaaacacagggacatttggtacagggcttaatatgtagcatgcatgatttaatggaatgccatggctttagaataaatatctacatgaaagaaattgcagaagaacaaacatagatatatcatatatgaaaggaagagtagtcatattagtacaccaaaaagatgaccatcttgtaaaataatgagccatgagaaaggttgaatctggataagaatagaaagcctaccttttatttaaagaaacctacaattttcttctcctccaacatatttccacaccagattgtagcaaaaaaaaaaacgccacaaaaaacacagggacatttagtacagggtaagtaatatatacatgatttaacggaatgccatggctttagaataaatatctacacgaaagaagccgcagaagaacaaagatagatatatcatatatgaaaggaagagtagagaaagaaacggaatgacctgaatttttttttttgtaatatctgagtatccccaaccattttcagtgaataagtgtaaaaggtactacattctgtccataggacacactgaagtctgaaatttcataaaaaatgttcacctgcaatataagtatttgcccaatagatgcctcttatcactggtttctaatgtttaggtgtaaatggttgcctacttatactaattcaagtgagattaccttcacaccaccgagctgacaatgttaaaaaggtgaattttggcaagtccttggccactataaagactgcactcttctccttcgccgatgcctgcacacagcaacaaaaaactaatgcgaaatagcatatatgtccccttaaactggccctcagatgtttgttacacctacaaaagcagaaacttgatattgtcacatgctcacaggcatagcaacagtgtgagagacaattattacagtaaaataatcagtgagagagagagagagagagagatgtaattttaccatctatatttcatcttgctccagattcttatccaatcctcagaagaacttgtgaacttcaggagtttttttttttggtctaaatgtaaagctaatctggatgtgattgtagaagatgttatctaaatgactacatccagtcagaaccatatcgcaactggtttgcagcattaggggtgtcctaaaaaaagatgttctgattttcctatcatctgaatgttcagccacatcatcggtagccactaaattttataaaacaatttgttttataaaatgttctatgcttgaacaatatagatacgaaacagtatatagcatctagtatcatagattacatagctagaagaaaacacactgcataacgttgtgcagtttcacgcaggcattatctacatggaccaggcaatagtcagcaagagctgagcaaattggaagtctacctcctgagagaacaaagcatggaactttggcacaaaatcaatgcaccatctctggctcacaccattacatactgcttccaagtggatctccatgttgccatgcagctccgttgccaccacaaactgtagggaggtgtcgtcaccaccgtatttgccatcaaaaagctcaatgtcatcagctatacggcctgaccgagctgtgcatcgcaaatcaatgcctccaggaggcagcctgagcagctggagctcaacagtggcctcgacgcctttcgaaatcacggcgagcttcaggcgcatcattggagtagagttgttgccacaaggtacaatggacagctcattgactctggaccaatcgcgccgatatatactaggatgttctactactccttggatcagatcatggtaactgtgaatgccattacctgttctcttcatcttcaggttgaactcgagcaagattttaggattggtatgaatggctctccgagggctcaatgttggcagctgcaaaacaccctgcagagtaaagcaatatgcccatatagagctttcatcatttccgcttagagaataagttgtgaaaagatatgtggaagagatggagtgcatacatgttgtgatacgacagtgaaagggtggtccatttctctgttgaaaatgtaattgcgccgtccatcacgtaagtccctaatcgcaacgaaaccggatatgtcgagtttgcaggaatgaagagaatcagctacaatgatctcgagggcgtaaacttgcaacatgctgctgggtgaacaagtacaccactccaaacaaacaagtctaggatacaccttcctcttaggtttcaactttgctggattcaaagagttacttaattagcctggattacaaatcgggccaaagcaaacaataactagtatccagaactttgtcttagagaaaagaatgcatgatttggagaagaagtcttacacacgtgcatctgtttagttatttgaactgcaaagttaaggctccttagcgaagccccaagcagtaactgaattcctcaagttataaaatacacggagagatggttaaggaaaagtgcccgtttcattttttgagtgctaaaatatatgtctttctcccctatctacatcaatgttcgcacagtggcaattattacttgcaatgaagacaaaagaaagttgcctgtccacttagtaaaccagcgactactgctgattaagatatgttgtatttttatctatgttacatgaattggtaggaattttctatgtaagcactctatcatgctagttaatttcagtaccaatatgtattggtcctactaatgaccatttttttacccagtataacaacaaatcagcaaatatgtgtaaatattagtgctcatggaaatgcaattcagatgaatatagatgtgtacttacattctgatttgtcggacaaggtccagtagtatagtaacactgagtatggttcatgcattgggagctctgcttccctggtgctcctgctgcgtggctcagacatgaaataatttataccccttctcggttcctgcactggccgtatgatcggcgccatgaccagcttaagctgctccttgcgccactcctccctcttcctaatttcttcttcagttggaaactttggtacatatggttctgaaaccttcacccaatcagattcgccaggagattcaaacaataagctgtactcagcttctccttcccctcccactgatggttccccagatagggataactcattaagcctaaagtcctggttttctagctgttcttggtgatacagaagaccctgcacttcctctgcttctaatgcaaagattgcactgagtcccaaatcatgtcttctctttctgtcattgcggcatttagccggcaaagcttcctattgagctgaacaagcaaacttgaacacgatattgggttgttatcatcgaccctccattctagaatttggtgtgtccagctctctgctgaggtgcagggcaggaatgtgcagttgtcgtcatcatctccgctatggatgcccaccgtgattccactccacccagtaagaatgatgccatcgttgagccgtattggtacattgtctactaggaacttgaaactcaaaatctgatccacctgtgtgtgttcttgcggcaacaccgatagcattgccacaggtctcaacgtctctatatagcttctttgttctgtgaagccaatggtctctgggtccgaatagccttccacaaatcctactacttgaagcttcatcgtcgtcaatggcagaataaacctgccatcgcaggcaagcctccggcgcatgacgcgaggacattcctgctccacaaagttgcagcgaacctccccatcagtgcccattgatagtttgaaccttcggtgcatcgcttcacaaggcgattcccactgcatctccccatggcctagagggatgcaggcaagaggcatcatctccagctcctccctttccctgttcagctcttcttgcttcctcttctcctgctcttgtttctcctgaagcaccatctttttttgctcctcttgttcatacatctggtagagagtcctggccagatcctccaatgcggccgtaatgttgatgaaatcatggccgaccctagcatacaacttctcctccgtccaattggaggggacacggaaccatcgctcggagaaggcaatggtgacagttgagccgtcggggggcaggacgaagagcttgtcatggaggcgcaccacaaggcttgccatcctcatgttggacacgatggcgaggcggtcgcctccggcgaccggaaaccgcctaatgacggccacaaccctcaccggcacagaatcagcggcggcgagggctacgacctcctccctcctgctccaaggccatggcctggactcgaaacaggagagcgcgcccacccggccaccgtcctcttccagctccaggcgaggggacccgtcggcggcgaggcgggcgaagcggagggggaatccgccggcgcgctcggcggagaagcgaggggtctccttgcgcgaccacatggcctgccctctcttgacggagagcttcatcgtgaacagcaggtggcaacgacgcggcggcggcggcggcggcgtggggtgtctcgtcttgggtcgagcacattgccactcctccagctccggatcgcccgcttcccacggattgaacggcgcgagcagctgctccaattgacgaagatgaatctcctcctcatcctgcttttcgtgagatgatttctcgttcagatcgatggggatgtacaagctttcacgggcacgcacgtcggctgcctccattgcgtatgccggctgccgccgacacgatcgtatatggaacaatttttcagaggcgaatacgtcgaccggaaaatacctcgccgccgccgccgcggcgatcctgacactgtcgtcgcgtgcgccgccggcagccagaaaatctgggggttaataaatcagatgcatatacgcgcgttttctgttaataaaacagatgcctgcacggggattaggcaggttcgtgccggttcgggagaggagagagaaagcggcgagattggttcgacttctccgaggagttcttcggaaggggagtatgagaaaaaaaaaaaggtttactatgtgtcatatgccattataaattccgtttggaaatactacctccatcccaaaatatttgatgccgttgacttttttaaaaatgtttgaccgttcatcttatttaaaaaatttaagtaattgttaattctttttctatcatttgatttattgttaaatatacttttatgtatacatatagttttacacatatcacaaaagtttttgaataaaacaaatggtcaaacatgtttaaaaaagtcaacggtgtcaaacatttagtgaaggagggagtatgtcactgcagtttacgtgattgaaatcatactacattttaatagatgtttgagattacatcattgatgcaatttctaaatattttagaccaaaatagccttgtcttcttcctccatcaattatttatgtcctctctctaacctttcacctctagctacggtcggtcgtcgtccctatgcgacgcgtcgcacgcctccgctccacaataggctcatgcagcaagcggccacgacgctggaagagctgttatagggcacaaccgttggcggagatagaggggaccggtgatgccttcaaatccgatggcccgaccttgttgctgcagggacctcatgcctagagcttcgtcaccacacgacttggcgtcgttggagcaacaagcctgcggtgcacaggaagatcagcaccggttgcgatcctcgccatcgacattggctctagcactgtgaccagttatagcccgtggacgctgcaaccgctgctctcttccagctacacgagctcgctggaagagaggagagagggagaggaagaaggggatggatggagaaaaatggataatttggtcctaaaaatttgaaaaatgtaatgaatgagtaagtagtggtatatttcgaatatgtgtgaaatttcaatggcattgttctaatttcacaaacaataatagtatattttaaaacgggtaaatttataatgtcatagatccaattaagagagagagaaagtaggaaataacgcaattttccttcaatccaaagaaaatagtggaatcccatgaatgaacaaatatcagggcccctttaatttggaggaaaaacatagaaattttagaggatttcaatcatataggaaaatttcctatgaagctctttgaaacaaatgattgaatcatatccaatcctttgaaattcctatggaatgaacaatcctatagagatttttggaggaaatttagcaagagctccaacctcttgctaactttcctttgagtctatctctctcatccaattcctgtgtttttcctgtggttcaatcaaacggtcattcctgtgtttttcctgtgttttgcaatcctctgttttaaacttatattcctatcaaaattctacgtttttcctattcctacgttgtctccatcctgcgattcaaaggggccctcagaatgtgcactacctgcctctccggtcctttcaccccaatatctctttcctcctgaataaacgcctgatatgtttcgatcaagtgtttctgttggtatagccgctgattggccttgaatggactcgtgagctgtgcttattgtgactgaactctggagacttggagttgacccccaatttgttcatcggatgtgcatggaacatggggctactctactcattgcacgtccatccccaattccccatggatcaagcaaggaactactgctattatttcattgcagatcatgcagccagaccaccaccatattggcgctgatcgtttctgctggttgttgcagccagcaagctgggcatcctgttgcagcggtagaaaatgaacttgcattaggctggctgcagccagcaataccgatcagcgccattgattgcgggcgatatgactacaagaaaatatcgctgatcctctctctcacacacacatgtatccgaagatgttaccgtgaatcagaagtcatagggccgtttaaattagtgtcattttaaatcataccaatatttagtaaaattaaaaaaaatatagttgcatttagtttatgtactccttccgtttcacaatgtaagtcattctaatatttttcacattcatattgatgctaatgaatctaaacatatatatctatctagattcattaacatcattatgaatatgggaaatgctagaatgacttacattgtgaaacggaggaagtaccaaatagtgatagtgcataagaaattttggcacaacatatttttattctatactatcaaagtttgaaaattataccaagtaactaaaagttaaaatttgaaagattgatcttgacaattatctgaattgaacaggcacatacccactcaggaaacatctaggctctcacgccgtctcacggtccccacctgtcggcgaccgagcgatggaaggagcagcgagacggacggcacgggggcccgtcagggtggtccgtgcccaccgccacccgtgacgtttgctcgccatcgattgtgccggcggccgcaccgcccggctcggccggacacgtgtacgaccctccccgcgccgtgcggcctctgccactccccatcggacggtcggcctcgctccgcccgtgaccgtgtctttcgaattaaaggggggggcttccgccgaccgggcccgtccccccctgcccgtgctgatgggccggggctccgattaaaggaccatatttgcacataccaccctacactttctcgaaaattgtagtgctcgtactagtactggtttcttttgttgttctcattgagcattagcatgtgattattggctaatctctccttgtaaaccaaggatctgatgaagctttgaaaaagatccagatttgcagctggttttctaatcaacatggacatcgtaaggcgtgcacagctcttctataatgatcatgtccgtactactaccacatgtttaaaaattgtgttccacaagagacaccaaaggaaccattccttgcggtccagacccgatggcgattaaagtattaaaccaagaaaattaaaccggtcagtgaacctagcatgtcttttggcttcattgtttggcttattcgtggaaatatttgtaaactagaagtaatttattaataaaacttttatatacgtgttctcaggggcataaaagtaaagactgaaaactaaactttgataagaaaacctcaaaaccaggtttaaatttaaggttaaaaatttaaattttggctgataagtataaacataaacgaaaaaagataggtcagtttgtttgatttgaagagaattaaacaaaattaagggagagtaattccatatcacaataaacgtataataacttccctccaatatacttttcttatgctctatttccaatcttgcaaggaccctaatgtaaaagtttgcgagacacaaaaaaaaaatattttctttaactttcccatctctttcacaaatcacacacacccctcttaggctcctcctcatcttcttctcccttctctcgtcccctcctcccttctctcctaccgagtccagtgtcgaatagctagaggcgccggccgccattgctggcccctgcacgcgccgccccccctgcgccacggccgtcgccgccggcgggaagtgtagctcgccgccgccactctgcgcgcacccccttcgccttgctccgcccgccgccgccgccgccgccgccgccgccgacgccgaggtcgctgccggtgcccccgcgcgtgccctagccactccccctgccgcctccgcctccacattgccccgcccgcagctgacggagtcgccgccgtcgccccccgcgcatctggcatcgaaggcctcccaccctccaccgacgtcgctcggcttcgcggggaccctccggagctgtggccacaggttcggcgagggcgctgctgttggttggacgagctcgttggtggcctgatctgctcagtggcggtgcggggaggcacgacaagatccccgccggccggatcaggtggagattggttagatcttttggttggcatccgcggttgttggtccactcggtgctagccttggtacgctgcctcaaagccttgctgcggctatggttttggcgtgagaagctcggtggaagatgtggaaagggttcctcagcaagctgccccggaagacctcggcctctgggaggggcgccgacctcgactccggccagtgcagcaatggcgctgggaatgggaacccgatacagcgcaccagcagctgcggcagcatcccatctggccgctccacttccaccatcaagcgcatgtcatccgccatcttcccgtccagcgtcgtggctggtattgagccacttgtctcgttcaaggatgtccccaactcggagaagcagaatctgttcgtcagcaagctgaatctgtgctgtgctgtctttgacttctcggatccgaacaagagctcggcggagaaggatatcaagaggcagacgttgttggatctcatagattacgtggattccagcagttcccgtttctccgaggcggtgattgctgctagctctaggatgtttgctgtcaacttgttccgggtgtttcctccaaattacaggtccagttcatctggcggcggcgagggtgaagaggaggagccaatgtttgagcctgcatggtgccatctgcagcttgtttatgagctgctactgaaatttattggatcctcgtccctcgatgcaaaggtagggaaaaagtactttgatcactccttcattgtgaaactgctgaatcttcttgattcagaggatccaagggaaagggattgtttgaaaactattctgcacaggatttatgggaagttcatggttcaccgtccttttatccggaaagcagtaagcaatatattctaccactttgtgtttgagactgaccggcataacggaattgctgagctgctggaggtatttggcagtgttattagtggctttgcgttgcctctgaaggaagaacacaaaatctttctttggagagttttggttcctttacacaaaccaaaatcagttggtgtgtatctccagcagttgacatattgtgtgacacagttcatagaaaaggatcccaagcttgctagctcagtaattattggtttgctaagatattggccaataacaaatagtcagaaggaggtgatgtttctgagtgagattgaagagatcttggagacaatcagcacggcggaattccagaaatgtatggtacctttgtttaggcggattgctcaatgcatcaagagctctcacttccaggtaacttgcccaaataaatataacctatcgatgtttattttctgtttttgccactatgcatttccctcacctaagaaaaataatatataggtggtaaaaataatatatcggagtactacatatgaaagtagttgtggccctgtttgattgatcaattgccacgctgatgaattactatactagtcgctaactctaccgcttcacctagacattttattatataggtggtaaaattttatgtaaacatcactcagttgaaatggatcatgatcgtaaagctcacatggtatatagggtttttttggttgcatcatttatgtaaggtatgaaagcattacctgttgacttgccaaatggatgagataatagatgtctgatggtccgaaataaatgtggacaacaatagtgggccattatgttatcaactaatcatgctttgggcatggggttgctctgtactgttaatatcacaaatgtgagatatttggaccagcattaagaattgaagacatttgtctgccatgacagactaatgctttttatccaagtaattgcctcaacgagatgggttttttcaggttgctgaacgggcgcttttcatatggaacaacgataacgttattagcttgattgcacaaaaccgccaaatgatcatgcctatcattgttccagcattggaacataatagccagaatcattggaaccaagctgtcctgaatctcacagataatgtaaagaagatgttttctgagatggatgacgtgctcttttcggcgtgcctggtcaagtacaaggaggacgaagaaaggcaagcttcactggaatcaaagaggaggttaacatgggagaagctagaatcagctgcttctttccagccagtgacgggccatacagccgtcctggtaggccgccaaccctcagcaaatttgattgccacccttatttagcatgtgttcagtggaggtgaaaaattagcatgtgttcagtgaaggtgaaaatggggttcttcactttctggtgatgctcaccaactgaacgacttcagacttcactattttccccttatttcttttttatgtctgtattagtaagcagtgctgtaagttgtaactattttcgtatgtttatgctctgaaggcaaagcatgtatcgagtgcttaaactccttacctgtatctttgcctgtttatttatgagcaatttcctacgcctaaactcactcttcttctggtcatggttgctcaagcaacttctaatacgttgattcagtttggtagtatctcctaatgtggtattcttacaacctaaaagggcatctggtgtgcttgcaaataaaaattgtaagatgatctacgtaatgacccttgttgatttacatgccataaagcttccagtgtagcatttagctatttagctttgaagatttgttagtttacttggctacctgtgttttcttactgcctaaatgtgatcattcaatgtcttgtgtatttgaaaataaatacttcacttgaaatactgagatgcaaaagaagaatttgcaagataagaacatgaaaaagcctaaatgtgatcattcaatgtcttctgtatttggatataaattcttcacttgaatttcctgagatgcaaaaaatgaaaaaaagattccgttgccgggactcgaacccgggtctctcgggtgagagccgagtatcctaaccagctagactacaacggattattgagtattttttcatgtatagttatattcactaaggcacttcacaaacaactccgtaaaagttatttttctaccgaagtaaatgtaaatttcaatgatatggtataatttttacatattgccaataaattccaggagaaaaatcattgcatgcttccgtgttcaacagtgcatagcaggtagtacaacttgatcgctgatcacatgcagttagtgcatcacgtgtgcactacaatcattttttccactggggcagacgttggacgacaacctgcgaaaataaataataataataaaaccgtttaaatctcactgaaatcatggtgaataaatgcattttcgtgggccaaattttgggtgataagcatgagcgaaaagacccttcgttcttgtggtatacttgtagtcttgtactgatttattcacaaaaaaaaaagagacattttcataaggactcttttggagtagcataataatgagaatagttcaacgtgttaaggaacatgccttgccggaattttctttgtttccaacaatagtctgacaagcaagcctccatgactccggtttctggcatatagacaagaaatacaaatagcagtcaattggcagctgttttggtgtaatcagaaaagcatatagcaacagaaagttcagaaaacagggaagcccagaaacagcattgcccaactgaaaaaaacctgaaatggaatgcttggtaccttcttcagataccggttctcagtgtttgttctttcattcaggagctccttgccatcaactatctgtgtcacattgacaattccaagctgtggttaactaatccagctacagtttaaagttgcatagctaatatcctagtaaggtgaaatgtttcagagtcgttttcagaattcagaccatgaacacaccatttgcaggttcggccaagcatcgaattgaggcaagaactagagatgccattggttaggcaagagagagtagggtacctcgacgatgcaagtgccgcagctgccgccgccgccgcagttcatcaccttcccctgcaaaaacaacaaaacagcaatgcaactctctctgttacactgcagcttggctagaagcaacctgacaaagtgacaaccgtagcaaaaatcttcagagaaatcgaggcagggcgagagggaaactcacatatgccgcgtagagctcgatcttgttctcgaccatgacgtcccggaggagcttctcgccgctgcccgccgccgcccggtccaccgggaacgacccatcggcatccgccttcggctgcacatcacccaggccatcacacatcataagaaggcaaccccaaccttccccatggcggggacaaccagccagtgacttactccgacgaactcgaggtcgatttggggcttgggcggcggcgctgcctcctccgcggaggcggctccggcggacgcgttcggcgaggcggcgttggagcacctgatgcgggccgcccggaaggggccactgccagagctagccttgcggtggcctcgggtggagacgacgcgggaggaagggatggccagcgagaagagcgccgtggaggtggagctcgtggccgccatggctttccttccccttctcttttggcgagcacgtggcctcgaacgagacggtttttttttatcggcaggaggcgcgtccacggtggaagcctcgcgcgccacacggttggctgcgttgcgtcgcttctcgcgggcttctttccgttttctctagggcccaaaccaagacgaggcgggccgcatcgttgccgtgggccagcgcacgcgcgtcttcccgttgttgggccgcgtgcatgcgcgaattgagattggaaaaagtacaccgaaggtccctcaacttgtcaccaggatacaaaagcgtcctgaaccgcaaaatcagatatgcgaggtccctaaactacacaaaaccggtcacctgaggtctttggtggttttgactccggtagtcagcgtgggacccacatgtcagcgtgccacgtctatgtggcgttctcttctttttagttatctttgctgcgggggagtagcatcgggcggcgccgcgcggggctgagcggcggccggcggaggcggcgtgcgatgggcggctggcagagagcagatgggcgcggcgggcgtgggcagcggccggcgagggaggagctaccaccggcggcggcggcgtcaccgcgatcccacaccttacccctccacctccacctccgccgctgatgtagcaaacatgcgcacgccgcactccccccatacacaccccgaacgcggcgcccgacgccgccgaagacgacgcatgctgacgccgctgctgctgaagacgacgacgactatggcgacgggttcgaggaggaggaggacacgcacctccgttatggggatcgctggtatcaagcagcaagcatccatcgtcggcgagccaccgtccgtcggtcttgtcatcccatcagctctcccgtcagcaacaagcgcatcttcatcagcaagcagcgagcatatccagatccacaggcaagccgcaagatccaacgccaagctgttaaatccacagacaagaagcaagctagcagcaacaagtagcaagtgttagcttcagctataatcctgtgccatattatcggttactgtaacgcgtctagcgttgtcgtttcttcagtttcgtcagagtctgtttctctgttttttttctcatgtaagccgagtcttccgggtcgtgcgtcgtgtgcgagtcatccgggtttcagcgtcgtggtcgcgtcatcgtgaatgatggcgtagtggtgttaatttgagtctgtacaaattggctatatatatgagcatcagaaaagtcacagcgagtaagcggcaccaaaaactctgttcgtgttcatcgttcttccgagaccagtgaattcgcgtgagagagagatagtgagtttacacaaatcttgggcttggctttcatttggtatcaaagccatgtccgctcccaccggcggcacgtctcgtactccccggcgaacaggccatcggctctcgccgtctcctccacggccacgcaggcgacagctcgtcgtgcagcggatcgttaaggaaggcggctcggtctcctatccaacgctcacacgctcaaattactctgattgggcggtgttgatgcgagtcaatctccaggctcaaggtctatgggatgctgtcgacaccggcgatgtcccgtatcaggaggatcgccaggcactttcggccatcttgcgagcggtgccggctgagattgtccggccgctcgccgagaaggacagtgccaaagacgcctgggacgcgctcaaatccatgcgagtgggcgcagatcgtgttaaggagtcccgagcatagaagctgcgccaaacttttgagtccatgcgattcaagaatggcgaacacctggaggatttcagccttcgtctccagggtgttgtcagcgatcttcgtctccttggagatgatctgtctgaagagaaggttgttcgaaaaattgcttcgcgtcgttccccggaggtatcgccaaatggctctatcgattgaaaccttgattgatctgacctcgctttctattgaggatctgactggccggcttctcaccgtcgacgatcaccccgactctgacggcgaggacgcgggtcaggcgctcttcagcgaaaaggaggcctcttctcactcaaacaaggaagctgggcataactcagccggggggagcgcgtccagctcgcggcaaccacaccgcagtgggcgcaggcgcgacggcaacggctccgacggcaagtcgggttcgtcccaagcggcgagccgcaatgtgtccaaggacaaatgccgttactgtggcaaacttggtcactgggccaaggactgtcgcaaggcgaagcgagaccgcgagaagctggctcaagcaaatcttctcatcgctgagccagctcaccccgcggacgaaggggagccgacactcctgatggcgcaagtgtgcgagcttgcccctgctaccgattctgtcattactgatggggaggtgacactgaacgaggaacgtgctcacgtttctcttcgtgatgaaggagagcccattgatccagactgaatccttgacacgggcgcttcaaatcacatgacgggctcccgtgatgccttctccgagcttgacaccaccgtgcgcggcactgtcaagtttggtgatgcgtcgagagtccggattaaaggacgaggcacggtgctgttcgcctgcaagaacggcgatcactgcgcactcacaggtgtctattacatccccaatcttcggagcaacatggtcagccttggccagcttgatgaggcacgttgcaagacggtgatcgaggatggcgttctcactctgcgtgattcacagcgacggctgctgtgtagggtgcgccgaggaactgggtgcctctatgttctccacgtcgagctggcgcaaccggtttcccttctcgcaaaggggaacgatcaagcctgggtctggcacgccagatacgggcacctcaacttcgacgcactccgctcactggcgagccgcggcatggcgcgcgacattcccactctggagcgggtcacccaggtctgcgatggctgtctaataggcaaacagcgacgagcgccgttcccaacagcggcgttgcatcgcgccactggtcgtcttgatctggtgcacggggacatctgtggacccatcacgccgtcgacacatggcggtaaaaaatatttccttcttctgattgatgatctaactcgctacatgtggctgtttctgctaacatcaaaaagcgaggctcccgctacaatcaagcggttctaggcaggagtggaggtggagaccggctgcaagctgcgcgttctccgcactgatcgaggaggcgaattcacctctgtcgagttcgggctatactgcgcgaacgaaggcgtcgctaggcagttgatggcgccgtactctccacagcaaaacggcgtcgtcgagcgccgcaaccagacggttgtggcaatggccagatgcatgatgaaggccaagaacatgccgggggagttctggggcgaggcggtcacaactgccgtctacatcctcaaccaggcgccgacaaagagcgtccgcgacaaaacaccattcgaggcgtggcacggtcgtacacctgctgtgcactactttcgcacatttggctgcatagtctacgtcaaggaggtgaaaccacacatcaacaaacttgatgatcggagcaaggcgatggtctttctcggctacgagccgggttccaaggcgtatcgtatctacgacccggtggccaagcgcatcgtcgtgagccacgatgccgtgtttgacaaggcagcgtcgtggccatgggcgtcacccggggaggaggatggggtggcgtcttctcaggaaaccttcaccgttcgctacgaggtagcggcggtggaagtgccgtcccgccactccgactccatgtcgtcgccggctcactcgggaccaccggcgccatcaatctctgcatcaccgggcgtcccagcggtcgagttcgtgtcgccgcctgcggaaacgcctgatgtcgacgacgacaacgtagggccacgtcgtttccggacggtggctaacatcctcgacactacctcgccaattgagctcgattccgacgagcttcatctggctgctgccgaggaaccaagtaaccacactgaggcggcacaggacacactctggcagcgagcgatgcaggaggaactaaagtccatcgtggagaacaacacgtggactctcgctgacctccctgctggcaagcgtcccattggcttgaagtgggtgttcaagctcaagaaggacgagacgggcgtaattgtcaagcacaaggcccgactggtcgctaagggttacgttcagcagcaggggattgatttcgacgaagtattcgcccctgtcgccagaatggaatccgtgcggttgctactcgccattgcagctcaccttgggtggtttgtgcatcacatggacgtgaagtcagccttcctgaacggagagctggaggaggaggtgtatgtcgcccagccaccaggtttcgtcgacgacaagcacccacatcaagtcctgcgcctgaacagagcactttatggcctgcgtcaagctcctcgtgcctggaacgcgaagctggatgttagtcttcatgaactcgggttcacgcggggcatcacagaacatgctgtgtacacgcgcgggaccgggaacgcgcggctaatcgtcggcgtctacgtcgacgatctcatcatcaccggcgctcactctgaaacaattcaaagtttcaagggggagatgcactccctattccggatgagtgatcttggattactcagctactacctcggcattgaggttcatcaaggcaacgatgggatcacaataaatcaatccacttacgcgcagaagctcttgaagatgggtggcctggcgggatgcaattcagcttgcgttccaatggaacccagattgaaactgacgaagaatagcgatcgaccaagtgttgattcaaccttttatcgcagcttagtggggagtctgcggtacttggtgcattcacggccggacattgctttcgctgtgggctacttcagccgtttcatggagtcgccgcgcgatgatcatctcacggcggtgaagcacattctgcgctatgttgcaggtactgtgaactacggttgcaagtttgcacattcaggagaagaggggatccatttgctgggattttccgacagtgatttggggggagatgtggacgatcggaagagtacctctggtgctctcttcttcctcggctcaagcccggttgcatggcagtcccagaagtagaaagtggtcgctcttgcctcctgtgaggctgaatacatcgccgccactggagcggcgtgcctcggcatatggctagctcgattgctggctgaagtgctgggaagtgatccggggaaggctctcctcaaggtcgacaacaagtcggctatctccctgtgcaagaatctggttttccatgaccggagtaaacacatcgatacaaggtatcattttatcaggcaatgcattgaggaaaaaaaggttgaggtggagttcgttccttcggacgagcaggttgccgacattctcacgaagccactcggacgaatcaagtttcaagagtttcgcagtaaggcgggcgtcgtgcagattgtcacccggcgacaagattagggggagtttgttagcttcagctataatcctgtgccatattatcggttactgtaacgcgtctagcgttgtcgtttcttcagtttcgtgagagtctgtttctctgttttttttttcatgtaagccgagtcttccgggtcgtgcgtcgtgtgcgagtcatccgggtttcagcgtcatggtcgcgtcgtcgtgaatgatggcgtagtggtgtcagtttgagtctgtacaaattggctatatatatgagcatcagaaaagtcgcagcgagtaagcggcaccaaaaactctgttcgtgttcatcgttcttccgagatcagtgaattcgtgtgagagagagatagtgagtttacacaaatcttaggcttggctttcagcaagctcccgctgtcgtcgtccatcaccacaagcagcagcaagttgtatacgccctcctgttcgtcttcaacagcatcagcaagtcggggcccccaggccgccgtcgatcgctgtacgccccgcgccgatctccgcccgcatgcgccgtcgccccgccagtttcggagttcggacgcgtcggcactccgcccgccgtcgcccctcttcgcccgcatgcgccattgccccactccgcccgttgccgccccgccggcttcgcgcgcgtcgctgctccgcccgccgtcgccccgcttcgccctccgtccaagatggactgtttcttgtcctccgtttgcacgccacttaatctctaggtacacatcgatgatatagatagatgctgctctgtgtggttgaggtgattttgatctttggttggatgcttgatgtgctcagttcatcgacgtggcgtcaaggtggagcgggcgaccacgacggcggcggcggcaaaggggggcgccgctggggaggatatcgcacgccggggcaggaggcggtggtggtggcgcgcaggaggagaggacgatactgaaggggataaccgacaaggtgaggccgtgggaggtgctggctgtactgggaccatcggggagaggcaagtcgacgctggtctccatcctcggcgggcggctcgccggccggcacgccgggatggtgctggcaggcgggcgcgcgccgtgccgtgccgtgcagcggcgcgcggggttcgtggcgcaggacgacgtgctccacccccacctcaccgtctgcgagacgctcctcttctgcgccatgctccgcctcccgacctccgcgcccgccaccgccgaggccgccaccgccgaggccgtcatctccgagctcggcctcgcgtcgtgcgccgacaccatcgtcggcaacgcgttcgtccgcggcgtcgcctcttctgcgccatgctccgcctcccggccgccgcgcgctcgcacgccgcctccgccggccgccgctcagcacgctgggcgccgcccgttgctactccccgcagcaaagagaactaaaaaaaagagagaaaaaagaaaggggaaatttgacgtggcacgctgacatgtgggtcccacgctgactcagccgccacatagaccaagatcggtgttaaaaccaccgaaggaccttaggtgaccggttttgtatagttaagggacctcgcatatctggttttgcggttcgagcctccacatagaccaaaatcggtgttaaaaccaccgaaggaccttgggtgaccggttttgtatagttaagggacctcgcatatctggttttgcggttcgaggacgtattttatcccgatgacaagttgagggaccttcggtgtactttttccaattgagatgggatggtttgggccggttcttccagcccattcagatcgagttgcattgaccaaacccccgatgggactagctaatcgtttcaaattcagcggcatttgtgcctacctgagtgctaagtatatggtgattctctgaagatactccaagatattcttctcggcaatcgctgcctgagaaatatcttcatgtcagctagtggcagcgaagagcacattgcatggcgtcatggcgatgttgatatgaggcaagcttaccacttgctgcatggcactatgctatattgctatgccatctactggcactgtaacacggtgtctttttgtcacaaacgacattgatcccaacctgaacaatgctagctgcgagcctgcggcgttggccagcatcaggccggagatgatgcacatatatggaacaatccattgatgatgtgcacgtgtttgtctgcaaccttgcgccagtgttctgggtgacggttgtacatgcatatggtcgatcgagccggccagaggtggtgaatcttgaagatatttggtgatccgatccgatccaatgcagacacttttcatcttatcatcatgttctaatacattgacgtgtaatccttttaacgtgttcgcgaaatcttcatcatcatggggtgcctaattcgatcatgccgcgtaatttatcaaaacttctacaatattgttcaggacaattctcaactgatcgatttcaatggaacatatacatgcatgcatgctaaactagctaaagtaaccaacatctcatcatctagctagattcttcttcctcttcttctgaaggatcatcatcatcatctggattctggatggggaagaagatcacttcctgctcctgcatgcatggatcaaaatatcctgcagggttatggataaactcgaggcaatgactggctgttgcgtagccaattgtcgcagcagccaccactgtccactgctgacacgaccggccggtgttgggtaccaacgacagcagatgattgtaccaccacattggttgccatcagttcagtgcattctctcgtcaacctggcctctctttcacaggcagcacaccgaatcgcccagcaactagcacaccggaaagaaactaacttaaccttcagtaggagtcatgcattgacgtcgcccttgatcgctagagctagctgcaactcaaggagaaatggaacacctcaagcagcttttgtagaaccaatcaatatataattgtgatcagtttggatgtaattgcgagccagggcataaacgtcgccgcacactaatacactatcatattctaatgcaggagttgcagaatattaacccattgatgccaacttggattattctgtaagtaatatgcacgcatgaacgtgtgttagttttgtaaccatgtcatgtcatgtcatttaaagtccaaattaacaatgtgtgacgcatcaaaaaaaaaaaaacaatgtgtgattccttcgctatatttgtgggcggacgcaggctagtcgaaaccgtgaagggatcaactgatggcgaagttttagatcagtggatatttgcatgattaattagttactcgatctgacgacctgactttgtcgttgcaaaggttgcagtagaacggactaatttttttctctctttttttaaggaagaaaatctgggctggatgatacgtacactatatccactttactttttgttatggccggaccttgaatctatgggaagattttgtagctgcagccaactgtttaagcaatgagatacttgtctggtggttgcccactcagacgtgtccaaagatgaaaatgatatgggatttcatggcatcttctcgatcctaatatattgacaggccaagctttaatgtgatcgtgaaaattaaaagatatagaatattgtagctcgatcaactataaatgagttgtcaaggctcaacaataggctgacatggaaagggatcatctaacttaattattatgctgttaagtcactgccatgtgagccgtaaaaaagtgaaacccacatgttaattattgggggagtatctccggatcaaaggaagctagcctccgaagggctgcagcgctccggagaaccatcctccccgggagatgaccgtgagtcatggccatgtcggtctgcagatggcccctcactccggaagcctcggggatccgattcggatcccacagtgcgagaggagcaggacctaagcaggctccggatgatggccgcccggctccgggaaagctccgggaggtcatagcaccatgggctccggtaccaccaaaggtgactgggctccgaagcccagaggggttcccaaagtctggaaggagagctccggaggctaccttagggcgtgggagctccgaggggcccctaaagcccgatatgccggccggagcggatcatatctcatgtgctctcacaagacaagccaagaaccaggcgctagtggacgtgaataaatgcgtactacgcgccccaactaactctgacactgttgatggctgccaagcggagcacgctattacccaggggatgcctttacccgggtaatagcgaggtcgctcggaaacagcggtgcccccatgctgggggcagcactcctgtcctctgtcaaattaccgctaggaccaaggtgggcccaccggtaagtcgcataggcatatcataaggatagggacactgaggccttttcctcttatgtatccatgtaaataaatacttcctccgtcccataatacttgtctttctagcatttaaaaattgtcccaaaatagttgtcattttgaagtactacatgtcacatcaaccatttccaattcaaatttctccccattctacccctaaccaccattccacatccaactatccattattaattaaggggtattatagtatttttcttcaaaatattagtatatgctaaacaacctataacgacaagtattttgggacggaggtaggatgtaaatatcacccatagagggcagattgaatacatgagagaaattgagacacttgttgaattcttgcaacaacattaatgactcaactatatatatgtgtctcagactcgttcggtctaacgtatatatctagtggtatttttcaaactctgaaacttctatggtggtgtttatgcccgaatgtctttatttccttgtttttctcatttatgatcatgtatattttagcagttttaaattacttcccattttagattttccataagttaaacatgtctatctttgactaccaacatctacaaatctaaaaaaaaatagtttgacaacatgtgaagtatatattatgaaatttttttcaaggtgaatctaaaagcatactcctaaatcttatgatgttaaattatataattttttagaaaccggtagtcaaaataaatatttgacttaagatatataggtaaaactataacaagaagtaatttgaaacaatttttttggattgatcctatatatctatgtgcagtaaatgtatactctgtatatgatcgattgactatttgacttgtaagaggatgtatatacccctatatatctacttgtgaattatactctatctattgactacagtgtctcgaaaaaatgtcatgcatgcatagacatgaccactagataatggtggaaaactggaaataaatcagttaatactgccatttatgaggcttatgtgattagaggacgcgtctgagaagatagcgcgattatgacatgctgatgaagagagatgcggcatttagcaggcgatttgtacttccttccaatccacgtacccaatagataagacgttgctgaatgctgatcagcaccgggcggattgtccaattaattgtcctcttttggctttcatgttcaggttgggtaacactaggaaacttaaagaaataatctggaccggtgatcccgaagatcacagtacgtacatcctccgataattttctgaatcgtagttaaacatgcgaaaataattgtaaatcaaaaacagaactcgaacttcagaaccagcaatgttataactcaactgttcaatcaaagaataggttgaaaatgacaaactgatcgagcatcataaggattttgacatatgcatgtgtttattggtatttccagtgatcagatacaagagaagtcattgcctcattggcatctagagttgaaaattttaatgttgaatacgtctagagaggaaattgcattcttacttctattatctaaaaaacatctgctaagttgacaatgacgatagctacattttccgtttgggatgtgattatatatatgtgcatatgcagagaaaaacctctatgttcttaccacacttattgtcatttttcctgtggacaaatctacccattggttctggagccattagtcgggttcgatgatctgtatcgtgatataaacaaacgagagaaaaattataaatagaatggtacatgagtcatctgaattactccctccgttttaaaatgtttgacaccgttgactttttagcatatgtttgaccgttcgtcttattaaaaaaaattatgaaatatgtaaaactatatgtgtacatgaaagtatatttaacaatgaatcaaatgataggaaaagaattaataattacttaaaatttttaaataagacgaatggtcaaacatgtactaaaaagtcaactatgtcaaatattttgaaacggagggagtatttaactttcatctttgtaggttgacgacatctatatctagtttctgaaatgttcagaactaggagcacccctgcacttggtttctcaggctaaatcctttgttctgtagcgtttcagagtatgatctcacgagtagcatcgtgcacatatataaagtagtaacatgtttatgatttttaatttttgcagagatcagattcctggtcccattcttgccgtgcttgacacatactcttctggaggcagcggattcctgtgtagctaggtaggctgacctgaatataccagtggatacgtgcagacaacgagcaatatattaatcgtgatagtggcaaattcaacgctttcacctctcactaatcgcagttgcaacccttcaaatccctttcgttcacgtcaactctttgggtgctactagtggtcgagaataaggggatttaagccaaccttgcttggtcaattttgtggatcacggtaatgcgattggttgactacttaagcagttgtggatacgtcttggtaactatcatgtgtaaataaagttaattacttcattaccgacgaactaataatcaaggtgtagcttgcaattgttaaggcttaaattatgtgcaactgattaattgacatactaattctttgtgctcggtagcatgattaatcacattgattcgagcccagaaattattgaagacctctctctatcttcccttttattttatttttaaaaagaagcaaattcttgaacttctcatcttaggctttggtttagcattcaattttgcagagaagcgttgttttgtccatagaaatttgtcatgaatcattgtctttccgttgtcacaagccgttgttgtaatctgcaaggagatatccttgataggacagtaacaaggggtatatagggcatgtttagattgatgcccaaccaaaattttggtagtgtcaaattttgggcaagttttggtactatcaaaattttagtagggtagagttgaaaatgtttatttggattgaagccaaaatttgcccataagagacaagttcataggcaaagccaaatttatggcactggtagagttttagtagagatgtttggtttgctaccctaccaaaattttggtagggcaaattttggtagggtagcaatttaaattggcccataattttaacttcgagatcttgtatttaatccctaactcgctacaatttatacttaaaaagtatttagaagtacgactctcctccaaaatctcctcctgtttttgttgtcgcctgcacgagtgcacgtgtcagcttgctggtgcaagcgatcaatcggtgaccgcctgaccagccggatcgagatcgatcagatcaggcgccgcttgcgcctcagctcgagccgagcggatagcggcgttgtcctacgtgcaaatggcgctacgcgctaatgaacaaagaacccaacaaatccaacgcgacagccggatcgatcgccgttaaacttgtggatcgataagatgatgatgatgagaaaaggtgaaaaacaactgggtttcgccgcctaattgagcgcgcggctttggctccccgcgcccgctcgcctcatcggcatcgccgcatcgccggctgtgcctcgctgtcgccgtggcccccgccagccgctccccgtttccgcacgtcgctctcggctcgctgcagctgagctaaaagattctgctttagctgcgtcggattacgggctttgcggtttgcgatcaacaccctctgaagatgtaaattatcgcgcattttgcccatagttttttttcctcttgtgagggttgatggaagattgtgagcttttgaagtctacattgtgtaatcttcatataactgtcatgcagttctttgtaactttggatgacagtatagaaatatggttcaataattatgtgctttttatcttgtgttgatgttcattcctttgtgtttgctttaattatgggagtgttttttaagtttactttgagatacactcgcttcaagtaatttgatgtaataattggctgtaactcgctaggtaaaggccgggatgattttatattccataattagaaaaaaaaacttttttcaccacctgcagactgcagttacatttcctaccaaaatgcatgccatttgataaaattcttagttataataaatttaggacggaggagtataatttatagcatactgtagaaattttttcaaattatgatatgtccctggaagtatttgctgtaaaacattggagtcccccctcccggccatgttgctttagaaaaaaaaacattgatgccacctacaaggctacaacaagaatcaacgaagaatcagagggagaaaaaaaaagaagtccaagaaaataccacacgaaaatctacgggaagatagggggtggtagcggctattgcgggtcccacacaaaataaccctataaaaatgagggcgcgtgctgctctgtagaacttcagagcagagagagaagaagcgatacacactacactaccacgaggtggagaggcgaagaagccgagcgatcggagaggggagaaagcggccggcgagccgcagttcgccggcgatctccatccatccgaggtgaagaggaaacgacagttcaaatcttccacagaatcgtgaggtataggaatctcagctttgtttgtttttacggcgtgatctgcttctactacgtgtgttcgtctccttttctgttcctcttttcccggtagatttctcggtttatccgaggagttgttggtcacttttagttatccgtaatacggagtagtacttatcttggttttatctaagatgggtagaactagacaattctgaactttctgcaagctaatgtgcagttctatattttaaaaaaaattctaatatttttttataatttaattaactacctttgttattatctctaacgttttctgttgcatttgcaaattttgtgtgcagatttaaaatagcagttctactctactagtagcggaggcattcgttcccgcgcgggcaatgtcggcggcgcagggccttgcgctgaagctgcgcgccgcgccggcggcgggtggcgtccgcggggagaagcggcgccgcgcggcatcggcgaccgcggcggcggcggcgcggcctcgccacggcgccatgtcgctggagggcgggttcctcggcggcgcgctccccgccgaggaccgggtggcgccgcgggcatcggcgtcgcgccaggcagaggcgggggctggggcgggggcggcgcgtcctcctcccaggtcgatgtcgaagatccccgagagcagcattgggctgtacgacccctccatggagcgcgactcctgcggcgtcggcttcatcgccgagctctccggcgagtacagccgcaaaacggtgaggtttccgcggctaagcacggcgctggagttgattgttcccgtgcaaacaatcgaaacccccaacgcggcgtgaatttctgatattctgaaattgttctcggttttgcaggtcgacgacgccatagagatgctcgatagaatggctcaccgtggcgcctgcggctgcgagaagaacaccggagatggcgcaggcatcctcgtcgctctgccgcacaacttcttcagagaggcaaacctacttgaagttttaagccgagaaatatgggaattttctaccgctgggggaatcatttttttttctgcctgtttttgtttttttgtgttctgacaggtcacgaaggacgcaggttttgagcttccgccgcctggtgagtacgccgtcgggatgtttttcatgcccacagatgacaaacgccgtgaaaagagcaagcttttgtttcgtgaggttggtgaccaagcagaacactagaacagttcagttcaatcctattgtaactgatatcatgataccattctcaatttcgtgttgtatctttggatttgtttgggttcatgcagaaagcagagttgctggggcataccgtcctcggctggcgccgggttcccacagacaactcgggcttgggtcaatcagcggtagatacagaaccagtgattgagcaagtgtttgtcaccaaaagtgcaagttcaaaggctgattttgagcggcaggttatttgatgagccagcacatttgaactttatggatttcatccgtagctgttaatttttccttgacttgttcttttgttgactgcaactccagatgtacgtcctacggaggttctcagttatgtccatacgagaagttctaggcgtcaagaatggcggaacaaaagatttctacatgtgctctctatcttcaaggttctgtgttaccatcccattaaagaatgtggtttaagtttccaaccttgggtaatttgaagcgctagccactaaggatttcagttatctgtattaagcaacagtaagctgtgatatggaataaaaaaaaacatgtttcagaaatgcttcattttgataacaaggaatagaagaaaacttttggatgtttttttttcctttgtgatttgatctcatctgaagtgaagtttgatttggtcacatgtgcatgcattccattttctgccaagtaattatttcctgaaattcggttttttacaggaccattgtttataagggtcagcttaagccaagccaactcaaggggtacttctttgcagacttaggcgatgaaagcttcacaagttacatggcactggtaagtgaataaccatttcaatattgtctgaacaacaaaatccatgatcatagtcagaagataggattactagcagcaagatttttgtgaggatatataatgcttctaagcaggcatcaaatatcctcttttcttttattaatattaatatgctatttccctcctgtttcgtgatgcctttggctgaagctgtagaaactgaaactgtgtcagctgatgcccaacaaaaaagacacttcagaatccttgtgtagttctgctattaggtactgctttttcagaatgtgtatcctaattaggtggtttgaacaaactttatttggcttgaggtagcttaggttctgaaactgttttacatggatgatagcatatggagcaggattcaaggatagatagtactggcctactgggtattcatatgaaaccatattgcatatcatttatatgtagttgtgcaaaagatgaacaaggtatagtttaaaagttatgcatgcaaacagatccactcaagattttccacgaacaccttccctagttgggatcgagcgcaaccaatgcgtgttttggggcataatggcgagatcaatacccttagagggaacaagaactggtaatttcactaaacacatctctcatcattttcttgtgagcaagaatcttcacatgcctatggaccatggagcttatatttatatgcttacttgcacttttgtcctatttccatgtttggtaggatgaaggcacgtgagggtctcttgaagtgcgagggactaggtctaacaagggatgaaatgttgaaacttctgccgatagtggatgctacatcttcggattcaggttccattcctttatcataatttacacatgataaaaataaaagcagtagtttgctgctagctctgtctctgaaacaatgtgtgtgtgtgtgtgtatgtatacatatatatattgggaatacgtgagacgcacatttttgtattaagagaaataaatgtgtatatttgggattccatatcccttttcacctgtcaaatggaagtatggccatctttgcaaagttatttattgaattatcttgtgaattcaggtgcaatcgacaatgttcttgagcttctcatacaatctggaagaagtgcgccagaggctgtcatgatgatgatccctgaggcgtggcaaaacgatgttaacatggaccctgagagaaaagctttgtatgagttcttttcagcacttatggagccttgggatggaccagctctaatctcatgtaacaagataaaactaaactctcttcttaatattgatgcatgcattatgatagataagtatcaattctgacctggtcttcacgcacagttactgatggccgctaccttggtgcaacccttgatcgtaatggtttgaggccaggccggttttatgtgacctacagtggccgtgtaattatggctagtgaagttggtgtggtcgatgttcctcctcaagatgtttcaagaaagggtaggctaaaccctggaatgatgcttttagttgattttgagaaccattgtgttgtgaatgatgatgaattgaagaaagagtactccaaagttcgtccatatggagagtggctgaaaagacaaaggatacaactcacagatatcatagaatctgtaaatgaagcagagagaattgcaccgagcatttcgggtgcacttccagtaagttaattatcttgctaacttttggagtgtcctgttggttagtaatttaccatgtaatggtgaggtattttatggatttttcacactttgctgcagattacaaaggagaacaaagcagatatgggtatctgcggaattctgactccgctgaaggcttttgggtaagcaacagcccaatcttagtatgtttcttctcatcctccttgttgaaaaattacctatttggttggattcaggtatacaagagaagcccttgaaatgctgatgctaccgatggccaaagatggacaagaagctcttggatcaatgggaaatgatactcctctagctgtgatgtcaaacagagagaagctgacttttgaatacttcaagcagatgtttgcacaagttacaaacccaccgattgacccgatccgggagaaaattgtcacatctatggagtgcatgattggtcctgaaggtgacttgtctgaaacaacagagcggcagtgccatcgcctcacgcttaagagtcctttactgaatacaaatgaaatggaggctattaaaaagatgaactaccggggttggcgcagcaaggtgcttgacataacttatcctaaaaagaatggcaggatgggcttaaaacagactttagataaaatttgtgctcaagcacgtgaagctattcatgagggctacactattctagttctctctgatagaggtcagtaagattcagttacaccagactcactaagcatgaattttatgatccatgaatttatcatcatctagatatagattcatgagcaatagtgttagtatgaaatcaatattctccccaaaatctttacttttgagctgaattcaatattgtgttattgtggtatgaaagatatcaagatttttttctatacagatcatgaataagtatattttcgtaacaacatgttaacagtcaacatcttagtttcatcttaggttaggtcgtacttagtttttcttgctcctcttggatcatgtgtcaacatagctcagcttttcttcttttttttttttttgcatccaagctcagctttcccaagcttgtcaccatgatatgtgctctgcatttcaatgtttaattctcaaaattaacttgatccgtcatctgtagcatttggattaaaacatttgctttaactagaagtttccatacaggtttttcttcagagcgtgtagctgtcagttccctattggcagttggagctgtccatcagcaccttgtctcacatcttgagaggacacgcataggattgttagttgaatctgctgaacctcgcgaagtgcaccatttttccacccttattggatttggtgctgatgctatatgcccttatttagctatagaagcaatatggcggttgcaaattgatgggaggattcctcctaatgatgggaaaccttatacacaagaacaacttatcgagaaatatttttatgcttcaaactatggaatgatgaaagttcttgcgaagatgggaatatccactctggcatcttacaaaggtgctcagatttttgaggcccttggtcttgcttcggaagtggtcagcaagtgttttgaaggtactcctagtagagttgaaggtgcaacctttgaaatgcttgcacaagatgctcttcgtctccatgagattgcattcccatcaagaactttacctcctggaagtgcagatgcaaatgctcttcccaaccctggggattaccattggaggaaaaatggagaagtacaccttaatgatcctttttccattgcaaaattacaagaagcagcacggattaacagcagggaagcatacaaagaatattctaggcgcatttacgagctgaataaggcatgtactctgcgtggcatgctgaaatttagagaaattccaaaccaaatttccttggacgaggtagaacctgcaaaggagatagtgaagcggttctgtactggagcaatgagttatggatccatttccttggaagctcatacttccctggctgaggctatgaacacccttggaggaaaatctaacacaggtatctcgcatcatatacggacctgaacttttgctgagtcagttactttaaatgtcatgtgtgctttgtgttgcatgtttgcttgatatagttctaagcttcttgatttcccatgataacttgcaaaaactttgagctaaaaagtaacatctaaaaactagttggctcttttagatccttttaacattgttattcccaaatcacttgaattatgcttaaagttcttaattatatgtgcctggaacgtgaaggttatataactattaagaatgggagcaaaggccagttaacaactcaaacactgaccttcttccgtggcacaggttaagctttatagtagccaaattacccttgatattggaaatagaagtataatatccccccattagttgccagaccaatttttgacggtgtcgattgaactgcgtatcattacatagtgggagggtaaccacataagcgtagagttgtaacaccatatgacccaaaattcgcccaatggctgggcctccatttggtggtgggggatgggccactcttgcatagcaccttacttgggctttcatccttgctttcccagaaaggttaacaagatcaggaaatgttatattttgggccaacagggcttatacgctactatagctaaaggtaaacaggcaattggtttttttacctttccagtcgaaccatttgctttgggtagatggtgttgtgagaactttgttcctttcaatcttaatacaaatgatgcacaaagcttatgcgcattccctaagaaaaacgtaagtgaataaatcaggggatcctttgacaggcgtataaggctttcttttttgttaattgatagtaggcatatatcacttggattcaatccagtagcttagatcatagtctttgtttgttctccgatttcagggctagtcgcaatttgatatgaacctttattttaaattccttctgaactattttcatatgctacacagaaacaaatgggaagatgcctgttgtttgcttatttgagcacagcagctaggctgatgcaagttatttatcaacttttgttcattcttctctaatattgcacttcctatctgcagagcatcttatgtaaacctttttatgacttatttgtgcacagctatttatttagaatatcaacttactactgtagtgaatttgctaactgactccattttatatgttaattgggacatctaaaaaggtgagggaggggaacaaccttgccgtatggtgcctcttcctgatggatcaaagaatccaagaataagtgcaatcaagcaagttgccagcggaagatttggagtttccatctattatttgactaatgcagttgaggtgcagataaaaatggctcaggtatttgaccagattggttttttgtaaaactaaacgagttacttcctgcaatatgtccatgaccactggtctggctatttcatcaggcagtagaaatttatgtcttgttcctctaactgtatagggtgctaaacctggtgaaggtggtgagctaccaggccacaaggtcattggtgatattgcagtcactagaaattctacagctggtgtagggctcattagcccacctcctcaccacgatatatattctattgaggatctcgcacaacttatccatgaccttaaggtatagtctcatttgtaaaaagtctcatgatggtggcttataactatttagtgcaagactccagtttgccacttacacatttacttccttattaattggcatttttttgttgtaatgtttcatattagagaacctttttaattgaaatcatgcatgttgcactttacagttttgcttgcttatgctatatcgcttctttctactgtagaatgcaaacccaggtgccagaatcagcgtcaaactagtctctgaagctggtgtaggaattgtcgctagtggtgtggtgaaaggacatgcagaccatgttctgatctctggacatgatggaggcactggagcctccagatggacagggattaaaaatgctggacttccttgggagcttggattagctgaaacacaccagactcttgtggccaatggtctccgtggccgagctgttcttcagacagatggacagatgaaaactggtagagatgttgctgttgcttgtttacttggagcagaagaatttggattcagcacagcgccattaatcacacttggctgcattatgatgaggaagtgccataccaacacttgccctgctggtattgctacacaagatccagtgctccgcgcaaagtttgctgggaagccagaacatgtcataaactacttcttcatgcttgctgaagaggtacgagaaatcatggcacagcttggcttccgcactgttaatgaaatggttgggcgatcggacatgcttgagatcgatcccaaagtactggagggcaacgagaaacttgaaaacattgatctctcacggctgctgaaaccagctgctgaaattagccctggggctgttcaatattgtgttgagaagcaagatcatggcctcgacatggcattagataacaaactcatagcctcctcaacagctgcccttcgaaaaggtgttcgtgttttcattgagacaccagtacggaacattaaccgagctgttggtactatgctcagccatgaagtcacaaaacggtatcacattcatggattgccatcagataccatccatattaagctgaatggaagtgctggccaaagttttggtgcttttctctgtcctgggatcactcttgagcttgagggagacagcaacgattatgttggtaagggactatctggtggaaagattgttgtgtatccaccaagaaatagtcgatttaatccacaagacaatattgtgattggtaatgtggctttatatggtgctacaaagggagaggcatatttcaatggtatggcggcagaaaggttttgtgtccgcaattcaggagctcaagcagtagttgaagggattggcgatcatggatgtgagtacatgacaggaggtacagctgttattcttggaaaaactggtaggaactttgcagctggcatgagtggaggtattgcttatgtttatgatgtggatgggaagttcagtagccgttgcaactatgagctagttgacttgtatgctgtagttgaagaggatgacatcacaacattgagaatgatgatacaacagcacagacttcatacacaaagtgatttggccagagatatactcttgaattttgatactctcctcccaaaatttataaaagtatatccaagggattacaagcgggttttggataaactaaaagaagagaaggctgctaaagaagcagagcaaaaggcaagagaagtggtggataagaagccagttgaagtaattcaagctccaaatggcatttcagtaaagacagaggtaaataaggtttaagcaggattatttctcattctctatatcggtgatatttaacttgactgttggaaatttatgatgtccttcttaaaatagttattattgtaattctgtaagctaagctttctagtctgacttaaagtctttgatatgcagaaagtaatgaacgaagagccatcaagccgaccatcacgagtttcaaatgctgtaaagtaccgaggtttcataaaatatgagcgagagggtacttcttacagagatccaaatgagcgtgtaaaagattggaatgaagttgcaattgaattggttcctgggccactgctaaagacgcaatctgctcggtgcatggattgtggcactcctttctgtcatcaggtgatactcagtttttttcccttttgtattaagcagttttttttcataaaatacaatgatgcttttcagtacagtagttttatatgaatgtcacccggcaaaaaagttttatatgaatgtccttgatgctcttgatttcttgtccatatatattagtgcatatagtcgtgcattcgcacgaatttaaccatcctctatactgaatatctttacatattatttgtagtaacaaaatatacttccctttttaatagatgacactgttaacttttaacataatatttaatcattcatcttattaaaaaatattatgtaaatgttaatttttttggtctgacttgttttatcattactgcgttatgatattttggtaagttggcaatggtagggtatgcttagttagttaccctataaaatttggtatttttttctattttatttaatttttaggtaaactaaattcataatattttactttactttagaaagtgtgttcgttgaaaaaaaaactgagatggttaatttgtgtgctaaacaaaaccgacaatcgagtgtactttatgcaatgtttaaaaaagtgtgtaaagaatataatctatctattatattattaaaggaatagaaaaagaagcctccacgttcgctctcatggcctagaaattctcacattaatcggagaaaaagaaaagacagagtccatatagaaatacaatttagaaatagctgaaatttggaattaaaaaataaggaatattagaagaggagactagagtccatatagaaatacaatttagaaatagttgaaattcggaattaaaaaataaggaatattagaagaggagactagagtccatatagaaatacaattaggaaataactgaaattcggaattaaaaagaaggaatattcgaagtagagtatagagtccatatagaaatacaattaggaaataactcaaattcggaattaaaaaataaggaatattagaaaaggagactagagtccatatagaaatataatttaaaattagttgaaattcggaattaaaaaataaggaatattagaagaggagactagagtccatatagaaatacaattaggaaataactgatattcggaattaaaaataaggaatattagaagtagagtatagagtccatatagaaatacaattagaaaataatagaaaatcggaattaaaaataatgaatattagaagtagagtatatagtccatatagaaatacaattaagaaaaaaaataaattcggaattaaaaaataaggaatattagaagtagagtatagagtccatataggaatttaaaactaactaaaattcagaataaacataataaaattaaaagtagagtttagagtctgtataaaaatacaatttacaaataactaaaattcgagattaagaaaaacatggaaagaagagtttaaagtcaatataggaatacaatttagaagtaactgaaattcgaaattaaaaattaaagaatattgaaagataagtttagagtccacatagaaatacaattagaaataataaaaattcagaaataaaaataaataatattggaagaagagcctagagtctatatagaaatacaatttacagaaaatttggaattaaaaaaatatattaaaagatgagtctagagtccatataggaatatatatattttacaaataactaaaatttgatattaaaaataattaataactaacacgtatataaaatacaatatgaatattacacattagtagtttcgtaaagttattgcaaaatctaaaattatgttgtcattttaatatatttggataatatattgagaaaacatatatgctattatatgagagaaaatataatgatgctagccgcgcaatctgcgcgggacaccatgctagtttcaatagtaaaactcaaaactttcaaggttcttcacgtatacgaggttttaattgtacacaaggtataaaaataatttaccaatattcaaaactcaaaacctccaaaattatacgcctaagaaaaaaatattttttaggcttaaaaataaaaaggtgccatggttgtgacatattggcaggttcagaggtggacttggaatatctagtaacttccttgccactcttccatcggacagctgagatttattcttcagtttttgtccttttatcgattctatggccattatttactacatgatgtggctttttctctttgcatcatcagattgtcttttcacttgttaagatttgtgaaattttcttggtatggttcctgtatttttcttatatcaaacttttgcaggagggttctggtgctggttgtcctcttggaaataagattcctgaattcaatgaattggttcatcagaatagatggcatgaagccttggatcggctacttgagacaaacaatttccctgagtttactggacgagtttgtcctgctccttgtgagggttcgtgcgtacttggcattatagacaatccagtatccataaaaagcatagagtgcgccatcatagacaaaggatttgaagagggatggatggtaccacggcctccacttcggagaacagggtgtgtgttcggcacaactttgtacttgctttcttatatgagttgaagcatgtaacaatagctgcacctaaagctacttcatttttttgcagaaagagagttgctattgttggcagtggcccagctggtctagctgctgcagaccaactgaacaaaatgggccatttcgtgactgtctttgaacgtgctgaccgtattggaggactgatgatgtatggggttccaaatatgaaggctgacaaagagggcattgttcagcgacgtgtcgagttgatggctaaggagggggttcaattcattgtgaatgcccatgttggaagtgaccctttatactccgttgaaaagctccgctctgagaatgatgccattattttggcctgtggagctacaaagccaaagtgagttaatacaaaaacgaaaaaaagaagagtttgtaactctagtttacatctttcttggcaccagtttttaaagtctaagcaacacagtctatatcattcatgcctttgaaacttggctaatgtttagagcattatccttgagcagagatctccctattcctggacgggagttggcaggcatccatttcgctatggaatttcttcatgccaataccaaaagtttacttgacagcaacttggaggatggtaactacatatcagcccaagggagaaaggtggttgtcattggtggtggagacacaggcacagattgcattgggacatccattaggcatggttgcaccaaccttgtaaatcttgaacttttgccagagccaccaagaaagagggcacctgacaacccctggccccaggttagttccctcatcatataaaacaacagcatctttatattctttttttagtgaaaatctttgtatgtttagaatgtaagcattgcgccactacggttgcctgaaattccactaacattactctgttgtgtttctactattgccttcagtggcccaggatcttccgtgttgattatgggcaccaggaagcaactagcaagtttggaaaagatccaagaagttacaaagtcctgacgaagcgatttatcggagatgagaatggaaatgtgaaggcccttgaggtaatacgtgttgaatggggaaaggtgaacggaaggttccaattcaaggaagttgaaggatcagaagaaattattgaggccgatcttgtcctcttagctatgggattcctgggtcccgaagcggttagttttcctccctttctcttatgagttatgacaagaatagcattacacaattgtgcacatagctatctgtttagagaccaaccaacacatagtgcctaactgcatatccttctacagactgttgctaacaagctgggtctagaacaagacatgaggtcaaacttcaaagctcaatttggaaactttgcgaccaatgtggaaggtgtatttgctgctggagactgcagacgtgggcaatcactggttgtttgggccatcacagaggggcgccaagctgcagcagccgtagacaattacctgtcgaaggatgatgaaggtgaaaccaatggcacagaggacattgctgtctcaagtgaaggtctggtccaacccgtagttgcataggccgagagaacatttctgcaattttgatacagcattgatgatgcgaagatagtagggccatgcattttttagctataaaaaggtaaaataaagggcctgtaaataatttacaagaaaagggggcccttttgtttatataagtatgataaaagggaaattttgcggacgcgtatattttttccctgtttcttcttgtgaagagatgcaaatcctgtgattataagagcaatgtctggtttttgttaaataaatgtgaggggattctgttaaaaacatctatttattatgtgtaagtacataatggatcttcgtgtttctcttccatccatgaacctaccacaatgctgctgcatgaattgtaaatgtttttaaagtttttgaagtgttgtcattgagtagttcaagaatcgatctgcagccataattaatcagttaaactttttttcttaaacaaaagcagaagctctgtttcatttcattgattcgcttcctttattgaaaagaaactcaatcctcgtgtgacatgtttggttgttattaactgttttataattggagcgaagtcacgcattattagtctgactagaagatattactgacgacacctgaggcaaaagaaattcatatttgatatgccttgttctaaattggcaatgccgttatgaaaaaaaaaagtacagtccattagtgactgcgtgcatgacgaccaataattattctggattgagcaacgaaacacaaaagaatatatagaacgggtaacaagattgaccttgtaaaatggtgctgcttcaattatgagatgtatatacctgttagatgtaaacaattttattgagaatttctctgtaagaactttttttaacgaggactttttttttttgaacaaactggcaagccgccaatttcattaaatagagatggagtaaattgtacaaaacccaaaaaaaaatgaaaaaagttacaagctcagagcctttggaccgagctaaccacataatgagccagttgccaaggttcttctcacccaccaaaacacatgttttggcttcctctttaatcttggctaggaggctggttgccaggagctccttttgttggaaggtcccgcgaggccactagcaacaggagagtttaatttcaaagtaatgatatgcacttgctagtgtaatggtattgtagtaggatgtattagtttaaccatatgatccctttattttggttctcaacatgataatattttatttttaattatttgacaaaaagattcccccggttgctcagtccttttaaaaatcaaagctatactgttgcataccatatttgtggatacactttgtacataggccgtgtttagatccaaagtttttcttcaaactttcaactttttaattacatcaaaactttcctacacacgtaaacttccaacttttctgttacattgttccaatttcaaccaaacttctattttcaacgtgaactaaacacaggcatactcgcatttagtttcaaagttaaatgtcattgcacaaaatgtatttgcggatacattcattatacgtactacctccgtcctaaaatatagcaatttttagttatgaatctggatacacagttgtccagatttataactaaaaatgattacattttgggacgaaggaagtacatactcgctgcagtatgcttggaaaaatatttttactattgcaacttatacgagccaaagaccgttgacaagctagtcaacagtcattagcgtacctgaccggctgactagtccatcgatcgaggttacacgcatgacgtacataataggctactatcagaattcttttttagtgcaaaaatttgcctaattttagtctataatttgataccccatcacttacgctcgcttctcctactgaacaagtcaagctctcctcttcaccgctatataacgcacactttctccaattctccatccaggtgccactcaaagctcacacatcgccattgattctccactcgaagcttagctacacagagagaagcatctagtagtagtcgcatgggcaacagcttgcagctgccatgtccgtgccaggaggccacggcggtggccacctcgggagtcaagaagaggaggaagaagtcgccggccaccgccgctgtcaggagcagcaaggcggcggcggcggcgtcgtcgaggcacgtggttccggtgatagacacgccgggggaggaggaggagatgaggatggcgtggccggggtgccacgtggagccggccgtcgacggcggcgacggcatgcgggtgaaggtggtgatgaagaggaaggacgcggcggagctgatggcgaggctggaggagcggtgcgctgtcgagaggaaggccaagatggtggagctcaacgccgggctccgcggcggccacggccacggtcacggcggcggtggcgccagggacgcgtgggcgccgcggctcgtggccataccggagaactagcaaattaagcaagaactgcaactgcgaaaaaattctgcatgcacagtacagtagctgtaacatttttggagccctgataaaattacatatagctcgagtacattagctagcaagtttttaattagtgacatggtgaattgaattggtgatttctactctctttgtttttttttccttctcttgattcctcttggcttcttgagaagacgaactctgtcggctccgccatggcgcagcagtgtatgcagagagttatcaattgtgcaacttatgatgagcatgatatgttcatatccatgtgtaaataatccccttgttttataagatgcatccttgcttgataaagaacaggtttttatttcttgtcacgctattttagcaagcaagaggagattgattcatatgttgcagacttgcagttgtagcacatcaactctttgtgaattctctaaaaacaaccttttgaattgaaatcgaaattcgatcggctgatctggatgttgctgcctaccagcttccttctaccaaacttgtcctcgacattgacatatttgttgtgatcggaatattcagacggagtgttgtcgatcgaggtgagacgttacacagcttagctgtcactcatcagcaaaacagtgttgattaccttcgtcacactgccatgaatcatgatgggtgaagctattgatgccaacggataatactctaaaactcatgttggcatattgtggttaggcaacattgacctcttcataattcaaagcaagcaaaagctagctctatcatgggcaagctgggcagtatcttctgaatccatgacatttcagacttcagagttcagaggatcgaggtagctagtcagcatgaccagttcaagcatcagctatctttgttctatctgagaagcctgtgattaccattaggtattgttatctgcacacacgtaagcgttgaaaaaaaaaattcacagtagttagtctggtcgtaacactgacgctagctgtatgagaaacttaatcgagtgataatttactagtgtatatttttattctgttcacacagtaactttgtctgaacaagaacgttaatctgttttcttttatccccctgtggtcgttgtcatgactgcaataaaaatacgtacagaagtagagaaatttgcgagcaaatgatttgcctctgaaagtctgaatcgaagctaatctttgtccaagtcagcaataggtattataggtattagtccacatcattttatttttttatctgttattttttacacccagagtctgattatttatgtcacagctacgccatcaaagcataagaaaaccaaacatctcaatctgccgagacctacacttgcaaagtctcgtcaacacacatgcgagctcgacatcaacacaccaccatccagacaatgaacagaagcgtcaacacgtacgcagtgcgtaattccatactacaatatcacgtatatactctctcagtcttcaaatactactttaaaattattttttcatgcataataattcaatattattcaatagtgtaaagcatatattgattttttttgttttcagaaaaattatgtcatgtttttttaatattctgcagatgaaattttatatcacataattgaagccgtcgaaaaaaactgagatggttataaagagattattcagcccaatcatgaacgacatatttgcaaacaaaaaataatctgtgaaacttttatatatgtgttcttagtgatttaaaagcaaaggatggaaaataaaccttaatgacaaaaccctaaaattaactctaaatttaaaatttggctgataaacataagaaaaagatgaggctctatgttaacaggcccattttccctcgcaaaaaaaggactataggtccactttgtttgtaggcccatatattagatgggcctttcatcttgggccttctccgacggggatctcgatgcacatccgccgtccatctagacgcaatctcggccgtccaatctaccacaagaaacttttaaaaccccacatgccctagggctcatctcatctcattcccctgcgccgtcacttcccctcctcctcggttcccgccgccgccgccatcgccatctccaccctcctcggcggccgccggcgacgatgaagggacggcaaggccagcgcgtgaggctgtacgtccgcggcaccatcctcggctacaagaggtgaccgctcgctctcacccccccccccctgcgtggcggggtatctgccttctccgtcatcgccgcggtggagtggtgttgatcttggtttggcgttgattttcacgcgtaggtcgaagtcgaaccagtacgagaacacgtcgctgctgcagatcgagggggtgaacaccaaggaggaggttgggtggtacgccgggaagcgcatcgcctacgtctacaaggccaagacgaagagcaacgactccaccatccgctgcatctggggcaaggtcacccgcccgcacggcaactccggcgtcgtccgcgccaagttccggtccaacctcccgcccacctccatggtaaatctcgctctctccgtcgtccgcgctatccattgatcccttcctgttttggtccagtcgtatgtagtttcgttgtccatttctgatgttttatgctggattgttttggtggtgcagggcaagaaggtccgcgtcttcatgtaccctagcagcatctaaggtagagtgctgtacttagttccaattgtttcaagcttttacaatgtggtgatgtattattgactattgcttctggttatgtttattgttcattgaatcatcgagctcgtggggttggtcagaatcttgtgcaattgttccctggattctgtatttgtgacagttgttgcctgattagatggaatggtgcattgttaggttttggtgtgagtgatcattatgtttgtgtctaagggctccatgccaatgggggaagctcttttgctagcttcgaaatacctgcaggttctctgcggggtgctcggaagttggggccctagataaaattcagcggtctcatagtacgaggctatgctttggttgatgggtctctcatcaacctgttcctcacagccttgcctccaatgacctcaatatctgttaatctaatatgtcagtttcctactgttaactagtattcatgcgagcccgagtgacatagtgatctcgagggttgtaaactaatgtgttacactatatgctttgccgtttaattgatctaggtgtccttcatactttgtccttgtttaggggtcccaatccagtttaggatgatagccccatcctgactaaaaaggaattggggtggcaggaggaattgcctgagatccctgagatcggtttgctctggattttttacctgatgatggatcaaatcccttattatgcataaatgtagaaattggtgagtcttagcattggaagttgaaaacgttaatgactatttattggcggctatctgcattatctgatccagtggtgtcctggttgactagtggaacacaacttggaacacaaccatctctcggtattgtggtatgatagaaacctaccgtgtgggatttcttcataattttgtgactttgtgttgatagttgataatgtcttcagagcataatgcagtccgtttggtataatatattttgctatcattgtgtttttttttttgtgcttatctcccttttgcataacaagtcaaaagtttgaaaactaacagtaatttcacttttaactgaaacaggtttcttgcctattctgcaaaactggtagttggcatcgtggaggttttatatcagctagtcacttggtttaccggccagagaaatttaagcgattttgaggagtttagcttttgttttactgcacagactatctggttgcatcttgtacaacgcatgccaatcactcatttgcgttgaaatgatatttccatgcggtgttaactctttatctgtaatttctgtctgattgtcatggtgactgtcaaatgcaaccttctatagctttccatgaaccagatgccctttgatctatacaaacataacatcgctattgtgaaccaaatcatcgtatcaaaagttcaaaactgttggcttgcagtattttaggatagtgatcttgcgactgctaaagtgttgttttttactacgtagcaacattttgtggtggaggtagtagttggcttccattatctgattcgtgataccttgcgtgtaaaatgggaactacagggatctcattcgattggatgactttgtactggacttctgtgtcgtgcgtcaagtgaactgcgtgtggtgtagtgtgccaatattctttgcgacctcccagtcaatcctactagttagtatacttaaaataagaagcaagtatatttgaatttaaatgtagtatacttcaaacaagaagagtcgtgttcacagtactagtatattagaatttaaatttgctaattgaaaacactatcccacatcaaatttttcggcaccgctgcatcgcgacgagatcaaatctacaggaaaccgcgcgagatcaaccggcttttcaactcttccgaaatgccggagcagccgtgcctagcgccgcgccaccgcggaatcgccggcgcggatgcgtgaatcctctcacctgcgaggctgcgactgcgacgctacacacactgacgtctcggtctcaaaaaaaagtagttgttacactcctcccggcattcgagtcccagacgaatccgacgccgagataagtgacgggggagatggagattggtcgtctcgtgcggaagcagacgcagccaggctgggcaccaaccacccgaggaggaggaagacgacgaccactcgctctcgcgctcgggcggctctcgtcccgtcgtccggtgcggtgccgctgcctcgccgccatgcagacttcgccgccgccgccgtccgtgcgcacggtctccatccccttctccgacctcaaggtaagagaggaacccgctgcatagcgtcgtatggttcttgattccatcagagttgcgacgccgttttctctgctgctgatgcaggagagggatagggacctgagcgggaagatcgaggaagggctcgggcccaacgggctcgggatcatctccattgctgacgtgagtgtgacgcgttgaaaactgatgcgcgctgcgttcctggcctgcagagaaaatttcgagttcctgaactgaattttgtagccgtctttttgcaggtgcctggttttcccgtgctaaggaaaacgttgctgcgcctggcaccaaagtatgttcttctcttagtctcatctttgtgttgttcataggaggcacatttcagtttcaacatttgcttgatatttgtagtgaaatctcttgttgcttgcttccatttttttttagatttgcaaaccttcctgaagatgtgaagaaagaacttgaagacccagacagcaggtgaaaacagaactgcatggtggtgccatttggttctgtacttatgttcttaatcacgaatttgatgtagcctattatgtcctccaattgggagctcctagttaggatcaacacctgaattgtacttcaacttctatccattttgacagtctagagtgagtacacagcaatgatgagtttgctcctttgcctcttaggtttaactttggatggagtcatgggaaagagaaacttgagtcagggaaactcggtaagcacttttgcacttttatctaattatacatcttaccatatgtgagatattgcactttattgaaaagatctgtatcacagacacattcaaaggctccttttatgccaacccaattttggatgctccaaccactgatgatgtacttgtgagaaggttcgttttttcatacataaataatttaactcagtttactgttacaatttagcactggagaaaactgaacaatttggcaacctttattattctaactccaacgaatttagtatgatttgagttaattaaagtttaattatcttactatggtcgatcatttgtatcactcaaaatgacctattgtattgctagtgcaaaagagttgtatcatatactcataaagaccaaatatgacccttattataggtgtttttaatgtaatattgaaccagcaggtacccatcttattgccgaacaaatatatggccagccagtcatcttcctgagctcgaaataggtatgactgactgaccatatgtatgtatattgactgacttgagggctatttctcagtataacagtacatatttgttaccttttatcactattttaataacccattcctacttattttagccattaaaatggaggacttgccataggcccatagcacatgtttatatgttataagtcaggatatctgtattgaataaatgtaccaaaggttgtactccatttaccttactggctgtcttgtatctcaaggtgctaaatgtaagatactgaatggttaatgttcattttcagtgcctcatgatcattacatgctgaaatatatttttaagtggttttgatttttgtagaacttattatgtatttccatgctagaatccaaccatttttacaacatttctttcatttgtagcatttaaagctcttggaaagctgatgttggaagttggcttgatgttggctcatcattgtgatcgctatggtatgtactatataattctataggcttacctgatatttcctttaaaaatgtccagggacaaaccacatctgtttggctaagtaaaaaatctccacaatttaacctttggattgattataattgtcaactctgtactttggtctttaagtttggtattccattggtgaattggaccaacttctgtttgtttgtcagtaatgcagcaaggagtgggaccatatgatggtgaaagccttgagcagacaattgccagctcaaggtgtcacaagggccgccttctgtattactacccccggcaatttaggtaaatatgatgtatacacagtatttctgacaagaaaaaacatgcatgaattgcatctctaggcagtgattcctttatgaccttcttgtattttggagttaataagacttaggaatggataaacaagatcaatgtcacgcgattccactaaacagcaagatggtgcctatcaagtattacacaccattgacacgcgatatcatcgcgcatattataaggcattttacatgtgttgtccatgtagatcaaagctttctaacttttcttacctttgtaacaatcaatatattttttttggattcaagatttttcaatgttctagccttttagttgtaaggattgatgcttgcatgtctcttatttcagtaaacaagaggaaggtggttctgtttcatcgtggtgtggatggcatactgaccatggatctttaacaggtaatacatgttatccctatggttgaatattatcagttgcacgataactcctgaacatgaaagtttgttgtggtcaaatgagcatgtggtgaaattctgaacccataaccttactgtattatacatatattgataaccataaatctgatctccgttttgtttcctactactatcatctatgaggctttagcgtttaaaaaacgtttgttttaatttatatatttttttcaattctgattatgcatcctacatgcaggacttacatgtgccttgtttacgaaaaattcaatggagatcccctgtcctgatagtgctgctggattgtatataaggactcgtgatgataaagttgttaaggtaatttcctgttaatcactatagacttatcatcaagatgatgctttgtaatttaggttgtacgcagtcatctctacattgaaattgatcggtgcttgcagatttggaaatgtagccaggcatttgaaacaatgtttaatcattgttagttgaataattgcctgtgaattgcattagcatattatacaggagagggttatgtggtctgcactaattgaaattttactgcataaggttacatttgaggagaatgaattggcttaccaagttggagaaaccactgaaatactatcaagaggtcgtctatgtgcaactccacactgtgtgaaggtattgtactataaatttgtagtcatgggtaatcagtgttcctagttcctgcagttgtaaagtaatttatacttttactgttgtctctaggcccccagcagtgaaaacgcctcgaatgttgatcgttcgaccttcgcgatgttcatgcaaccagattggtatgtgcagttttcttgaccaaattgtagtgttcacatattctctcacatggagaacttttgagtttcctgcccctcatcctactagtgacttgccacttgccaaagctcccaaccaatttcaacacataatgttagcccacatgaagagtactggttttccctcatcattatgtgttatgtgggtttgttcatttatacggtcaatactcaataatcaatagtaatatgcttgccgttacgaattcggcacgtagattttcaaagcctaggtctgattaatgtgggtttgctgacattttctttttattgtgaaatattttgtagggatgaaaagctcaagtttccaagtgaaattccgtatcatcaagaggtttgttcctaatcagaaacttgcattcagtgctcctgcgtgcctttttctgatatagtaatctatgttttaacttctggcagttgatcccaccgaatggaactcttacattcggggagtattcagaaagattggtgaacaagtattaccagggaaagacatgaaacactacaatacgcatgcaattttcaattgttgtttgtccgtttcgtactagcagtgaaatcgtcagtgcaacctggacaaacttaactgttaggttctctgcgtgtgttttgaactggagattcgagcaaccaatcatagaaaaaatgtgtctactgtaattgttttttccttacgataaaagcaacaacaccggtggcagcgtcaccttttcttggttcagtttccactacactcatcttcaccatacttgattgagtttcctctgtagtatgggggtgcttagatctatgagtgtaaagttttggtgtcacatcggataagtttgggtgtgtcacatcggatatacggacacacatttaatgtattaaacatagactaataacaaaacaaattacatatttcatttgcacactgcgagacaaatttacacacaatgtcattagcaccacgttatcaaatcatggagcaattaggcttaaaagattcgtctcgcaatttacacaatgtatacaattagttatttttttcatttatatttaatcctccatgctatgttagaactctgaaaactcggataaacatctacatggactaaagacacatacaaataatacaaattaaacaagctgaaaataaagggagcgaaagaatggactagtaacaaattgaagacgatatatgtaaacggaacgaaagaatgggctgtgacaaaaattaaacacgatatatgaacttggtcgtaatacaaaaagtacagcagcctggtgtctcctagatcctcaagcacaaggaacaaaagcacaaaccaaatgacacctcacagctgcgttgatctatgaatgacctagaacggggtaaaatcagctatatatgccccaagataggggaggatcaccaactgggagtaaaggagaaacatgagtatgataagtagatgatcaggactatttggaccatgcaaccgcatcaatttctgcttgagcactccgatatagctccagcctcttcgcaagattagtcctccgttccatgacggcggggtcttcatcaagaagcttagaaagttgtttaatctgcataacatttaaaaggcagtattactagttagatcaattctgttggactttaaaaggcacaccaaaaaaaatgtaaaacagggcccaaaaacttatgttatgctttattaagctttaagaaagaagaactcacctctcttgctcccaattcagtaaagaagtgatcgagcagtgagcgctttgcctcccgcacttgacagtagacaatagatttcggaatagagttcctcaaggttgaacataccatgttaatatatgccagaaccgttgttcctgttgagtatgaattgtagcaaggttcagcagaaaatacaggtaaaataagttaaaaggcagccaagcaaagccttgatggcatgtatattcatcattaaactaaattagtgggcaatattacacaaggttgcaacaatatgataaaccacttctcaacttcaacaaatggccatcattgcaaagcagtaacagtatacattgaatatatacaaggaagaatggttgatgacttaccaattcgtctaagataagaatcattatatctatcaaaaatagagtggcttggatttccacccttctcaacatcctggggaagtttcctgaagaaatctacggttaagtagctgcattccatatcaacaagctttaatgtgtttttcttgctttcatccctcattctgtccaatgactcaaaagccgcattgcctacttccacacgaagagtggggaactgcttcagctcctgcagagaactcactcacatcttttaggacgcttacacaattacaagtggagtaatgacaatttgacaagcatgcaaattaattatcatgctgcttctcatcttaagtcgagcaaaaaagttccaggttcagattttattagaaagacaaaatattgaaacaacagaaggcaaaaatttcaacagtattaattgattacctcctaaactcctagtacaatcagtatacctcatgtaccatcagaatgcacatattccccagtataagttacagaaaacattgtgcaacagtgcgaagacttacatgtgtttcattgatggccttgtgcactaattccttgagtatcgcatggacctgtcagtacaacaaacatacgataatgttgtagtgcacattcttcaacaatatatgacacgaaaagttagaaacgctcaagctattttgttaagactaaaaaatagatcaaattaatagatagcataccgcatccacagctgcctcagcaggacctctgatactaacaagacaagactctatgagccgtcgatatccttgctctggagctattaaatgaggttggtatccatcagcctccgttatgagctttttcacattttccattgccagttgtttgtcaaactgcaaccgtttaatggctacaggaaactgattgtcaaagacatgatagattttctcaccaccaggacgcctggacattagaatttttgtgggtaagcatcagggaaagcaacattcaattcacaaaagaacaagcacacaagggagaatgatgctaattgcatataacaatctacaagttaaattgtgttaaattgcatacttcagcagcaagaaaatatgcaaatctttattagcaataactttgtaagtgctatcatgtaattaggttttagggttaaattcgacgatccctttcttctgaaagaaaaacaactggagattctaggtgcatgtacgcccaagcaagcttattgaaatctttattacatttgatagaaatttattgtttaaaaatacaagacaaattaacaggttactttgccaagaacctaaaataggctgtatgcttacgttggagtaaacacacaagactaacaccaaaggagagcttatcaaattagggccacacaaattttagaaggcttatacagatcagagaggggaaaatgttattttaggataaaatgttattttatctcggaattcaggaagcacacacgtagctacaataaaacttctaagagaacatttagcaacagaaacattaagtttgaaacatacactccatccagatgttctttgtagataccatcaaacatgcggcatatttccatgatcgtgtacagctttccctgcatggccaaatatgtacaaaccaattatgtccattagcacaatgatcaagaacatacacaaaaaaaatgggcactacattagcaattagcataaaaaggggatgcagaattaggctcaataaaccagtatctaattaaagaataaaaaagccctaatcttactccagcatctgtagcaatgggcttcccaagtcgattaagttctgtctccagttcggcaattgtctttgtaatgagagattggagccctgggattcttgacttaataacagtctccaaatgctacatatacaccaaaacatttaagagtcaatataccaaacagagttacaggtattctacattagaaacgaaatgaaaggcataccttcgagagactctttgctaaatgttctgatcccatcctatgagcaaggtgcttgtattctggcgtagttgaaaaatattcacgctctctgcgcctagcagcaatcatgtccacattcttgttgatatcctgctgagatcgattgacgacaccaatccattgttgttggagccggtatgatctgccttccaatatctgcagaaaagaaccgtaagaaaatacagctcaaagaacaaacataaccttcattttctacaactgtatatcttccaacagatagaacagaagaatattcaacataggagatttaaaaggtcccaaaagcaagggaacaataatccatgttgacatctccggggacaaaatgtatcgataataaagtttttagcaattaattttagctgggaaaaaacttacatcaacagcatcggtgcccttgtccattagatcaatttttgtaagcacaccaaacgtcctttcacctgaacattacaagacaaaccacatctcaaaaaacatgattgccatcctttatccaaatggcttacaacaaaggcatacctttggggtcaacttcccgtgaaatcttaattgcatcagaagttgcaagatcctgattggctggagaaacagccagaatgatacaattgggctgaaacaaaccaaaaagggtcgatatacatataagcttttgcaacattacagacatgatacatgacaagataagcatagctcacacactacaagcataatgcatgatacaaaaaacatattccaaatatgctaacacatggctgaaatcataagaatgtcgaaacaaatatgcatagaataaattactgtatatgtgcatacaaagctatggtaccgaaataaggcaagcatagtcagcaatggcagtggacaaatattaaaaggttacagcaaaaaatataccttttctatgaacgagcgaaccatgttttcaatgtcctgaacaatactgtcaggctgaccctctggaaagcatatagcaagtggtaaatcaggaaatggacctctttaaaaagaacaaacaaaagaaaatagctcacaaatgacaatgggtaatactgaccaacagcaactttagtaagcccaggaagatcgataagagtcaggttcacaactgcaaaagagtgggagttaagacgctaacaaaaatagatactagaaaccagataaatcataaacaggcatgcacatataaagacaaataaggtatggtcatcttatcaatgacagagatctcactaagtaagcaacagacaaaaggaacagcttttaagccacatatccatctcagcaaacaataatcaaaatgaaccaatttgactgtgataaagcaactacatcgaactgacattttatattattgttatcttaccatttggagaatatatgcttaaatgaatagggaccgatgatatttgctttgaacgaccagtttctctgtcagtttcatcagctatctccttcctcacaagagctgcaagaatacgactatcatcattaaccatcatgcagttgaatatatgtttagcacttgaaagactgtttccaccaacaattacaggtgtaatcatatatgtttgactatcatccaacattggcaatctagttcagtttgaatatatgatctccataaacatgcaatctcgcaattttaatcacagaatgatatgaccaaaaatgaaggaaaaggtagatggagtaccgaaatcagtgaatctcttcctgggaaggtgcatgaactctgcatattctctgtctccgtcgatcctatgaagctgcagcaccaagggacgacgggtgacaatgcctggaaaccaaatccaaaaattccaaatcagataaaacaggagcaataacactgaattatacaagcacttgctattggaaccgccatacctgagcctcttggtaggaaatccttcccaacaacgctctccagcaccgaggatttacccgaactctatcaaacgtatcaggaaagttcaaacgtcaggttaccgaagtacacccattctggtacagaaataagcttaaaccatttctaacaggcgcaactccgcacaaaattccatcgagctggatggttccatcaactagtttagtagcttcagttgctacaaaacctatcgatttcatgtaagcgtccaaatctagtcttcggcgagcacagcaatcgtagatccaatcgtagctagaccgcatcggctactaatcctttctgccctaccagcaactcgcgagatccagatcgacgcagctgaggcgcgaggggccagatccgagcgagataaaaacgggtaggggggaaacgacgggaacctggcctccgacgacggcgatggccggcagcgagtcccagagggtggggagggcgctctcctcgccgtggtcgccgagggcggtgcaggcccgctgcagcttgttgacgagcgagatcaggttctccatggccgctgctgctgcggcggcggcggcggctcagcgagatctgggcgagatcgcgcgcgtggggggaggggcgagatcgaggtcggtggagaggagggggggagatgagggttggcgatgccgactgccgagccgcgtcggggtcgagagctgcgcggcctcgggctgtgtatggtggtgcgccgcgacggtttggtgatttggactttggaaaaaggcttcgtggggaagaaacgggctggatttttcacattttgatccttttaaaaaacttatttcccaaatagaccccttaaaaaacttatcccagaaatggtccttttttgggcgcca

SEQ ID NO: 73887 - DNA, 1421 bp, Oryza sativa
cctgcagccctgacttgtcggtggggttcgaaatttcagaattttccgagaattttgaaccaaaatcgctatcactagtcatgcgagcacgaagaattagggaacaattcaatatgaattcgggttaaacccatttatgcccaaaaataccagtccaatccaaacccttttttcttttttttttttgcctcagtccaaaccgctccggtccgttagctcactcaacccatctccacccaaataaagcccacccgtagtgaaaagggtaaaatccagaagaacaccacgcacaagcacaaccttgaaaatctgaagagcacacgaagccctaattaaccaaaacctccgccgccgccgccatggccgccgcggtcgccgcctccccggcgcaatcccgcaagacggagacctacaccgacaccaagcgccgcgacgacgtccgcggcctcaacattgccgcggggcgcgccgtcgccgccgccgcgcgcacctccctcggcccacgcggcatggacaagatgatctcctccagctcctccggcggcgaccaggccgtcatcatcaccaacgacggcgccaccatcctctcccgcatgcccctcctccagccggccgcccgcatgctcgccgacctctcccgctcccaggacgccgccgccggggacggcaccaccaccgtcgtcgtcctcgccgggtccctcctccgccgcgcccagtccctcctttccggccggcgcccaccccacccggggcgacgacgccctccacctcctcgccgcgcgcgccgtggaggtcctccacggcatggccatccccgtcgagctctccgaccgcgaggccttcgtcaagtcggcatccaccgccctcaactccaaggtcgtctcccagtactccaccctcttctccccgctcgcggtggacgccgccctcgccgtcgtcgacccggcccacccgtatctcctcgacctccgcgacatccgcgtggtgaagaagctcggctgcacggtcgacgacaccgagctcatccgcggcctcgtcctcaacaagaaggccagccatgtcgccggagggccaactcggatcggggacgccaagatcgccgtgatccagttccaggtctcgcctcccaagacggacatcgagcacagcgtcgtcgtgtcggattacgcgcagatggatcgaatcctccgcgaggagcggaattacatccttggcatggtgaagaagatcaaggcatccggatgcaacgtcctgctcatccagaaaagcatcctgcgtgattcagtcaccgatctgtcgctccattatctcgcaaaggccaagatcatggtcgtgaaggatgtcgagagggacgagatcgagttcatcaccaagaccctcaactgcatgccaattgctagcatcgaacatctccccgagga

SEQ ID NO: 73888 - DNA, 2306 bp, Oryza sativa
cttcatacatcgatatttgtatgtctggcatagttcaaatagagatgaattattgatgcagggtagctcctggctatggtggacctagaaaaattcacctgtaggatctgttataatttattcctcaagtactatggtaatggtctagggatcactcccacctattggtggtccatttagtattatttgcactcaaatgaactagaaggggtcaatgggtcagcctgatctggtccacttgcatccctagctaaactatcatattaggtaggcaatttcttataaatgtataggatgatttaactgaacactcagtagctgctactcatccattgcggctttcatttggttactgatgttgccacagccaaatcaattaggcgcaaatctgttccattattacctgcttgatgttctgttacatatgttttgcaggcacacagccataagttggtgttccatgagcttataagagtgatgccattattggcatgtttctatagcatctagcatctcccaatgttatgcatgtactgggctcccttaaaagatggaaattcagaagtctgatcatcatgagcagaatcttacttcaccaagagggctaatccataaagtgctgcgtcgcacaagtagcaggcgttctccaactgcagcagaccataacccttctcctgtattcctggagacaagcaattcaaaattcttaaagcaaaaggatattgatgatgccatcaaggatccagagaaggcaggcacacacgacaacagaattgaagatgagaagtctgatttgttagggtatgaaatttgttctgggaagcttacattggataacaaagccaaaagtgcatcaggtgaacagtctggatcagggtccagtagcaattgctttgatgctagactcactactgaagccttggtatggggttctaatatccttaagctcgaggacattgtatctgtgagtttttagctcattgactttattctgtaaattgcgttggtatgtttctgagtttcactgcaagtccacatcatgtgagagcaattctaagatcttttcaactttaacattgcaggtatcatatcattccgggctccgtcacttcactgtgcatgcatgccctcttgaaaaaagatccagtggactttcctgctttatgaagcctagaaaaattcaaaaggacttacgtttcctatccacttctccacacgaggcttttcggtgggttaatggttttgcagatcaacaatgctatgtaaatctattacctcaccccatggcatctagcaagaagcattcatctgaactcattccatttgataatatgtttgatccatgtgttaaatgccggtctcccccaaagatacttgtcatcttgaatcctcgatctggacatggtagatctagcaaagttttccacggaaaagtggaacctatattcaaggtatgtctagatgaatagaatcatgtgcattattttataatcagagctgtgatgtctgcctcatcaactcttaagcatgtttgcagcattagctatggtcatatagtcattacataactttaaaaaaaatgttgcaatgagtgtgctttcatgtttccttatttaccattgacattggttaccgataaaaatgcaagtcatatacctaatcgtgttgacctttttatttgtagtaatcaagtaagatgctaactttgcataggtagatgaaaaggcacgaactgtttctttattatgttccttgatccatctccataaaaatgaattcgtttgtagtagaggaccatatcaatattcatgttgtcagtatcttaccaagatgagcttctctatgtataaattcatgtttgagttcatattgtgccctaagaatcatctctcctgttgaactggagcatgctttgctatccatttgttgccaggagccattttgaaggttctctggctctagtagttcacattatctgtcaaggtccgctggttggtatgattcatatgtttgaaatgttcctgaactttaagggattttaaatctctctctctctctctctctctctctctctctctcgctgtgtgtgtctgtagctgttgtatcctttcatccagtctatttgaatcaagatattggtattacatagacacgtgtgatggagtaatatcttgatacactgttgtctctactgcgttacatatcaatcttgctgcttctagtgccatgccttgaagattatttctgccatgtcctatcatctctgtaatgctgaatttattagggatgaaaatgggctgcaggaa

SEQ ID NO: 73889 - DNA, 7062 bp, Oryza sativa
ttcccctttctactatgtgccaatgcatgttgcccggaatgattatgtgaaaaatctgcaaaactcatgaaattccagtgttctaaaggaagacacgaagtgttgtatacatcttatatgtcctgtcctgtgctgactgcataatcagttcatctatgatttgtctagcatcaggccatcagccatcctttttgagagtttactcatccaaatgctaatatttccggaattaaaaaatttatggggttcagattgacaaacagtacgtaatgacatttgctttaatttgtgttagggcctaaactactagaaccaaaatcctggaaatatgtcatccccagatgtcggtgaggcaacaccgctgaggtcatgaagaggcctttttatagaggtttgcaagatttattattacacaacaagacatgcatacatttttggtaagctatcagattcattttaacttctgcttgtttcgttctgtgcatgtcttggttgcaggattgctcccaaactctgcttgtttcgttctgtgcatgtcttggttgcaggattgctcccaaactgaaataacgggttggtgactttgtagtgaacatgggcaatccatcttctaaattgcaaggtatttctgtaaagcgtatggctgaagcaactagaaaacatcatttgggtgaaataattccctgaaccatgcatgttgttgcagacataattagcatatgtatatattgatctcaccgattacgcgcagtgattgaaatttcgtttcgaaattttggatcccccggcaagttgatatctcggccaaaatttttggtttttcacaaattttggtgaatttggtcaaaatttagtcaaattcagttagagtgtatcaaaaattcagaaattttcggtccaaaagatgttcggaaatttcggttttaccgaaataaccgaaaatttttgcccaaaacaaaattgcaaacctttattacgcgtactacgcaagtatttcggtgagcacatttgcacgactccacacctccgctgctgctggtatcttgtattatttttaggctgcatatatgacattttataattatagctgccatatagtcataaggtgtgagagtcttgtagtctggacgctcacgaatgatggtcaccaaggtagagttccttggagtgattgcccgaaccatctttttgatcacaaccttatcggtcatgtccttggactcaagccccttgatctcattgatgatcttgctcaatcgatcatacatgtcacttgggctctcaccatccaacatcacaaaccgctcatattgcccctttaggatctccaccttggactcacgaacgctatccgtgccttcatgcaagttgcgaagtgtatcccaaatcaccttggcactctcaatgccgtccacccggttgaactcacttccactcaaggcgctaaatattgcatcagcggcttgagcgttcttgtgctcgtgttctcatcgtcctccttgatgggatcctcgggtttctgcaaaacataccctttttcgactattctccaaatagaagggttaataaacttcaaatgcatcttcatcttatgtttccaagcagcatagtccgtaccattaaagttcggagctttaccgctataggtgctcacgtaagatgtagatgtaggtggatagtaataagggatcttagctcccttatcacctttcttgccatcccccgtttgacccgatatgatctctccaaacgattaagcctaattaggagattaggctctgataccaattgaaatggtcaattaggcctagagggggggtgaataggctaatttaaaaacttaagtaaagcggaatcaggaattttcagaactaagcagagattttcggaacttccgaaaatactcagtgcagtcgaactcaagatgataactctagatctagaagtctacaacaggataaacaaggaacaaacagtaactagaccaatagcggcacaagcaagcggagctagtggagagggataaagaaatatcaccaagataaagctcgcaaagttgttcccgaagttcaaatccttgagtagattctactctccgttgatgagctcactaagagcagggtcttagctaaccatttcctcaagaggttgcactaagcactcctccttccactaagaggtatctctttccttgcggaggcgagatccggccttcacaaacttcttccggccaaccacacatagatcggtggctcgggagcgacacctagccgtctaggaatcctcaacctccaagagtaaaacataatgcaaagaactcccggagatgatgcaagtgctcacaaatcttcacgaagaccacaagaagcccccacacaaactcgaatccacactctcacacacacaccaaatccgaatcaaacccgggtggagagaggaatcgagaaagaaatggctcaaatgactagagagagaagcacgccaagggtgcacaagtttgtaatgagagcagcagccttcacaagtgaggggagtgggatatttatacccacagctccaaatctgcccgttggaacacaataattctgattttcggaacatccgaaaaattccagatctgaaaaaatcgaagtcaacgcacttttcggaacttccaaacataattccgaaagtactttcgatccagaagcatatttggctcgcagacattttcggaacttccgaaaatacttccgaaaatttccagaagcttaaaatcagttctatgtattttcggaacttctgaaaatttccagaagcttaaaatcgattctgtgtattttccttccgaaaatttccaaaagcttaaaatcggttatgtgtattttcgtaccttctgaaaatacttccgaaagaacttccgaaaatttccggaacacacccaagagggcaatgcttccaagaaaaatagattttgagcacttgcattagtccttatatgtctatgcatcatcccccttaatagtacgactttcctatgactcaatgcaaggtaaaagatacaatataccatttgatcattgccatattgcatcgtgacgtcgcattcaacggggtatgcatcacattacaacacatcgaggacataacaaccttcatatttacttgaataaaaaagttagtcctctctaacagacaagcatcgtagattctttggttcagctcactaaactggaagtaagaatcaggtagtgatttaggcctcgtttggaacagcttcagctcccaactccaacttacctagagtcggatctgtgccaaatagtccagttcctccgtttttgggaatggagttagcagagctactcttaaaaaatgaactacgggggtggagctgggattttcagctccacagctccactccaacctaaaagaccaactaccctttaattttttacgcaaaaatggcactgaactaccccaaactcacctctctcacggtcggtgcacacgcgtggggggatggcgcgcgcggcggcggcgagtgatggcgtgtggtcggcggcgcatgagcggtctagggtttggggatttttttccttttttttcaatttcagatctggagttgaatgctagccaaacacttttcagcttgttcccaactcccactggagtgggagtttagagctaggtgttggagtttggtgccctaccaaacggggccttacagtgattaagagctcacagtaaacattcggtaaacagcaaattatagcgtactagtactagttaatctctccgtcccaaattataggaagccccatttttaagaaaaattaaactcggtagcttttgactagtaatcatactaactatatctatactaagtattatatatgttatatcactagattcatattttgaagaactttcatgtgatgctaatttcatatttggtgggatcatagaatggaatgaaatactagttaaagtatgttattgcagaccgtataaaaaatatagaccttataatttgggacagaggaagtactacgctataatttgaactttcttttcttttatttctatgaaaatcagttgcaaaagcatgggctttttcgctagcactaaataaaataataaataaaataattctgaattgacctttataccccctgatgggcacccgatcctcattcccaaatcccgagaatttagactatttaccatcaaattcacgtgcctcaacttttttaccactcaatccgtatgccctctataatatatcactagagctgctaattgttagatttggtaccactttcactattttcatccttttctattatttttcacatgttaatggacattttaaccccctggacccacctgtcagatctttggatcggatcgatccatctcctgtcgcatgccccttccctgccgcgacagagagcgacgccgcgccatagccgagcaccgccgacgccgggcgccaccaccccgccaccgagcgccgccaccccacctgccgccgagcaccccaccatccatctgcaaccgtccatctgatcgtccaattgatttttgtatgtaagcacagatacgatttggtaggagtgctagtaatactgatcttgtatgtaagcaccttggcatctcctgattgcatatgtgagaatcatgcctcaaaaaacacagcttacaataattttacatatatcagccaaacttcatccagaattcagcacacattggcgacggcggcggcactgcgtcgagctgaggcgaggggcgacgggagatggatcgcatctgacaggtgggtccaggggcaaaaatgtccatcaacatgtgaaaaataataaaaagggataaaaatagtgaaagtggtaccaaatctaacaattagagctaacaattagcagctctagtgatatattatagagggcatatggattaagtggtaaaaaaattgaggcgcacaaatttgatagtaaatagtctaaattctcccaaatcccaacctaatcctagaacatggtggccgcgcgtggggcaaggtagcaggctgtggcggcgagcaacagccggcgcccgtggctgggcggcggctggctaggctggccagcgaggatcgagagcagcaagcggaaagttttctgtaagctaattttagcctcatttcgcgttttatgtaggtagaacttgattgttaatggcaaactgaatcgatgctgccagccatcttcttttagagcaacaccaattactactagtatagtaattacagcatctgaccatagtgccgtaaagaccgctcaatatatagcagggaaactaactagcttgtgtcgacagaggacagagtagctagcttgtgtcgaacggtaatgtagcttcagtagaagccattctcagttcacctttttatgtggctatgagaatgagtgctgtccctttctcctttaaaccgatctccaaggtgaaagttccattaaaatccagtgtgtttgtgtggtgattgttgaggaagtgtatcctcaccacagatatcaagacaaagggatgacatgttggttcatcatttgtgtcaaattttattgaaattatgtagaattctgccaatttttttttcatatttgtcaaatttcatgtcaattgaattctgtgaaaatcaggttgaaattgggcaagtttcatgtcaatgtactttgatatcaaaataggggggatgcaacatatgtacaaaattaggggcaagtatgcaacaataatcaaggctatacatgtttttttaccatagacttaacactgtcaacaggagttaacaacccagggtcaaatcgaagctttgattaaaaaaacaatggcaaaatcacaaaccctacaaaacatggggaaaatcacagggcctcatcttttagcttatgcttatacttatgagccaaaatttgaattttcaaccttaaatttggagttgattttgaggttttttcattaaagtttatttttcagcctttacttttagattgctaagaacacgtatataaaagttttattcacaaattacttttcgtttgcaaatatgccatttcgaataagcgaaacgatggctctaacaatcgtgtggggaagtaggcgcaagaacacaattgccacatatcgtaaatatcaaatggatttcaactgcacggtgtgtgctatgtatcagtctgcatgagcgtaagatatttgcgaaaaggtgccccagtcccagtctgtgtagtacagtgcatgtcaaaggagggagtttaccaccagtcccaatgtgtgtactacagtgcatgtcaaaggagggagtttacctcccaaaatcttccaatcaggcatagtttggtcattagctagatacttacttttctattacattgtatatataagtaaaacaaaagaactcaattattgtctcacatacttgtttagtttctgcagagaaaacccagagctggattatggacagagcaggcctacaggcataagctcacaacatcaagcaacaatagtgcaactgtgcaaccaataattgcaccttatgatggagacattccacagccttgctgtgagggtccctatgtgacacaaaatatccaaaagcatgcagtgaagtcaaagtcaatagacttgttttttaagggaaggattattttttttggcctcaatagaagtgtgttaggtaaggctgccaacaagccaatggataactctaagcttttaagaggtttgattgattcaattgttcagcacagctttgctggtctgttgcttcacatcaataattgtcatccatggctacgagcatgctgcttgggcctctcatcgccttggtcaatcggcaggtctccaattacctgttgcaacagtaccaagagctggatggtatggaggagcagctcacaattctggagcgcaaactgccggccatattggatgtcatcattgatgctgaggagcaaggaactcaccgtcctggggtaagtgcttggctcaaagcactcaaggctgttgcttacaaagctaatgacatatttgatgagttcaagt

SEQ ID NO: 73890 - DNA, 16412 bp, Oryza sativa
cgcgagccaaatgtcggacggaatcctaaaattatcttataatattacacgttttaatttagtttatgactaaacaattaaatataatgtacgtctaaaattcctagcgattaagtccgaatttctaccgtgaatcgatttcttatagagattatccaaaaatgatccataatagtctataacgattcatctatttgataattatgtctaaattactacggcgaattgatttcccatagaaactaccaagaataatccataattaaattttgcaattctacggctataattaatctataatgaaattctaattattttaaattttctaaacttacccaaactccctctaatttcctatttatttccttttctttttctccctttcctttttcttttcttttctcttttcccctttctttttcttttttttttcctttctctttttctctttttcctttctttcctccctcccggcttcctccttccttcctctccttttcctccctcggcctctctctttctctctcggctcggcgacaaaagaaagaagggggggggggggggggcagcggctcaccgacggcggcaacggcaacggcggcggcggcaacaacggcccacggtgcggcacactggggcggcggcacgggggcacaaacgcggcggcacaacagcacaagggcggcggcccggcggcttggaggcggcggcccggtattgtgggtaaaggaaaggggtggaaatggaggggaagagggggaaatagtgaggcttatataggggaggggaaaagctaaggggggggggaggggagaagggagacgcgacggcgacgcggggcgcgaggtgggggcgcgcggcgcgaggcgacgcgacggttgcggcgacgcgacggcgggcggcacgaggcgcgagacgacggcgacccgcggcgatggcgacggcgacattggcgcggcgcggcagaggcgaggcgacggcgatgggaacggctcggcagcggcggcgcgcggctcggagcgacgatgggacgcgcgcggcgatgggacggtcgcgcggcgacgtcgacgcgcggtgacggctcacagcagcggcgcgggacgcgaggcggcaggctcgcgtcgcggtgatggaacgggcgagcggcgcgcgggcgcgaggcgcgaggcgacgcgacggccgaacggtgacggcgcgtggcgatggaacgggcggcgcggcgcggtaacagcggcggcacggggctcgggggagcggcgtggcacggggtgcgaggcgacgacggcgacggctcggcagtggcgacgagacggtgcgcggcgcgatgggacggcgacgcggtggcgatgggcgacgcgacggcgatgcgacggcacggggctcggggcggccgggcgcgcggcgcgcggggcagaggagggggctgggctaggggagaggtgggagagaaggggaaaggctagggaccacattgaacaccttgcgggcaatgaatagtgcactttcctaatattcccgattttaggttattttcaaaataaatttgatttcataatttctaaatcttgtataaatgaagtacatcccacatttgtgttatcctaactaaaatcctccttaatttaatatcactcatattctgtttatataatttattttaattagggttattccatcgcactaaaatttaattattgctaatatggttgcgataatattttatttatttccaaacccacctaacctttattttaattatattttaattatttatttagtcaactagattttcttttatggtttgttcctagctagttattcattattcgcgattaatagactccgacatcaaaatccaatgaaacaggcaaataaagtcagcatgatgcaattggtttaaaaagtttttgaaagtccgcatttttagagttttgattttgttggtcgaattttcagggtgttacaaacctaccccccttaaataaatctcgtcccgagattttcttaccaattgccgaatagatgcgggtactccgtcctcaagaattcttcgccttcccaggtggcttcatcctcggtgtgattactccattgtaccttgtacatacgccacactttgctcctagtcctcctttctgcttcatccaatatccggatcgggtgttctggatatgtgagatcattgctaatgtgaatctcttccagcggagcttgttcttcagacactcgtaagcatttctttaattgggacacatggaagacggggtgcacatcggcgatatattctggtagctgtaactgatatgcgacttctcctcgcctggcgatgatctggaatggccccacatatcttggtgccagttttcctttaaccttaaacctttttgttcccctcatcggagaaacctttagataaatgtaatctccttccttaaattccaggtttcttcttcgagtatcggcgtaactcttttgtcgtgattgtgctacttttagacgatcacggaccaagcgaatcttttcttcggcttcttgaataatgtcaggtccaaataccgcccgttctccagtctcggaccacattagcggggtacgacatcgtcgaccaaacaatgcctcattgggtgacatctttaggcttgcttgaaagctgttgttgtaagagaattcggcgtagggcaaacacctctcccagtccttgctaaaatccagagcacaagccctcagcatgtcctccaggacctggttggttctctccgtctggccatctgtctgtggatgataagcggtgctaaatgcgaggtaacttcccagggcttcatggactttctcccagaaatgtgaggtaaattgtgtgcctcgatcagatataatcttcttaggtataccatgaagacacactatcctggtcatgtacaactcggcgagttttgcactgctatagtttgtcttgacggggatgaatcttgccgtcttggtgagtcgatccacgattacccaaatggaatcatatcctgttgcggttttgggcaatccaacaataaaatccatgcctatctcatcccatttccattcgggaatcctgagaggttgcaacaaacctgccggcctctggtgttcagccttcaccttttggcatacgtcgcaaagtgctacgtattcggccacgtctctcttcatgttgggccaccagtagcccaccttcaaatcctggtacattttggtacttccggggtgtaatgagtatgccgactcgtgagcttcctttaaaattaatcccctcagtccaccctgttcgggtatgtaaattctctttttataccatagaacgtcttttccgtcggttgaaaattcttttgcacgtcctgcagctaagcgttccttcacctctcggacctcctcgttgtccttctgggcttcttctatttgggctctcaaaagaggttgaatgtccagggtgtttatctgtccatgaggcactatatgtaggttcagctgagctatttccttcctaagctcagggaccatcccttccattctcagatgattgcaatggctctttcgactcagagcgtcggctacaacgtttgctttgcctgggtgatagtgaacctctaaatcatagtccttgattaattctaaccatcgtctttgcctcaagttgagatctgactgggtgaagatatactttagactcttgtggtcagtgtagatatcgcaatggtttccaattagataatgtctccaaatctttagcgtatgaaccacagttgcgagttctaggtcatgggtagggtagttttcttcatatggtcgcaattgtcgcgacgcataggccacaacttttccctcctgcatcagtactcctcctagtccttgccttgacgcatcacaatatataacaaagtctttcctgatgtcgggaagaactaaaataggtgccgaggtcagtttttctttgagctgctcaaagctttcctgacactgttctgaccatacaaacttcttttccttcttaagtagttgtgtcattggtcgggctatcttagagaacccttcaatgaaccttcggtagtatccggccaagcctaggaaactccgaatttcggtcaccgacttgggtgctttccattctgtaacggcctctacttttgcagggtccactgctactccaccggctgagattacgtgacccagaaaagcgacttccttcaaccaaaattcgcacttgctgaattttgcgtataacttgtgctttcggagtttctggagcaccaatcgtaagtgttccgcatgttcttcctcgtctttggagtagactagaatgtcatcaatgaatactaccacaaacttatctaaataatccatgaatactttgttcataagattcatgaagtaggctggggcattggttagaccaaacgacatcactgtgaactcatacaatccatagcgtgttgaaaacgctgtcttggggatatcttcggttctaatcttcagttggtggtatcctgatcgaaggtcgatctttgaaaacaccttagctcccttgagttgatcgaaaagatcatcaatccttggtagtgggtacttgttcttaatagttacttcattcaatgatcggtagtccacacacattctcatgctaccatccttcttcttgacgaatagcactggagctccccaaggtgacgaactgggcgtacaaatcccttttcttgcaactccctgatttgctttttaagttcttctaactcattgaccggcatccgatatggtctcttggatatgggggcagttccgggtatcaggtcaataataaactctatgtcacgatctggtggcattccaggtaaatcttctggaaacacgtcaggaaatcgctgcactacgggcattccctttaggggtagcatggtaaatatacctccggcacgttcggttagcctaggatcttgatccatggttgctcgcatatccgatccccagggtgtggtcagggtaacttctctacgtccacagtcaattactcctctatgctttgctaaccaatccatacccaaaatgacatcaagagtttggggtattagtaccataagattggagggaaataccacatcctaaggcggatgggtacgtcaatgcaagctgtatccaccgctatctcacccccaggtgaatgtactaacattggttgtcttaatttaactctggttaaattgtgttgttgacttgctttcaaagatataaatgaatgcgatgctcctgaatcgaagagaactttaactggagtggagttgagtgaaaacatacccatcagtacgccttgatcttcctgggcctcttcagctcgaacgtggttcacttgcccgcgtccaaagccggtagcggtcctgttagtctgcggggtcctgaatagacctcgtccagtagcaggggtggcggtcccgtgaatagccgtcgcattagctccggtgcgaatgggtgtcttgtttggatgaggacatttattggcgaaatgcccatactctccacagttgaaacagcttcctggccttactgatcctgtggcggcctgattcggtgcaggagcgcggttctgaatggtaaccggcctgtggaaattgctggaggcggcaggttgtcacgcccggaatttctatccaaaattccaaacgcttacatgtgtgtgaaccctcgtccaggaatcagccgaggcacacaataacaaattgataatagagtacaaatattactctaattaataagcgaataaaatgtcattacagaggtagatagttcctctcaatcaataaagttctagcagcggaaaataaataaacggcgcagacggctccactccacaggcagcttgaccaaggctacacctaatcctccacaccatcagcctcattgaagaactcttcctctgatgaatgattgcaaggtgagtatatgacatactcagcaagccacgcagcaaatatgcaagtgcacaggataacaaaggatggcataatagggttgcatttgcaaaagcagcatttagcaaacatttgagaatttgataaaacagttaagtattaattaagcaatattaatccaacgctatacaacataccctgttgtatgggcccaaccattctgaacaaccaccccggctgcacagttctatctccaaaccaggaatgtaccattccaaaccaggagctaatcaaattattaccagttatagcatcttttactatgatgagaggtgtgagactaatcacgaaagacattgttagacccgcccataaccgcgggcacggctattcgaatagttttactctgatcagaggtgtaccactgtacccacaagacacaaccccacatcatgtcaccatgtgcctcaataccaccacggtatctcggaaaggagttgtgacaatacccctcgcataacacaatccactgcagcgcaccttcctggatcataatcacccccttataaaacaaggcatggactccccagcgacccccgtgggcttatctccgccacttctcagtctggtgccccgcaatgaaccatgctatacaaaagataaagccgttgcccatgctggcttgtggttggcacgataaatgtttcacaaccgaaactcgtgaaccggtccttaattgccatgagcacgaccttcaaaaccatgtgctcacaacccaccattaccaggttttagttggcacattaattaattaactaatcacgattgaccatcgtgaactatcaataagccatcatgaaataatagtgagtcattagttatcccataagtgtactaatgtttctaagcagggctaagcaattatatctaatatctagttgaaccaatataaataaagctcaactagtcaaattaatataacccaaggtatcaaggaataaggtaatcaatgtacaaaagggccataacaaagaataggtcaattccacccaatgacattcgaaaatagatgcaatagttgaatagaaacaatagctttaaataggatcaacatgctcaaagggttgtttgggatctgtgtgacttgccttgctggccttggaactcttcaaactcttcttccgcgaaaacggactctccggaaacgacggaatctaagcaaaaagaagcaaaatcaccaaaacagcacataaacaagcatgaacagtacatgtggatatttttaatgtgtagatctcaattttagaaaaatttagagacttgaaccaactaaatcggagctaagatgaattagttatgaatttttaaagattaaaccggattaaaacacttaaatcggtttaaattgaattatgacgcaataatgaattatttttgaaaaggaaaaggggatttattgcgtcagcaactagggtttgggtggaccgggcgcatgggcggcggttcacacgaacggacggccgagattgatccgatccaaatcggacggccgagatcgatcgggtccacggcggttcacggcgaacggccttgatgacgccagcaatgacgtcaccgacggcggcggcggcttggcgaggcagacgactcgagcggcgcacgctcaccggcgaacggcggcgctacggcacgaacggaggacaccaacgggtagcggacggcacggcgaactcaccgacgaccaaagcgacggcggacgaccaacggacggcgacggcgacgaggttgaaacggcgggaaccttcgggtcgacgacggcgaagctgctccggtgatctccggcgacggcgaaggggcggacgaggacggcgacgacttggcgagcacgacggcggtcttcccgagcgacggcgacggctggaacgacggtggcgcacggctggagcggcggcggcgacggcaaagctagggcacacggcgctagagctcttccggcgacgagaggcgaaggcgagggtggcgacgggtagaggagacaccgggggtccttttaaaggggctcggaggcggcggcgaaggcccacggcgacggcaacggcgaaggaaaccttcgggaaggacgaatccgagacgaactcgaatccaactcattccaaaccgattgagccaaagattccaaaggagaaaaggtagaggagatcccggagatcatttcccctctattgattcggccggagaaggaaaggaacggccggatttggaaggaaacagcggcggcggctcggcggcggcgcgctagggttccggcccgaggaagacgacgggcctgacaggtggaccccacctgtcagcggccgaacgcgcgcgcgcgcggctgcggactgggccggctgggccgaggagagaggaaagagattttgggccgactttcggcccaaagccaaaagaagactttttaaaaccttttcaatttaaattatttcttaaatgcaattccatttattaaaaatacttccttagctcaaataaatcccagaaaaatctaggaattatagaattaagcaaagtatttaatgaaattttatctggcccaattttatattggaatttattaattaaaattagatcttctcttcaagacttttaaaataaattctagaaattccatttaaacaacaatttatatattttgaattttcagggtgtgacacaggtcgactggttgtcaccactgttggtctccatgccaaggaggttgtccctttaggacgctggggtgcggtctgaggcgggcggttcatggcaagcctccttttacgattgtgctccatgaccttccggtcgttctccaacctaacgaccttattgattaaactctggaaactatcgtggtcttgtccaatcatgggcccgcgtaactcgtcattcaagccttcaatgaatttgtcaatcttttcctcttcgtcggcaagatctccagttgcgtagcgcgccagctgagtgaaacggttcaagtactcttgcactgtggtattcccttgccgtaatctcttgaactcattcttcttcatcctcatcaccgcggcaggcacgaagttgtcacggaaggctgtggtaaattcctcccagtttggttctccagcatcttcttcccgggcttctttgtacgtgtcccaccagtctccggctggtccttccaattggtttgccgcaaagatcactttatcggcctcacgtactcgaacaagagttagcttcttctcaatgaccctcaaccaatcttcagcatccataggttcttcagctgtggcgaatgtgggtggcttggtcctcatgaactctccaaagcttgaccccccgcggttgccttggttgttcgcgatagcttgcagaagttgagtttgggtggccataaccccagccagagtggttaggtcaggtgtctgagtttcgtcgttgctggttgttgcccgacgacggcttgccatctgtgtaggttgatggggtaagtatcctaattttctaactagctcctatggctttatcctattaagggagttgtgttgatatgaactttgttttgcaagcatggtggaataaactcatttaaaacacaacaacaatggataccataaataacatcacagagtttcacaaatgatacatgaatcatgatgcaatcgactgcgtacatatgcagtccaaataaagttcatccagaagatacaacgaactaatcattaaactactcgacaatctaggtaagggagggggtgtctcgcatactatccaaaaaccatctgatacgagagcgaagctgcaaggagtccgtcagtctagtcctccagccatccgcaggatcctggggcaggtagagggtggtcgctggcacgcgcaaacctgagtccccacggctcagaagtagtggcctctggatctggcttgggcctcttgcccggaggtcgtgtgctcttgcgagcagtgctgagggtgcgagggcctccaaggaaggtgatgcggggaacaggagcctcatcctctgaaggatcagtgatgtctggctcgatctccggctcagtgtcggtcccctctatctcggagtcgatctggatcggagtctccaaaccggaacccagctgcggagaaggtgtggggatcagtgaagtgtgcaccaactccggaacaggtggcggtgccgctgtaggatccactaggtagggtgctgactcggtagctagcatactagcctctcccagaagagcgtggaatgctggtgggtacggcggggtgaggaagaagtagcggtcacggcctactgctgtggaagtagaagcccctgtagtgctgatcttggctgctcaaagctgctcctccagctggctgatgtgctcctgactctctctcagctgctcctccagagtatccatcatcccgcggcgatcgttgtactggtcagataactgctggaactggtcgccgtggacctggagctgtgccttcagtgagtctatctcactgccccaagcctggtgctcctcctccaactgaagctgctgcactgagaggtcagtcaactcagtctccagctctcccatacgtctctggtggtcgtcaatctccaatagagcctcctcgtagtagtcatctactgcctcagcccatcgtgacaaccgagtcactatcgggttgtagcagcagggcgtgtcctgaactgtgcaaactgagttgccctcctcccggaacgggtgatgagcaaactcggtactcactaactcagctcggtggatagagctgagtcggagaaaggcctcccgagcagcatcctgcatcgcggtctctggcaggtctcggtggtgacgtgtctgaaagctgtagtccaactcggaagggactcgggggtgaatctcgacccgagcctcccaaactgggccacactgcctcactcggtatgacggaaaaccagggtatcgcagacgcctcaacatccgatgcagctcaatgacatacccctccgattggggtaagctcaactcccaggtagcgggtgaatccgaatctgccatctaattttaagaaaaaccccaaagtcagttgagagtaaaacttgttttgtaaagaaaatagttaagagtaagatgaaaattgtgtcgagttttgtaaacatagcgtttttatttttgaaagtattactaaatgggaatttctcccttggccaacttagaaaaagggtggggcgccttttggtcttttcctacagtcgtatggctctgataccagctctgtagacccccgtttttatagcaggaatcactcgtgtaaactgtaccatttccctggatcaagtagtctggtacacactaattcataactggaataccaatgctcatacacgagagtctagtacgaattattacaacataagcccgcaggcattgtcttaaatcatcagaccgagcggtctggaatacaaccaaaagcagagtttagataaggcagcggaattttaggcagcggcatgccattgccacaggcaacgaccgtactaagacctactggacgccatcatcttcgtctccctcctggtagtaggcataaggatcttccgtggcttcatctcccgcttctgattaattttataattgcaagggtgagtaccaaccgtactcagcaagccaccacagcaatgatgcacatgacaggggaattcaaaggatggctatggttcttttgcacaaagcaagttttgtaattcttttcacaagcctaagacctagcatagactgatcaagttttaataccagtattcatattaaacaatgacggttctgtccaccatccattgtgatcccaaggatagcttcccgccattgagtcgttatggttttctaaggatgtccatattcccacctctcaggaaatggctccatcagcataaaaatcatcatgcaatatcccatcccatacaagttaagaatttagagtctagccaagtgtaatatatgtcccggtgctcaataaccgcgagcacggctattcgaatagatttggtttactcacactgcagtggatgtacactttacccgcactccgcgactgcccaacacatgagcctcgtcccaacacatgagacgcgtcacggcaaagcttttcgataacctcgcattggcagtacccgctccatgaacttaaatcctcatgcactctaggcgttcatgtttctagcagtgagaggagttctggcgctcccgggaaagagaagtctcacacacatattaaattatggttcaagttaagttctccctctcacacactcatggcagtcctaccaatggcgacaccgatgtagggcacgcctctcggccctacctcaacggctgtcccatcgtagcgcacctgcctcactcaggggtgaaccatctacgcagagatactgcctccgctcggctatctaatccgctaggtctatacccattcgagaagtacggttgtacgggggtcgtttcatgcttaacttcatggctcggtccttaattgaccggggacggtactagcctttcccagataccacccaaatcctccgtccgccccagtcgaaaacagttgtttaattttatttctcctttcacaaatcatgtcatcaacatcatggcaatgtggcgctcatgtctccacatgccgcatctcaattaccttcccaaaggtatttgcccaagcatatagcatttgataaatatgagtatgcatgattctagaatagcatttctaagcaattgtcataattgactagggactcatacttaatcatgggtacaaggattttaagggtaaacaataatcaaggcatggcataatcacaagtaggatgttcataattgcatgcaaattttatttgtaaacaaaacaatttcgcaattaggatcaacatgttcaacgaatagtgatgacttgccttgctcaaagtcttgcgggtcttggccttcgcttggatctgcaactccctcgggctctatagttacgtgcaagaattgatttgaattcagttagaattcaaataaaaatccaaacaaatccaaataaaagttgcatgcgaaagtcgattcttttatattaactttactattcgcgaactacggcaaacccaatttcgatttaaactgttttgcgggtataatattttgttgtcataagttttttttaatttaatttacccgagcattatacccatatattagattagaaatttcttctcgcgagccaaatgtcggacggaatcctaaaattatcttataatattacacgttttaatttagtttatgactaaacaattaaatataatgtacatctaaaattcctagcgattaagtccgaatttctaccgtgaatcgatttcttatagagattatccaaaaatgatccataatagtctataacgattcatctaattgataattatgtctaaattactacggcgaattgatttcccatagaaactaccaagaataatccataattaaattttgcaattctacggctataattaatctataatgaaattctaattattttaaattttctaaacttacccaaactccctctaatttcctatttatttccttttctttttctccctttcctttttcttttcttttctcttttcccctttctttttcttttttttttcctttctctttttctctttttcctttctttcctccctctcggcttcctccttccttcctctccttttcctcccgacgccaccttcatgttgtgagagattatttattagtaatcaacatatataagcagcaactagcggaatggctaaatcttacctttattgataagttcttgaaaggaatatgcagctcacatggtgtccgctgagtgatgtcatcaacgggacaggtcgattcgtcctgtgtttgcatggcgtccatgctctgtgatcctacctgccccgttgaggcgcagctgctacggtttcctgacgggctcaccattgcaggaggaatggtcggctggggatcatgggaccgatgtgcggccatgcgttcatcaaccttccttgccacctcctcttgcatgttgagttcgtagctcgatacccggaactctaggtctgcaatcttcgcctcggtatctctcttgctcctcatccgactcctgtacgtgtggatgtcctccttgaaaccaatcttccaaggaatcacccctttccctcgtgttcgtcctggatgctctggagtctgcagggcgagtgtcagctcgtccctatctctgtctggtcggaacgtgccctgagaggaggcttccactgcatctgttagtcgtcgcgcagcctctcgtatctgatcgccgaagaccagtgagccatcagctgggttgagcgttccaccgtgagcatagtaccagaacttcgatcgttccggccaattggctgttgccggttcgatacccctctcaatcaagctagcctccatctgctcccacttcggcatcgcgacgctatagcctcctgaccccaagtggtgatggtacttcttcttggcggcattttctttgtttctttccatcatcgcctgcccttgttcacctgtcttatatgcaacgaactcgtcccagtgatcccttagctttggaatgtgtcgaagttcggtgtctgccccttcagtatatacttctggtacagatctcccttgaagctctgaaactgttctgccattttcttcagagtccaccttttcactttgtcctctgtacccgcaggaagggtgaatgtctcgagcattgtggtccacagcatctctttctccgaatctgggacaaagctctcatgatctccgcgtgcccttgttcttcgccagtacaccgtactgacaggcacgttatcccgcacaacccaaccgctgtgatgtacatagttcttggcggcttcggccggggcactaggacgtccatcttcttccacttccgttatgatgtgccgaccctcaagcttcttcgctgcacctcgttgcccgcgtgccctcttctgtccaacggagggttgactaccaccagcctcctcctcctggttcccctccacatccctttccacgtgcccctgctggttcccctccgcatccctctccacgttcccttcctcgttcaagtactggtttggatcctcgttcccctcttcttcattccagtactggctgcttccctccgcgattgtatcgtacaatatctgttcctcatcgcggtcagccatctgttgatacaagaaacatctgctaagtcacgagacatttatgttttaacaatctaagtcatgtatgctaagtgtaaatgtcgtacattagaaccctacacaaccttacgtgctaagtctaattacaaatcgtgatataagctaagtctaggtgacgtatattatacaaccctagctagtaaataattatatactaagtctaattacaaataaaataatcttatattaaaactcaaataatattacatgctaagactaaaatagtcatgtatatgctaagtgtttcgtgcgtatatgctaagtctaattaagactacaatagtcaattgctacttgtcgcaccacttccgtagtcaataattacatactaagtctaattacaaataaagtaatcttatattaaaactcaaataatattacatgctaagactaaaatagtcatgtatgctaagtgtttcgtgcgtatatgctaagtctaattaagactacaatagtcaattgctacttgtcgcaccaattccgtagtcaataattacatactaagtctaattacaaataaagtaatcttatattaaaactcaaataatattacatgctaagactaaaatagtcatgtatgctaagtgtttcgtgtgtatatgctaagtctaattaagactacaatagtcaattgctaggagtcgcaccaattccgtagtcaataatgtcatactaagtctaatttgcaataaaataatcttatattaaaactcaaataatattagaacactacacaatcttatatgataagtctaattacaggtctaataatcttaattaattgcattacaaatataacaatcatttatattattacgtcacttgcctgctccaattccttctagggctagctcttccactcaggcttgacggacgactccgacaacacgtcttttctgcaagatacaaaaagatgtattaggataaatgcgaagtaacatacatacatatatatatatatatatatatatatatatatatatatatatatattgcatttcacgttaacgttcgtcctcgttcgttcgctcgttcacgttccctagctcgttcacgttcgttcgcttgttctcattcacgttcgttccctcgttctcgcttgtcttcgttcgatcgttctcgttctcgctctcgttcgttcgatcgatctcatgctcgttcgttaacggcggtgtggcggcatcggggcagcg

SEQ ID NO: 73891 - DNA, 21774 bp, Oryza sativa
aaaggcaagcaatcccagctctagtagcatatcggaaggagtggatatgaagtcacctcgaaccacttgagaatctcctcgtaaaccgcaccgtggaatggtagattttggagagagaaaaacgagttgccattgttaattcctcgagaacaaaagttctagttgactcgcttgacaatttttctctctacaattcgatactacctgcagattggccatgaaccaatcctcagcagtatcataacctgctaaactagatttgcaacaaggatgcaacaggagagggggaaaaaagagtagttactaatctggaaacaaacgaatggagtagtagtaattaggagaagaactcgtgaaaatcaaaagaacagacaggtagtagtagcatatcatccttgaacgaatgacaaatctaatccatcagtttatacacgacttaattcataataatataagaatccaatcgcaatatacagggggcacacatcttcttctcagttctcactcgattcgattcgtgggcaccgacccagaccaattctttcacggttaaaacagcgacaaggaaacgaaagaaaagggggggaaaaagaaaaagaaaaagtagaagacgaggcaaacgaactttgaataatcccggtttgagcagagcagcgggtggtggcggaggtgggttagccgcggcagcgggtgatggcggagcagccgcgggagtaggggttggcctggccgccagggcggcagttgtagtaggaggcgccgcggacggagcacggcgtggtgtcgcgccgcagcgcgccgtagctgatgtacccctgcccctgcagcacccgcctcaccaccgcggcgccgtcggccgccgcatcctcggaggagaacccgaagctgtcctcctcgccgccgccgccgccgccgccgaccccgagctcccaggcgagcggcacctcccccgccgccgccgctcccccggccaccgccaggagcagcgccagcagcagcgcggacgccgccagtagggatttcgccattggctccttcggattcggtcgcctcttgccctgcctgcctttggtgtttgcttgctcggtggtggtggtggtgggtggtttaagcgttaatggtggtggtggtggtcgccgggcggcgcgcgggtggtgggtttattataggagagagagagacagagagagagacattgagaatagtagaggaggaatgcgcgtgaagaggggagcgctgcggcgtggggcccaagtgcccaaccgagttgcgtgcaccgcgtcgcgttaggtttggagtcggagccgcgggagggatacggtatttggcgaaaatatacagaaaccaatggcatgtgtttggcacagctcaaaaagctcagctaaacggtctctagctccaacaaaaataaaatcagagttgggtagagctatctcacgaaattaactagaaagttagattttgatttagtctgcttcataactccactccagacccaactcgtagagctaaatttaggagttggagctctaccaaacatatcctaaataaatgttcttaggttcgttcatgttatcacgagtaaaattttttttctcatagatatagttaaacttttactcatagtgacgtagaataatcttaaacgtttattttttttatccaacaataattatcaggttttcagtatatatatatatatatatatatatatatatgtgatttgcactgcatagtattttctctggtatttgtgggtcgcgtcaggctgacctggctctggctgagtactgcggcaacggcaagcggcagcaataatgcctgcagggcagacgcagcgatcatgccggcagcgcagacgcagcggccggtggttcgccgccgatgaccatggtctcagaacactcttcgtggtggaaaaattgaaggaaaaaaaacatataattaagcacggtggttcaatccggagacggagactccggttgctagttgttggttggatgatcgatgaacgatgatcttgccgttccactggccgcggctgcggctgcggctgacgaggggcttgctgctctggtctgtcagcttcgcacattcgcatcgcgcgcgcgcgcacacggtcacctccgcccacatcgcccgtcccgaccaagactagtggaagtgtgcagcttgcttccttccgatagccgctctcatcggatctctcgcatcattcagcaggaggcgtacgtaccagtgcatcattgcactgacttctaactaacccgatggtgtggacagtgcctgtcgagaaaaaaaaataaaaggttaaaataacagaattgttcacaaatataaataggagtacaaaacatttttgctctctatttgttcacagacataaatgacttttaagtagtactacttatttcatccatcaccttctatttttctttctcatcttatctcaattaccctatatccccacctctctttttttttctttatccttaatctctccagatatactaggagtgattgagagaagggaaaagaaaaaaaattaaaaagatacgtaaaatgaggtgagtcataagcacatgattaactgagtattgatcattttaaaatttaaaaagaattagtatgatttttaaagaaatttttctataaaacattttttttaaaaaaaaacactgtttagcaattttcaaaaagtgtgagcataaaaaaaaagaaaaatcttctccatttccatcctaaacaaacattatgttaaaaagacttttatatatatatatatagagcgagtatagcttataggagaaacgcaataactactacttactactacccctacatttcatattgtaagacttttaagactcacctagattaatccattgatcaatatacatgttttctatatgtgtctagattcattaacatttatatgaatttggataatgctagaaagtcttacattgtggaacggaggaagtatctaaaaacttagtctctttcctctccgtctctcgcggcgggtagtcaccagcaagggtagaggagggtgattttccagggagccatcagatccctatagtcgagttcatcctattttaaattgagtttatctcatattatgacgtcctctttccatttcctgtatagttcagtggagatgtcaacatccatattctttgtcttagccgcctccttccatggtcagcctgagctctaaagacagagcttgctttaccttctctgccttacgccatctagatggctaatacgaggttattcactggtgtttgggtcgacaagtgcagcagatttgcctagtggtgggaggtcttcttcctccacaaggacgagatggtgctggccattcaaatcctctgacgagtttgatgctgccaattcggtgtccttctttgtctccgaccgagcattttcaaggttagactgaagcttgttttgttcattgggttcacttcaacctccacttatgagatgcccttgttgaatttgcagcttgatggtagttaaccttgtccttgctgtcacacgagttcatcgtcggacgagagatcatcagtgctcctctcgacaacgcgaactcgctttccttttttgagggccacctgtttcgccaaagcttgtttttatgacctagcactcccccaatgtattgtgtattgggcaccattgtagtactggtttgtcgccttgaagagctgggcgctttgggggtgggttcgcttgtacttcaatctacgccttacgctttcttttctttttgcgattttgtttctttttcttgctagactccagtgcgtccttcttggccgacgactgtttctgctcggccaccttgccctttccatctttccacctgagagcgtctgcgtgattaaccattagtcgaaacttaaaattctgtgctcataaggatccaagcccaaatacaacctatacttggtgccattcatgcgggggttattaatgccgccgatccccagctcccgctcccgctcccagctggccggcgcctggcccgcccccgcggccagcgcgaggacgcacgccgcggctacggcggccacggtcgcggctcttgccatggcgcgcctgtctgcctcttcccgcgtcttcccggctgcagctatagcgtacgtaatgctctctttgtttgacgtttgtagtacaagtgagtggcaggtttcacatgatgtgttcaatagaatggttgtaagtgacagtaagttacacatttattttgggggtagcatctagcatgctgcatggttacatataagcatctaggtgtggattcagacattcagtgctgtcccttcttatcatttttattttacagcattggcgttacttcgtggagcacaatttagtttgatgaattatgaatgcttttgttggttttccttacttttgggtagatcaaatgcattttgatcttgatatgtgtacattttccggtagctcgattccatttgatgtttgtatggtcacttttggagtagctacagtaggagctaggattttggagttgtcaaatctgaagccaagtgagttagcatggatgaaaatacatgagcaacaactattcttggatctgtttttctatatataaaaaatacggtataccaaaccatgcgtcaattttctgcccatatattaaaacttacatatcaaatctttattgttacatataactaattttgtgcaactgaagatgcatggcgaggttgtcctcaatgagaggatacatgacaaggtttgcaatgagcaatttattcctgaagaacatactaatggggtgaaaattgatttgggaatttagatggttttgttgtgttgtctccgtttgcttctgtagttgttgcttccattcagtttgcaatggcatcaattggtttgtactgaaattctgttactagacttaatttcttggtgacatgcagctaactaatgccagtgagtattgttcttgttatgcttgcatgaaagcaataaatggatatattcataaataaactccatgtgtatgtaatcgtttttttttggacacatgtgtatgtagtctaaacctcgctatatgcaatgaatgcaagcagccatgctttagacaatgcttttcatttttttctttttgatcgagagcatgtacatatttggtgcaatgttaaccaaaagcctattttttggctttacatttttggacaaaaggcattacgcccggctttactgaaagcttaaattggtgatgcagaaaagtacagagaaaatgctgggttttccatcttaacctgcaggctcaaaacaaaataaaaccaactgctttaattagaacaccacacatccagaccacaccacctgaaaactacaggcaagcagcgacagaagacaagctacaggaggtgcttggacaaaagcataacactactgaaaaccaacaaaaacaaaaacaaaaccaaagactgaaaaaatgtaatatgaccactatggaaaaccgtatagaatggcgtgcaaatctgaacggttgctctgatcagtgatcactttctggtgaggctttattgactatagatgttatccttgagagccaatatttcaagcaaatctgacttgctctctctataatatttattccacaattgttccatttgattttctctcagcaaatctggactgcagatttgaacaaacccaagcaaaatcaatgaaataatcatttagcaatatggtcattttgcttgatactatcgcaaagatcacaatggtagaaaatagcccggacatcattttaacaaacgatatttcttgggggaaaaaagagagataattttaacaagcgaccgtgtttttcgattggcacattttaaaatgttactttcctgatcttcccttgttaatatcatgcatgctagctactacaaccaacaagaaagcaaggagagaaatggactatttggaacaagaagtaataattcacaaaggacaggacagctaatcatccatgaatgatgaattgatgaatccatccatcaaattaggagaatacacgatttatttataattgatacagagtaggagtaccggacacatgtacagtgtacatctctcttgactttagattagcgggcaccaatccctaccaattcgttcacatttcaaaaggagacgaacaataaaagaagacaaaaataaacaaaatatgtatagagtagacgagacgaactttgaatcacaaatcccaatttcaacagttttggtggtggcagctggatggatggatcatcccctgcactgggtgatggcggagcagccgcgggagtaggggttggcctccgcgccgggctggcagttgtagtaggacgcgccgcgcacggagcacggcgtcgtgtcgcgccgcagcgcgccgtagctgatgtagctcccctgctgcagcacccgccgcaccaccgcggtggcgctgtccgccgcctcctcacccgggaagccgaacgcgtcgtcggcgccgacaaccccgagctcccagctcagcggcacctcgcccggcgccgcgtcggctcccccggtggccagcgcgatgagcagcgccagcagcagcagcgcgggcgccgccacgatggcgggtctcgccatggcgctcgacgcggaggaggaggaagaggaggagggaggaggaggaggaggaggaattggttgcttgctttggtcgacgtcgcgcgcgtcgtaatggtggtggtggtcgccggccgccgggtttaattataggagacagaggaagggggttggcggggttgtttggaggctgaaaatttcaatcaatattctaataatatactctatacaactatataagaaatggtaaggtaacgcaaaattgaagcaatcaagacactcttttataatctcaacatgtctaactattacccttttctctctctctcttattctcccgatgccaatttaaaccataaaattatggatgaatagcaaatgtggtactccaagtttcatctcagactcagtttagtccttaatcttttagtctatccatgctataccttcaaattttcattttagttcaaatttatttttaaatccacttagaaaccacatagctaaacatagtcttttttcattgaaatttgcatgcaatgaatttgtttatagataatgcatagtagtttatgtaaaatgaaaataagtacgtgcttccaagtgtatatatgatagccattaagctcaacctttatgtgcacatgttgaaataataggaagtacatctgcagtgctatttattcatattgtttatctcttttctaatgtatgcatattaagggcaaagggaaaattttctaatagaaacgttgactagaaatatccatgtggcatattaagtgggtccaagaataattttaaaccaaaataaatacttttaaaggatttatatgtacaaaataaaacctgaaggactaactttagcgtctggtaaaacttgagggactagattggctattcaccctcaaattattatcaaagaatggttgacacttgacaatttcaatatttttcaattatcaaagagaactaatgaaatattaaatgagaattataaaaaagattcaatatagtggtctgtgtgcttctctcgccggcaaacaataattttcttttctgctcggacgacaaaagttggaagtccagatagcatgtgcctcgtcgacttgagagttgatagccaaactaaagtatagccataggtgtgagtgtgaaacctatctgacaatgcaggctttgtcctcatgtttgtttttttaagaaaagaaaaggaagatgaagaaagaaacaaatgtaagccctatgtaacacaagtcgtcctccaagttgcacatcacgttgccaccattgactcggtctcttttatatttgcttcgtcgtatatatcgctgcaatgcaattatgcaattgtaaaaacaaattaatatgatatgatttgcactacagggcaggcgtgcaatggggattgggagtgactgcaactttggcagtagccacggatccaccatccaacaggtaaggaacgtacaggattaactgtctatgctccctccttttagctatttaaacatgaaatgttttctccttttctttatctcaactttctcaagtttgagaggaatcaaatgtagtttataaacaaaatacacacatacttcacttcaataatattttgcacaattgtacatggcactgataaatgagctagtgagtttaacttctccccgtgtttgggaataatgcatccactaagtcaaaaaaaaaaactaagctactactccaaaatcttcacgtaaatcagtgtgaagcttctattgataacttgtaaagaaaatgttccgttcggaaaaaaaaactttaaagaaaaacaacaggattaatgtttcttagttgaacagagcatgagtcacataataaatttaaaggagagttacatcaaaatacgagctctacttcaagcccttaaaataaatgccaagcttcttttaaacatctaaataagtagtattaaatttcttatcagatgaaaaataactgtgctagtatttcatgttcaaatagctaaatgaggaaggagacaatcaaatctgagcgttccttactagctggatggttgcattagttgctactgctaaagttgtagttactgtagtgactgcacctgattccaatccgtgcaatggattggacggacgggtcacacatctgcgtcctacaaggtttgttctgatttgctcaaatcaattaagcgacagttgagttcaagctaatgcatcttggcacattatttcctctttttttttctttttctggagcaacaaactcgctgatacaaacactggagctaccggtatactatatatagcgactgtccatgcatgatttgaaagaaaaaacaatagatatatatggctactaagaaataataattaatgtcgtgcaaaatgtgtgggacacaccgaggaaaggatgatgcatggtatattggtatcgatacacagtatggatttgattaaggataaacattcacctgaattagaatggaggcataaccctcgcatcaattgggggtacatagacctaatccttatttaatttatatatatacactttaaatactgcaaaaataattataaaaagctctcactcaattgcgtgtaataaccaaagtatactctatccgtcccaaaatataaaacctaggacatgatgggacattttcaagtactacgaatctagacggataggagcctaggttcttatattttgtgacggagggaatagcggtttactagatgccaataggatatgtataaaataactgaaaaaaagaagtaaaagagaaaacatacctgaaaatgacttaattactgttagaactgttctaattacagatctacgagacactccgttactccgtagaaacctatgaggttttttgaggaaaaataatgaaatttaggaataaaaaaaggatctgtctattaatacagaaataataaatctaaatttccgtaatgattatccataaatggatgaatgctaaagccatattattgattttttttcttataaatgtatcgccatatctttcataaaaagtattcagcatgtatttacattgtaagtccctaaattactgtcggtgacatgggatcgggagtatcatgactagaggcttgggcaggagcaatcacccacgtggcctgaccccctcggggggggaggggggtcgggcccgagggtggtatgaccgcccctctctttgtctccccgaggggtcggaccgctcccgtttcggccccgagggccgaggcgccccgaccccttgtgggttttgcgccgcgtgtatgagttaggtgggcacagcggggctcacctaaccgcatttattgcggtttggacgagcgcgtcacgctgcatgtaacgcagtgcagcgcactcgtttatccggtctgtgaccggtcacagaccggtcagatcgcgggttaggtggcaacaggcgatctgacacacgcctcgccccgtcccgtcaggatgagagcctccaggcactcgtccctagccggagccagcgtgctagctcctggagatggcacgttggtcccggtcagatatatgccaggcttcatcgcaaccattaaaagcaagacattgtatgaagaagggcgaacatgcagattggtaaactgacgcgtggtggacaagaacggtcatgatcccatgttgcacctgcttccggcggagtggaggtaggtatgggctgtcccatcagaaggatcactcggacagcaaccattgcaaatctccgcccatttatgaaggaaggacgggccaagttttaggaaaaagaggatgggtccccaccgaaaggagagataggtagaagtggtgcatgtggtatccccttgatatataaaaggaggaccttgcccacttagaggggggatccgaaaaaaagggaggaccaaaagacgagagctgggagagaaagaggaagagggtctctagagtttgaactctcttgctctccagctctttgtagcttcttcatacacagatccaccagaacacaggagtagggtattacgcttctcagcggcccgaacctgtatacatcgtccgtgtcttatgcgtttccactttcgcgaacattccacagattgagagcttagaacttcacttagcgtccccggccgaaccggcaaaggggggcctgcgcggtctcccggtgaggagccccacgctccgtcatctggcgcgccaggtagggggcgcgtgtgattttctaagccctcatactctttcgtgcgcgccaagcttttcctgttcagcccaatggccgagcaagcaaaggtgcgcaacctctctccgagtgttagcggtgacgacggggagccaaacccacgccgtcgagctcgtactccaccgccccctccgcgccaaagtcctaggcgggaggaggcgctggagaggatcgaaggatccgcgacttcgacatccacgggtgatggagaagagcggcgagatggggagcgtcgcctcctcgtctacggcgacgacagcacgccccagggcgcggtccaagctgcgggcgcgctcctacgtcacccgcccgtcgtccctgacccggagtctccagcccaacgttggctggacgacatggccaacttggtcatgatggcacggcagcgcctaggtgttggtgggcggtcctccgctaccaagacctatggcgctgctaccaccggttccgtgtcgtcaaggcggagggcgcggcgagcggcggctattgctcgccattcggccgccactccctcgtcagcacctccgacccgggaagatcagcgtggggggccaggtgcccgcatcggtatcgagcgccggcgtaatggtcgacgtgctgcccacgcaacggagggcgcctcctcgtccggagtgtcacctcaacacggacgcggggatcagccctccgtgcccccggttggtggtgttggctgtagagcctttatggcgagccttcggaacgtccgttggcccccaaggttccggcccaccatcaccgaaaaatatgacgggagcgtcaaccccgccgagtttctccaggtctacacgaccgggatcgaggccgccgggggtgatgacagggtcatggcgaatttctttcccatggccctgaagggacaggcgcggggttggctaatgaacttgccacccgcgtcggtccactcttgggaggatttgtgccagcagttcaccatgaactttcaaggcacatatccgcgcccaggtgaagaagcggacttgcacgcagtacagcgaagggatgatgagtcacttcgctcatacattcagcggttcagtcaagtccgcaacaccataccatgcatccctgcacacgcggtgatctacgcgttcagggggggtgtgcggcacaaccgcatgctcgaaaagatcgcctccaaggagccccagactaccgcggagctttttcagctcgcggaccgagtggctcgcaaggaggaggcctggacttggaacccctccggttccggtgtggcagcttcggccgcccccggatccgctgctcggacagggcggcgtgacaggaggaggaagaagaggtcagcccattccgacgacgagggtcatgtccttgccgttgagggcgctttgcgggccacccgaaaggggaggcctgcgagcgacaaaaagaaggaggccggcgctcccggtagggagcgtccgaccggcaagtggtgttctgtgcacaacacctccctccacgacctcgcggactgtcgcgcagtcaaaagtttggctgagcggacgaggaagtgggaggaggagaggaggcaggagcgccgagagggcaagtccccggcggttccctccggtaatcagcgaagtgaggccaagcagaaggcccccgccgaggacatcgatgacggcgatgatgacctgggttttcaggagcctggggccaccattgccactgtcgatgggggagcgtgtgctcacgtttctcgctggagcctcaaggccatgaagcgagagcttctggccgcggcccctactcatgaggcgacgcgtcgggcgcggtggtcggaggttgccctcacctttgaccagaccgaccacccaccatgtgttgcccggggaggacagatcgcgatggtggtttcccccaccgtttgcaacgtgaagttggggcgtgtcctcatagacgggagggggggggcagccctcaacatcctttcccccgcggcctttgacgccatcaaggctccggggatggtgctccggccgtcccagccgattatcggtgtgacgccggggcacacatggccgttaggtcatatcgacctactggtcaccttcggtggatccgccaacttccgcacagagcgggtgaacttcgatgtggcggacctcagtctgccctacaacgcggtcctagggaggcccgcgttggtgaagttcatggcggcggtccactatgcctacctccagatgaagatgccgggccccggtggccccatctctgtccatggcgacctcaaagtcgcgcttgcttgtatggagcagcgcgcggaccacctcgccgccgcggccaagcccgagggtggcgacgagaggctcgccacctccgtccccgccgccccgaggcagcgaatgatcacgtgcgacgaggtcccggtcaaggagattgccctgggcgacggcccgtccaagatcacacgaatcggtggtcttttggacagcaaataggaagacgcgctcgtctccttcctgcgggcaaacgctgacgtcttcgcatggagaccggcggacatgcccggggtccccagggaggtgattgagcaccgtctcgccgtgcggcctggcgcaaggccgatccggcagaaagtgcggcggcaggtcccggaacgtcaagccttcatccgcgaggaggtggcgcgacttctggaggccggattcatccgcgaggtcatccatccggagtggctggcgaacccggtggtcgttcccaaggcgaacggcaagcttcggatatgcatcgactacaccgaccttaacaaggcatgtcctaaggacccttaccccctgcctcgcatagatcagattgtcgactccactgcggggtgcgaccttttgtgttttctagatgcatactctggttaccatcagattcgcatggctagggaggatgaggaaaaaactgcattcattacccccataggaacttattgttatacgacaatgcccttcgggttaaagaatgcaggtcctacttttcaacgcactactcgaatttctttgggtagccaaataggacgtaatgctgaggcttatgtcgatgacttggttgtgaagacgcgcaaccaagagactttactttcggatctggcggaaactttcgagagtctccgctccacccgcataaagctgaaccccgataagtgtgtgttcggtgtacctgcgggcaagcttctcgggttcttggtctctgcccgaggcatcgaggccaaccccgagaagatacgagctatagagcggatgcgcccccccagcaagcttagggatgtgcaatgcgtcaccggttgcatggccgccctaagtcggttcatatcgaggctgggagagaaggcgctacccttatttaagctcctcaaacgctccgggccgtttacctggacggaggaagctgaacgtgccctcactcagttgaaggcgtatctcagctctcccccagttctggtcgccccggagccagacgaacccttgctactctacttagcggcgaccccgcaagtagttagtgcggcgttggttgtggagcgcgatgaggacaatcctcattccgcgcatccccaccctatgctggcttggcccgggagagagcagggaggagaggcccccgagccgaacggtggcccaaggcccccgacgaccggggtaggccctctgcccgcttgtccgacgacgccaggagcccccgacccccaggacggccccgaggccactgtgggaaggccgcgcctgtcgtcctccgaccccgaggtcgtcggcacagaagacgagtgcgccccgcgaggccgcttggacgaagagcgcccctgggatgtggcccctggcgaagaggatcggccccaccgaaaggtgtagcggcccgtctactttgttagtgaggccctccgggacgccaagacccgataccctcaggcccagaagatgctttacgctattctgatggcttcgaggaaactgcgccattatttccaggcgcatcgggtcacggtggttacgtcttaccccctcggccagatcttgcataatcgagagggtacaggacgggtggtgaaatgggcaatcgaactttctgagttcgatttgcattttgaaccacgccacgctatcaagagccaggccctcgccgattttgtggcagagtggaccccggctcccgagcccgtctcagtccccgaggccagctcaggcccctcgcagccgcctcacaccgcccactgggtgatgcagttcgacggctccctgtctcttcagggcgccggtgcgggagtcacgttgacctcgccgagcggagacatcctcagatacctggttcgtctcgactttcgggcgaccaataatatggcaaagtacgaggggctccttgcgggactcagggtggcagctggactggggatccgccgcctcctggtgttaggcgactcccagctggtcgttaaccaggtctgtaaggagtaccggtgctctgacccgcaaatggatgcttacgtacgccaagtacggcgtatgaagcgccatttcgacgggatagagcttcggcacgtacccagacgggataacacgattgccgacgaactctcacggctcgcttcctcgcgagcccagaccccaccgtgcgcctttgaagaaaggcttgcccagccgtcggcgcgacccaaccccctaggggagacggacgcgcctgaccggcccccgaggcccgtcggagtccaggcctcgggacccgaggggagcgctcctagctcccttagattgattgcttggatcgctgagatccaagcatacctcacagataagactctacccgaggaccgcgaagggagtgaacgcgtccagcgcatctccaaacgctacgtgctggtagaagggaccctctatcagcgcgcggctaatggaatcctcctgaagtgcattcctcgggaacaaggcgtcgagcttcttgccgatattcatgaaggcgagtgcggagcccactccgcctcgcgcaccttggttggcaaaacctttcgccagggtttctattggccgacagctctcaatgatgcggtcgacctggtccggcggtgtagagcgtgtcaattccacgccaagcaaatccatcagccggcccaggccctgcagatcataccactttcatggccatttgctgtctgggggctcgatatcctgggaccgtttaggcgggccccgggcgggtttgagtatctgtatgtcgcaatcgacaagttcactaagtggcccgaggcttatccggtcgtcaagatcgataagcactccgcacttaagttcattaagggcattacagcccggtttggggtgcccaatcgtattattacgtataatggcacacaattcactagtgaacttttcggcgattactgcgaagacatgggtatcaagctctgcttcgcctcccctgcccaccccagaagcaatggccaagtggagcgcgccaatgcggaaatcctcagaggccttaaaaccaagaccttcaacatcctcaagaaacacggcgattcgtggatcgaggagttgccagcggtgctctgggcgaaccgaaccacaccaagccgagcaaccggggaaatgcttttcttcctcgtctatggcgcggaagcggttctcccatccgagctcaccctgaggtcccctcggaccaccatgtactgcgaggctgatcaagatcagcttcgcagagatgacctcgactacttggaagagcgaaggcggcgtgcggccctccgagccgcacgctaccagcagagcctacggcgctaccatcagcgccacgtccgggcccgatcactctgcgtcgacgacctcgtcctacgccgcgtccaaacgcgtgctggattgagcaagctctcaccaatgtgggagggtccgtatcgagtgatcggcgtcccctggccgggctccgttcggctggccacgggcgacggcacagagctgcctaacccgtggaacatcgaacaccttcgtcgcttctacccctaatggggttcgggtgtcaggtttcgggctcgggccaaccccgcactcccctcgggcgtgcagagttggccgggggctaccacacatgcatattcttatctctcttatatccgtatttcaataaaagcattttcgatttcctaaaggctgtgtctgtgctgttgtttccttttgaagaatcttgacttgaaataggtcactcgtgctcaatcctgccctcgggggctcgggtcggctaaaatcgccaaaaggggcccagaaccgagccgtgccccggggcgtggtgaactcgggggggggggggaatcggcaaaaacccacaatcgggtcacccataaccctcggtcaccacgctcctggcctggccagtctcgacatgtggatctccccaggcactagccccaacccgagccatttgaggactgggacctgggcacgagcccttgttcaagctaagacacaaaaggaccacggcacagatcatcctcgttctcatacacacagcaaagtgaaattgacacagaaatttctttattttgattgcagattaagttaatctatacaagaaggaggcccgaaggcctcggaagaaagaaaagaagaaaaaactatttaaatattggcgggggcctgggagctcactccgatgcactcgggtcgccagcctcgtcgccactgtcgcccacaccgccgtcatcgccctcctcgtctgagttgagggcgaacgcgagccgaggggccgaaccctcgaagctgtggacgatatggttggcggcgtcccggacctgcgcgcgcacgccgtcctcggtcccgggagggaactcgtccagcgccgtccatggggagaagtcggggtccctggcctggtagctcgccagtacgagctccaccgctcttcgggcgaggtccctcgaggatgacttaatcgtccgctcgagctcctcggggagccgttggagagtcccggccatctccgagaggcgctgggcgaggcccccctggttggcggcgtacttcgcagtccgcccgccccaaagacccgcctgtcgtccggcgcggtctaaacgggacacggcatcgcgaagcatgctgggccctatctcgcctgccaggcgaagggcctcgacctccccagtggacaaattcagcgcgccctgcagatccgcgatggtgtgttcggcagctgcgaggcgggcggctaagtcgctatcgcccgtggccgccccgccgctatgcgcccttgcatccagctcccttgcctgcgcctcgagttcagcggcccgctggttcagtgcggccctctcggcgcggacaccttccagatcgcgacgcgcttgttcctcttgcgcagcctcgcggagggacgtgctctccgccagcctttgcgctgtggcctcggcctcctcgagggctcgctcccgctcggtgagcgcatcctcacggacgcggagagcggactcttcttcggcacaggcggcttcgtgcgccgccagtgtgacctcccgaatggcaacggcggcctcgcggtctgccaggtccctctccacgacgcaggcgcgctcttccagcgccatggcacgggcctcaagggcttcttcgcgccgccgggacgccgtctcggtctccgtcgcccgccgttctcgggcagcggcagcatcaaggaccccccgggcggcgtcgagcttcttccctagctccgcctcccagctcccgtattgaaggtggaggtcgtcctgcacctcgttcattacggtagtggcgatgagggcagccccccgctcctcctccacctccctggcgatctcctccagcaccttccgacgggcctcaagctctgaggcgcgacggcggtgtgccttgcggcccacctccaccatggcctccaccgagcgtcgcccctcttcgacacgcgcccatgcggcgtcgagctccgcccgctctgcttgcagggcctccatctgggcacttaacccgtccaacatcgtggtgtttgcgacggccaaggcctgcagaaggggctctgcgctcagtggggcaacggaaggcatgggggagagccgccttggtgaagatgccgctcggctcggcccgccgatggacgtgccggactcagggacgtcccccggacctggcttgtcctgagtgtcgcccgagggagtgggcccaagcgatgcgtccgcggcctcgtcgcgagctgcctcggaagtcgtcgccgcctcggcctgacgaagtctggcctcctcccgagcggcttcttcagcctggcgagcctggacggcctcccgggcggcctcctcggcttccggtagacgatccgcggcttctcgacggtcagattcccgcctccgggcctccgcggtcgccgtatcctcggcctcagactggccggacttggaatggcgggagggacgcgacgagatctcgctgaagcagaagaaagaccagaagacaaacaagatgggtgagtgaaaactcgcgttaggagaatgaatatggccacaatgggcgtgggacgaacctgcgagggggtcggttaaacgaccactttggaggggaaatgaggtttccccgggatggttctgtccccccatcttgcggagccgcttcttcttccgctccccctcgggctgcggcgtcggcgcggccccctccgggcgcctgctgctgacacgcgccgccccgccccctcggggaggagatggggaggaggtaccctcctgcttcctcttccctcgggcgtcggcagggcggctgccccccgagcccccatcacggggcccggaagcacgaccccctcctggggtagattgttctcccctgcagctcccgcccgcgccatcatggcctcgaggagcccgctcctctgaggccccgaccgccatcatgatggtcaagatgttggcgcgatctggatcgctgcagagggggaggactccttgggggatgagggatgcctccacggagctgagattcagcacccgttggaccattaccttgaagtcttcagggacccagtcccatttgaccccccggtgggtcctcatacagtcctcggacccggtgtactcccaggcgccccgggcgcgccgctggagtggcgcgatccggcgacgaaggtagtcgccgtacaccatggcccctgtgagcccctgagatcgcaggcccgccaggcggtcgagaacggcgtcgtagccatctcccagatctaccggcgcccgccagctggaagcctgcaccgggggctggctcggaagtcggaggcgcgcttcgtcggcgaggggggtgtagaaccagtcgctcttccagtcatcccacttcttgcggaggacgcagggaatgtagcggttcagcaccggcccccgcggctggaagtagcagccaccaaccaccgacggcggcgacaccggctgtacggtgaagaaccaccggaacagccgaagggatgggcgcaccccgatgaacatctcgcacaggtgcgcgaagatggccaatgtcatcaccgcgttgggggtgaggtgcgccatctggagattgtaaaactccagaacatccatgaagaaagaagaaaatggcggaaccagccctgccattgcgaaagggaggaagaagacggaccgccccgggtagcgtggcgccgggcgtccctcgcccagcgtgactatctcccggccggtggcagattccggcatgaagcggcgcggcagcccggcctgtctctcgctcacgatgcgggaaggcggcagcacgctaccgtcaagcggagcggagccccgtgccatgacgccggatgaagaaatgtttgagagcgagcgcgtgtggcgagggtagggcacaggaaacaaggagttagggcgcaagcagtgaagacaaggggaataatggcgagaggaaggaagcaaatctcttcctcggtgtctttatacccttgccaacgctgtgcccggctcctcgcttctcgcgcccactatctcgctccctcgtttctcgcgcccacgtctccactaatcccactcgcccgttggcggcgcacgaggtggatatgtggctggggcagtcgagatggaacatatcgtgcgcgcgttaattacgctcgccgaccgaagcgccattaccatatctccaggcaaaacgaaccggctcgtcccgattcgtgtgctactcgagtaatgtggcagtcttgaagagaccgctcattattgacagtcgagttgccattgccgatgtgtgcgatttgcgaccgctggttttctgcccaactgtagagaccggccccacctgtcaccaggccttaggagtggcgtcacgcccgaccgcttccctcgaggagggcgatcgccctggcataacgccgggggctactgtcggtgacatgggatcgggagtatcatgactagaggcttgggcaggagcaatcacccacgtggcctgaccccctcgggggggtcgggcccgagggtggtatgaccacccctctctttgtctccccgagtggtcggaccgctcccgtttcggccccgagggccgaggcgccccgaccccttgtgggttttgcgccgcatgtatgggttaggtgggcacagcggggctcacctaaccgcatttattgcggtttggacgagcgcgtcacgctgcatgtaacgcagtgcagcgcactcgtttatccggtctgtgaccggtcacagaccggacagatcgcgggttaggtggcaacaggcgatctgacacacgcctcgccccgtcccgtcaggatgagagcctccaggcactcgtccctagccggagccagcgtgctagctcctggagatagcacgttggtcccggtcagatatatgccaggcttcatcgcaaccattaaaagcaagacattgtatgaagaagggcgaacatgcagattggtaa

SEQ ID NO: 73892 - DNA, 6584 bp, Oryza sativa
ctgtcctcatatttttagatagacttgttatttttttgttagaaaaatgagttgccaatagatatgtgcttaaaatgtacgtagtaatttgatgagaaagaaagcatttggttgaattaggagtttacacagaatttccaacgaattatgaaataataatttttcagaatttccaccaattatttaattttaccaaggctatgttctgttaatctcttccaaaaagggtgagggaggatttactagaatcgctccaatcgatttaactgaaaagccctaaatgattccttaggaacgacgggtgatctactgggcactggccgtccattaagtgttttaatctaagtattcagtcattgattaaaattatgtttgtggctatctactatatactcctattctactacagctactcgtactagccaatgtcccgtgtgaatgcatgggcgaatgaccggacaaataactatgcaaacttaattccagttaattagtactcctactcgtactgtagctactggcggatcaaaatagttatgcaaacttaattccagttaattcctccctccgtccctaaatatttgacgctattgatttttttaaatatgtttaaaaccgttcgtattatttaaaaaatttaagtaattattaattatttttctatgatttgatttattgtcaaatatatttttatgtatattgtactgtaccatcttctagatcaactggtcgatcgataccaataatgattatcgttcacttatcgctctccaggattagtgctcaacagaatccgatccaactgccgttaattaaagaaatcgaacctctgcatacaggaagaaggaacactagctttattcttgacgttcctcttctcttttagatgcaatcatgcaaacgaattatacgcggtaagctaggtacgtacgctggtctttcttctctcctctcgctcaattatttattatttattggtcatggttacgttttcagatttcttttgaataattatcacgtcctccgattaaattacgggatgactaaaccgcggcacgagtggtttactaactcgttgagatttggtaagaggagagagataatcatggacaggaggatcgacattgccggatatttagcgaggtcaaaatagaatgctcaacctgaacgaagtaataataattgttcagttcttccctcgtgatactacatgcctccgtttataaaaaagtgtaaactgttcatgtttatagcttataaaggaatgccgtaactaatgattttgctgtatttttgttgatagtttttttctaaaaaattgatagatgtaaatatagtataatcatagtataactatattgtaacttgcacgtaactacgatataattttgaaccgtttgatttactttaaaattcgtgcatgggatagaaaaaatcataacccacccacgcacatgtgaggggattcggtaccattatctccgttttcacatgattagcatatcaccttggaatttttaaaagttaaatagaagttacaatatagttacatgcaaattacactgtaattatatcacaattgtattatatttacctctataaaatttgacgacaaatgttatagctaatcccagtaactaatacgcactccttccaaaaagcctaagacctatttcattatttggtttttccaaaagtctaagtcctgtttgtagttattatgtgctaaattaaattgttgataggaacccaagaagccattttaatgtttataggttgcatgttcattggttttgtcacatggtgaatgaattaattgtttcttggtcttcatgaaaaagaaataacactcaaatttttggaaggagggagtactttcttataggaacttaattttagattagaaatatcatagtattacgaatcttgacatagtctgtctagatttatcgtgtatatgttcaatttagtatttattactaatataaagcgattagtaataattaagtttaatgatgcgacttacaatttgtttctgcatggctagctgtattctcttcgaaccctttcgccaactgctgtcgatgcagacttgtgctttatatggttgtgtgtgccgtcgcattcttattctaggttttgatccctttgggatacgatgaatcgtggtcagagttagtttggatacagctaatcaccagctgccaagtgacttgcacccgccgccgccgggagggacgggcaggtatatatctctgtcttgcctcgtatcgtaagtagggttaatcgaccgagctttctgtaataaataaactggaagggatctgttttagcagttaattacggagtagttggtgtgtgttgccggagtcaaaattgtggatgcaatcatggatggggatgcctcaatgtatagtaagtgtatggtgtttgtaccctcgctaacacgagcaaacaatatatggtcggcagaagggctacggggattattgagtttgctcctttgcctatggtgttgtgcttctgtgcttgggccaaaacttaacatggcatttctaaattttccattgtttttttttatattttataattaagaatgtcattgaaatgataattctggtggcggagctaaaaaaatttcaaaacccaggcaaatctaactacaacaaatatttactaatttttttttgttttcaattctataaaatatcaaattttacagcgttttcgctacgataagtccgggccaccgccagggcggtggctccgccactgattttatgaataacaatttttaattatccctaaaaagctcaatgcaacacaaataggtaaaaattgtataatcagaagtacaagatggacttttttatagtttaacactactagccaagagcccgtgcatcctaacgatgagtttctagcttatcaggtcaattaagcacatgtttagtctaaataatacttttatgatttttcttattgaacatgtttttaaatttaaggagaggcagcagtgaaacatgagaggattcgttgaagggtggtgcggcatagattgtgaggctcagatatcagtagtagggatgttactaacagaacagacactaccactactaatattaatagtatagatgcaaagcttatttttttaaggagcaaaatttatctaagtcagggtcaatttagtctttgtgcaatacttttgggtggctttcatgcgtattttttaccaaaaaaactaaagaaaccgcatataccagcccaactatcttgtattgcatcgaagtgccaggaaaactagaagtacatacggatttgatggagatcagctcacttctaggttgcttttgcttgcattctcccttggaagttggaagtttttattgctgatggctgatccaaggtgggagacaaatcctttctcggttgaaatgccattatatcatttctcggtgctcacctgtgactaatttactcaaatttcaattcaaaaaaaattattcaaaattagccgtggatgtgctaatcctgttaaacagaatgaagcagccattactactagagcttggcttacactaatctcgccgagcagatgctttaagtcttcaaaaacagagaatttttttagtatgctgctactcctactaatgaaatgctcatttctcacatatggtgcaatttttgtggtatattgtctatcccacaattggaaccacatttttgctcacactgttaaggtattgttccattttgactgtgtcggctgaccacattttaattgatactagtgttgagcaaagctggggtatagtagagcagtggaagaacagagagagggagatgatgacacagggaagatatatctgtcattttgcaatgttttctcttacagtccaaattgacagaatgggagcaaaacaggaaaaaaaatggtatgtggcttgatagtagtgacataaacgagaagtcacacagtaactagtggagtacgtcagaagttgggaattcatatattagtggcataaacaaaattttccctcaaaattacattggtatggtctatacatagattagggaattaataatacaatggagaaacatatggatgatcaaactgcagttgtatacacaccttcatcaacgttcaagtttgctcagcagttcttcaagtcgtggaagttcctgcaatatgtcgttccaatttggcatgccctacaaataaagaaatacacttggttagatatattaatttacgcgtaaacttcagattcagtgtcattcaattctaacgtatgaccttcatactatacttattacatcattaagtactatctccgtctcaaaatataagggattttgcctaaattcctcatattttagtacggaggtagtataaattttcctgtgaccaactaaaatccagagaagaatactcttccagatcttctgacacgaccatccaatcggaggattatatagacatcttcaccgggagtgacaccttcagactcttgctggtcacgtatccaactgaaccatgagaatgtagatgtcaacaaaaccttagacataacaaattgatgctttacaatttttggatattgaattgttgagttccttctataagcatgcttgactactattaggacaaatacttcaattcctggaatagtcatcgcaggacattacataatgtaaacataaaaatacagtgaagctaatagaaatgcacaattctttttaaaaaactagtaaaatgcacaattctttttaaaaaactagtaactagtaactgcaaaactgagagcagcaggagggttagaagccattatattaaacatatacttccatcctcccaaaataaataaacttttatacacaaatctggacaaatagggtgtgtccaaattcgtgtaggaaaaagttgaatctttatggggcagagggagtacagagagaggtgaaggtgaagctattcctaatatctattttttctcctaaaaaaatgtttatctgtacattaaatagagacttaacagcaggggtgtttttggtgccataagaaaaacaaggtgtaaaattcttcaaatgagtaaatactagtactcccgccattcagaaatgtatggcatattttcctcaaaatgagattgaaaaagacttttactatttattctctctagctactatatttaacacatgcatattggaaagttggatacttatcagaggtataaaggacattatacttgttttgcacaggggtatgaaatatttacatttgtggacaaagcgaatcaagaacaggccttgcatatgtggacagaggataataccttggaaggccattcaaaagttaaaacatatggtctacgtgagtggatgatacttacttaagaaggtaaaggaggcaaagcattgtggaacaacacaaaaaaatggttgacataatggcatgcaagtagtgaaaccgaggaagtaattttgttgtttaccaggtaactatgcccattgtaatgctaaattatcaaagagcagtaaaaactattagcagaaatgggtgacacagattttaataataatgataagtatttcagagaagaccacaaattttgaatattgtagaggtgaccataagcttattcatttgtgccctagcttttcaaaaaatgtcagttttttttattcttccatgacatctaaatacttatttatgttgttgttctatgtagtgagagtaaaaaatctacaagttaaaagaaaaggcacctttcccattgttcaggagagacaatatcagccttaaatcgctcttcagcttttaaccgtgatttcgctgcaatagattcagtacgcttctcaaagtcatcctgtcaagagaaaattgctttccttttgaaatatagaggaaattttattgtctaaaatatatatatataaaattcttgggttttagcaaaaacatgtaagtttagcctaaccccaactgaaggagctgatgcagcagatcttgaacttccaaagcctcttggcttactttgggctttctgagaagcaccaaagatcacaggaattagaagaacacctcgtttcagcagttcagtccgatatctctcagctctttgcattgctcgagtaatggatgcttttgaacctgccagtataacctaaaatacttgtcaatatagtatgggcacacaaaaaaagcacaaaaagatgtatgcaactcaggaaatatcaagctatctattgagaattgaagatgtaaagagaactatactaactggcctagtaatgtcccggagttgcacaagctcaataatgcgattggttgacaggcggacaggtaaccttgaaagggtttcattgcgagaaatttgtgtgatctgctgctcttctttcttgttttcccagaaatacaaagccacgagcacaacaatacctgcagtgcgctgattcaaaagtttgattatcttttagtttaattaaccgtgtgaaagcacagtatacaagtttcatcaaatgattatattatacatggaaacccgagaaagatcattattggcttaagatgtgatcct

SEQ ID NO: 73893 - DNA, 17178 bp, Oryza sativa
  unsure (1)..(17178): unsure at all n locations
accattttcaaccataccattttttggcaaagttgccaaaattttggctgcgtttagtttattgccaaatttagtaaatacacaagaaatgctgccaaaattttggcaatattgccatcttgctaaaattttggcattgtcaaaatttggtaaggtttattttggctacaatctaaacaggcccatactcaattatgactacaaacatgaagtgtcaccaaggtgtagtacccgcaacaaatttgtacatggatgtttttttcctcatgttgcaaccatgcataagaacgcattatcgccatgtaaaggtggaacagaaatcccatgctatcaaaaggtacactcttctcaacacccctttcttttaggacatatcaatttacctccaatattgatggcagcattcccaacagtttccagcagatcaggggcaccatcgccaccttgaactgcaagtataagtctaggaatggtaaagaatgttgaaattccagctgctgcagttaacgccacataaaagaaccttcggacaccacgaaatggtgcttgtacttcactaatgagtttcaggtctcttcggaacccagaaccaatatcttctccaccacgcaatgcctgaaatgaatttacagtatgtacaggatcatattaaatattagtaaagtatggatacttacctagtggttacagtgctcaagtagcacctctagatcctgggttaaacttcccacaggagggaatttcaggcctagttaaaaaagttactccttggcccctcataaaaacatgtattaagaatcgacctatggaaggcgggccctcgtgtaggggacaggggcctcaaaacacgggctaaggaccaatccatagggggccagtccgtgtgtggggggccagggtttgtggcttttctcggtcggtttggttgaggcttcctcttcttaatgaaaagtcgtgagggcggtcattcccccgctggtcgagttttttttttttacttattcacaaggttactttcttattcattgggtcaaatatcggtattagtcattgcctcattgggtcaaatttaaactatggtcagcagattactttcttattcacgaggtagcaaagcagtaaaatacaaattcacaaacctcttcttgaagttccttgaattccggtgatgccctgaacggtgccaagtcaggatcattaagtatagtaccaaacttgagattataatctcgcagagctgtccttaagcaatctgcagctttgttgctttcttccctggtcaaacatgcacaccaattaatagaaaaacataaataaagcacaaaaggaacaaatcaataattttgaaagtgttgcctcacctaaatgcatggcagcatgctttattgtatagtgctgcttgggcttcaacaggatttggattcagctctagggcattctcaaattgttcaagagcatccttcacctttggaatgtgaaagcaatatcacaatgaatgcagttgatattttattgtatatggttcttcaatttaatgattacaacaaacccatgcaggagttcactagtacatgcaccgtctataagaaacccacttcaattaatcccatatctctaacagacaaacatggtattgtttcagtttagagcgagtacaatagtaggttacaagtcagctataagcacatgtgttggtgataagataagagacagaagaaaaatggactacagatttgtagccagctgcagcacggactccaaaacgtcgtgtgtatatttttttttgactaaatcattgtgtgtatatgaaaggtgggaccatatattaattgtgtagtatatatttataggtaactattgtatgaatgtgctattaaattgactatacatgatttggagctaatagttggctatactattaaacttgctcttagagcaagtttaatagtatagcccactactagctgcaattcacctataaccaatctagtagccaattcatacaataattgcttactatactattaatatatagtcccacatgtcatacacacactgcgtcttgaagtccgtgctgtagttagctacagatctgtagcccgtttctcttctctcttatcttttatctcattaaaatatgtttatagccggctaatagttcgctattgtacctgctcttaatagctgctttgcttaaggctgagtttgagggagcatatgggctgaaagtttccctcattttctgtgcacacacttcccaaactgctaaataatgtatttcatgtaaaagttttctatatagaagtttcttaattcttaaagaatcatattaatcccttttcaagtttggaataattgatactcaattaattatgtgctaatgacttatctcgttttgtgcaccgctaagttgctaagagcaagtttaatagtatagccaactaatggctacaaatcaactatagccaatataatagccaattcatacaatagttacttactatactattaatacctggtcccacctgtcatacacacattatgtcttggagttcgtgctgcagctggctacagatttgtagcccgctgctcttctctctcttattttaactctttaaaatatgtttatagccggcttgtagtctgctattgtacctgctctaagcccaaatgctcattcaaacccagcctaatgttcaaactcaatatggacatgaggatgtggtcaaatatttttgggttcaacttcaccattcccttgaaggtcgttacgaagaatttactattttactcagcaagcaaaagatggtaaacccagttcaaacactcaaatgtggcgtaaacatacctatatcagccaaagatgaaccaaaatggagataaatgcaatgattaaattctgggaaaaggctgccgaatactgacattcctcagctaactagagctgcttgcgcactaaaactggggcatctctatcaacatattactcctaccgataaaattactcgttaatatgatctgatccttcacgacgattgagaagcactcgaaatgtggaataggcggaacgggaatcgacttcgctcaccctgcccttggagaagagctcgagtcccaggttgacgcacgactccgccgtcgggacagccaccgcctccttccccggcgatggcgggggagacggagacgaagaggccttggagcggagcacgcagcggcgtcgtcggccgcaatgagggaggaggggcgagacgaaggatagcgcttggagggcatagctacgggttccgccgcctccgcctccaccgccgccggcggggagaagggcgaggtgtggccggagagccgatgctccggcggccgccattgccggtttcgtgaggtgaggtggtcgtttttctcgttatccaaactagtatttgtggtcgaggaggaacgagttgggccgaagaagatgcaaaacccagcccatttactcatcacgtgtaaaaaagaaaagcccaaaccggcccaccacggaaaccctacttgcgctgcgcctccgcagcatataacctctcccacctctcgccctccgccatccctctctcctctttggcggcggcggcggaagagagcgacgcagacggacggcgtggtggtctccccctccggcgacgtagctcgagctcgcaaccatggtgagcgccgcgccgtttctcccgttacgtctcagtttcatagtctctgtacttgtgtagcaccggtgtcttcttcttctgttctttagtttcgggtcgagtggtagcaggatgggcttgtgtttagcttgtgtggtggtaatgttaagagggagaattgagagattgggggaggatttggtttggttcttgggaattgatgcggtgtgcattgttgtagattggcgggcaggtgtgatgagggctatgcaatctttttttcgtgttatgtttcctatttcctgtttcttgatggcagcatatgtatgatgattaccttttgatgtagtaactgatttaagttgtgtgctgtttgatatattcttactaattttatataggaattagattccaagatatgtagttaaacagtatggatcctgttgggatctagaattatattgtggatatacagtatcgagcctattgctatctagaattatattgttgtactggcttttaagaagcatcacaattctgtgagtatgtggttaataacatacttaacgttgtcaacctgttattttctgaacaggcgaggggattgaagaagcatctcaagaggctcaatgcgcccaagcactggatgctcgacaagctcggcggagcttttgtgagtttactgatttcctgtgatgtgcttgaaatggcctctgccatttgcgactattttctgttgttcagtaatgtaattcgccgaactgctttgtgtgccttccaggcccccaagccatcgtctggacctcacaagtccagggaatgcctgcccctgatcctcatcatcaggaacaggttgaagtatgcgctgacataccgtgaggttatctctatcctgatgcagcggcatgtcttggttgatgggaaggtcaggactgacaagacctaccctgctggtttcatgggtatgcacgcatgtttcttttctgacccgtcgttatcttgtatggtctggtatgcaagtggttcatttctagcataccttacatggtaatgccctctgtttggcagatgtgatttccattccaaagactggtgagaactacaggcttctctatgacaccaagggtcgcttccgccttcagtccgtcaaggatgaggatgccaaggttagcattgcttcttttcactcatgcacacgtgaatgtaaattctctattctgttttgtagtctaaatgtttgtgacccgatcttttatatgcagttcaagctttgcaaagttcggtctgtccagtttggacagaagggcattccctatctgaacacctatgatggacgcaccatccgctacccggaccctttgattaaggctaacgacacaatcaagattgatcttgagaccaacaagattgttgacttcatcaagtttgatgtgggcaatgtcgttatggtcacaggagggaggaacactggtcgtgttggagtaattaagaacagggagaagcacaagggcagttttgagaccatccatgtggaggacgcattgggccatgccttcgccacccgtctgggcaatgtgttcaccatcggcaagggcaacaagccatgggtgtctctccctaagggcaagggtatcaagctcagcatcatcgaggaacagaggaagcgagatgctgctgctcaggctgctgcaaatgcttaaatacatttctatcttcaaaatttgagttttgtttgggttgacagaattttccatcctagttgaaatgtagttcacagtaatactgttaagttgcagagatgcatccttttctactgttatttcatgttatcgagccattttattgtgttcatcttttggccttgaagctaccaaaatggctgagaccgttatcatcatgcagtcattataatgaacagtagcaattagccatcacttgtttagagcgagatttgttttcaggcaactgctgctttactgaagctacatggctaatcttggtttattcaaacgagactattggcatccttccagcttggcattcaaagggagtcttggtttaatcaaataggcttccaatctttccaggttttgcaaagtaaaacctttttcgtaatggatcatattcctggaacacaattgtatggaaaggtagggatgggtagaaaaagatcgagaccgagaaattcggtcctaggtagtgagaccgaattttattcggtcaattcggttagtcttatcggttaaaaaaaaagaccgaattaacaaattaacaaaaaaaaatttctaaatccaacctataatccactaaattcaacatgattaaactctatttttcacacccctacttataggcatgtaatgtaagaagtgtctttacgcatacatgcttacgattttttttttgatttttgtgttgaaaatttccattatttctttgcatatatgaaaatgttgctgaatttcggtcaggactgagaccgagacaaattaatttgtcggtcctaatattttttcgttgaaattcggtattcacttccaaaagaccgaaagaccaaagaccgaaaccgaaattttcggttagaccgaatacccacccctgtggaaaggtacgcatgccgaacaaatggaatgtttggtttattcaatgagacttcaattattgggaaaggtgataatacaaattggcaaatacggtagtactgttttaaacctctcgctagtattttttttcacccgaggctaaaccgaaataccgtcctgcctgggatgcatagtttacaaaaccacgcggtcatcacgtgtggtaatcttttcagtttttgaaatcacggtatagctctcggtttggggaatcatgctaggatgtggatcctggctgtgatgtgaacacactcgtgcatactcaccggcagcggtagatccggccgtcatagggccggcaacgacagatctatccttcttgggctgcccttgcctccccttcaccagtgtagctcctaaggccaccatgggtggatccacgtcccctaagacctccacctcaactgttgccatcgtcgaggtcgcggtagccgccgccgtcatttgagtcgttgtagccactgccttatcccgtcacggggtcactcgagagatatttaaccatttgccacatttagatgtggcaattaactatttgccactggacccacatgtcatagacacatgtggacccacatgtcattgagataggggtggcaaatagttatttgccaaatctaaaagtggcaaatagttaaaagccccggttactcggcggtggcagatccgccctttcctagggctgacaatgatgctgctggatccgctgccgccatcaccgtccctccaagggccgagggtggtggatccatccctcacgagggaggtgtcgatggatccactgtccttagggggctgccgccgtcgtcatcgtcgtctttgccatatctcccaccagagccgagcggggtagggagaggggaggggaggggaggagtagggagaagagaggggtgaggagaagatctcctccatgatagaaaaatctcctccccaagcatctactccacgcgtgcgcgctccgtcggggccgccaccgagctccactgagcatttggacctcaagcgccgccacctctgcatgagagagattgtgagtgagtgagaaagagagagaggaggtgaggagttgaggtgactaaatacgtagggagagtaaaggggataaggataaggatgagcagagagatgggtggcaggcgggcctattaagacgtccacctgcgataataaattttcgtatcacaggtggatttttgctggacaccgcctaaatatttttacatatgaatgctcatttagttggccgcctaaatatttttacatatggacgctcatttagttggctaaaaaaaaaacacagtgtgtgttcgcgaaaatcgttttttgtaagtgtttcttaggtcttccggtgaaaatggaggcacaacacataagatcgcttcccgattttgtttcaattcacgatcacgggatttcacgtggccgcaggccgcagccagcgtcgcatccaccttcatttgtccgtcatcgtacaccgggctcttcgtccgtcattcgcaatcccgtgagcttcgtctgtgcgtccgcgtcccaacgcccgcacgagcgttcgttgtttctgctgtccccagacaggttccaagactgagagcgccctgacgtccatgcctagggagtatagtcgatcacgtactagccacaccaagtaagaagaagaagaagaccggtaagagaggggtggctgcctgcttttttgcttcttgctgctgcggcctgttcttcatcggagctcttcgtgtccagatttcttcaaggctagagagcagctagcaataggaggaggcagtaggcatgggcagcgtcaaaggtgagcggctgaccggtgtggagctctctggtttgtgtagatggctttgctctgtgttcatgatttgggttctcaggggatgctctgaacttgggttatttggggttcaaagttcggatcatctgttcgatgttcccatcgattttgtttggtgagagttgcaaaagaacggttttatgtaggtagggccaaatcaaacttgagatttctctctctctctctctctctctctctttttcctgacgctttccctgatatgtgcattaaaggattttgatatggcccagcctgtttgagtttattttcttgattttctttttgaatttatttagatagtgtgtgctcttttgagtgagctctctagatagtgagtttgcttcattgtgtctgtgcgtgatgacagcacaagtgtcaagacgaggcaacaaggtgcactacgctttatgcgcaagacactgcaaaatcacatacgactatacatgacaattgaaattgtttttatccagtataccgcatggacatcttaatagcataggataaagagaaaagcaataataaccaaaggttggagtttaggattggtttatttatttataggggtattagcatggctaggattataattagctagggtttagctttagattagcgatagtaaggttggcaagtatagcggctaggatttagtttattaatttctagcctacatgggagacttctctaaccggtgctgacaaatagcataatggccagaggattggaaggttggtgcaggttgtgaggtggatgtgttattctgacaaccatggatggtagtggggcgggagagctaagtgtgcagtgtactgtggagaccaaggaaacaatgaagctccaatctctgtaggcatcgataagtgtggtgcgaggaatagcagtacttcggctttgggattatgttatgtggagctttatatccaacagtccgatctcgaacgtccttatgaaaggcgtaaatttccaaacggtgttttttaagtggctaaggggtaatttggaataagaggaataatattcaaaagattgaatttaatataattctaaattggaagtttaaatggcatttaaatagattaagaacattcaaataaaatatgaaaatataaaaaaatagtatcaatagatagagtttgaatttagagtaatttaggtccaagtttgacttgaatcggttttatggttgaatcagttttatggtttgggagaaatgggctctaaaaattgaactttggattaaatctagaaaatacgaaacaaaactgtttatggggccaacctgtcaaacactgttattcttttcttttctctccttcctcctcccgatcacctctctctttcttgttgcaggccgtggctagggttggggattccagcggctatgatggccagaggccagggcggattgagagaggaggctgtgtgcacgacggtggcgaagtatcccccgtagtggaacggctaattgtgccagcggcaaggtcggtagctaagagtgggcatggcggattggcatcgaggaggccgaaaggggatgggtggtggcttcagcgtagggtagttcagattaaattgatgtcatgggaagctctagcctctatgtggatgatgatgataactcattttgtggttggttgtatttacacccaaatttgtcatctaagattcggattaggaaaatattgtcaaaatttggagagtatcggtttgcttcacggagctggtatgactgtcgtatgtgggccagtcagaccgctgcttgtgtgccggtcaaactagcagagtccgatctcgagtctgttttcgtcaggcctcggaattccttttttgggatggcatattttgggtttttgttgatttttttgtcccgagttggacgtggaggaggcaagaccaacccctatataaagcacaaggccggtttaattggaagaagaatctacacagtccaatgtagccaatagaatcgctttttcaatattgcacctacttttcgcctagttctagcctagttcatccatctttgtcgatttgcgccgtaaatcatccgccttcactgcaagagtacagaattcttttctaggtttgttccgtaaacctaatgttcacccttaagatgggtgtgtatcgcttgtttcatttaaatcggctccgctagccggtttaatctatcgaaacccattttgatctagcttttgctagattgaggtggtcggtgactccataccaccgcaaggtgtttaggtgtctcgatcatgattgtcttcttacaaaaaaaagtttccaataggttggttgtaactagcgatggaaaggaagctcgtggctcgttagctcgctcgacttgtgacaagctcggctcggctcgactcgtttcattttcctaacgagccaagctggcattttaactcgttagagataaggagccagctccagctggctcgcgagccttaacgagccaggactccaatagacaacagcaaaggcccagcccaagacaacagaaaaaccctagtcctctcctcactcctcacggcatcggcgtcggcggctcatcctctctggctccgcttgattcctcgatccctcccccctcaggcttccgcaatggcgtagtgcgctgccactagtcgctctcctctcctcatctctcgctgcgacgccgcccggccatcctcttccattgaagaagctctcctcgccgccgccaactgctagggccgtcgccgcacttccccagccagcgccaaaagctctcctctcttcacctctcgccgcgacaccgcctggtcatcctcttccaccgaagaccggccacctaccccgcccccgctggccaccaccccatgccacacgccgcccactgcccaggcgcccaccgatggtttggctctcgagcctaatgagctagctcaagctttcaaatgagccaagccaagctaggtttctagctcgttaggataacgagccaagctgagccagctcgttatcaccaagccgacccgagctggcttgctatccacccctagataggtgctatagctttctaggatgtactgagacgctacaaacaaaaaggctccaccggattatagctggacgccttgatggagaaatgagcttgcgcaacgaaaaacagagcagtgcacacacttggcctcggacttcgacgaggacttgaaaagcttcaagtatggcataacgatgcctaaatttcgcgttacaccagaagttgatgaaggatttggcttgaattggtggagtgtatgcacgcatagtgctcgatcactgtcatgcacgaggccgtgcactttggcgcgtggacatctatccttcggctgagcaaggggcggtgtaccaccatggtttgggccgaggtggactggcttacgttgaggaataagttcatttgaggtcccttaacttgacaccgactctgatttcgtccctaaaccacaataccagatacaccctcaattatcaaaactggtgcaaataaggtcccaaggcagtttggatgtcggtttcggtgacgtggcatttacgtggctggtttccgtcggacttgagggagaactggtagacaaagaggtccaggaagaaagggagtatggtttgggcgcgcggagtctacgccgaagccgaggacaacgagggacgagtggcgggagggtggcgaagatgtccaggtaggtggacgcgaggggccagccacagcgagggaaatgagagggagtggatgttgccaggaccgtcaaagaggaggacgcgctcgcctgctctgtcgttcttcttgctgtccacccacccgtccaccatctcgcctcctccaccattctcctcgccgcgcacccacccgtccaccaccgctcctcgccgcccacctgcctgtccaccactgtctcacctcctcccccgttctcctcgccgcccacctgcccatatgccgcctcgcctcctccgtcgttctcctcgccgcccacctgcccgtctacgcagatccaggtcgccgcactctccgctactgacccttggcgaggagctcgattgcggtattaagggaggagcaaaccaagcccctcccttgctgccactgccacgtggccattggatcgtgggtgtagccttgctcctatgatctcgaggttgagggtgctatcgatcccacgctgggggtgggagagcgcaaccttcttgtgcgtgatgaggaagggcgcgtcggtggcggtggtggcggagagaagggcggcgacagcgaggagtgagaatgaggaagaagagagagaggatagagagaggggatgagtgaagatgataggtggggccacatgggccctaccatgttttatttgtgtgtgcatctgattgtgggccccataatttttatttcgagatcaaattgccacagtcaaaggagccatgtaggcgccacgtcagtcaaaatcgggcataatactgccgagggatcacgtttgcacggttttgtaaggttgaggatgcgttgtatccggttttgcggtttagggacgaatttcggactcggcgacaaattgaggtacctaaagtgaacttattccttagtttgatatcaggttttgtgggacgaaatttgactgggctgaggttttgcgccggctagaatgagcttgaaattctgtagagcacttcatggacatggacagccaggggcggatctacccattaggcggggtgggtcgatcgactcagctatgactcgtgttgctccacgctctcaagacccctcttactccattatagtagttatgggccatcaaaattaggtataacaaggtgtaaacacccaacaaattgaggcaattatgcgaatgaactattaatacgatacatgttgattgtttctgattggttacagacagtgtgataccttgatgtttttttttgtttttctttctgtaatttgtaaataaccttttcattttataaaaatacactgcgaggtaaagtcctggcagtatttccagtaaaaaaacgatacgtgttgtgttcaaatgctcttaacgagtgaacatttctgttctccgccccatatatattttaaagctgcgtccgccaggacagcatagttttgtattttcaagatatttcagataataaaatgaataatttggaggggcttggatgcaaagtctcagtgtaggtgtaggagtaggagtaggccatgatgatgtaggaatttagtagaattttcgtggactaaagcaagaatttgaaattcaaataatatttgaatttgagaggaattgagagtttgcgtcaaattaaaaaaaaattgaggctaagcctatggtactggagtggagggaataagtagatgaattagttttagatggaaagtgatttggaaaggcacttgggggtttgagcaaatttggaggaataggattttattagcacaagagcaaaccaaagatcccaagagttttactgtgctagggaatagatatttgatttgaagaaaattttgggcatgggaatatgtggaggaaatttatagaatatttgtgacgagatgaaacatcaacgatttgggatttaaagctagagatagaatatgggatccttgaaccttgtttagaagggataaattcaaaaatgtttaaattgaagaaaggagagatttgaaaattgggatcagacttacatgaatttttctataaattttttagaataataaaaaatgcttaacattctaaattcaactcaagaaatagaaatgaaaaggcggcatgacgcaattcgaaatatttaaattttgaggatgttatactattgattactctctgtcctaaaatatagccatttttagctataaattatgttgagatggaggcagcagatcataaagcgtggggaaggagcccggaggacccacttccattcctttgcaggattcttctcgaaggaagaagatgtctgctgatcgatcaccgggatcgacctcatcatcaaccaatggttagcttcttgcaggatcactacaccaacactggcaccaaaggaggcaaatgatcatcaccaagtggcactaatggcttcacctaattaatctggtcagtaccaccaaataccgcggtagattgaattttggtggcctgtttaggctaagttttcagatcttgttagatcagaaacttacaactatgatgaacagtagcccttaactatccttttttttatttggagagatttgtttccaggctattgctgttttattaaagctgcatgtcaaacatactccctccgtcccaagaaaaagggacacaactacaccgagagtgctagctggttagtgctaaagggagacaccattctttctaaaaaaaaaagctactagtacactcaatatctatgtatttttttcttcttagagaagattctcttaaattacttatccgatttataatccgatttcacctttgtgttcgtaacaattaaatctttacaacaagatctcacatgattatatttttatgaaaaatcacaaattacttttatgatatgtctaaattacttctagatttcactaagttacttcttagacatataaaagtaaattcagtaaagcttaaaagtaatttacatatattatagaagtaacttataacaaaaagaaaagtaactttaatttagaactatatctagattcattaacatctatataaatgtgggcaatactaaaatgacttacattatgaaacggggggagtaactctctgtagtagaaataattatattgtgagtaagctgaaataagaaactatgtagactgaattcgtaagtaaagtgtagagaagatttataaagtccacaaaatatagaattaactaaaaacaataataaaaattaacttagagcattctatagaagtaatttagtcaaatttgaaagtaacttatatatattataaaagtaacttagtatataataaaagtaatttacaactataaatattttttcattgtaatataatcatgtaagatcttattgtgaagatttaattgtaacgaacataatggtgtaattggattgtaaatcggataagtaatttgagagaaaactttataagaaggaagaaaaagacacacatatctaagaggaaaaacaacacgcacatcagcacgtgtagtagtaattcttctcacaatttgatcgtcgctggttaacactaaaccgagagacttctcggtttagattttaccaagaaaaagataaacccatgtttagatttatacccagggtttgttgttttttggaaggatgttcagatttatatttagagtttgttcttttttttaaggacgaagggagtagtctgcagctaatggtagaggtaaatttcatctagtaatgtatggtagaacgtattgggaatacttgaatttatccttcctatgcttacaaaaaaaatttggcatgactattggaaagggaaaacatttctaaaatatgccttttatcatacaaatatatttcaacaatgcaatcttcattggtcagcatttctggaacacaacatgaagaaaaggtacacatgccaaacaaatgaaagatttgctctattaaaaagacaatttgaattactaggaaaaactgataattcaaatttacgacttttgaacaccttcttattattaaatgttcatcgaacgatgaaaaaaaatacttcacgttgattttctatttaggggaaattttagagttgtgtttttctgctagggaatagatggttctccaagttagcccttatttgtcagactgcaggaaacgttcgatctgcagataagaaatacatgatcaaaactagaaaagattcaagtggcatgggaatatgtggaggaaatttatagaatatttgtgaggagatggaatatgaaggatttggatttanagctagagacagaatatgggattcttgaaccttgtttagaagggataaattgaaaaaatgtttaaattgaagaaaggcgagatttgaaaattgggatcatactaaaaggtatttttctataaattggtgagaataatagaaaggcttaaaattcataagttctactcaagaaatagaatgaaaaagcaacaatggtgcaatttgaaatatttaaattctaaggatgtaaccatactgattagataaggcatggggaagggacccgaaggaccgcttccaatccattgcatgattcttctcgaattcattggtgagcattccgggaatacaacatgttgaaaaaggtacacgtgccaaacaaacgacaggcttgtggcctgttcactttgatgccaaaaaaaccttaccaaaatttggcattaccaaaattttggcatagttgccaaaattttgccaacttaccaaaattttggcagaatttcttatatagttaccaaaatttagcagcaaactaaatgtagccacttttttttggcaactttaccaaaatttggtaaggttgaaaatggcatcaaagtgaacatgcccttggtttattaaaaagagacaatttaaattactagaaaaaaactgataattcaaatttatgtcttttgaacaccttcttattattaactgttcatcgaacgatggaaaaaaaggcttcacgttgattttctgtttaggggaaattttagagttgtgtttttctgctagggaatagatggttctccaagttagctcttatttgtcggactgcaggaatagttctgcaaataagaaacacatgatcaaaactagaaaagaagcacaaaatgaaaccagacatctaggaacaagcggttgaaccgttgaagattcaccaaatcgagaatatggcatctctaccaaatcgacaatatagcatctccaaggcttcgagatagtactagataataaatctgctttccaggtcgtgttgataacagatctgcttggttaacttcctaagtatctgtctatgttgctatgaacagaacacaatcatgtgccttgtgttctggcgaaaaagttactatcatg

SEQ ID NO: 73894 - DNA, 7098 bp, Oryza sativa
aggtaaaaggaatatttcttcaatttttttcatcagtacttatcattctaatctataattctgactgctcctttactattgactagtttctctgcatttatctgtttttcacgagcttgaaacttttataagcacttacatatctttggactgattacctgtagatgcctaaaatagttcagcctaggatgtctgaacaagttggaacaatagagtggtataatgggataaaaatgacaaaacactgtacatggtgaatgatcgaatttgcttcattgtgggaaatacagaaattaattataaaattattgcataccttcatgacgggcgtctagttctttccactcgaggctgcccagccgttgccgcaggcatgtagggagcacttttagagcagggcattccataattataagcccttggagggatgagtacgcttgcggtgaattgggtagtgatgatgatgccaggcttttgcagtaacagagcgtgagttttaccaacgatgggagctcgcccgagtgaggagactccagtgattcaggaggagagaagtggtccccagctggtgatgacggttccaacacaggagcagacacaatgttgtcactgcaaggcccttcaattaatgttgacccacgtctctgcttgccgaatatggacttaagctcagggcaacgtcgtatgtgcaaatacttgagagatggtggggtgttgaagacctctaccaaacttttacactcaattattgttagtgactccagacgtgttaggagttggcctccacctgatgttgaccgctcaggagcttgtgcgtatcccttcagtttgttgcagctcactatccctaatgtcttcaaggataccaagccctgaaattctttctccggccagtggatgagcacatcgcatctacaaattctcaaaactataagctgtgcaaaacatgtccatagtgcatgtgcaccagaaaggaagaacatgttgaagttatctaggcgcatatctgccagaggggattcacctttccaattctcattgtcgtccacccactcaatcaaattgtgttcagctggaggcgctgtttctacaccttcctgcagcaagctcagagtggacaatgaagtaatgtatcttggtatgcaaaagagcaactgttgggagcccttcgttatgtgtaaaacactaagctttcgtgcttcaggtagacttgccaactttggacaatccataatacgaatgttctcaaggttagggaacattggtgttttgacatgtgttgcttccacctgttgccatctgtcgattttatttaactcaatgagttggagctcctgtggaaaatttggcagcgcagttggtgtcttattgttgtcgttgtcacaactcggctgttcttgcctctcagttttgtcccaccatcccttgaaactcttcagattttctagtgtgagctctttcaattttggaaatattgaacatgtcgtgctgttctcaccaatgctacacaaatattgcaatctatcaaatccagccagtcgaagaagttggaggtactgcagctgccacaactgcggaatattttcgcaccttgtataactagtactgagatcaagctctataagaccttctaacatactaacccatgatggtaatgttgtacctttgtaggaggccaccttcagaaccaacagattatcatgaggtcgtagagcttccatcaccttgttatgactagaatctgctgtttcattgcgaggttcttcattgtcccatactaaagacaattccatgattttccttttgctgtcaagcttggtatgtattgcatctgactctcttacattctgtagctggggtagctctaggtgaccgccaatgtctaatttctgcagctctccaacattactgcatttaaagccagaacccactacaaaacaagtgagtgtctgtagggaagtgagttttctgaaatccggaggcatgtgcttcaaattcaaacaaccatgagtgtagaggtgacggagcgaagtcatgtacttcatttgtttaggaagtcgacggaggcaataacaatcagataggtttaacgtttgtaaactatatagaatgcttatttctccgggaagtgcttttatataagtttttgagagatccaggtaccttagatgatgtagaatctttggttttagttggatcaaccgcatctctttactcagtttcaatgctcgcacagagctatattttgccaaatgctgaaattgtctatcaacaagtacatcacatagaagtgtttggacagattgacacctcttcttcatataatcattcaacgtagtgtcaggctcattagatgacaaaagtatatggcggacagtacttggaaaaaactccttttgactaggattttcagttatgctaaaacattcgtttcccataacagatagcgcaacatcgtgcatcaaatcgtgtatcctacataaccttctataacaattcccatgtttgcttccatattcctgaaatgggacttgtttcatgtcttggaagaatgaccttgaggccaactcatggaaaatatagtttccaatggtttctagagggacattttttttcgtctgggataaagccattggccatccatacgtggattagattgtctacgtcaatcacataatctttgggaaacatagcacagaaagcaaagcattgtttcatgtatgagggcaagtcatcatagctgagcttgagtatatgtaaaattccagtctcctcattgcatatactgcttctcattaatatggcctgccattcttgcacagtttccttggtacgaagtagagagcctagtgctgttgcggctaatggagatccaacacatctgttgacaaacttatcaatcatttcaacttgctcattaggcttttcatcctttctcaaactaaatgctctcgtgtcaatgatttccttgataatgctgttctccagagcagtaaggttatatgcatcagttgtctgcattagttgagcaacttgttcatcacgagttgttgtcaatactgcactgccgatgctaccatgttgaagggaagcctttaacttttcccacttatcggcatctctgctccaaacgtcatccaatacaaggaggtacctttggccgctcactaatttttgaagcttctgcagtggcttgtccttggtcacttgactcacatgataatctatttggtgtttgccatcctcttttacttccttgctcctatcagctagtttaactatattttcagcaatagagtcaacatcaaaagggtcagatacgcatacccataccaacaactggaaatgcttctgaatttcactgtcgttgtaaactagttgcgctaatgttgtcttgcccagcccccctattccaactataggaagaaccaagagatccgggctgctagcttgaccaaggagaatattaacaattttcagtttttcttggcttcttgatttgctaataatgtttgttgggtcaaagatctcagaatcagtttgcctccactgcatggaaactaaaggctgaggttggaatctgaacctaaaggcattcatctccgtgacaaggacttcaatgtcatgcacaatcttgcaaagtcttttgtccatcctgtaccggaacatgacacggttgtgagtaggaaagagttttaccacatcgaagccgagcgcggtgtagtgcccattcttcttggcttctcgccaaagagcctcatacttgaactcgtcgaagatgtcatttgcttcgtaggccaccgtcttgagctcctcgagccaggctttcgctccttctctttgttctgacgcctgcttctcagcgtcggagatgacgtccaggatggccggcagcttgcgcttcaggatcttgtgctgctcttccaagccctccatcaccctgtactcctgtaggaggtagctggagaccttatccttcaccatggacagcagtggcttgaccacgatgctggtcaccacctccgccatttttgcacgctcgcagccagaggtacgcacaagcagaaggatgaggagagcaaccacacttcgaattgcacagcatcaattcgacgactctcctctccttttatctttcttctttcctcaagcatcctacagagtgtctccaattaattaatatttgctgccatctttgctgtgagagaataacttttttggggattgatccttctaacaaggcggccctgtttctttatttttatttttttgaaacagaggtggctctggaatcttgacgacattatgaacattaggtatactataaagttttttttctctcatttaaacaaatcaagaagacagtgctactttgtagaattgcgaagaagctacatcatagtatttatgatatggtttaggtatatatgcaaagtgatccctagcttgattctttttcttagttgggcaagagtaaaccatggatcaacttctcggccaggttactgctggcctgccgctcgatcgagatcgttaccgctgcctgcgccggtggacgagtctcccctgcacaccacatccggccagaaggacagaggcggagctaataaggattcaagggctggcaatgcaacttgcgtggggggttgtatatggatggtgtttgctccgtgttattcagtgatgagattatttggcaattggcacttggacaggccagctctgctacgtttagtctactcccttcgtcccaaaaaaaaaactaacctagataaggatggaacactttatagtacaacaaaagtgtacctaggttggtttttttgagatggaaggaatagctgctatgtcggttttgacctgtcgggaggaatatctgtcttctccgaccttctacatgattctggccgatcctggatcgacaatccgacggtatatatggatggtaggaatgcttcaactgcagaggtttaggcgctagtcgtctgtggagtcgattcaaattcgaacctagcccccacgtcattctctgtaggtagctgacagttgagaaaaataataaaaggatttcgaaattagcacgtgaattgggaaaacttaaaaacctacctacagaaaattttagctccaagttgagtgaaccaaattttcctagaaaatttcaggtttacaattggaccgtgctgtgtttgaataaatagtagaactttcattttcagcatattgacacttgtaaattgcatatctttccaaacaactataaaattagtaaaaatttcttcataaacaatatactattcaatgtgtaacatctcatgaattttaaagcatttcccatttccatgtttctttggtattaatttttagctttttttccccttgtagatagatatccaccccctcaaagaattttgacaaagaacctgtgataagtctgaatacaaacataaagcatctatgtatatcgaacctatattgaactgagtgcttagccgtgctaaagtatagtaaagttcaaagcaaatgcttagccatgctaaagtataggaaaggccaagaaaatggataaagccattagacgtacctttcacttgtgagcaattgaatattatacgaagactaatcatgtacctaaaactttggattaaatctagaaagtactccctccatcccaaaatgtttgacgccgttgacttttttaaaaataaaatgtttaacgccgttgacttttttaaaaatatttaaccattcgtcttattaaattttttaagtaattattaattcttttcctatcatctgatttattgttaaatatacttttatgtatacatatagttttacacatttcagaaaaaaaatttgaataagacgaacggtcaaacatatttaaaaaagtcaacagcgtcaaacatttagaaaaagagggagtagtaaatagtgttcatcggggccaaccggccaacttgtcggtttctgttttctttttctttcttttctctccgccttcctcctcctgatcccctctctctttcttgctgcaggccgtggctagggttggggattccaatggctgtgatggccgtggccagtgcggattgggaaggaggctgcgcacgattgcggcgaagtatatataccccacagtggaagggcttattgtgccagcggcaaggtcggtagctgagagtgggcatggcggatgggtggtgggctggtggcttccgtgtagagtagttaagattaaattgatgtcatgggaagctctagcctctaggtggatgatgatgacaactcatttttgtggttggttgtttggttgtgacggaggaggccggcccagagggttggtagctgacggagcgtggggctcctcaccgggagaccgcgcaggcccccctttgccggttcggccgggggcgctaagtgaggttcttcgccctcgatctgaggaacgtcagcgagagaagaagcgcacaagacgcgggcgacgtagacaggttcgggccgctgagaagcgtaacaccctactcctgtgttcttgtggatctgtgtgtgaaggaatacagagagccagagagcgagagagagttcaggctcccgaacccattcgccccttcttttctttttatctggttaggggtcaccacatgggcctctcgctgcctaagaaaggaaacatgctttttacaatgagggctaatctacagccggaagtgacctctgacaagcagagcatacgcctcctgccccgctcgccagctttcccggtggacgcccatttcaaccttcattcaatggccagcgacttccttgccatgcttgtgctgaagcctggaatggatctgaccgggactgacataccaactccaggagttagcacgccggctccggctagggacgagagccaggaagctctcatcattccgacgggacggggcgaggcgtgtgacaggccgcctgttgccacctaacccgcgatctgaccggtctgtgaccggtcacacaccgcgactggtcacggaccggataagcgtgcgctgcgctgcattaaatgcggcgtggcgcgctcgtccaacctgctataaatgcggttaggtg

SEQ ID NO: 73895 - DNA, 17205 bp, Oryza sativa
taacccacacatgtggcgccaaaaccacagggggttggggcgccccaaccctcggggccgaaacgggagcggcccgacccctcggggagacagagggaggggtggccacgtcaccctcgggcccgaccccccccgagggggtcaggccacgtgggtgaccgcggctacccaagcctctagtcacgatacccccggccccatgtcaccgacagcagccatggcgccggacagaaaaactcaaccgagaagggatgatgatgtggttgtttacacccaaatttggcacctagaattaaaataggaaatattgccgaaatttggaagtctaccggtttcctccgaagtgggccggtctgaccgccgtgtgttgggcggtcagaccggcggtgtgtggccggtatgaccggcaggtctgagtccgactctgtttcatcgggtctcaaagtttccttgctcggaaaggcatgtttcgggtttcctttggtttctaccccgagttggacgtggaggagggcctatagagggcaagaccaacccctatataagggacatggccggttcattgtaaaaaatcaatctacaatcaatcaatcgaatcgtttttcatattgcttttagttttctcttagtttgtccatctttgtcggtttgcgccgtaaaccgtccgccgccgctgcgagagtgcgacatctctttgtaggtttgtcatgaaaacctttcgttttgcccacgagatgggtagctatctagaaatcggctccactagccggtttagttatcaaaacccatctaggtttagctctttgctagatcgaggtggttggcgactctaggatcaccgcaaggcttaaggtgctgcgatcgtgcttgtcaacttgtcaaaaaagttgccaacacgatttttggcgactccgctggggaggagatccgttcatcgtcaactcaacttcgacttcgccatgacgaagccgccatccaagacggaggtggagccatctaatgtgatgccggtcacattggatgacttcgaaggagaagatcgcaaagctatggaggagtacatcaatgagctcacacgggaggcgttgatgagagcaactactaggactcgtcaaggcgtgatcatcaagcccgggccacgtcccaagctcgctcccgacgtggtaagtaatgacgaggtatcacaatctatccaacaacaaattgcatctacaatagattcatctatggctaattttaaagatagatttgatgtaatgtttaaggataaagttgatgggtttttaaggagtaggctcggttcttttatggatgattacacattaaaggataaagcctataccactgttgatcaacctcctatagatacaatgggtagtaaaaccgatggaacggcattcacggtcggtccgaccgggcctgacagccagtcagaccgcgacatagccgtcggttcgaccggccagacggccggtcagaccgggtattaccccagcggtcagaccggctttcaggctggtccgaccgcacatcatgacgccggtcagaccgggccttgggccggtcagaccggcgcaattgtcccaatacagggtatagatccaatgactaatgctaattatttgtaccactttagaacatttgatcctcctgtatctactgctacaagtaatcctcatgttcccccacatattcctaatgcttataatgatgcttctaggggatatcctcgcgatactagacaaggccaatataatcatattgcgccacaaacacatcctattaggccaccaaacccactgccaaatccataagagcctaataacatggaggatatgattagtgatattatgagtaatagattcgggattgaaactaggaatcgtgctagagcttacaaaaagccatatcctgattattatgataatgtgccgtttcctcgaaattatagagttcccgaatttgctaagtttagtggtgaggatggtaagaccacatgggagcatgtaggtcaatttttggcgcaatgtggtgaggctaatagtgatacttttaaattgcgcttgttttctttatctttatccggtaatgcttttacatggtttacttctttaccggcaaattctattcatacttgggctcaattagaagaacaatttcatgattatttctatactggggaaactgagcttaggttatgtgatttgacatcggttaagcaaaagtataatgaatctgtcattgattatattaagagatttagagatgttagaaaccaatgttatactttgaatataactaatagagatttggccggtcttgcttttaatggtttagttgctcctcttagagaaaaactagatggccaacaattttttgatgttagtcaactcatgcaaagggctctggctcaagaaagccgggttaaagataataaaaaatttgctagaccatttgacaaaaggcctaatgttaatgtagttgattatcctgaggctagtgataatgaggaggagggtgatcatgatatttatgttgtcgaatggtcgtggactaataaaaataagccttttgtttgctctaacttaatgccgactcctcgcaaagatcggcaaagtgaagttaagtatagttttgatgtggccaagtgtgataagatttttgattaccttttgcaagaaaaacaaattagattacctaaaggccatgtcataccattgcaagaagagttgaagcgtcgagcatattgtaaatggcatgattctcattctcactctactaatgattgcaatgtgtttcgacgacaggttcaattggccatagatgaaggacgattgaagttcaccgatggttccaagatgaagcttgatcatgatccttttccggtgaatacaattaatttcaatgataagaaggtgttgattcggccggagcaagccgaatctactaaggggaaggaagtggtcattggggaaccaaggtccaagatggtagtgccaaagaaggcggaggttggcgtttggaaggagaataagagtggagcttcaacttctaaggctcctaggaagaccaaactgacctttaatatgcttttggagaaatatgagaggcaaggtggtgagaaaattcgcaacaaagggaagagaccaagatcacctcctagggaacgatttggtcattcaccaagacggtcgcattcaccttcatatcatcatccacaagatatgtcatggggtccctattcgatgccgccgccgggttattcttatccctacttcatgccatggggggcaacgccgccaatgtaccatcatatgcctccaatgcaattcaaccaagggtggggaggaccaaggaggccaattcatgagtgattgtcttctccaaacaatagccggttctatggtaagaatcgggttaatgaagaaaagagggaaggaaaacgcgtcaaggtggaagagaggacttcggaagtaattactatcaaagtggggtcccatgatgtgcctataccttctggagatggagttggaaagtccccaagcaaaaaatccgaagccggtaccagctcctcgcagacgaccggtctgaccaggccctctggccagtctgaccgcggccatgttgccggtctgaccgggccataaggccggtctgatcgtcgacccgatagtggtccgaccgacgcctcaggccggtctgaccgtgtgccacacatcggtctgaccggcgcgtctggccggtctgaccgggctccagcgccggtttgatgagaggattgtaaagggcgatgtgagggcttcatcgtcttcaagcaaagtcaatagaggacattatttacctcctggaacagagccgaatcctaggtggatgcctgaggatttgacggctactcaaaagagaaggttgcaacgtcttcgggcccaagaactaagggagaaaaaggccgaagagcaaagggataaaaggttcaatgagttgctaccaccaccaatatggaggcctaaatccatagagaaggcaaaaccgattgatgtagaggagaaggaagaacaatcggttgataaaagtgaatcatctccaaagaaagacatggatatcaatatggtatgtatgttgcctatggagttttgtgctatggatgaagccgaagttgctcaattctcattaggtcctaaagatgcggtttttgagaagcccgatgaatcaaaccgtcacatgaagcctctctacctcaaaggctatgttgatgggaagccggtctctaggatgctagtggatggaggtgccgctgtgaatttgatgccgtactcgttattcaagaagttggggtgcgaggatgatgagttgaagaagactaacatgattctcaatggcttcaacggtgaaccaacggaggcgaggggtatcttttcggccgagctcaccgtgggaaacaagacgctaccaaccgctttcttcatcgtcgatgtgcaaggtaactacaatgttattttgggccgttgttggattcatgccaattgttgtgtgccttctaccttgcatcaatgtttaattcaatgggacggtgatgatgttgaaattgttcaagcggatacattggccgaggttgcaatggccgatgctacttttgagtggcgtcatgggaatatccaatgcttatcggggagggatctttctagctatgattttattagtatctccgatggcaaatttgtacctatctctgtaaggccggctagtgtagcacggctaagccatataaatttgtatagtgagtaaagaggataatttagagtggttacaaaaaagggtgcaagaatatcggtctacaaagaacgatattggagaaactgttgaagattttgatgaagtggagaagcttggacaagggtttacatcggccgatccattggaagaagtagacataggtgatggaactaaaccaaggctgacttttgtagacaaaaacatgagagccgattataaggttaagataatcgagctacttaaagagtatgttgattgctttgcatggaagtaccatgagatgccgggtcttagccgtgagcttgttgagcatcggcttccaattaaactgggttttaggccttagaaacaaccgcctcgtcgttttaatcctttactatatgaccgagtcaaagaagaaattgatcggttgttgaagacggggtttattaggccatgtcattatgcggagtgggtttccagcataatcccggtgagaagaaggggagtggtaagattagagtttgcatagattttagagatttaaataaagctactcccaaagatgaatatcctatgcctatagccgacatgatgattaatgatgcctcgggtcataaggtgattagctttttagatggtaatgccggctataatcaaatctttatggcggaagaggatatgtacaagacggcttttaggtggccgggatttgttggtttatttgagtgggttgtcatgacttttgggttgaagaatgccggtgcgacatatcaaagggcaatgaatttgatcttccatgatttgctaggtattatcttagagatctatattgatgatattgttgtcaaatcggatggtatggaaggacacatagccgatttgaggttagcgtttgagaggatgcgccggtatggtttgaagatgaacccacttaaatgtgcttttggtgtgtcagcggggaagttcttaggattcatggtgcatgagagaggagttgagattgatcctaagaagatagaaaagattcgtgatttcaaagctccgacatgcaagaaggaggttcaaaagttgctaggtaaactgaattatttgaggaggtttatttctaacctagcgggtaaaatcgatgcttttgttcctatacttcgcttgaaaaaagaagccgattttacttggggggcaaaacaacaagaggcattcgaagagttgaagagatatttgtctactccacccgttgtgcgagcgcctaaagccggaatgccttttcggttatatattgcctccgaagacaaagtcattggtgccgttttgatgcaagaggaagatggcaaggaatatatcattacatatttgagccgccgtcttttggatgctgaaacgaggtatgtctttatagaaaagctttgtttatgcttatactatgcttataccaaattgaggcattatttgttatctagtacatgcatagttacttgtcaagccgatgttattaaacacatgttgcaaaggccaattctaagtgggagaattggcaagtgggcatatgctttgatagaatatgatttggcttatgaaccattgaaatctataaaaggccaaattgtttgtgattttatagtagaccatcatatagatattgcttatgagggagaggtttgcttagttgaagttataccttggaagatttattttgatggttcttcttgcaaagaaggtcaaggcataggggtagttttgttttcacctaatggcatgtgttatgaggcatcggttcatttggaatattattgcacaaataatcaagccgaatacaatgctttattgttcggcttacaagttaaatatgtggaagctaaatatgtggaagcctttggtaattcggaattggtggtgcaacaagtcgtcggaatctacaaatgcttggacggatcactaaataggtatctcgattcatgtttagatattactgccaattttgataattttgctattagacatattgctaggcgtgataattctagagcaaatgacttggcacaacaagcatctggttataatgtgaaaaaggggttatttctgatattagaagagccagtgcttgattttaaatcttcgtgcgaaattggcaaaactggagaccaggggcggtctgaccggcgttgcatggccggtctgaccggtgaccaggggcggtctgaccggctgtatgctgccggtctgaccggcgaccccgagcggtctgaccggccctgcgtggccggtctgactggttttgggcagagcgctgggggcacgcttcaatcaatttggaagccgaattaattaagaattcagacatttgtgcccaggatgcagaagaggattggagaattcctttgattcaatatctgaaggatcccacgcttaaggttgatcggaaaattcggcggcaagcattcaaatataaattgcttgatggagatttgtatcgccgaaacagagatggtgtcttgttaaagtgcttagatgaagatcaatctaaagtggctatgagagaggtgcatgaaggaatttgtggaactcatcaatcggcccacaagatgaattggttgcttaggagagcggggttctattggctgaagatgattgatgattgcttcaaatattatagaggatgcgaggcttgtcaatggttcggcaatgttcaattggcgcccgccgccgtattgaaccctataatcaaaccatggccgttccgaggatgggctttggatttcattggtcaaatttatccttcgtcatcaaaggggcataggttcgtgttagttgctacggattacttcaccaagtgggccgaagccgtacctttgaagaatatgactcatacggaggtaattgactttattttgaagcaaattattcatagatttggtattccgcaaacattaactatggaccaaggtgcttcttttatgtctaaggaagtgaagagttttatcgaatcttatggcattaaattgttgagttcttctccttactacgctcaggctaatggacaagccgagtcgagtaataagacattgttaatgctagtgaaaaagaagattgaggaacacccgaagaggtggcatgaggtgttttctgaagcattgtgggcgcataggatatctaaacatggtgccactaaagtcactccttttgagttggtttatggtcaagaagccgttttaccggtggaggtaaatcttggttctcttcgttatatcaagcaagatgatttgtcaagtgaagattacaagatgttgatgggagacaaccttgatgaagtcatcgacaagcgcttgaaggcattggaagatatagagaaagagaagaagagggtggccaaggcgtataacaagagggtgaaagcgaaattgtttcaagttggagacttggtttggaagacaattttgcctttgggtactcgatccaaggagttcggtaagtggtctcctagttgggagggtccttatcgagtgtgcggcattgttcgagggaacgcatactttttagagacactacaaggggagcgttttcagcgagcaatcaacgggaaatacttgaagaaatacttctgagcgtttggcaagacgcttaggaggtactatggcctgtaattgggttatcgtcctaagaccaaaaacatgttctatgcttttagattcacgttgttcatcaaaaaggcaggggggcatgtgtttagacccaaatttggcagttaggattaaaataggaaatattgccgaaatttgaaagtccaccggtttcctctgaagtgggccggtctgaccgctgtgtgttgggcggtcagaccaccggttgagggccggtcagaccggcggtgtgtggccggtctgacggcaggtccgagtcctactctgtttcgtcgggtctcgaagtttccttgctcgggaaggcatgtttcgggtttcctttggtttctaccccgagttggacgtggaggagggcctgtagagggcaagaccaattcctatataagggacatggtcggttcattgtaaaaaatcaatctacaatcaatcgaatcgtttttcatattgcttttagttttctcttagtttgtccatctttgtcggtttgcgccgtaaaccgtccgccgctgctgcgagagtacgacatctctttgtaggtttgtcctgaaaaccttccgttttgcccacgagacgggtagctatctagaaatcggctccgctagccggtttagttatcaaaacccatctaggtttagctctttgctagatcgaggtggttggcgactctaggatcaccgcaaggcttaaggtgctgcgatcgtgcttgtcaacttgtcaaaaaagttgccaaaagtggtttgagattttgaaattgataggtggtatagcttctaggatgtactacgatgttaccaacaaaaaggctcactggacggagaaatgcgcttgcgcgaggaaaaacatagcagcgcgcgcacttggtgtcgaactccgagaagacttgaaaagcttttagtatggcataatgatgccgaagtatcgcgttccagttccacccgaagatgatgaaggatttggcttgaattggtggatggtggtggagtgtatgcacacatagtgctcgatcactgtcccgtgcgaggccgtgcgcatcggcgcgtggacatctacgcttcggttgaccatggggcaacttaccaccatggtttgggccgaggtggactgatttagggtgcgtttggttagacttttcaacctgtttttttgcttttgcaaaacccaaaagctaactaaagggtctaaaagccacagctacttttatccaaagtcaacttttggtgtagtacaaatcaaaagcaactctacccccttattttcacttgcttttgggaaaaaaaattactcatccctaccattacgaaaaaaatggttcgctattcttttcccgtctcctcctccttgcgagtcgcacacggggagagggtttccgccgccgctgcccacggccggcgccggcgcccgtccggccccgcccagcgccgcccccgcccttccccaaccgttcggcctccgccggcgctgtcaaggccgactccatctccgctgccacgcgtctgcctccgccgtcgccgcggccgccgcacgcgcgtctgcctctgccaccactgccgaggccgactccatctccgctgatcctcttgccgaggcgcttgtcgacgtcgacaacgcggcgtcgcggcgcgcgctcgagaaggccgggttccagcaggaggccgtgctgtgcaactactgtgtcgtcaagggccagctcagggacatggtcatctacagcttcatctccactgatcctctcgtcgagtgatcaatggctaatcatgttgctgtgagattttttctatgtattgtgaatgtatgtatgataaaaaaaatattttgccaagaaaccaaattcagattactgcatgcaaaccagcaagaatttcagccacaaagtacagcaaatcctgcagtgccattctgcaagatgataaattcaggcaattcatcactacccagcagactactaatgtttcttccccaactaatctctgagaaaggtacactcatcgactcatcgtggggttggttatcgaatctatcttctccaatcccgattgatagattgaccaaagcgaaaaccgaaagaagttcagtgcatgaagtacaacaggaagatgatcagatgactgacgagatcatgcttcccatcctctgagaacggtggcgcgggccacacggttgacgccgagggtgaaggcgcccatgcggaggtcgcagtggtggctcctgcacatctccttctcatccctgaacccgcgggtcatgtaggtctgcccctgtcgccgccgccgcggcgcatgtctgcctccgccaccgccgctgaggccaactccatctccgctgccgcgcgacttctttttttttcaacgccatcgttcggtcgtacatcggcgggcatgggaggtggccgtgctggagctccggcgacggcgagcgcgcgtgcacggcagcctcagcctcgccgcccgcgtatgcctctgcctctgcctcggcctccgccgccgccaaggccgactccatctcttcttctttttttttccagagtgtatgacatgtgggacccgcttgtaagcaagactaatttttcaaaagccatagttgttgaaccatacgagcttttccaaaagtcacagcccatatttcacagcttcttttcaaaaagcaacgacccatggctactttttcaaaatccacagctcaaccaaacacaccattaggttgatgtcgggctttgcgggaagaaatttggctgggctgaggttttgcgccggcaagaatgggcttgacattctgtctagcaattggtggacatgaacagtatggttctgtattttcaggaagtttcagagaataaaatgaataatttggaggggcttggatgcaaagactttggtagaacttttttggactaaagcaagaatttgaaattcacacaagagttgaatttgagagggattgagagtttgggtcaaattaaaaaggaataagttcatctgaggtctcttaacttgtcaacgaattcaatttttttccttcaaccagaaaaccagatataacgggtccctcaactgtcaaaactggtgcaatataggtcccatgacggtttggacgacggttttagctgacatggcgcctacgtggctaaattgactcggtcttcatctgacgtggcagtgatgtaccctgttggtatttcttacgaccacagataaatccgcaagcgcacagaataccactgtagcactttaccttcgggtgaccccaaagggatatattgaactcagggaacgtttgtaatctacctaaggctaaaaaatctacctaaggctaagactatccaaggacaataactgatggtaggctagctaggctagagaggactttctatgtgttttagttatctaagctaagtaaaggaaatttcctatctgttgcattgggcaccaacccctgctggtatgccagcgtggttcctgctatagctttatgatgtacccgaacgtggaggattactacgacgggatttagggttgtcaccacttgccatctacctctaacaaatccgtgggatacacaacaaacaaaggtaatttctaacttagacaccacgcctaagttattaattactaatccctccgtttcctattataagactttctagcattgcccatattcatatacatgttaatgaatctagacatatatatgtgtttagattcattaacatctatatgaatgtgggcaatgctagaaagtcttataatatgaaacggaggaagtactctaatacttgcgcaggaacttccttctttacccagagtcctagtactagaccccttagtacgaatactaaataatgaacccgcaaagatggaaatatatcttacttagtctaagtaattaaataacataagaaatgatcttgaatccatactttatagaagaagtttctccgaacccggaacagagtgtaccgacagctccggtactcctcgaaagctacactcgtcgaggtagaagtcggagagagcgccaaacttccaggcacttctcaagagcttcctctcactctctacctattttctaatgtacaaagatacaatagaggctcttgtaattcagctcaaagttgtgtattgtgaagtgaagtgagctcctccttttatagcctccatatgacggttacagctatcggaattgtccaaaacacccttcaaccgtcattgggaagaaatcaggaatgtacacatggaagatggtgatcaatgaccttagaacggattcggccgaacccagaaaccctcctcccggcatctccttcggccgggaggtcgcttaatgggcccccaacatcatgtactatgatttggcccaattctaagtggttttgattgacatatgggccctccaatccatgtaaacacatcttggttgtctggaggtgtattttgtcgtatgacgggtgtgttttctctttaaaatacctgcatacacatatttcaccaacactagtgaaaatgattagtaataaaccctaccactaagttggataccatattttatttcattatatgcaggcgttgatggtcagatattatggtttaagaaccgtcaacatggtattgacgtggcaatttgcttgagaaaataacaaaaactgtggtcctacatgtcatttacacccaaaaaataattaaaaagtggggcccacgtgggccccacatgtcattctcaccctcttattccccttcttcctcctctctccccatctcccctctcttcatctctctccaggagagatggggagggcgggagatagcggcgcgctacagccggcgggagaagggagaggagggagtggtgcgtggcggacgacgagagactagagaggagggagcggcgtgcggcggccggccaacatggtcaccatgcacgccggacgacatggtgtagttgtcgctcccgatgcctcaaagggagaggagcacttcaccgttgacaccgagcatggcaacgacgaagcagaggatgagcacgatgagcggcaagaggattggtggcatcctccttgttctcatctctagcagcattgctggcatcctccttgttttcgttgccaatctgctaccactcatcgtggacgatcacaaaccgtggcggcgcgaagacggatgagacgggaagtggaagaggaggtgtgtgtcctcctccttctcgaacccatcgttgtcatcgtcttcggcggcgtaggcggcagggaagcaggagctgtagttgccgctcgcaccgctctgaaccaccctccgccgcctagagcggtcgccgccgctccgcccgccacccgccttgccactccgagcttctccctccaccgccgaaaaggagaaagggagagaggagcagagatgtggccgccactcgccccgctccgctccgcactcttctctccaccgcctggagcggtcaccgccgctctgaccaccgctcgcctcgcagctccgtgctccgccctccgccgcccatgtgccgaaaaggggaaagggagaaaggagtggagctgcggccgccgctcacccggctccactcccctcgctgctcgcctcgctctggcagctgggtgctccggccttcttgcaggttgaaggggagatagagaggatagagagagacaaggggagtagtgaggatgacatgtgaggccacatgagccccaccattttttattattttgtgtgtatttgacatgtgggtcccacggatattattattttttcggatctaattgccatttaggcaccacgtcaatgccacgttggacgaagacttagtccgtgtagaagccacgtcagccaaaaccggtatcaatactgctgagggacctcgtttgtatggttctgtaagttgggggattcgttgtatccggttttctggactgaggacgaaaatcaaactggacgataaattgagggacctagagtgaacttgttccaattaaaaaagttgaagctaagctttggtactgaagtggaaggaataagtagatgaattgcataattgatggcctttcataatagcattgcataatttatggcctttcatatttaaaagttacatttttcatattaaatttacattttaatactcatgttgactaggtctttttagaaaaatatcatatgggtgccccatatcatagacagatgttatgcaatagatgtatattttctttgtctttattgacttacatgcaaatatgtaacaagttatatgcatttgaattagaggtaaggatagcttgatacacatacaatatattcattaataattttttagtatttcataagaaaagagcgagacaatgaacattcaattaaaaagaatggaaaaacatcttacttttaatttgaaattaacttgtcaggcatgtttttaacaaactaatacacatgcccgcgtgtcgtgtgggctaccttcctagtttatacaatatttgtgaggatatggaatatcaacggtttgggatttaaagctaagagatagaatatggcattcttggacattgtatagaaaggataaattgaagaaaatgaaagatttgaaaattggcattagactaaaagagaattttctataaattcttgagaataataaaaaaactaaacaatttcataaattcaactcaagaagtagaaataaaaaagcggcatgatgcaatttgaaatatttaaattttgaggacgttacactacttattagataaggcatggggaaagaacccggaggacagcttccaatcaaccgatggcttcttgcaggataactacaccaacacaggcaccaaaagtaggcaattgatcatcaccaagcggcactaatggcttcacctcattaatctggtcagtaccaccaaataccgcgatagattgtattttggtgacctgtttaggcttagatttcatatcttgttaaatcagaatcttacaactatgatgaacagtacccattaactatctttttttctggagagatatttgtttccaggctattgcagctttattaacgctacatgtcaagcatagtcggcagctaatgtaagaggtaaattttgtctagtaatggctggtagaacatattcggaatacttgaatttgtccttcctaggcttacaaaaaaattggcatgaatattggaaagggtaaacatttctgaaatatgccttttatcatacaaatatactttcaacaatgcaatcttcattggtcagcatttctggaacacaatatgatgaaaaggtacacatgtcaaacaaacgaaagttttcctctattaaaaaagacaatttaaattactaggaaaatctgataattcaaatttacatcttttgaacaccttatttatcaaatgctcatcaaacgatgaaaaaaatgcttcatgttgattttctatttaggggaaattttagagttgtgtttttctggtaggaaatagatggttctccaagttagctcttatttgtccgactgcaggaaacgttctgcaaataagaaacacatgatcaaaaccagaaaagactcaagtcactggtggagaaaccctttgtagttccggttcgtaacccccctttagtcccggtttccaaaccgggagtaccaatccgggactaaagatcgctatctttagtcccgggtgaaataaccgggagtaaagatcgatctttagtcccggttggtaacaccaaccgggactaaagatcgagctgaccttttttttttttgcatggccctgttgctgcatggtttatatatatatatatatatatatatatatatatatatatatatatatatatatatatatatatacatatatatatgtatatatatatatatatatatatatatatatacatatatatatgtatatatatatatattatattatattatatgtatatacatgcataatatatatgtatttatacatatatatgttatgcaaatgcatatgtatatagatatatatatgaccaaaatatatttacattatagaaaatgtttacacatgcatatagaaacatatgtagtcatgtattaattacaatccattatatgtcctagctagctacgatttcgacgtagcagtagtcgctgctagctcagaagataaggaccggtgaattgtgtttccgtcgtagtagaattcacccttgggatcaaggatttcttcattgatgaatcccatgagttgttcttgaaccgctgcgataaattccttgtgtgtggtcaggttatccctcatgcgaataaactatatgaatgtatgaaattgattagtaattaaacaagaaatcgctacgtaatgaaattttgaatttatttgtacgtacatcgagctctcttgtggtgatgatttggtctgcaaggcagtggcaatactcgcacacgtaatagccgcacaagttagttccctgcttttgctttgcgcactacaaataaatgacaaacaacgagagatctaattaatatacacttgtatgtatttgaatcggagaaatataaatgtagagcatgtgtactcacaggaaatttgaacttccgcctaagtctttctctccatttgccgcggaccaaatgacggaaccgataccaagccctacatggagtttaaagctatgattcgtagtagcaattaacgtaacaagattttcttaattaacaaaggaacttatgacggtacctgtagacccccgtttttataacaggaatcactcgtgtaaactataccatttccctggatcaagtagtctggtacacacgaattcataactggaataccaatg

SEQ ID NO: 73896 - DNA, 1047 bp, Oryza sativa
agttggcaactctacctgaagcaccaaagctgagagtattagtatttcccgaagataaatcattgatgtggttatccatagcaagatatatggcaacactgtccgatgtcagattaacaattgcagcttcttcctcacaagtacaatgtgcaatacaacaggtcagtggtacagaagaatttagtcataaaacttctaatgcaactatggaactacggggatgttacttcttctgtatggattgggaatgttttgtgaacctgcaagatttagtaatcaactgctgcaacgaactcgtctattggccactgaaacagctccaatgcttggtatccttgaaaagattaacagtttattcttgcaataatctgactaaatctggtgatgttctagaagcgccattagaaaaaaatcagctactcccatgcttggagtatatagaaataaaagattgtcccaaattggttgaggttctcatccttccttcatctctaagggaaatatatattgagagatgtggtaagctcgagttcatatggggtcaaaaggacactgaaaataagagttggtatgctgaaaacaaagatgatttgaggtcagaatcttatagcatcctagtatcctctgcagatgcacctttggcaacaaatacacatttaccttgtatggagtctctaacagtgataagttgtcaaagcttagtagtgcttctcaattttcccctatatctgaaggaaatacacatttggagttgccctgagcttagatctataaggggaaagcaggatataaaagtcgaaagtaaatatgttgagcgtaataacggcatggctatatcagaatctagcagtgatctcagtgcatctataactatagaagatcaaggaacatggagaagcaaatatctcctgccatgcttagaatacctaagaatagcatattgtgtaagcttggtagaggttcttgctcttccttcatccatgagaactataattatttcagagtgtcctaagcttgaagtcctgtcagggaagcttgataaacttg

SEQ ID NO: 73897 - DNA, 7469 bp, Oryza sativa
  unsure (1)..(7469): unsure at all n locations
aaaaagcttatttaaccgcttcagtttagttttggttaacatttgatacattgagatgcttaaacaatttttatgcataaagcagtagaattgattaatgaatttttgaaaatttgtttgtgcaagataagcatgtggctatggaattgctgcccataagagaagttcacaggacagcagcgcaataatggtacgattgataattgcactcgtgctgtatgaattttgcacagttttgcttaatgggagtgtcccattcttaaagcttactaaagtcttgtttggcacaactatcgaaggtttttaggagctaggtatttctaagtccacaaattcattaatctgtatctgcgattatgttgacaatatttggatgaatcattttgttcctattttaaataaaactagcatggtggcccgcacggattgcgcgcatcattatattttctctcttataatagcatacatattttctcaatttattattaaatatattaaaatgacaacataattttaaattttgtactaactttaccaaactaccgacgtgtaatattcatacagtattgtatatatgtgatagttattgattatttttaatatcaaattttagttatttctaaattgtattcctatatggactctaggtttttcttcctatttttttaatttcgaattttagttatttgtaaattgtatttctatatggactttaaactgtacttttaatttattatttttatttcaaattttagttaattctaaattcctaatattccttttttaatatatactcttcttttaatattccttttttaattttgaatttctattatttcttagttgtatttctatatagactctgtactcttcttcttaaattcctgtatggactctatactcttcttctaatatttcctttttcaattctgaatttctattatttcttaattgtatttctatatggattctaacataattttatttttctttttttaaaattctgaatttttattgattctaaattgtataccggcatggactctagtctccttttccaatattccttttttcgccgggacaacgaagaatgccgaccgatgtatatcccccctgcaggagggggacaaatgcagtgcgtcaaagcatcgccttcacaaccttaagcnangnnacaaaggctataatgtccctaaagttggcgctgcggcaacacttaacgagctaactagccctgctatttccatgtttcccattcatcacacatgatcacacacagttgtgtgaccgacgaggatgttccctcgaaaacccgtgcgttgcactctttccaaatcaaccacgtaacgaggatgacctcagcgtcgaagtctggcggtcgatcttcgcaacagactgtcgggtagcgagccaccaactggcaaaatctgaggacagcagcgagcacaagaagctcaatcgagcctggacctgcatccaaacctgctgcgataaggggcaagcctggaagatgtgttggcaggactctccatcctcggagcaaaaaagtgacaaattggtgcaagcttccaacctcggcgctgcagcttatcgactgttaaacaggcattgcggacggcaaggaacatgaagaacttgcatctcgctgacgcacgggatttccaaataatcttgccaagcgggcaggatgttctgccggccaaaaggatagagtaggtagaccgcacctagaagtcgccacttccagatcatagagtccgtacttccggggttgagagaaatcccggcgaccatgtcccagagcgcaaggtatttgtttatgcgaaaacacgtgatctggaagatctgcttaatttcagtgcaggtccaaaaatcttgcctttaggttcgtgagcgtgccggttgatttgatcttgcaatcaacaagaaataaagacaaagaaaccatggttaaatccataaatgatagccgattggccagccgccgatgacgtatcatttatctttgagccgatgtcatatttgattcgatcggcaattataaataagtaagaactaaatctatttgattggctgaagatattaatagcatataatgcttccgtcgatatatacttaaatcaagtgattgggatagatcggtcgccatgccgagacagtataaatctcttaaatcgaaatatatattaacaaggagattataagcattcacagcatagccgataagatagatccagcatgtatcggctaatactccgatactactttatattaagatattaaagcaagcaaaatatatcaaacaaaaagcttaatatatgtaaatacgacaagatcttaacataatgggcaaatttaacatatcggtcaagcacataatatatgaaggagttaaatcaggtaagatcggctgaaaccccgatactactctaatcgacaaccaaaaggcaggctaaagactgagattctaatcatgacttataagatcaaactcaactgatgcagctataagtatgaaaagaaggacaatatctagacaatcaagccactggctgtttcatggagtggtggataccctatataatctacgtcaacattggtatttaacctgatcggctgccttccaatgacggatgttagccgattgaaggttaaataacgatattgttagagattatatagggtatatgataactcaaagaattacataaacaatattagagtatcataaagatggaagcattaatcccgagaacgcaagccgccataacaagtttagccgatcctgatcgctgccgattcggactttagccgattctcgctctgtttctagaatgatctccatcttggattccgcttcggatttatctttatctccgatacttgaattaccaaatttggttgttaacagtattcccctatcgcttggacagacaggtcgcccctaacatcttcaatccaggaattgtcgtggaggacggcaaccaccatgattcccctcagcttgacaaaagagaaaagaattggaaatctgtactgcactgatcctccgtccggcaaccagctatcgcaccaaaacaaggtagaggctccgttccccagcagtactttgctaccagtggcaaagcagtgtagtgactttttgtcagcaagaggtgcaacgcgcgtccaggaacgctctagctcagtgcggtgcaatcaaatccaccgagcgcgaagcgccattcccattaggcgtaggtttatgatccctaatccccattgctcgatagggaggcaaagcttctcccaagccaccaagctgcacgagaccgcagcatcttcgtcgcccttccaaacaaaaccccggcctttcttttcgatttcgttgattgcccaggctagtagttccaacggacatgtagagtgggagcgccattaacactggcttgatcagggctaagcgggcatttggagataaaagcttgggcttctagccagccagatttttggcaagcctatccatcatcgattggatttgcgctttcgtcggtttacgcacagaaagtggcagcccaggtaaacaatcggcaattgcttgattgggcatgtcaacacctccgtcacctcttcaatttgggtatcggtgcaatggatcaggatcaacgagctcttggccagattggaaaccaagacggtggcgtcgcccatcagcttgagcacgaagtggattgtcagcgcatcccatcgggaaggatggaagaagatgatggtatcatctgcgtacattgaggcgcggagcggcaaggaatccgtagcaaggggggaaaacgcgctacggcgtgccaccgttgcgcaaagagccacaaacgcctccatcacaaggacaaaaagcaacggcgagagaggatccccttgcctgagtccccgagctagcctgatcctctgagtatctctaccgttcatggtgacggtggttgaagaagtgaaaagcagagtagaaacacagtcgcgccatcgagcgccgaagcccaaatgtcagagcaggtccaaaaggaattcccatgagaccgtatcaaaagcttttgcgatgtcaatcttcaacaacatggcaggcgttttggaccgatgtaacttcttaaccacaccttgaatgtagaggaagttctcttgtattcttcttcgcctaatgaaggctgactgtgcaggccctatcagctcatccattcttggggcgagacggagctccagaattttggttagaatcttagcgaaactgtgaatcaaactaattgggcggaagtcagttagttgattcgggtcctctttcttgggcaacaagatgatggaggccgtgttgatgagatgcaggtgctgggaattcgctctccaggctaagttaagagccgcaaccaggtcacccttgataattccccaacagaccttgaagaaagtggcgctgaaaccatctagccgtggcaccttgtcacttggtgacgccatgatcgcctttttcacctcttcctcagtgacgtcgccctccaattcagagagatcgtgggccgccaaaccaatcgagtcgaggttaatggacgccgaaggcggactatacgtccccaaaatattgaggaaatagttgtaggaagcctgcaacttatcttcctcggtggtagcatagacaccgtcatgacagagggtaggaattgcattctttcttcgatgtgcattgattttaaggcggaaaattgctccgttgtgccgctatgtttgaggaataacagcctggctcgctaacggaggaacctatatggactctgtttttctttttctccgattaatatgagaatttctaggccatgagagtgaacgtagaggctcctttttctatttctttaataagttaatagatatcgaattttaaatcagtgtaatttaacatacaaactttaaatccggcatagataaaggatgtggagctatcaaacatgacttaacatagacattgagttatatggttaaagagacgtgttttaacgttggggtcatacttatttgtctgaaacgttgatctggaggaatgttaacaagatttgtcttcaataacaaattaattctgaattaacatatacacagatttttgcaaagccgtcccaggaaaaaaaattgaaaaaaaagcatggccaacgagcaagaataggtccataactagcatggccatagtggatcaataattgcagttgatgaggaaagaatcattgcacagttgtgcttatctggaagggtcccaactgtgacagcacaaagatatagacaagcaagtcaagaccagtccagtcctaacttagtattatagttattaattttaggtttgtaattattggaattggcctgtactctaaaagtttttactatatcacgaggaaactataattgactaatttcgaatgttggaattatttaatggtcaggaaaaacgaccaaaaactagtatgtatattgtgctgcagtttctccctttcatttttatgtatgttggaattatttttgtttacacatatcatctatccacatggcctccttcctgttaggacttctgaagcactgccaaactaaaatcttcaggatggccataattgattgcttttgatgatttcacccttattttgctgcgcgtatacgtttgaattctttttttttttactgctgagatctgcatttaggctattactaaccatctcatcagtgtgttacgtagccacaaaattcaacttctttttcaaggagtataggtacactgaattgtgagagcggaactcatgcaatcagttagcagcatcgcaccgttgtaacttcctacaatcttaccatcgatgaaaaacagagaaaaagggtagagatggcctactgtctttttcataatttaatgacctagatttttcataaaggctaagcaccagtccctactttgtttagcagcttctggacatcaattgcttgtcaggttgggaatgtagcgtaatttacaacgggtgttcattccctttcaaagtaagtggctaataattatattcaggatcatgacaaattgcaacttgctgcacacagcgatggacaatgacagcacattacgcgcaccttttcttctaccagtggaggtccatcttgtactgattgattgggacgctgtccaagataaattgtggacagaccccattgaaccaccagttccctctccatttcattgatatttgtgtgtaagctctacaatgggtgaactggtgaccagcatggtgatcgggccactggtccacatggtgaaggagaaggcttccagctacctcctggagcagtacaaggtgatggaaggcatggaagtgcagcacaagatcctcaagcgcaagctgccggccatcttggacgtcatctctgacgctgagaagcaggcatctgaacacagggaaggagctaaggcctggcttgaggagctcaaggcagtggcctatgaggcgaatgaagtcttcgacgagttcaagtacgaggcgctacggcgtgaagccaagaagaacgggcactacaccaagctcggcatcgatgcggtaaaactctttcctactcacaaccgtgtcgtgttccgatacaagatgggcaggaagctctgccggatcgtgcagaatattgaagtgctagtcgcagagatgaatgcctttgggtttaaattcgaacctcagtctatagagtccaaggaatggaggctaaccgattctgacatctttgacccaatgaacattgctagcagatcgagagatgaagataagaagctgctcgttagcatattgctctcccaagcaagcaatgtaaaactcgccgtccttcctattgttggaatgggagggctaggcaaaactaccttagccaaactcatttacaatgagcctgaaattcagaaccatttccagttgatgatctgggtatgtgtgtctgacaactttgatgttgcgtctgttgctagaagtatagttgatgcagttcctaaaaaaggtgataaagtaaccatcaatgaaaatcaaacctcggcacttgacgagcttcagaaattagtgagcgggcagaggtatctccttgtattggacgatgtttggaatagggatgatgaaaaatggcgtaaactgaagaaatgcctcgaacatggtagcactggtagtgcagtgttagcaacaactcgtgaaggaggagttgctgaactaatgcacacaactgatgcatataatcttactgctctaaataacagtgtcattaaggaaatcattgacacagcagcttttagaccgaaaaaggagatcaagcccgctgagctagttcaaatggatgataagtcattattatctaaaaagaaggaaatgattgatcagtttgtggagagatgtgctgggttgccattggcagcaaaagcactaggttctgtactttataccaagaccagcctggaagaa

SEQ ID NO: 73898 - DNA, 23969 bp, Oryza sativa
  unsure (1)..(23969): unsure at all n locations
ctgcagccctcatcgataattttgaaaggttgagcaatagaatcaataatattgcgatgccttcaactaactctgagttattaaaaaacgaatgtattgttgtgcctcttcctttggatactaatgttttgcaggtgtctgagaacaaccaaggtaatgaggaagagaagaaagacggggatcaaaaagaactatccatagctccatgtatgcttgaggaatgtttaattgaccaagcgcctataatttctaaagatgagaaaaaaggcaatgataatggtgctacaactactcaaggtatgcatagttatgatgtgccaactatgtccactacttatgctatattagagcaacccatagtggaaacaactgttgaaatacctctgtcacaaaacaatttgcttgaagtttcttgtgataaataagagttgtgcgatgcttcacttatatccatgccacaactagtgaatgaacatgttagttctatggtagagccaccatgtgttgagtttaaacatgttattcacattactagtgagaatgaagagcttaaattgctatattctttaaatactcggggttatattcaatttgatgatctttgtccactcaactgcttagagaataaattatttgctagatttgaattgccatgtccttctgatgtgatttttcatgttattagcaattatgatagtaaaggagaatataatgtgcgttgagtatatatttgttcgaatttgactacacctctttttcatgatggaatatattgtctagaggactgcatgcgtatgtaattctctatcaagttcctctagttgtttaaataagttacaggttggtttgcaagaaggggagtgttgtgttttttcaactacaaagatttcaggatccaaccatatggtcatcaaaaaatgttcctcaccggatattgtgatagataaagataagttcaatacgcgccatgacaaggtgaaaccgaggacggtttccaatcaagaaggggaggatgatgaggacacaactagcacggatataatcatgactaccttatgtattaatcaaccaaagctgcatatgttttatattagatttacttgttatatatttgaacaaacgttgctacacaatgagttttcgtttgcagacgtacttgcttgggcgaaagaaaagagaccgagcagaaggaatgcatggatgattaaagaagttgattggggaccaaacgaagaccttctccaagaccactttcatctcaccacgtcacttttggtccatagaagacaatagataaagttctacacattttggattcggattcggacctcctgacatcatcaacttcaaacggacctagtcgctgatctagaacgaatttcggggcccatgagttcttgtttgatagtttttggagtctactttcagatggttttggtcccaccttttctttcttttatcttcacccctgctatcttcgagaagcatcccagtaaaaccttctcaaccaatggagcatcaatctattttccaactaactgctccgcggggcaaatcctatgagccaccttcttcatcgaagccaatttttagaactgtctatgagattcattccgagttaatcagtatggtttaggaaaaacctttttctagtgttgaccaggaaaatccttaccatcatctgcgggaattcgagcaactttgctcatgccttaagattcggcgcatgaagcaagaaactgtgcagtggaaattgtttccgttttctcttcaagagagagcgaaacaatggtacacatctaccgtagggtgtgtgcaatcaatgactaggagaaattacgagacaggttctttctcgcctttttccttgtaacccgtgttattgctcttcgtgtagaaattctcagtttccaagtagataaataaaaaatcaatcggtgcagcatggtccagattcactaatttagtatagtctggaccaaccttgtctatacccgatcacctgcctgttacagcattttcacacaggtctggataaggagtctgcattccatctaaacattaccaccagaggatcttttatgcacaaaactccatcagaaggaaaagtaattctagatcgaattatggaaaatgcatccttcaagaatcagagtgaggaaccactccttgaggtatgagtatctagaattgaggaatctttggccgagtctaatctttaaccctccacttcaaatgattcggctgagaaaccttcacccgagccatcgcatgttgagaatgaagaaattcagactccaagatgtgctcccaagttcgaggatgatcttgatgatgattatggaaacaccctgaactattttagcaaaaagaaacaacatattcccatgccacctcccgatccaatagagtttcagtttctaaaagagacagttcaggagttgacatccattatgagcaacgaatgactaaaggaggcagagctttcttccgaagtaattcggataaataccgctcctcgaaccattccttgtcatttataggggaataatgttggaattatttatagtccaacaatcggtgttaacattatttcagaatcttctgcattcgcttacttaagcgataaggcaacaacaccgactgacaaattcttcaagcaccctaacgggagccttattgaaggatatgggattgttcaagatgggcctatcatctgtgacggcaaagaggcaatcttggatttccatgtcatcgaaatccaagaggtcgatgttctcatcggattttcaatcgagaaacttctcatcaatacccctcgattgggctgcctcgagttctctttaggggggcggatacattctcgttaccctttgaccaatcgaagtacactctaactccctccctgaagatgagtatgcagaggaagtaagagcggtgatgcctttcgaatcaaccgaatcactcgttgaagatgatgtcctagacttcatccaagaggatgatgattccggtgaaactcttgatcttcccagctttgaaccaccgcctcgacctccgctagaactcaaaccccttcctcaaagcctgcgctattctttcctacatggagacaaagaagcttgcgctatgctttcctacatggagacaaagtagcccctgtcattattagtgacaagctttctgaagacgagaccagtcatcttctttccgtgctagaaaagcatcgctctgttctaggctattccctcaaggatctcaagggaatcaatccagttctttgcacacatcgcattcccattgagcccgagagctcgccatctagggagcctcaaagacggtttaataatgcgatgagagaagttgtgaagaaagaggtattaaaactcttgcacaccgggattatttatcccatgccatacagtaagtgggttagcccagtccaagcagtgcctaagaaaggaggaatgacagtcatgcaaaatgctaataatgagctaattcctcaatgcactgtcatgggatggaggatgtgcattgattataggaaactcaacaaggccacaaaggaccattttcccgtacccttcattgatgaaatgttggaacggctggcaaatcactccttatatttccttgatgggtattcccgttatcatcaaattcccatccatcccgaagatcaaagcaagacaacgttcacatgcccatatggaacctatgcatatcgaaacatgtcatttgggctatgcaacgctcccgctttttccagaggtgcatgatgtccatcttttcggacatgatcgaagaaatcatggaagtcttcatggacgacttcttggtctatggaaagaccttcggtcattgtctcttgaacttggacaaagtcttgcagcgatgccaagaagaggacctagtacttaactgggaaagtgccattttatggtccgtgaaggggttgttcttggtcatcgaatatcagagaggggaatcgaggttgatcgggctaagattgaagtaatagatcaacttcctcctcccgtcaacatcaaagggatccgtagcttcttgggtcatgctggcttttatagaaggttcatcaaggacttcactacaatcaccagaccattaactaacctgctagccaaggatgctccctttcattttgacgacgtgtgcctaaaatcctttgaaactctcaaaaaggcacttgttttcgctccaatcattcaacctcctgattagacgcttcccttcaagagtatgtgtgatgccagtgatttcgctattggcgcggtcttgggccaaaggataaaaagcatcatgcaatctgttacgctagcaaaactccaaccagggttcagctcaattatgctaccactgagaaagagcttcttttggctctttttactatcaataaattctgatattacttagtgggggccaatgtcataatctattctgatcatgcggctttgaaatatttgctcaccaacaaagatgttaagcctcgtctcttgagatggatcctcttaccccaagaatttgacttagaaattaaggataaaaagggagtagagaattctatcgcagatcatttgtcgagattgcaagtcactaacacgtaggaaccaccgataaatgactttctacaagatgacatgctgatgatagtacgcagctccgacccatggtatgcaaacatagtaaactacatggtatcgaagtacgtaccaccgggagaaaaccaacgaaagctgaaatacgagattcgttgtcacatctaggatgagccatatttataccgagtttgctcagatggactcttgaggagaagtgtaccaactaaagaaggacacaagatcatagagagatgtcacgcaacaccatatggtgggcactatggtgcattccgcacacaagccaagatttggcagagtggattctactagccaacgatgtatgaagattccaaggattttgtcagacgttgccagagctgccaacgacaaggagggatcactactcgcgacgcaatgcctctcacatacaacctacaagtggaaatattcgatgtatggggcattgactttatgggaccattccctaagtctcataattgcgagtatatcctggtggcagtcgactatgtgtccaagtgagtggaagcaatgccatgtagtgcaacagatgccaaacacgcgaagaggatgttctcagaagtcatttttcctcattttggtaccccaagaatggtcataagtgacgggggatcacacttcgtcgacaagaccttcagagaacttctacgcaagatgggcgccaagcataacatcaccacactctaccatcctcaaaccagtggccaagcagagacttcaaacaaacaaatcaaatatcctacagaagacaatgcatgcaatgggggaaggatggaaggataagcaacaagatgctctttgggcatgccggacagcccacaaaacgcaaattggaatgtcaccttaccagatagtctacgggaagacatgccaacttcctatagaactggaacacagggattactaggcaatccagaactggaacatggactttgaaggagctggagaatagaggagaatgcaattggcagacctagaggagaggagagaaaaggcatatcacaactcaaagatctataaggagagaacaaaacgctgcacgataagcgggataaaaatcaagaaatttaagccgggagacaaaatgctaatgttcaattcaagagtcaagctgttcggacatgggaaattgaaaagcaaatggaagggttgttcgatgtcatcaacacctcatcacatggagcaatcacactccgtgatgaatcaggtaacattttaaaggtaaatggccaacgttaaagattttccttgaaccggatgaaaatttggatgaagaagtggatattatttagctaattgactatgaaccatgatgatctcatctaaaatttgcttagctctacaaaaaattgcattttcgttttctccttagcttagtttgtgagtgtgaaaattttggaggctgaccgggccgaccagggttcgaccgaaccagggcagcgcccgattgcccccaattttcaaacctggatctcctcgcttgtgacaacagtagaaacccggtcagtcatgcgatagctacgttagatcaatctagagttcattaaattgaacttgtgttcatcttcctctctactccactcttctccattcatccagctcgtgtcttgagccaattccatgcccaaaaacactcaaatggctaggaaatccctgaaacactttggtgcatccacctcccacacctttgatctcaatagggaacattctacggcaaaccaacttgtgccactgcatgatctgccgctagaagaagtgtcacgcacggaaattcactagtaatttccgaactaatttatgcataaaatcctcgtccaggaatcagccgaggtacacaaactgacaatttaatatacaaatccatcataataataacgttacatacttacaaaagaaaagaaaacagcagcggaattaacggtctagcgatggcttcagctccactcctacagacagctcaactggggtataagccaaacgtcttctccttctggatcctttttcttcaactgaggtttgatgattattgcaagaatgagcatatgacatactcaacaagccacacagcaaatatgcaagtgcacaaggataccaaaggatggcataatatagactcatttgcaaaagcagcatttagcaaagatttaagagaagtaaaacagtagagtactttaatcattaattttaatcaacactgaacaacacgcccatgctgctcaagcccaaccattctgaacaaccatacccggctgtacagatctactctaaaccaggagctacagctgactgctattgttgcatcatatggttgaggtagcgatgaaacgcttgccagtcagcttgctattgttgcatcatatggttgacattttcactccctctcaaaaccttgctctcaaaattcattgaaagttttgcaaactcgcctcaaattcacacaatttgctgcaaatttttgtaaggtagcggctagtggggcccacatgccattactagccgttatccatgcactatatatgcagctcggctgggagagggaagtcacaccactttaactcattttcactccctctcaaaaccttgctctcaaaattcattgaaagttttgcaaactcgcctcaaattcacacaatttgctgcacttagtttagacactttgcatatacaagtttgctttagttcgctgcaaggttaatcggcgggtatttgcttaacccccgtccgagtagtcttgtattcttgctctttgctgtagctatgaagaaatgacttttgggcatattcaagagacgatcaagctcacggacaagccgacacaataagctgagtacaccttcttccgcggatgaatccatggaggaggcgtacgttccaccgaggctgtacgacaactccgatctcaacctcatgggcaaccggaaaatgcaagcctatcatatgctgaaagaccgaacgtgtgctctgacctgagcatacaactcgaccttctgaaaaggatagatatgaatgttgattttcataatgtttggtgtgctatagtttgggataaatttgcatgtgtagacgagccgggttcccgcttgcttaccatgcagtaggcgatggtgtactttccggttattctgcaaggaatatcacctttcttggaaagaccttagcttacatctaggctttgacaaaacatgcaaagttgatttcaggaacacatttcctgattttaacaagtgtatgttttggcaaagtattttgggtctctcatcctgtagaaagcttagaactaataacatccataatcctaccttgaggctgttgcataagtggcttggtttaatgctgtttcttagagctgatatccagatagttcgtgaagatgtactagtcctattgtatgccatggttagaaaaatcaaagtttcacccgttcaacccatgatcaagcaatggttagaaaatgtgaagttgtctggtcctgttgagtgtatttctttggtgactcgtttaacatgaagagttgggactctgcttaatatgcaagtatcttgtattcctgttacccactcttatgttaatgaggcctatttggttcaaggccacatactcaaacatggtccaaatgattctcttatgtttcccggctatacaaatgagattccgttacctaatccggagtttcatttgtataactgccgagaactaaccattccactccaagtggagttgccttgagatgtcccacgcaggataacgcgacgaatggcaagaggagcacctcaagaggcgtcttcctcttcaccaccagtgcagatgtatgaaggcagttgggacccgactgcggatgccccaggttagacccaagttccacaacatgacgctggaggttcatcctggcagagtgccagcgacagccagtggcatgtaccacaggagctgcactggggatactcatgctcctccagttcaagtggtccatctcgatcctctcggatgcgtcgctcagtctcctcttaaggggatctgggagaactcacccgaggatggatacacttgaactgcaagcggggaacatgcagcacacactggaggatcatgtggtgcagtcacgggagtggcagcagtctgttgatgaacagttcgcaaacctcaaccatatgatgcaacaatagcaagctgactggcaagcgtttcatcgctaccagggatttgatccccgccatgagccatagcaagaaacaagcttcgggggagatgtctctccccccactaaggtaacttgtatcacattgcatattttcctttcattgcatgtttcaatttctgcattgcatttataaacctgaaaacaacataaaaatttgcaaaactaaaaataccaaaaagataggctagatttattatgctaggtaagacatgcttagttcttcatgttgaaatgatgaatagttgctctgttttatatctctcatatatgggtttatggttaagtactctctcaaaatttgaataggagtagccaacaattatccgggaacctgaggtaagtgagctgcactttgctgatctgagtctaggttgttgcgagatatgagatagcaaataagagttgctatgaccctgctctaagtttgacttgaattccggatgttttattttccaaaatgataaatttgaaagttcctcaattgatataaattcctaccagagccaaaaatattcatattgattaagccatatacattttggttacttgtaattccattgaactttgtcaaatctttgtgacttgtgtagatacttttcatgctctatgatcaagatcatacacccacatatgcacacatatgctaagcttctacactggaagatagcatccatatcatccaccatatccatgttatcattatccacaaataagctctccagccatacttcctttccaaagaaaaatcctttgcaaaaatgaaagaaaaaaaaaagagggaaaggtatggctatgagaaaaataataaattcttgctctcccaaaagtggagcataaaaaaaaagaggaaaaaaagggaagagaaaaagtagccataccgtctctatgaaaattaaaggatattttggaggaaaagcataagcacaaagaagaagcattttctttatccacattttgttttctatcatattttccaccatattattcacacacactttgcacgatcttgatcttgagtatgattagtcatctattttagtccaagtttttgacttagtaataaatgtgaatacaagtatgccatgtttgatccctaccaagctccacatatcaaaccttagagtaggaatcaaagaggcaaatctggtgaggaatccatattcatacaatttgagtgatctagagaatcatttgaggaacttggctttcttttgcaaaaaaacatttgaaaacttccggaataaaagttgaataaagactgggtaactagcgctctaattgctgttttgtctctcaaccgctcaagacaaggaaaggcagtgtctcatgggaatcaggggtaagggtaagccaccgtgccaaacttatttaatttgagagagagagtacccataccatgtatctgtatctttaagatatacaacattgtagcaactcctgatcaacaaccaagtctttattcctttcgtccttttctcgggacgagcaaaggttcaagcttggggggtttcgttgacggtcgttatcgaccagtttcgaccgtcaatattaccaattaataaagactagttatgcttgcaatgcataaattccaaataaaatatctactttgtcacgcccggaatttctatccaaaattccaaacgcttacatgtgtgttaaaccctcgtccaggaatcaaccgaggcacacaataacaaaattgataatagagtacaaataattaactatttaatattcgcaaataataaattgcgaaccggtgccaggccggttcggccgaacccctggtggaccaaatcggccccacatttagctgttgggttccaacgactagtttggtggtggtcgtgcaaacttttgccaaaaattttattttattttgctcgcaaaaattcatttgaagaatttgcttcaaattcaaatctcaatgtgcctttgaaaattcaaacatgctctgatgcaatggaaaataaatatgagataataactaccaatttacctgttggcaagggcgacgtcgtttcaggtccgacgagcacgaccgtacctccgacgcatttaactcgatgaggtacccggttccggaggtacatgaacgggtgtcttctccttaacccgccataccttcttggtattaggtgcgggcagcggcctcttcgtaactgggaacgcaggtgaaccaacttgtattcccggcttcttggatgtcggcttaaggtgctgacggttcctcgtttcttcctgctctaggaacttcatcatgaaagcgttgaggctatccgtccttctgggttttactttgacctccttatgggtttggtccgttcttgatctaccccgtggagcaatgctccatccttagtctccttgtggatgattcccgttgttgttgttcatgagcatgacgttctcacgggtttttggacaatccatcccagagtgaccggtgttgccatagacctcacatgttgtgttaaagtccagggccttaacggtgccctgcttggcatccttctcattgttgtccagtctcttcataaggagagacaactgagcggtgagcatttccgtcctctcgatggtgcacatgccgcgttgacgggtttggagtcgttcctcgctccaacccatatttgagacttcttctcaatcaggtcagtgatatctctgaccatctttgagaagggtgctccttcatcagcagcgtccagatgatcccgggacgagggggttaatcctttgaagaaattttgtaggatgagtcactcgtccatcccatgatgaggacgggcggtgacgcattcctgcagcctttcccaagcttcaagaatggttaatccctcgtttgctgaaagctggatattcttccacgaagagcattggtcttgcccatccggaagaattttgaatggaatgccgttgagcgcttattccgggttttcaccgttgcacggttgatgtagaaccactgttctgctctcctgaggagggagaacggcaacagttggagtctgactcttctgacggtatacgtgctatagctttccaggaattgctgcaaatgagcacttgcatcctccttaggctttccacagaacaggcaagcctgcgccatcgttaatttagttggtcttcaaatcaaagtcaccatctcccctgctgacttgggttccaattggcatgttactagcagagggagtagtgaacatgaaaagtgtcttctcagccatatcgtgcaattctggtggcgcggaattggctggtctaattgccgatagagtaaccttgaggatgaacgacacggggtcggcttcacttcaccagtgactctagatatgaaattggtcggcagatcagaaccagtcctgtactaccctgttttcacataaaagagaaaacaaacaaggtttgcctacaaaggacaatgactatatatagaggtaaatataaaattattagctagtagtaaactcttaatcatttatcttcccctgcaacggcgccagaaatgcttgttggtatttcttagcgacactactggaaatataattcccagcaatagcactaaaaatactcatggtatatttatggttacagatctgatccacaagcgcacggatataccattgtagcatttcacacgggagtattccaaggtatggtatttattttatcctaaggaaagatatgataagagagtactatgctaatagtttttatattacttatatacatcaaagtctatgcaggggttaattcagttcaaagggtagggtgacacacaggagaaagaactaagaactactctcactaaaatatagtctaagctaagttgagaaagaataagaaaagtatcattcatgtacttctactatacatacatctttagtctatacttgctattatacagtcatgcaaccaataccccgtacccagtgtccttctggtgtttcgagaagccacccctgactgtcgagttccttacgacagcccgtcatgaccatacaaccggagctaaatacggaagagtaccttccccagggaattaacttaggattatataccgcgcggaggaatacccatactgagctgtcaccatcagcggcccacctctcatccgcagtatataaccccaattaatggtatctaataatctaagcaccacgcttatattactaaatactactctacatccttgcaaccgacatagagcaaccgaataatcggacactaaacccacaccaatacacctatctggaaagctagttacgtgactatattgcttcaagtataaagtaaagtcggcactcaagtaatatgaatggaataaattaccgaacttgtataaagaagaatattctattaattcagtaagtcttacaaaagaagagagaaaagctactatagccatacccgaattctcctgaagactcgaggactatgaagactattctatttcctactccactagcactagaactactaaacaatacttgagagagctcttgatcttcttcttgaggtgtgtgtgggaatgaatgagaggaggggtatttataagtggagaggtgccttgggagtgtggagatgctccaagcatcctatgagcatctttgctctcctcttgacatgtggcatgatgaagcatcctaggagcatctttctccctccttgtgacatgtgtccacggcggttatttcaggtagaaccgatcacaaccaccatgggatgtggataacttccagctgatgaagaattgggctgatcgggctggctgctggttcggccgaaccagggggttcggcagaaccctggccgagcccaatcagcccaccatttggcatgtgtttctcccaatggatcctcagcttagtggtatgaattatggccttgtttgctcatgttaattctgtattattagcccatctatccacaagtctgcttctcgacagcgtctgattgatcattcgtctattttctgtcgattctcctccatttatatgtgcttcttctgcatacatgttagtagcatagtatatagtggaagtagatattttatttggaatttatgcattgcaagcatagctagtctgcattaattgggtaatattgacggtcgaaactggtcgataacgaccgtcaacagcttttatcttgttcttgcttgtttcttcgatttgcttgaaggaataaggttgatctgcaccggcaagatcaacaacccactgagagatgtatcgatcgctaaggtgcaacacaacaacgtctagtacggttgtagtcgggtcatcaacgtttctcccaaatcgtacttatcatcaactcaccgaaagatcaggccaacaatagccttgagtgtctcgagtggagctcagggttcatcatcatgacacttggggatttattttgaaaataaaacttcttttgggacttacttctcagttggtttcatcattttacctaccaaggcaatacaccaatatatattatcaaaccatttatatatgtgtatgactacttgttattatattgagctttgctaaattatcgtgactcgtgttagatatctctcatgctctcgtgatcaaggttgcacaattaccacattatccctataaaaaaatgctaagcttctactctggaagttggtaatataaatttccatcaccatccaaaaataaactctccatccagtttatgcctgcttcacctagagactccttgaaaaaaaaatagagaaaaggagggaaatgtatggctatgaagaaataaaactttgctcttccaaaatatggagcaacattgaaaagaaaaaaaagagagatattgtagccatgcaacctccaaaatattgaaaggagaaaattggagaaggtatacacaaaaggagaaacattttctttatttctttttcccatccaccactacaatattcattccacacaagttgtgcaatccttgatttgagagtatgattgactatcttcttgagtccaagtatttggctttgcaatatatatgatgcaggtatgtcccgatttatccctatcaagctccacatacacagccttttaggctagggataaagtttggtaaaatataccttggcaaggatctacataaattgcaaaatacttgagtgatctgagataagtcaatatgaggagtatagccagctttgcgaaaattcatgaaaaccccgagagtacaacaaaagaatacaagaaggaccagaatcgagactgtttcgtctttcaattacctaagatggtaagctagacacttctgaagctcacaggtacgagaattgttttgaataatttatgtgcttgcattatatcttggagaattttatcttacatcttaacctttaacctttactcaggaacaagtaaagagctaagtgttgggggtttgttggcggccgttaaatgccaattctatgccgccaatacctgcataaaacataataaatgacacatccaacatagtggtagggtttaattctaatctattccatgagtgttggtgtatatttggatacagaagataaaccaccaaagttgggaggaaacctagacttaagagagagaatacttttatctatccaagagtgggttttgaacttcatcgaattatcagaaaataggcccatgttcctggaaatagataaggtagaaggagaaggagtaacaagccaaaatctgggcctgttgggccagaccaaggttcgcgctggttcggcccaaccccaatctcagccgtccagactgaggtttggcacggacgctccagatcttctcctgatggtggttgaggggtacttcagacatttcgcgttctccaaccgtcattacctgataaggacatcaccttctcatttcattcacacacactccaagtttttgagttgaattgtaagaggccctattgtactatattgtatactagaattagggagagagtagagtagtggaagttggaggaattccggagttgtcggtaatcctctacttatttttttactctattaattactctgttttaatcgaaatatcatctagagtaattaagatttattatgtgagagttatttcttagttagttcctaatcaatatacgggatcatttattattataatcgagtaaaatatagtgtttgctttagtgtttagctaacgctaaagtagtttttaactgcgtagacgtggtgtctgggtagttaatttctggtgtttgcttcatatcccacattaggtttgaggtgggtgtagaggtgatgacagccctcaaatacactcatgtcctccctgtccgggtactttgtagagccatatctaggagcagcgggctggccaacgcccgaagtaccgcgttaggataaaattgaactctctgtagacactgcctctcactattaaatcttctctacccttagtctatcttatctttatgtctttggatgaaccaggtgaagagctgacacacacgttccccatggaaatcgataccttggaatacttcaagtgaagtgctacatcggtatctttcgtgcgtttgcggattctatctatgatattaagaaataccaacaatgacatcattaataattggtcccacttgttatacacaccgtgttttttagtccgtgttacagttggctacaaatctatagcccacttctcttctctctcatcacttatcttctccacataataagctnatcctcatctcatagtctattattgtacctactcttataggattataggattccatgtaactcgagtatcttcctctctccttggcgttaaggatttgccactcttaaaatttgctactggacccacatataatagatacatgagggcttatatgttatagaaagcgagtggcaaataattaaatgcctcggcaaaataaaaaaaataaatgtcacaacagaaaatgtcccgtctagtctcctctcgtccttgcgccatctcgctgctgaacaagggaggggcgccgatctccatctggcgagcagaggaggagaggggatcctggtgagtatccacatcgtctttctgattcatctctctctcccaccgggactacttttgtctggaatttgcttgcgttcgttaaccctagcttctcttctagatctagaagaagctcttctcttaatttcagagccttgaccttaatacaagttacagtttgtttgttccccaaaagtttgggggttcaattgaacccccatgtcccaagttggatccctggcttttcggtcgcgatctagctagggtttattttgtctgggcagcgttgagttgcacggattcgattttgttctgtgaggggtcctgcgattgctgctatagtagggttaaagttctaaaacttggactggttcatgaagagaatatatagaggctttaatcctgtgcttaagtttttctactgcatgttggatccgcccctgagcccagcaatgattatattagttagtagtcactattcaacactttattagattattccagtggatttgaaggatgaattaaattgaacatcaacacataattatgaaatacagtgataatccaaatgtttcgtcatcacaaacaaaaaagaattggggagccactacataacaaaaaaaaaggtatcaaaccacatatacttagcatatatctattccattcattgtcatactggatggtatctagctatgtgccaactgcttagatctgtagtaaaattcggaacatcgccttgctcaccatggatcactactggcaatgcattcaacatttaatcacacatgggcattggttgtgttcctcattcaatttgccaaatgaaattcccaccatagcttacctgaataatctaatatcagaaccaattgggatgtgtagtagtgaaattcaaggcaatcatgattgctggacagctgaagccatccagcataggcctgtttcacttagtatgatagttgtgtcggaattaagtactcagatattggaagcaaataaactgtttttttttctccagagggatgaaaatcaaaacatgttagttcaattttgtgtgtatgcatgtaagtggtaaatacaataatcaatgccaacatgaatgattcgattagttagagtgccacttcttgctggtcggaaattgcttggcatgataattggtatttatcagctaataaatgaagatatagttttcattcaacaatcaatatttcaagtattgttgatcgtctgatccaaagcttatcaatttcgtgttgatgtggctctgtcagatggctttgtgtagtcagatggcttctttacttagaatggtgtagttagcatcactggtagtatatactaattagcagtagtatatacttgtttttatacgttgtattatcaatatatgctacattcctcgacaaagatgtactaccttttttcggtcagtatatactacatcccttaatcaagcagtatatgcttctttttttgctcagttagtatatactagaagctagtagtggtatgtactgttttttagctagaagtggtatatactgtttttaagttagtagtggtatatacctttttttatgttagttgcagtatatatcttttttaaagtggtatgtataagtagagcagtatataccttttcaagtcagtagcagtttatagaagtacattttttttagttactagcagtatatacttttcttaaggtagtactccagcagtatatattgcttcttacttagtatagcaggatatgaatttttttagtatatgctatttttaagttagtagcggtaagtttttctttttactgttatctgaagatcaaaagtatcgataaattctgtaagatgcaaaaggcagtatgtattgagatgagaatatgaagaagagagccgttctactctatatataaactaaaccatacgctgaatacaaacaagaacaaacaatccagccagtatatctcattcacttcatgcatacagcatctaaaaaagcagaatattcaatacgagaagcacaaagctctgttttcttttctgagcaatatatactcgattctcagaatgctttaaaacaaaattcagctagcaaatcacactttctaaacaagggcattttcccatggcgcaacacatactctctgcgctagctgttgcagggttgaggtaagcaattgagtcattggagtcaacacgcgttcttggcgccggctggcaaccatctgcacgcatcaattagacttaattattgaacgaacggaagaacaaatttggattgccatgaaaagaatgcatcacaatcaaaataaaataaaataaaatccccaccgttccgtgcagcgtcgggctgcctcattagtcttaattgcttgctgcatgactgcatccctcgatctggagtcattgggtcagcggcgaaactaatatgaagaagtcgtcaggtgccctgctgttggaactagctagcaaggctgtcgtcatcccgtcggcaacgaggtagatgaaccgctgcgattggatgagctggcgcgccgcttgggaatatgcagtcgtcattctagatcgacgttcatgatctacacatcgaaaaataaaagtcagctgcatgagatctacattaaacgaaagggaactgttgatctgcaatacaagcagagaaagtaggaaggattacatgcctggaaacagagcctatggatccataccatagatcacctaggaatctctgttgaacggcttgtagagctgtagatgggttatatgtgtgtgctctgatcaactggtaatgtcgagggagatcgatgtgtgacacctcccgcctgggaatgacatgggagagcaaggcgagacatcgcccacctgcgcctgcgatgggaacgccgccgacgagattgagtcgtcggcgctgccgactggagacgagggtttttcttttgagattgagaacgatggatttatacgatccattcggtaaggacgtcagttctgtttatttggaataattaacaattatgggaattatttattttcacaaaaatggaacgggttcgtattgatgcacccattagcagggacagggaaactcaatcacgcaggtttggatcaacggtggatgagagcaggtgtgtgtgtgtatatatatatgtatatatatatgtacacatacatatgtacatacatatatgtacatatacatatatatacatatatacgtatatatacacccctcccctagaataactattctacaccccccatctcccaagggtcaaacccacctcccccacattccctagggcccaaaaaccccctcccacctcggtcaaagcgtcctcccgccggtcaaacccgccaaccactttgctgttctcgtcttgcaggaatcatgcagtaacaggacggtcatcgtgtagtaacaagataactttctcgcagtaacaacatcaaaaagtagtcatgatggatctagttttgttaagtgtttttttttgaacgtcatggtgcaaacggattagaaaaacaagatattatgtgagagatattgctctataaagattgagatttacctctttttagtcctcgtctcactggaacggcgtagtaacgagacgaccaatgtgtagtaacacgactgctttccgcagtaacaacatttaaaaaatagttatgatggttccagtttcgttaagtaccttttctactgatgccatgatgcaaacgagatagaaaaataagacatgacttgtacgttactgctctctaaagattgagatttagattttttttagctctacaaaaacattattaccatagtgtcactgttactatgcatgttctctgttactgcaaatttcgccatatcgttattaccaaccgtgcagtaacaacatataaattttgcagtaacaacacataaatttggcagtaacatatcatgttactacccttctgggataatgttactgccgaatcatagtaacgaaggtatgattattacagcaacataactgatttgttctcacacaatttgaacatatatacaaagcatgcaaacaatattttctattcacataacatcatgtggtgaattggttaggagagtttgccatgaaccatgagatcataggttcaagtcttaatttcaccaattttttttaaatttttctaataaaagagagaagaataggaggaaaaaagagagaatggagggagagaaaaacgaagaaaaaaaatagaggagggcgctaggaggagaaaaagcgaagaaaaaagagggctctgcccgggatcgatcgggaggaggagaaaagagtgaagaaaatcgagggcaagggaggaggaggagggcggcgccgggagaaggaagaaaaagaaaaaaaaagtagaggaagaggcgccatgatcgggaggagaaaagagcgaagaaaatcgagggcaagggaggaggagggcggcgccgggagaaggaagaaaaagaaaaaaaaagtagaggaggaactgaggaagagggcggggctaggagggttcgagatcgggagtgcgaggaggacgcccgcgcgatcgggaggcgggccgtgcgtggccttggagggagggatggatgggctaggaggagggaggagattggctatgtgggaggggggtgtagaatagttattctaagggggaggtgtagaatagagctgtcctatatatatatatatgtatatgtgtatatccatatatgtatataggtatatgtgtatatatatgtatatacatacatatatgtatataggtatatgtgtatatatatgtatatacgtatatgtctgtacgtatatgtatgtatatacctatatgatgtatacacatatgtatacctatatgtatacacatatgtatacccatatgcatatgtgtatatgtatacacatatgtatatgtgtatatgtatatatctctatatatatatgtatatatgtatatatatgtatatgagagagagagagagagagagagatagagagaccagtattttagaaaagttgacccttttgctattctgctaggagaaaaaataatcttgggcatggaagggcgctcctcaaatgaaatatcatcagctgaagctgttttggtgggagcactgtcttctggtgttaacgtacgaaacacagtacagtattattcattgtattaaaaaaatcttaaatttgattttaatcttgtttctttatatatgtggtttcaaactgtacagattgttatattcagtcttcaatttaacctatttcttgtccctttttgtttagtactaaatggagaaaacctaattggtgttatctcaatttgtaggcgccaacgtggtttgtgctcaagatcacattcttgctactggctttctgttttactgctatgctttctctagcattcttttcaagtgacttcatgattattgcacatgttcttttgcttgtgaccattggcacggtgctatttgtgcttctcaacaggtttgtctctccgttttctctacctgcatccaatctttacagtcgtcaggatgaatattttgagttatttttattactgtatcaatctttacaggtttctggcagaaactggtctggtaccagttgaacaacagatgaaggagatgggtattcataaaatagaagctacagagaaggacaagggaaactaagccttttgcttttattgacatagatgacagctcaaaatattacatcattgaacagtgtccttttgtacagactgtatatgctcattcaggcatggatgtaaatttcaggctgacactaacacattttgatgaagctacatttatctaggaatataccacttttaggaatgcttgtcatcctcctttgatttgctcttcttcctcttgatgtaacagaaacatgagcagcaggggaactgaaacaagaacttcatcgtctgtttattcacaccaataccgtgtttgtggaagtgttattgtgtttatgcagaacggatttgctcccaaacccttacatatatagtatgcattgattccttgcttagttgcttatcagaagagagttgaaattgtggcccccgtccttgtcagctggggcttttcacctgcctgcacttatactttgtttagagggtttggttttttatggaacattatatcaatcatcaatcattccgtcagttgtattgtattgttatatcaagggcaacgtataactccctaaaactgacatagaagtcaagatcttttgaggtcttgaagttgggcaagctttcgtgcctctttgcctctttgcaagacagaaaggatattgttttcgttctggatgggttttctggtgcatattctttgtttgaagaggagctttgtgctgtctcgtacatttagattttagagagaacttacgtcaaaaccaaatacataagcattgtaagtacaagaccattagagctaacaaactgtcagggaagtccttaaattgtgctaaaattttctggttgttcatcggttttgtgacgatactggtatttttgtcgaagccggaattcaaaaccttcatctacaccagcaatacaatatgaagtgcaagaccttcataacttgtatccatgcgcttccttcagattattagcttggagttcaccgacctttagggagggaacaaaagtaatagccacaaactgtttatcatcctatgacaaatgattgaaatgcataacaaagaaacttatgtggttgataaaaaaagagtaaattgcattagcgacacacgaacttatcaagtgagtgtaatctagcgcaataacttataaaacttataaaacgcttgttttggtatacaaacttgtttgctgaccaaaaatttgctcagcaagattgatcttgttgatttgaatgttgcgtaaatatgtatctcagaagaaaatcagtatgtcacttagacaaagatctgttcaacaaaatatagaatatggcgtaatgattgtataaagattaaagaaataaaaaaccaaaattaatgcaagagaaaattccctatgtagcatcaaaaaaagttgttcttcc

SEQ ID NO: 73899 - DNA, 5278 bp, Oryza sativa
ccgtcctcgtctccgtgcagccgctgccggcttccctcgtcgcctcctcgccggcccggtcgtcgtcgtcatcgtcgtcctctcgtcgtcctcatcgtcgtggcgttcgtccctccgtgcaagcctgcgcgttcgtcgtccgcattccgtcaactgagccgctgcagccccatcatcgtcttcgtcctcggctccgcgtcgtgaagcctcgtgccggccgcgtctcgacttcgtccaaggatcgccaccgaagtcgttccctcgccgttcgcctccgtcgtccccgagccgactccgccgtgctcgttcgttgtcgtcgtgccgcgcctcgtcgcgtggtggtaaggatctctcctctcgctgccccgtcctcatcctttcggtgttgccccgtacccgttgtgtggttgtcgaccccggtacccatgtaccggtgtcggtagtcgttcgcttgtgcgtgtggtgaccgtgttagtgtgcccgctcggtagccgcgtggtttcacgtgtgcagcccgcgtggtgtctagtggagtccgcttgtcggccactcgcctcggttgacacacggggtccgcttccgtcaacccgtggaccgtgtctatgtactcggcctaccgcggtcctttaggttgacatgtggggtccgcatgtcaacagcgcagccttcctgtcttttccaggctagtgcttccacatgttttatagttgcaaagcttaattataataatccgcaaatctccatataacagcattaaacttcggatgatcgtatcttggtcatacgaactctgaatcgacccgttcaagtctcctaatgtttgttataacctaaagaaccctgtgctttctttttatgtattgttattacttctttatagggtttagctttgcttgtgtgcttcgcgtagcttctgtcgttccggaggttctcgaagcgtggttcgcggtcgtcgccgaaggttcagcaggccgttctctctgagcaaggcaagtcacatcatccttgagcatattgaatcccagtttataaaattattttgatttaaattaatgcattatcgctttatttaaattcccgcgttatcactgttttatttagccatgcctatttacctttgttatgacattattattgctattgttattattaccttgttcaccctagaataaataaaaccccaactagtgggtactctattcatggttccactagtatgaatttaggtagatgcttcgctgattaattaggcaacattaggtggttttataactctagactttgggaatattcatatcacttggacactatggaatggttggattattgtggaattggatgcacacctccccctctattcaaaaccctcaaaatggttttaggctgggctcggggtgcatggttttgttagtagcacctcggccacataaggaccggtcttcgggcccctgttgcaaagcactaccgtacttccacatgtctagtgggtaaggcttagtttgtggctcagtctggttataaacaaaagtacacggatggagatggacgaagtcgggggtcgatggacatctctaggacaaatgaaggctacacgagttgcggcccggtagtcgagatgtcatggcacagggctggtgtcctgctgctaggggctcaattttgcctgcctgtccgggggttccggccgtaggtgggttgggtcggtactcttgtctatggctaggatgggttggaaactatgtcgcgtcttccgtccgtatgccgtggtggtatgtggcacgtggttacacgtgaggaagacgtgtcttgtgggtaaagatgtacacctctgatcagagtataatctattcgaatagccgtgccctcggttatgggcaagcctagcaatgtacccaagttagtgttttaaattcttaaaacctgcttaataactaaaatgtggaatggttggcctgggttggcttgggacgagctgggacccagggtcgggttgccagttcggtctgaatcatcgtaggccttgggttaaggcaggttcatgtgggtccacggccttgattaataatattatatagctctaggatcgtgtttacaaaatactttgggcaactaagtgacttttaaatgctgtttactgcataacttaacccctagattattatccccttgtactcccttgcattaattatgcatctccagtgtggcttgctgagtactgtggttgtactcattcttgctcaatctttccccccttcagtaagagaagctttgcagaagaagtcttaggtggagtcctggcttatacccccagttatgcgcctgtgaagatggagccgtaggcccgctagtccgctgctgtttatttttgattgtcaggcctgaagtgcctttgtaataatgcaaatattatcgatataataaagatgtgccttttgtatcatgtttgtttggtgtaccccggcttttcctgggacggggattaatacactagcgttcgagaaaagacaattttctcggtcgcgacacgtcgtgcgcagagtgtatgtgcttgccttgctcttgccctgatggtcgcgcccctgtaattccttctctgcaagcatagcaaatcgaaacaactggttgacagagttaaattccttataatcaacaatgttctgaatttcctccctcaaactagtgtagaaacgacaaatagcatcctcgaccccctccactataccacagcgtctcacacccttctgtagctcaccatagtaatcctgtacagatttatccccttgttccaaacgcatcagtttcttacgtaaatctctatgataagatggaggaacaaacctatcgcgcatagctaccttaagttcttcccaagtagtaggtagtaccccctcatcagataacccagcccaccacataatagcaaaatccttgaactcactactggctcgtctaactctatgttgctcgggtacaaggtggacattaaacttttgttctactgtcatctcccaatcaaggtattttttagcatcatcatatcccaaaaaagatggtattttaaacttaaccttagcataaggatcatcgggcacacgatcattattattaccttgttggtggcgagtgccacccatacctgtgcggtttgtgcgtagacgacgtcgtagccatgcttgccttgtagccggtgcgtcaatatagccactggaatcatacaccgtgtcttcaggatgagcatcgtcgtcaccactcaccacttcctcattggaaggtgtctccaacacggcgacccgatcagttagagtggatatccgcttgtccaacctctccatgtggtttaggaagccgattttagtgaaggcatcttggacagactttgcaacagcctccgtgatgtccttttgagtattttgttggagagttcgtagttgctcttggctgacacagtcagcaaaatcctggggactcttctcgccttcgttacctgacattgaaacaccaaaacagaaacaaaacggtgaaggttatccctaataatctactacgcaggtgtagtggtgcctctcaacgattctcagcaatatggagttcctaaccatggtcttataaggttcttaccagcaaagcaaaggatacctggaaggcgtagtcagcaattgcagtgatcaagaacctgtgctgttcagaagtaatatgtggagctaggaaggccaaaaatatgtttatgagtggtacacaatccaatgacagatagtaatgctgaataaaaatcccaagtcacttgcccttagttgctggtctactcgtgtcctagacagtagtgataacaaagatggctcaaagaatatgacactagtaaacagcaaagaaggactgacaggcaagcttcagcgagtttcagcaaaaactacaaaaccgaactggcagataagctcaacggagcgcgtcgtgagctcaaagcactagtggaaatcaacttttcttttttttcttttatttttttgatattttttttctttttttagaacacaaaaataggcacacctccaagttaaagctcaattggagtaggtatgtggcctatggatttttctgaaaccactataaacaaggtgcaggaacttgtgagctcgaacagacaattttgcaagccaatttttggaattttggattcgccaaaccagccaaaggcggggataaacggatataaaattttttctcttatccgaaaagttaaatttttcctgattccgagtccgtatgcaaaagttatggctgtttgaagtttcggcttccggctaggttttccagaggggatataacctagtctattttgcggtggaattgggatatggtggcagcggagttgtagggtgttctggagatgcttggttatctggatgggtgtttatgatggcggaaacggctctcaaaggatgaagcctaacacacggtgaaaggtagcggctagggttacaaaggacaaacacatgactagactaaaacacacactagaccagcaacatgaacttaaactaggactcaaactcaacactacggactctgagagagaatcatgcaaaggctaaacacggtctaggttaaggtaactaacaactaatttttttttggcttttctgtagactctaggataattgcgaaaaaaaaaactaatcaagggcaaagaaactgagcgaacctgacggtgaacctagagctctgataccacttgatgtgcactagggttcccgatcttccgaaaggttctgataaacaacgatttgggcggagtcgcgacacaaatcgatccggcttcttgaacgcgcacgttcttgagccccgcaatcgcagcaccacgtctcctcaggttatcacccgtgtcaaaatacggatgacctcgccgagaaggctaatccctgtttgccaatcgaagaacacaaacaagaacaagatagaaaaacaaccaaaattgcagatgaatgattaagctcacgagttggggtcttacaaaccaatctagcggcgaaactgttcttgacagattaatctaagcaaaacccaaaaacctaaagatgacggcgggtactgatatatatagtttagggtcgtgcaaacccctctcgacgcaaccctaatgggttccaatacgatacacgggccaaaggcccaaatacggtgacgcagcaccgggacagattctggacgttaagttgttcggtcaattcccgttgactcagaaagaatttggacgtgggaccaaaaccattggaaaggttat

SEQ ID NO: 73900 - DNA, 4964 bp, Oryza sativa
taatttatttatgatgttcaactcagtaaaattagccttgccatgctattttggctttggttcatacgcaccagacaagttcatgcaccagcgctttacaaattcattcactagattaaacccacctggcaagttcgtatattgctgatgcaatttactctaaggagaaaaaaagtggtgagaaatataaaatattaataagtcactgtacttcattgtgtctgctagttacttttgagttgtaaaaaagaaattttcagttcgcttcctcttaatgcattttggaacctttttatatctcctcgatctttgttcagtcttttgcaaaaaaaaggaaaataaaaggaaaacaaaaaaactatgcaaatatggactaaagtaagcacctatcggaaattttcatattagattttctgacgtgtatatatgtcttctacataattagatcaagaatagcaataaatattgtataaaagcagttgcataagagaccgctctaaccgtactacaattgtaaagcatagcttagtcaaattttaaaaaggaactaaacaaaaatgaaggtttgcataataacaatttagttcatctttgtgagttattatttgagcaagccaatcacctatatcccttgtcaatattagttgtaaagcaaaccaaggttgtcttgctttccttttacaaatcgaatacaatgagtaaaacagttacatcaaagttattattacttggtatttacatgtatacagttaaggccatgtaagcactttcttatcacttattaaaaaattgtcagcaaacatacatagcttcaataagcatgacttctaaatgaatcatagtagtctttgcccctccatgtatagtgtcaaaatcagtaataacaattatatgtttaaattaggagaaaatactaacctgatacacccaacatcagtgacatatttgccacaggagtagaactttagactgaacaaacccattctgaagtttgcaatagtacttgtgatgaccaatatattatgggtgcaacagacatgaacaatactgatccaaatggaaacaaaattcacgtactccaaaatgattttatcctccttttcatgaatggttcaatggataacggttatgatgcatcagtcatatcatgactgacattcttgtattggaaggtacaagtagtacgttcattcagtaaaagaaaaggcaccaaaaaattcgccaacttacagttacaccagcgcagatagtttcgggctgttctaggcttctagcaagcaatgaagtgagacactgccattacccttaatccagtgacattacagcatcactatcttaaagggatgttagctataaagatcaaaacgtgacattatgactacaaagatgtcatcagaacctaagccctttggtacattgtcaccagtaatcccgacaagagcataatccatctttgaagtgatggaagcgctgtaaatctctgatgatgatttctctttcagtgatcttggtaatgaacttcattgctgtatggcaatcactacagacccggagattctttattatatggatcactgatcttgggactgaattcattagagcaaaagcaacagcaagcttttcactatggattcgcaatgcagactctttctcttcttcatccaaatcatgaagaacagaacccgtgtttggtacatagcctgcttcttgcattctttcaagcagtttctccaaataagaatagatttcaatgtgctgtgggtgactcttgtcgccaacataaaacaaatagattttacctttcaactcaaaagagctatacccaggaggcttttctattcttcttgttttgaccagaagccttatccgttccacatctttccacattctagcctctgcatatatattagacaacagaacatagtatccactattgcttgcatccaattcaaacaatctttttacagacatttctgcaagctcaacatttttgtgtatgcggcatgcactaagaagagctccccatatagcagcatcgggtttgaccttcatttctttaatgagactataagcttcatcaagacaaccagcacgaccaaggagatccaccatgcaaccgtagtgctccacaccagcttcaataccaaattcttgcttcatggcattgtaccaatatcggccctcatccaaaagaccagcatgactgcaagcggctaaaactgagataaacgttatgtagttaggccttagacctgatcttttcatctcggtgaaaatctcaagggcttcttgtccgcgaccatgcatgccataaccagtaatcatggcagaccatgaaaggatgttcttttccttgatttttcggaaggccctacttgccatttcaactcttccacacttactgtacatatcaactatggaagtaccaacatagacattttcctccaaacccatccttaccacctttcaaatacaaacatgatgaaacttcagtcataatgtaaataaatatttaagaaatcatagaaatgtaaacttatgatgcatatcctcacaaagataatgggcatgtgtatgcaataaacttgtcacaaaaaaatgttacaaacatcacaaatggaggattatacaatttggaacctgcaaatagatttgcattttctagggtcaatttttttttctcgaaaatgcaggagagctgcatttcatttcattaaggggaagaaaaaacaatacaaaaacacaacacaaagaaaaaacaaagtaggagtgcccgagccctcctaccgagacccacacacactagactacccggggagcttagttgcctaggttagccgtcccactaaggagcttttgaaggtgagaagctccagcaacaccccaaagatggccctcattttctatcacttgtaagaccgtcgctactctaggattggcgttgttgaaaacgcagtcattgcggtgcttccaaatctcccaagctactaaggttaccaaggagttaatccctttcggcacctccttcggccagttcttggttgcttgactccaccacctcaggaagcggttggtagagggctgaggcgcagcctcggcaaaaccaagtctcaagaagattgccgtccaaacttggcgagaaaaaacacaagaaatcaaaatgtgttggatggattcttcactttgatcacaaaggggacagatcactgagtgttgcagcccaagctttgctagacaattggctgtccaacacctattattgaaagagactgaatacatgcaaatggatagtaacagtttgtggactacagcggtgcttgaactatcactatgttaagttcattttggaagagattgaatgtgcaattttagttactagagaaagttaaatatattaagttagttacatacaaaaggcacggaacacatcaactataaaacaatatctgatattactaagagaaatagtagtgtgtagaaagcttttggagggctcatgcctatatgtattgttgaatgctagtatattgctatgtattgtaggctcatgagcttctttcccacgattaggaactgaacccttcacaatgcaactaaaatgtttggtctgaaacagcagatccaagcaagtaatttacctgattatgaatgcgctttcctgtctgtattgcccctgcatgcgcacaagccagtagcacagccgacaatgccacagcgttgcatttgattcctccgccaacattcagcatcttgctatacaacccaattgcttcggctgacatcccattctgtgcgtacagagcaatcatcgaattccaggacaccacatccctttccattgtatcaaacactttcctggctacctccaagtcacgactgccacccttagcgtacgagtctagcatcgtgtttaccaccccagcattcctttcgaagccaatctttgcaataagcgcgtggaggctggcagtaacaccacggtcagggacacgggcggaagcagagaacgccaccagagcggcagcctcgtcgaccacagaagcagaatcggaggctatcatggcacggaagagttcgagcgagtggtagactagattgttgcgtacgtagccagatgccatagcggtgacgatgacggggttggggtcagggatttcgtcgaacgccctgcgggcgtccatgggacgggaacagtggtggtacatgtggaggagggcggaggcggaatacgggtcggaggggaacaggcccgagcggagggcgaggagatgcagctggcgaccggcggcgagggacctggcggcggcggccgcgcggagggccgggggcagagccgggcggagcgcggcggggttggcgcggacggcggcggcgaacgtggcgagggcggcgaccgcgtcgccggaggagaggaggtctgcgacggccgcggaccaggacgcggggcgcgacgggtcgacggcgcggaggaagagcgcgcggagggaggaggcggtggtggtcggactcgggacgctgcgctctcgttggcgttggggattgaacgcgggagatgggtgggcaggcggcgtggggagtggatttgggagcgatgtcatgacgcttgctcccgccattgccgagccacagccagtcagtcgccactgctcgcgtgccaccgccgctgcggctgctcgtattcggccgccgtcgtcgctctcgcactcggaacttttttcgtttttagatttttttttaatatttacagaaataatctatggaccaaaaaaattgcagaaatagcccctgccgccctaatggtgggcggcaaggtgacgtggcagacggtggatcgaccacgccgtctgccgccgtcggccaaaattgcgcttagcccttgccgcccgtacagagggcggcaaggggctaattgcaattttggccgcccataaagagcttgcggccgtacttttttcatctgggtc

SEQ ID NO: 73901 - DNA, 8036 bp, Oryza sativa
ttcattttacacaaaccaataaaaaaaagactataatacccttcgcttttatcaaatctcaatgcaactatatcttactttatctactatcattttttttcttctttatctactatcattttttttgcttttacaaactcggatacaatgattactcaacaataaacttattttggaataaatgggaggagctaaaagtaacttatttcagagacctgggaagtaagattttatgtccagttcactctaaggcgtaaccgtaagagttgtcttaatcctccatatataatcatctactcccttggttgaaagaaaataagtgaattctttacatctcgaggaaattttagtggtgaggagaaaagaccaaagtaaccattatatatggaaaagtataatcggtaggtggtgggtaggtaatattaagggataaaatttcttaacttttggactatagtatgtatgaaggtgaaaattaatttatttttagacaaaatttaaactgtagaaaccaaattatttttgacgggaggcagtattataatttttatgagttaacaataaatttattgaggagatagaggttaattttaagtctcatgaagaaaaaacaactctaggtaaaaaaaaaagaggagagagggacatgatgatgatgattgaagaaaattttattttagatccacaagtactcctaggaaatagaaacaaagcattgataaagtactacccttctcatttcatattattattagttgcttttcctttttctcagtgaaacttctttagatcttaatcaagtttatagaaaaaaaaatagcgacatttacaatatcaaaatagtttcattaaatattacattgaatatattattgataatgtgtttgttttatggtgaaattgctatttcttttatatacctagtcaaattttaaatggtttgattaaaaaaaaatcaaagtaccttataatatgaaaaggggttcccctagtgcacatgtaattttatccatacttaaaacatattgttttaaacatatttttttcaatcaaattagatactcaaacttaaactgtatcattttatatattaagattgaatgtgctcatctttacccaaagtaacctcgtactcttataatatttctgggttttataactatactactggcatcggtgtgcattaggtaggtgtcatcaagatgagatgagatggacaatatgacttaattgacatgaagagaatttatgttcaaatcataattgacatgaggagaagtaatacaaaatgtaaatattactatgagatatttgggtaagaatcgaacaacaaacctcatccatatgatcagataactgcatgtatacaacagtcagtattaggtgcattaacactattactccctcaattccaacagtcactatgtttattattattataacacatctctctcgactaaattattgttattattttaaatctttcatgctcaagatctctgattctattgggtatatgcattatattttttgattgatccacataagaagaaagtgataataattgtttcgaaagtgataataattgtttcgatctttatggattaagggtgtaccttataatttgtaacagatggagtatgatatgatagttagttctctccccgtccttatatttttttatatggtctttagtggcatacagggtggatctagcatgagggcgacggggtctcgagcctccactactgacgtgagaactatagaagcccccacgaatcctccactaaaattttttactataaatagatggggagagggctatagcttcgtttagtttattcagtccctcatgttatttctttatccatcacgtgtggtctactttgaccattaatatatttcatattatgtgcccaatggatatgtaattagcataactcgaaagtacttcaaaatataaaacgagtgttataacgtgcataatatttagtataatttggttagtatgattattagtcaaaaggtaccaagtttaattttccttaaaacgataatttgggacggagggagtatcattatactctttatattatataaatataaataaataacatcactattgctttctaaataagctacgatgagagcataaaaacgctttcgacagtatcaattcctaccaaaaatgaaccgcaaaaaaattccataaaaaagagagccattccttatcggaatcagaacccccactacaggattcgcgctccgcacgggcgggcagcagcaggcaggctcgctcgagaccgatcgacacgataacgacacacggccacagtgcaccaccgcccggccgcacccgatccctcccctcctcggactccgcccccggccccggccccggccgccgtctctcgggctttactctctcccgtgccgtccacccagggccccaccccgccccctgaccccacccaccacccgggcccactcgtcattgcccccaccacttcgtcataaaccctccactgctataactgcgactgcgacgcactcgtcatattctcatatactagtagtatcaactacccaccccccacctcctacgcctccgccgttgcagctaaacccctctccctactcctcatccttcccatccgcatggatcgcgccgcgcgcctcgcccgccgcggcggcggcgtgaccgtggctgaataccgcatggtgcggggccgccgccgcggaggcgacgcggggccggtggtggtcatcgatgtcgaagacgacggggaggacgctgctgatgactccgccggcggtgggggtggagcggcggcggcggtgaagaggagggtggtggttccgggggccgtggcgacgcggacgcgatcgcggaggatggcgatggcgcagcaggcgcccgtcacgccgccggctgcggcggaggaggcgccgagcaggaggaggaagaggaagggggcggcgagtgcggaggcgggtggcggagggccgtcgaagcgccgcgtgcgatcctcggggtcagcgggcgggcgtggtgcgcgcaagcgcaaggaggcggaggcggatgaggaggaagcggaagcagaggctgaggaggaagcggaagcagaggcggggactcccgctcgcggagaatcgatggaggtgtcacaggttgacgggggtggcagcagcgggcgagccgatgacgcttcgcacaatggtaatggcgagtctcgcgtgtgtaacgcggatggcattgatcaggcaagcgaggagcgtccaagtgtcgctggtggggatctaattgaggaggagcactacgggaatggggaagccagcgtcgctggtggggatcgaattgaggagcactgcggtaatgtggaagccagtgtcgccaattcgaatcgtgatggcggtgagatcatcgctggggagggcacagaggatcgtgggaaccggagttatcagtggtggatccagtgaatgaagagttggcttccgatgaggatgattacgacgatgaaatgttggaggaaaagcttgtcggagatgtcattcgtgcttacagcaatggcgctgatttggatacaaatggagtggactgggaagccgaggatgagatggaatttgctgatttggatacaaatgtagtggactgggaagctgaggatgagatggaatttgatgatgataatgataatgatgctgatgacgacggtgataattttgggggtgatgcggatgaaggtgacaaatctgtacaaatgcatgacttttctaaggtggaaacacaagatttggtgagccacaatgttaatgttagtgaagtgaggcctcatgaggatgaggaggctatcaaggatgagatggagtcaaagggaaaaggatctctcagttttaatgaagggagctcctatattgaaattcttgactctgacgaggaagtcaaagtggtcaatgacacagggaatgccttgagaaggaagccattagtaccagcgaagctaccgattgtgccatcttgtgttgcatggagaactcggtcatcatggggtatgaaggaggagaggatttcttacaatacatatttcgaggtattgtctgatgagccaaaagaggatgatgatgacactgaagtggaattggatgatgaggaggacgatgaaaacgatgacgattgcaatagtgctagctgtgatgaagaagatgaagaggaagaagaggaaagagaggaggaagaggaagaagctcaaaggagaaagcaaaagaaagggattgactcatctgatgatgagatgattgatgatgctgtagattgtggcattgattgggaggaggattacccagaggttgattttactcggccacttacctttcagaaagatggcagtgaggcccctgtgggcagcgaggcttttacggagcaacagaagagatcgcgatttacatgggagcttgagaggaggaaaaaactgaagcttggcatgatgacgaatcatcgtttgtatgaacgagacctggaatcagattccaactcatcagattctagtcagaatcgaaaaaatggatgtcaagggagtggtgatcacagaactgggaggaaaaggaagaatccattatcaaaatctggtaagaaatccagccgcatgttaaagaggcagtctcttatgaagcttctgatggacaagatgtgtagcaatgatgatgggaagtctactccttttgaccagaagccccagattgagtatagtttcaaggatttgcatccgttggttttttcatttggggacgatgatcctagtccaactgataggtcagagcaagatgctgcacttgatatgctatgggctgatttagacttcactttagagtcagagaacattgggacttattatgatgatgaggtacttttgctgcatgaatttatctgacattgctgacgtcctattattttccttaatggggttgatttgattatggaacatggcaaccctatctatattacatgattgttgcacttatctttgcagagaaaataagctgggtatagacataggttcttgttaatcattcatcaccattgctgcccaatttgttacattctattttaccactatttgtggtaccaatatttgggaacagcagtcttaacttggcgcagccaattctaagtagtgtatgtatgcgtattttgtgccactaccatattgcactctttaacaatgaacatatatttatttgtttggagaataaatattcctttatgttatctctgtataacagcagaacaccttttgatggttgacaacaggagattctggtcaattttaactatattatattatgtaattctccaaaattttccagtgtgacaaatttgatgctttcatttttttggtgtcatctagtcaaggctaccatgttgaaatgattagcttctgttgttttgtagggccaagaggacagtctgctagatcatgcacttgctcctattacaccttgttctagagggaagcatgaatttattattgatgagcaaataggaatcagatgcaaatactgctccttggtaaatctggaaatcagatttattttaccattgctggtgagtttagtatctctcaaaacttctggcttgcttcccacaacataagttgatcaattccattatttatcttgttcttccattccaggcctccaattttgcagagaaacctgcatggcgaaacagctcttgtttgaagactgcgttgatgtgtcctgatctttatgaacaaacagggactggtgatggacaatctcaagatttccatataaatggaactgtgtgggatctcattcctggcgtcattactgatatgtatcagcatcaacgtgaggcatttgagtttatgtggacaaatctagtgggtgatattaggcttaatgaaataaagcatggggctaagcctgatgttgttggaggatgtgtgatctgtcatgccccagggacaggaaagactcgtttggctattgtgtttatccagacatacatgaaggtgttcccagactgccgaccggtgattattgcacctcgtgggatgctgtttgcttgggaacaagagttcaagaaatggaatgtcaacgttccttttcatataatgaacactactgattactctgggaaggaagacagagatatatgtagattaataaagaaagagcatcggactgaaaagttgactaggcttgtaaaactgttttcatggaacaggggtcatggtgttcttggaattagttatggtctatatatgaaactaacatctgaaaaggttggctgcactggagaaaacaaagtgagaactattcttcttgagaaccctggtttgcttgttctcgatgaagggcacacacctaggaatgagcgcagtgttatttggaagacactaggaaaagttaaaaccgagaagcgtataattctatctggaactcctttccaaaataattttcttgagctttacaatattctctgtttggtgaggcctaggtttggtgaaatgtttttgactaaaacaagagtgggtcgaaggcactgtgtctcaaagaagcaacgggataaattttctgataaatatgagaaaggagtttgggcttccttaactagtaatgtaactgatgataatgcagaaaaggtaagatcaatactgaaaccatttgttcatatccataatgggactattcttcgaactcttccggggctcagagagtgtgtgatagttctgaaacctctaccgcttcaaaagagtatcattagaaaggtagaaaatgttggatctggtaacaattttgaacatgagtatgttatttctttagcctccacacatccttcacttgtaaacgcaattaacatgacggaagaagaagcttcccttattgataaacctatgcttgaaagattaaggtctaatccttatgaaggagtaaaaacaaggtttgtaatggaagttgttcgtttgtgtgaagcattgaaagaaaaggtattgatttttagtcaatttattcagccattagaattgataaaggaacatcttcgtaagattttcaaatggagagaaggaaaagagattctccaaatggatgggaagatcctcccgagatatcgtcaaaattcaattgaggttttcaataatccggatagtgacgcgagggtgttacttgcatctacaagagcttgttgtgaagggattagcctaacaggggcttctagagttgttcttctagatgttgtctggaatccagctgttggaaggcaagctatcagcagagcatttaggataggacagaagaaatttgtatatacatacaatttaataacttatggaacaggtgaaggtgacaaatatgataggcaagcagaaaaggaccacttgtccaagttggtcttctctacagaagacgagttcagtaatgttaggaacatgctttcaaaagctgaaatggagcactgttctaagttgatatccgaggataaggttctggaggaaatgacttcccatgaccagctgaaaggcatgtttttaaagattcattatccaccaactgagtcaaacattgtttttacttacaaccagattgctcctgagttaagttaataatgactggcatcagatggattcattctttaaggtggtgctctcgaacttttgacttcttattgttgtggctagttctagaatgatcagatattgatggaatgcgatgtgcatgtgtaatgcagctgactagctagcgtgaggacagtgagactgaatacagcataaattttcagctgtttttgttgcagatgatgattcattaattataaggtgaacccttgtgtaatcgcactggaagaacatactattgctatggcatccgtggtccagagttaaatagttctagttgactgtaagtttgttccactgacttcatcatgttataaagttgacttgcatacaattagtagtcaggtggctgctgatttccattattttcttttaatggacagctatgtgttt

SEQ ID NO: 73902 - DNA, 2033 bp, Oryza sativa
cccttcattgtccccctatattctcgaattcatacaaagaagaacataggaacgaactcacctctaaatttaattgtcgcgcacgagctcttgttatcggtccttgaatgaccgttggaggattgttgtgtgtatccgaagtagtgatgtccgcatcagtatatacggctgctaattaaaaaaagaaatattcactgctacaacaaaaatgtaaggtactccttattatgcaccgctaatacacaaaaaactagtatatagtactgctcatcgcttcaaagagtatatatactgcggcttaaaaaacagtatatactgttgcatactagaaaaggtggggatatctaaggtacgttatcaaatttgaaagcaaatgcatgccaacgatcttgttcaaatttgcacccaatccggtgtgcagctatgccacatgcatgcagtcatttggaaattaatattattaatttttttcacagctaaattgaatgctaatggatcatccattaataaaagggtgtacatacacctgggtgtatgaaagagccgtcctatatatatatatatatatatatatatatatatatatatattatcacctatcatgcgtctctaatggcgttatataaagaatgcttatcttttcgtcattaatctagtgatgatccttctgtcgtcatacagtctatgacgtccattttcgtcaccatcaagcccagaaatcatgataagatgccatgtggcctgttaaggcccatgtagtcagggccggctcgggggggggggagcgggatggccgctctaggcgcccacccacacaccttgtcaggtcccaaaattaaagattcggtaatcgacatgtttaaactgtatcaagccctggatcagtagattgatacaggtttaacaatctgaatcttcatagcatacatttgatcaaggctccaaaggagatttctttacataaaataatagggtatttacaagattgtggctatctattactgtagaagctataggatgagccaactctaatgtttaaactctatagaattaaaccatctatctaatctatacttgggaactaagttggaatgaaactaatttatatgtttaaactcacggtttcagcaaaaactccaaattgattctcaaagagagggttaaagcaaggctgagtacaacatacttatcaagctattatatcaagtaatgaatgcatgaaatagtaatttctatgtagggtttaggacctaccctaaaccctatacaaaaaggtccattggcattaggtgaattgcatttaggtccataggcccacttggcatacaaagcaattttacaaaaagaaccttacaagatttaaatttctagtaatgaaagaccttacgcctaatgaagtggctaaatagccggggcccacatgtcggtgacttggttgctggggagcagaggcaataggagggcaacggcgaccgatggcgttcgcggcggcgtattggcttgatcatattttggcgtctttctcctgggacctaggcgacgtcggtggcgcaatggctcagccagggatggttcgagtcgatgggaacgacgaagtggggcgatggcggcgctctggacaccgggaacgctgacgagcataccaccaagtgttcgatctatgccaaaatagaaacaaagaaaatggattgattaggtagagaaggaacttcatgttcccgtggttggagtgcggtgaagctcaccagagaatacgtgacatggatgaaactccttcgggtgaaaagagtaagtggaagttcttggagattccgaggtagtttttggtggtttgcatagtggaacactatgagaaatagatgaggttcacagtggcgagttggcttgattaatcactactacagggacccttttagattccgtgcaggcagcaactcgtcgcttttgaaaaatcagctcattttcacgtgcggtccttttaagaggacagcacggaaaaatcgatgtttccgtgcagttctcttaaatggacc

SEQ ID NO: 73903 - DNA, 27855 bp, Oryza sativa
gggacccagatgtaaaagtacggccaaaagatttttctatgttatgttaataataaataaagaagtatttattggtaaaacttgttaatattgttataaaaatgtattgaagttggttgttgcgcaatttcatatgttaagtgaggtattattttgtaccttattcgacgtattagtactcggataatttatataggcctatcgcagtttgggtcgtagaaacattatatggacttaaacaaggagaattatgtaacatgaagaaatagtagtacaatttgaacatgatacaactatttgcattgcggttacatagatgatattagattcgaactaggagggaggtagtgcaatagttgaacacaacgacgatgtagtaatgggacaaggaagcatgacagtagaaatttcaatatgccaagttgtccgataatagctaacccctacgtgaggatccctctcctctcttaaaccgcgctttagtaaccctgtattgctctggtagttcaagctgcacaacacgactaggtggagttagaacccttctggtgtctatccattctctgtattgacatctccttggtggttcctaggaggaaagaatagatgtaaagcaagcaaagttagtaaatgttgtgagaaaataaggattcatgtaatcaaaatattcttaccatgaaatcgtcgtcaagaatatttggacaaacaaagaaccttcgacccaatgttgtaggatttatggaacgaagaacctgacaacgatcaccacacctgcatcttggacgggcttcccatggagggagtgccgtagttagcacccgccagtcgctctgttattcacgacattgtcgttcataagccgcttttctctgtaagtattgctcagtactttcggatgcgaaataccagcgactttcttgtaaacaagtggttaggtcgagaacgggattttctgtatcgacccactcgatgtatgcgcaagctgtagtgcgggtctgccgaatagagtagtgttacgaagaataaagcgattgcccatacggaatgaataagcatatgcagataataaaatacctcacggtcatagttaggacacctaaaaaagcgccttcctcgaatatcaggactcctcgaagccattagttggcatcgatcaccgcataggcagagaggacgctggcaccaaggtggtagtaggtatacacaaggatcgctacgccagtttggatcctcaacacctcggcgtctagccattgacgaaagccggtcggatttgtaatgaagcaagtggggaagagagtactgaatgtgactgagttctgaaagattgtgaggcctcactcgttaaggcgacttatataggcgcaaaaaatcgagtgatacccctgacatgtgaacgtggtggggtatggtgggtacgcctgattggcgccgaaagatacatgcatgatcggcgccgaaagttacattggtcgtatgcgccaaatggcgggcaaatactcgtatcacacgcgaataaaggaggctgcatccgtgcggcagaaagtagtcgtgcatgcgccgaaaggtatcgtgcatgcgccgaaaggtatcgtgcacatataacaacaacgtagtcattacacaagcatacagtactggaaagtgaagcaagtaaacaaagagaagactgctctactggccctgccccgcgccgcgaccacgcttggtcctccgggcctgtgctcgcacgtggtcctgggagtaggtgaaacgatccggtggcacagcacgggtagcacgagtgtcccgcggaggagtggcctgcgcctggtcctgcgtttgcaccggcggtgcgcctcccagctgtgaggggccgatgacgtcctctgtcgagcctgaagcgaagtcgaagtcagtgatgtcgaagaggaaggtggaaggtaacaagtggtccgacgaggtcccagcatggtccagtggtggaccctgactcgacgtgccggctgcctgtgacgaagtcccggtgtactgccagaactgcgctgagtgcgaggtcgacacagctgcctgagacgctgaccctgcagcttgggagaagtgggcggcctgcgtcatagcgaactgggcgaaacctacacatcgacaacgggacccttgtaagctaagacataaaatgtatgtaaattgattgtcgaagtaatgttgtttttttaagtacctgtggggggcacaacagaaggcctagccgaggaaggcggggtgctgaacggtgcacgaaaccctgaagcaatcggcaagtgaaacggctcacttatatgtgcgaggcatatacagaaatagtaataaaaatacttacctccgtgcggagggggagtcggcctaggaacgtgcgcagctggacggggaccagtcggtacgggtggccgctgtacagctgcgtctgcccgagcaacgtcgtctgcacgacaggtgagcactcggagaatcgagcgcatcgactccaccatccgcgtgtacgtcgtcaggtgctcctctacgggtaccggaatccccgcgcctaaacgttggatcgtcgttgaaccgtcaacgatgacccggttgatgtcgtcgacctgcatggttaatttgttcgtaaatattcataaaatttgacgaagagaaagacatgaaaacataaaggaatggtgcgatgcagggtactcacagcacgagcgaagtcctggtcgcggtgcctgacatagaggtctctagtgctcgcaacgtggggctgctgctccaagggagcgaaggtgaccctagtacgggtgcgtggctggtaccagcgtaggtaggcctggtacgactcctcagtgtgtggctctccctcgtggtccacgacctcctcggttgcgagcaaccagtcctcaacaaaagtcgccaacttggcgggccagtcgccagctgactgctgacccttgcgcgagtacctgcgaattaatgtgtaatattagtgtgaaatgacagatgttacaaattattgtgaacaggcagattttaatgcaacaacgaaaagcgtagtgcaagatcttaccggtgaacagcagctgggacggtagtcggaaacggtactggaaagggctgacggaagccgaactgccgcatcacgcggaaaggggcgtgaggctcaacgcagatgtcgaagaccatcggaaacgtagtcatccagtacgcctggtccctggtgcagagtgtggacagacccaacggcgcacgagcctgggtagccgtggcactgtagggctcccacacgacgtcagtcggcagaaggcggtcgaactccataacaaactcaggatacgaccgcctaacctggacgtgagcccatcggcgctgcaatacgagacgatcgatgtgatgtacaatgaacttaacaattaacttaacaatacgataagatcgatgcaacgtacctgacgacggcaccacagagtacccatcgtagggtagtcgacctctggtcgctcctcatacagtgactcctcgtacgcgtgctggtccacctcagggaggccgatcgcaatcctctcagctgcccagatagaaagaaagagagggcacccaccaaaggtcgcgctgggatccgtcttcgtgcaagactcacaaagtgcacggtacagagccgccaacaacgcggaaccccagctccactgaggcacctcgcctaccgcggcgtcggcgatgctcctagcgtagtgcacgaatcccttgtcgaccgcgtgcccgtgatcgccacagaacatcacccagccaaaaagccagagcaagtacgcctccaaacatcggctgtaggagtactcgtcggcctccgcctgtagctgctcaacctgcaagccgtcgataaaatgttaggcaccttaactgcggactaaatatgtaatacgattgtcatttcggtacaaaaatactcacggtgaactgaagcagccacctcttcgtaggtccggtgttgcggtggtgtgccaacggctcgaacgggaggtgcggtgcgcgctgtactagtgcgaaacgtgccgtcagatcgtcctgccagtccacagccgtggtcactggcccaacagcgtctcccgcgagcggtagccccaacaagtacgatacgtcctgtagggtaggggctacctcaccgcacggcaagtgaaaagtgtgcgtctctggcctccatcgttcgaccaaagctgctaggagggacctgtccacagtccatcgcttggccgggtccacgtcgccggccgcagcctccaccagccgacacatcggtaggaggccggcctcacgtagcctgcaataacaaattaatatgtcattataaaaaatattacagtgcaactaacttatagtaaaacactgttcgtacctctcgacaaaggagtcgtgaaccgtgagtagctcaccgcacgtccgtgcccggaacgtcccaagctgagccccctgcaccgcagtaaggtgagaccggtgtcggtgatctatcgccgggtccaacaactgaggtgtatcctgacgtgccatctctgaaaaatatagtgtttcgtgttagaacaattcaaaaaatagtactgtaaaacaaaagataacttgcaaaattatgaaatagtaataaaatcatgagattaattatgtacaacaagagtacaggctatttaaatatagcaaacgttactaatggtacataacgatgacgtgcaatttaacatatatgtagagttcaataatataacataacattacgtgtcgaagtccgacatacatcagcatacctaaagacgttaggcgccttagtccgacgttacatcacgagacctaaagacatgacatgccgaagtctgacattacacgacgaaacataaacacatcgataagttcgaaacgaattacaagcaaatccacatgccgacatagaacataagaactacaccacgtagccagacgtggcacgacgacgcctaggacgtggtcgagtggaggtagtgccttcacccgtagggcgagctccatctgctgctgatcctgatagtcctgcctccgccacacttggtttctccttgtctttaggacaatgcttgtaggtgtgcccatgttcatcgcatttgctgcaacgcttcaccctgccagcctccgactcgtccatatcgttgcggatgcgacgagtcctcctccttccagccttgcctcggagcttcgatgggtcaggaatattgagtacttcatcgttagtctctgtgaactccccagctatgccgaacccataaatctcgccgctccatgtatgatatattgcttgcttactgaagtactgtgacacatatactgcatctggtatgccacactccgctgcggcagcaatgacatgggtgcatggcctgtggagcagcttcggctttgcacaagagcaatgacatgtgccgtcggctttgagaacacactcctgcttcactctcttgcggtagatacccctgcctgccttatcttgacatagtatctcaaacctgtgctgttgggtaccttgcactagagctcgatgtttcatggcctttttacgcaactcctctagctttttctgcatgaaagctccaaacaaaatgctgttgttcggcatagagggaagaactgcctggaaccgatccctaaaatacctgcatgtcccatgtaaaatgaactccactatgccaactagtggcagtccacggacaccgcgcatcacccagttgtaaacttctgccaaatttgttgtcattattccatatctagcaccacctgtgtcatacgccttggcccatttctcttttggttcatgcagaatccactgagaaaatttccgaatctccaatccagttcttctaaccaatgttggactatccgttgggagaggtccaagagcttgaggagggtaagcaacggcggtcgatggagccgctgcacgctgatcactgcatttggctgtcaactcatctaatctcttccaaagctcattgaattttttctcctggttctgattgcacagcctcttgaacatgttcatgagctccttgttcttgaattgcttgaagaaattagctcccatatgacgcatgcaccacctactctgtacatcttcccaaacaccggggtatcctcattccatactcccaaactgcaactctcctatcgctcgcagaatgccagcgtgcctatcatgtatcaggcatacatttggcctcataccaacaacttttgttttaaccaatttcaggaaccagtaccagctgtcggtattctcactctcaacaaaagcaaatgccaagggcaatacctgattgttcccatctacccctattgctgttagtatctggccccgatactttcctgtcaagaatgtcccatcaatgcagagaacaggacgacagttcacgaatgccatcttgcatgcatgtagagctaagaacgccctttgcagcacactcttgccaggatgttcaattgaggggaatttcttcacttcgtaagagctcccagggtttctttcctcgataacaccaagcaggcgtggcaaattgtcatacgaggcttcgtaagttccaaatctcatctctattattttctgtttggccctccgggccttggcatagctaatagtatacttgtatgtctcttcaatgtgtcggattattgaccttggttcatatgtgagattatcgatgacatgcgcatacatctcagatgcaacaaatgcacatgtaatgttcctgtggtatttctgaacaccaggtagaaaacatgtatgcttggtaacaactgtgtcacgtcctgataaattcatcccaaaataaaaatcattttctaaaaggaataatagaattaattaaaattcgaaaagaaattgacaaatactaaaatacgtgccagaaaaattcgaatgtggtccggagaatttttgttaaattctccttggtctaaaaggagccctcaaattttacttgaattttcagagcaccaaaaatatttattaaacaacaacaacaattatcaaagtttactaaaaagaaaaactaaaaataaatccccctcctccctttgggccaagtcgacctctctctctctcggcccgcggccaaagtcctctcttcctccctctctttttccttccctctctctctcttgggccggcccggcccatctccctcccctctccctcctctccccgcggcccactcggcctctccccgcgcgcgcgccgctgacgggcgggcctgcccgccaccctcgctgacgggtggggcccacctgtcatccccttcctcccgccgcccccgtcctccccgcgtgcaatcaataggggggaattattccccgtgattccctccccctttccccccaattttccctccctctctcccttggattcatttggaaaccctcccctaatcccgccggcgccattgatggagccccagagcgccgcgccggtttccttcccctccggccgccctctcccccttccaaccctatataaaccctccccgcgcttctcccgtccgtttccgcctctcgccgcccttcctcctcgccggaatcgagctcgcgccgtcgttctctctctccaccgtcgccgccgagctccggtccgccgccgtcgtcgccccagaccacctcccacctcggcaccgcctccttcggcttcgccgcatcgtcgccgacctcgtccacccctccgtttcgctcgccgaccgccggaactccgtcgaccccgtcgacccgagccgcaccgccgcctccctcaactccggccgcctcctccgtcgccgccgtcgccccggggtgagccgtggaccattgcctcctttcccctttccctcccctctctcggccgccgctccgccgcgccggtggtcgccggcggcgaccatcggggcgcgggcgcgccgcctcccgccgaccgcgccggcgtggccgccctcgggagcgccaagtggctgccgcgtggggcccggccgtcagccgcccgcgtcctcgggtgcggctgacgcgtggggcccactgcgccggccggtgtgagcccgggtgcacccggtccaccgtggaccgtgaggctgccgcgtgggccccactcccatggacccggtccgcgcgccccctcccctcggctgacgcaataaacccttttaaaattaaaatttaaatgaagaaattcgcaaatattcatttaaagagcatataaacttcaaatggccataacttggccatttgaactcggaattggaccgttcaagtctctaatttttccttaagaagtcaagaacccatttttgtgctttgttcctgcttgttatatggagtttattagagtaaaagccttttctttttcgttggtcgtgtagacgctgcagctttggaagatccgctttcgtggaggttgaagccgatgtttgggaaagcgagcaaggcaagtcacatcatccttgagcatattgaatcctagtttataaaattattttgatttaaattaatacattatcgctttatttaaattcccgcgttatcactgttttatttagccatgcctatttacctttgttaagacattattattgctattgttattattaccttgttcaccctagaataaacaaaaccccaactagtgggtactctattcatggttccactaatatgaatttaggtagatgcttcgctgattaataggacaacattaggtggtttttataactttagactttgggaatattcatatctcttggatactatggaatggttggcttatggtggaattggacatacccctctcttcctctttcaaagcccctaaaacctgtttttcggtggggtttgggtgcatgccagttgtgggaagtagcaccccggccaatataaggactaagctcgggcctctgttgcaaagcactaccgtacttccacatgtctagtgggtaaggcttagtttgtggctcagtctggttataaacaaaagtacacggatggagatggacgaagtcgggggtccatggacatctctaggacaaatgaaggctacacgagctgcggcccggtagtcgagatgtcatggcacagggcatgtgtcctgctgctaggggctcaatcctgcctgcctgtcccgggggttccggccgtaggtggggttgggtcggtactcttgtttatggctaggatgggttgggaactatgtcacgtcttccgtctgtataccgtggtggtatgtggcacgtggttacacgtgaggaagatgtgtcttgtgggtaaagatgtacacctctgatcagagtataatctattcgaatagccgcgccctcggttatgggcaagccgagcaatgtacccaagttagtgttttaattcttaaaatttgcttaacaactaaaatgtggaatggttggcctgggttggcttgggacgagctgggacccagggtcgggttgccagttcggtctgaatcatcgtaggccttgggttaaggcaggttcgtgtgggttcacggccttgattaataatactgtgtaactctaggatcgtctttataaaatggctttgggcaactaagtgacttttaaatactgttttctgcaaaacttaacccctatattattaccccttgtacccccttgcattaatcatgcatctgccggtgtggcttgctgagtactatggttgtactcattcttgctctatctttctccccccttcagtaagagaagctttggagaagaggtcttaggtggagtcctggcttataccccagttgagcgcctgtgaagttggagccgtaggcccgctagtccgctgctgtttatttttgattgtcaggccttaagtgcctttgtaataatgtaaatattatcgatataataaagatgtgccttttgtaccacgtttgtgtggtgtaccccggcttttcctgggacagggattaatacactagcgttcgagagaatgtatttttctcggtcgcgacaaactgacactgtccaataatccttccatttccccttatacgcatgcactctccagggacaaccatctttttccttaacacaccgaacttcatattgcgaccggttcgacttggcaacccaaaactctctatgaagtgacactacaaaatgttttaccgcctccttcatatcttctgctctactataaatcgctccctgaataacctcattttctttgtactcccgtctcacactatcctcttcagagacgatcagcccagaaaaatcctcactagcccattctgctggattaatatccatctcatcatctgacgaatcaccttcctctacatgctcgttgtcagaatcctccctctccatttcatccacaatggcaccgacagtctccccctcgtcggccactccacctggttgaatgcccactggagctactacgcccccgtcctctcgtgcgttgacctcctccacagaagtctcgtttacttcagcacttggtccctcgccatcatccatgttcgtctgcacacctggatccttcgggtgaacaaacggaaccaaagctagaggccacccgcgttgcaatgcattttccaaataccatctccacactcgagagttttgaactggcattagttcccaataaaaaccctcagttgcccgacttactataacattgattgttatgtcacttgtctgtggatcaactctcaagcccctcattaaccatccttttatagaaggtacactcctctcagccggtctatcaattcccctttctgatacaataaaatctgacagatctaccccagttggctcgtaacggacgtttcctggtccatggtaaacttggaatatttgtttgttcgacatatctgtcaacgaaataactagatcatattactctttcatgcaataaacatctacaacgtaatatcttcttgtgtaagccaatgcaacggtaatgtattaattccaaactagcagatctacgtagttaccgatatctacaatacgcacttctagattagtacaactaaaaccctaaaaatataatgcatttattcaaacaaatttttaaagaatacacactatttaactcaatagtcacatataggatctatgaatattacctgaaatcggcgtctgaatccggcagggcttcgccccttcttctcttctcctcccctctcttcttttttttttcactggaattgaggagagaagaatgagggctgggggctgggcagcaggccttttataggcagcgaggcctgccgcccggccagagggcggcaaggggccgcctgcaaaatagccggccccgactggcttttttgcattcgggccccttgccgccccaccagagggcggcaagggttttcctgcaaaaaaccctccctccgtcaccgcccgttcctcccccgtttgccacgtcagcttgccgccccagaggtgggcggcaggggctatttctgcaatttttttggtcgatagattatttctgtaaatattaaaaaaaaatctaaaaccgaaaaaaattcctcgcactcgtaccgtcacatctgctttgccgtctcgtgctgggactcggtccatcatgggtcgtgcaaacatgggccgtgtggtacagccttcgtcgtgaggaataagttcacttgacgtccctcactctgtacgccgagtatatctgatgtcccctaaccgcaatactaaatgtgtatccctgaactatgtaaaacggtcaaaaaaaaaaaaggtcccgaggcagtatagatgcatggttttcgctgaggtggcaacctagtcggcaaaaaaataaaaaaacaaaatatgaggcccacatgtaagtgagaaggaaaaatgcgaggcccacgtgctagcatcatcttcttcctttctcttttctttcttctcttcgcttctcttctcttctctagtcttctcttctgacgccggcggcagatggggagaggcggcctccgacgagtccgcgccgctcgtcctcgtcggcgacggcggcgaccaaccccggcacccccggcacgctgcttggcctcgcgctccagcttctcgcgccggcctcaccatcatcttcctcgtccccaaggagtactcttgggaggtcgccatccaagttgtggttgccctttcttgcatcgtcggtggctccattgtcttcgcctgcacccggcccgccgaaggagtcgaagtgagggaggagctcgtccaccgctagctcatccgccttcgtctgcagtagagggacaacgggaaatgggtgccgcacccgacccgccccgttgccaaccctattgttgatctgttccttgccaccgattgaaggttggagaagttctaggtcaggaatatactgttggcaactttttgttacaagttgataagcgccatcgcagcaccttaagtattgcggtgatcctagagtcgccaaccaccttgatctagcaaagagctaaacatagatgggttttgataactaaaccggctagcggagccgatttctagataactacccgtctcgtgggtaaaatggaaggttttcaggacaaacctacaaagagatgtcgtactctcgcagcggcggcgaacggtttacggcgcaaaccgacaaaaatggacaaactaagagaaaactaaaagcaatatgaaaaacgattcgattgattgatagtagattgttttttttttacaatgaaccggccatgtcccttatataggggttggtcttgccctctacaggccctcctccacgtccaactcggggtagaaacttaaggaaacccgaaacatgccttcccgagcaaggaaacctcgagacccgacgaaacacaatcggactcggtcctaccggtcagaccggccacacaccgccggtttgaccggccctcaaccggcggtctgaccatgttaacaaccaaatttggtagcatttgtatcaggaaaaaggatttggtcaaagcggagttggaggcggagatcgagttcggaaacagagcaggaatcggttggagtccggatcggctatggttaggatcggctgagtctgagtcgagctaaataagccgatatagccgattccgacaatacgacttgtacgcgacatcgggttcaagttgatgtatttcaagataattgccacgcatggatagagtcctaggaaggcaattgtatctattaattaagatattttatgtaaatcccttatagataagtgtgggcaaaagtctgccgcaaagacttgtggtatcttagagtttgttagagataatggttgtgtccggtatgggcatatattgtaatcctcgggtataaatagaacccgagccctatgtaatttttaacacacgttcaatacaatctcggcgcatcgccatcctttttgctttagttttgtttcgatgagttcttgctttcgggttgagctgcatcgatttcgatcttcaacaagaggtaaaattcgttatgacggatcgcattcttaggattagtgcttccatcttcatgatactctaatcttgtttatgtaattcgtcgagttatcatatatcttacataatctttagcaatatcgccatctaaactactatcggccaatatctgtatacagaagacagccaattaggttagatcttgacgttgatctagattatatgagatatctaccattctatgaaacttctagtggcttgattgtctagatatcactcttcttttcatacttaatgctgcatcattcatgtttgatctattaagttgtgtttagaatatcgatctctggcctgctttctagttgccgattagaatagcatcggagtttcagccgaatgtatctgatttagttatatttattctatatgtctcattgatatgctaaatctgccctttatatcaagatattgctgcatctaagtatactaagtcctcgtttgatattctatacttgctttgatatctttatataaagtagtatcggagtattagctgatacacgctagatctatctgatcggctacgctataaacatatataatcccattgttgacatatatttcgatctaagtgatttatactgtctcggcatgatgaccgatctatcccaatcacttgattttaagtatatattgatataaggggtatatatcgttaatatctacagccgatcgagtagatttagttcttctttacttattcatgattgccgatcgatatacagatgacatcggcccaaaaataaatgatatgtcatcggcgtctggccgatcggctatcatttatagatttaaccacagttttcttgtttttatttcttgttgattacaggatcaaatcaactagcacgctaatacatccgaaggcgagctttggacctgcactgaagttaagtagatctcccaggccacgtgttttctatcaacagaccggccaacacacggcggtcagaccggcccactctgaggaaaccggtagacttccaaattttggcaatctttcctattttaatcctaggtgccaaatttgggtgtaaacacatgcccccctgcctttttgatgaacaacgtgaatctaaaagcatagatcatgtttttggtcttaggacgataatccaattaccggccatagtacctcctaagcgtcttgccaaacgctccagaagtatttcttcaagtatttcccgttgattgctcgctgaaaacactccccttgaagtgtctccaaaaaatacgcgttccctcgaacaatgccgcatactcgataaggaccttcccaactaggagaccacttactgaactcccttgattgagtacccaaaggcaaaattgtcttccaaaccaagtctccaacttgaaacaactttgctttcaccctcttgttgtacgccttggccaccctcttcttctctttctctatctcttccaatgccttcaagcacttgtcgatgacttcatcaagattatctcccatcaacgtcttgtaatcttcacttgacaaatcatcttgcttgatataacaaagagaaccaagatttacctccaccggtaaaacggcttcttgaccataaaccaactcaaaaggagtgactttagtggcaccttgtttagatatcctatgtgcccacaatgcttcggaaagcacctcatgccacctctttgggtgttcctcaatcttctttttcactaacttcaacaatgtcttattactcgactcggcttgtccattagcctgagcgtagtaaggagaagaactcaacaatttaataccataagatttggtaaaactcttcacttccttagacataaaagaagcaccttggtccgtagttaatgtttgtggaataccgaatctatggataatatgcttcaaaataaagtcaattacctccgtatgagtcatattcttcaaaggcacggcttcggcccacttggtgaagtaatctgtagcaactagcatgaacctatgcccctttgatgatgaattataaatttgaccaatgaaatccaaaacccattgttaacagtgaaatttggtaagcccaaagttaccattggcttagagtcagtatcggcttcaaagttctagaatcagccgatgggagtcaagtcgccacgatgttgtgttcttggtggagtcggatcaatcaaaggaagcttatctagaagagtccgagttcaagaaggatgcgacatgacaatttatctattaattaggcatagtttgttagtttccttttatctttaggaaagtgtgttttgtgtcctataaggactttatcttttccttttatctttaggaaagtttctttcttgtccagcaaggactatgtacacccggagactatgtaatctatctctcgatcaatacaattcgacgcatcgccaccctttttacttctacttttgtttttacgctccggcggaacttggcacctgacgcggggctgcatcgtcttcgatctccggcgaagggataagtccaatgttccaccggtccaggcaattatatcgtctacgtcggcgtcgttcaaggctgcatcagtacattcgacctcttggattactctggtttggataatatatttgtctggctatttatcatgtctatgttaatctagtcttagcatatcaatttagctctatcggctgcttcttgctttagggtttctgccggtatcggctaaatcgcgttgctagattagattagcttagacatctaccaccctgaaaatcagtcaatggcttgattgtctagatattgtgttaagtttgatctactaagtcgtgcttagaaccataatctctagcctgcttcttgactgcatcagttaagtttgatctactaagtcgtgcttagaaccataatctctagcctgcttcttgactgccaataagggtttcatcagggtttcagccgatgaattatctagacattgcatcggcttgtaaggattgtgtacatattagatttagccgatgacaacaaaggtttcactatttaatctaatcttgtggatttcatgacatcggacctccagccgatgtgtgctttaaccttcggatcgatgcttatttatcatatcattatttgtcgattggtttatactggattatattgttattttattacatcctcatcagccgattgcctttatatcattatctacattggacttatagccgattgcttaaacctatcgctatcggctgatatcggcatcggctattatcggctatcggctagaactattcgatcggcttgtcagccgatcggctcattgatctgctatttgcatatcttgtcagttgcaggatcaaactgactggcacgcccacatctcaacaatctttggacctgcatagaagcagatctcccaggccgatgtgttcgattttttcgtcaacacccatcctcggaacggccatggtttgattatggggttcaacacggcggcgggcgccaattgaacattgccgaaccgttgacaagcctcgcatcctctataatatttgaagcaatcatcaatcatctttggccaatagaaccccgctctcctaagcaaccaattcatcttgtgggccgattgatgagttccacaaattccttcatgcacctctcccatagccactttagattgatcttcatctaagcacttcaacaagacaccatctatatttcggcgatataaatcctcatcaagcttaagcgtgggatctttcaaatattgaatcaaaggaattctccaatcttcttctgcttcctgagcacaaatgtccgaattcacagttaattcggcctccaaattgattgcaacgtgcccccagcgttctgcccagaaccggtcagaccggccacacagggccggtcagaccgctcggagtagctggtcagaccggcggcatgcggccggtcagaccgcccctggtcaccggtaagaccggccgtgcaatgccggtcagaccgcccctggtctccagttttgccaatttcgcacaaagatttaaaatcaagcaccggctcttctaatatcagaaataatcccctcttcacattatagctagatgcttgttgtgccaagtcatttgccctagaattatcatgcctagcaatatgtctaatagcaaaattatcaaaattggcaataatatccaaacatgagttgaggtacctatttagtgatccgtccaagcatttgtagactccggcgacttcttgcaccaccaattccgaatcaccaaaagcctccacgtgtttagctccaaccatctccataacttgtaagccgaacaataaagcattgtattcggcttgattatttgtacaataatactccaaacgaaccgatgcttcataacacatgccattaggtgaaaacaaaactatcaatatgccttgaccttctttgcaagaagaaccatcgaaataaatcttccaaggtataacttcaattaagcaaacttctccctcataagcaatatctatatgatggtccactataaaatcgcatacaatttggcctttcatagatttcaatggttcataagccaaattgtcacgccccaaaacgactctaaaatacatcctctaaattacgcctagaataattaaaatccgtgtgaaagccttcaaaaataaaaatgtgcaaagttaaaagtcaaataaggcttggaggatttttgtatatttcctaaaagcctaaaatgcgtaaataaattttagtggaattttcagagcacaaataataattattaagaaataaacaaagttaaaatgattttataaaaagaaaaaccttaaaagtcccccttccctcccttgggccggcccggcccatctctcctcccccctctctctctctcctctccccgcggcccactcagcctctccgggcgcacgcgccgctgacgggcgggcccgcccgccaccctcgctgacgggtggggcccacccgtcatccccttcctcccgccgctcccgccgccccgcccgcgccaagcgtcgtcgccgccgccaaatccgccacatcccgccgtccccgcatgcaataaagtgggcggaaatactccccgtgattccctctccctttccccccatttttccctctctccctcgcgttcaaacgggcggatttgtccccgcaaatctcgccggcgccattgatggcggccggacctcccgcgcctattccttccccgccggccgccctctccccttccaaccctatataaaccctccccgtgcttctcccgtccgtttccgcctctcgccgccctccctcctcgccggattcgagctcgcgacgtcgcccctatggtcgccgccgagctccggtccgccgccatcgttgccccggaccgcctcccacctcggcgccgcctcctttggcttcgccgcaccctcgccgacctcgtccaccccctcgccgagtccgccaaccaccgaaacgccgtcgaccccgtcgacccgagccgcgccgccgccttcctccgctccggccgcctttttcgtcgtcgccgtcgacctagggtgagccgtggaccgccgcctcttttcccccttcccttccactctctcggccgccgctccgccgtgcctatggccgccgccggcgaccataggggcgcgggcgccgcctcccgccggccgcgccgagtggccgccttcgggcacaccgagtggccgccgcgtggggcccggccgtcagccgcccgcgcccttgggtgcggctgacgcgtggggcccacggcgccggccggtgtgagcagggtgcacccggtccaccgtggaccgtgaggctgccatgtgggccccactcccgtggacccggtccgcgcgccctctcccccggccggcgggggaggcggcgggagcggcgggaggaaggggatgacaggtgggccccacccgtcagcgagggtggcgggcgggcccgcccgtcagcggcgcgtgcgcccggagaggctgagtgggccgcggggagaggagagagagagaggggggaggagagatgggccgggctggcccaagggagggaagggggagttttaaggtttttctttttataaaattattttaactttgtttatttcttaataattattatttgtgctctaaaaattccactaaaatttatttacacattttaggcttttaggaaatttacaaaaatcctccaagccttatttgacttttaactttgcacattttaattgttggaggctttcacacggattttaattattctaggcatcatttaagggatatattttagagtcgttttgggacgtgacaaacctatcccccttaaacggaatctcaaccccgagattcggaagaactggcaaaaagatcgggatgggctgccttcagctcgtcttcacgctcccaagtagcttcttcctcggcgtggttgctccattggaccttgcaaaaacggattacctggttcctggtcctgcgctccatggcgcccaggattttcaccggtctctccacgtaggtcaagtcttcgcgaacttcaatctactctgagtcggcctgctcggacggcactcgaaggcatttcttgagttgtgacacatggaacacatcatgcacgtcgcccaaggaggcgggcagctccaactggtaagcgacttctccacgtcgagcaatgatacggaaaggacccacaaaccgaggtgcgagcttccctttcgtctgaagccggtgtacgcctcgcaacggcgtgacccggagatacacaaagtcatccactacgaattctaggtcacggcgtcggttgtctacataactcttctgccgagactgggccacctttagattctcccgaatggtcctgtccttcgcttcagcttctctcaagatatcggtcccgaacacttggctttccccaacttggtcccacaatagtggtgtccggcatttgcggccatacaacgcttcgtacggtgctgtcacgcccggaatttctatccaaaattccaaacgcttacatgtgtgtgaaccctcgtccaggaatcagccgaggcacacaataacaaattgataatagagtacaattattactctaattaataagcgaataaaatgtcgttacagaggtagatagttcctctcaatcaataaagatctaagcagcggaaaataaaataaacggcgcagacggctccactccacaggcagcttgaccaaggctacacctattcctccactccatcagcctcattgtagaactcttcctctgatgaatgattgcaaggtgagtatatgacatactcagcaagccacgcagcaaatatgcaagtgcacaggataacaaaggatggcataatagggttgcatttgcaaaagcagcatttagcaaacatttgagaatttgataagacagttaagtaattaaacaatattaatccaacgctatacaacataccctgttgtataggcccaaccattctgaacaaccatcccggctgcacagttctatctccaaaccaggaatattccattccaaaccaggagctaatcaaatcattaccagtttaagcatctttttcaatgatgagaggtgtgagactaatcacgaaagacattgttagacccgcccataaccgcgggcacggctattcgaatagttttactctgatcagaggtgtaccactgtacccacaagacacaaccccacatcatgtcaccatgtgcctcaataccaccacggtacctcggaaaggagttgtgacaatacccctcgtataacacaatccactgcagcgcaccttcctggatcataatcacccccttataaacaaggcatggactccccagcaacccccgtgggcttatctccgccacttctcagtctggtgccccgcaatgaaccatgctatacaaaagataaagccgttgcccatgctggcttgtggttggcacggttaatgtttcacaaccgaaactcgtgaaccggtccttaattgtcatgagcacgaccatcaaaaccatgtgctcacaacccaccattatcaggttttagttggcacattaattaattaactaatcacgatcgaccatcgtgaactatcattaagccatcatgaaataatagtaaatcattagttatcccataaatgtgctaatgtttctaagtagggctaagcaattatatctaatatctagttgaaccaatataaataaagttcaaccagtcaaattgtaataacccaaggtatcaaggaataaggtaatcaagtacaaaagggccataacaaagaataggtcaattccacccaatgacattcgaaaatagatgcaatagttgaatagaaacaatagctttaaataggatcaacatgctcaaagggttgtttgggatctgtgtgacttgccttgctggccttggaactcttcaaactcttctccggcgaaaacggactctccggaaacgacggaatctaaacagaaaagagcaaaatcaccaaaacagcacataaacaagcatgaacaatacatgtggatatttttaatgtgtagatctcaactttagaaaaatttagagacttgaaccaactaaatcggagctaagatgaattagttatgaatttttaaagattaaatcggattaaaacacttatatcggtttaaattgaattatgacgcaataatgaattatttttgaaaaggaaaagaaggattattgcgtcagcgggctagggttttggtggaccgggcgcacgggcggcggttcacgcgaacggacggccgagatcgaaccaatccaaaacggacggccgagatcgaacgggtccacgaccggctcacggcggacgaccccgatgacgtcggcaatgacgtcaccgacagcggcggcgcctcggcggaacaaacggctcgggcggcgcacgctcgccggcaaacggcggcactaggacgcaaacgaagggcaccagcacgtagaggacgacgcggcgaacacaccggtgaccaaaacggcggcggaagaacaacgaacgacgacggcgacgaggaggaaacggcggaaaccttcgggttgtcgacggcgacgaagctccggcgatctccggcgacggcgaaggggtggacgaggacggcaacgacttggcgagcacgacggtggtcttcccgagcgacggcgacggctgaaacgacggcggcgcacggctggagcggcggcggcgacggcaaagctagggcacacggtgctagggtttttccgacgacgagaggcgaaggcgaaggtggcaacgggtagaggagacaccgagggtccttttaaaggggctcggaggcggcggcaaaggcccacggcggccggcgacgtggaaggaaagatcgggaagaacgaatccgagacaaactcgaatccgacgctttccaaaacgatttagctaaagattccaaaggagaaaggtagaggagatcccgaggatcatttcccctctatcaattcggccggagaaggaaaggagcggccggatttggaaaggaacggcggcggcgcgaaactagggtttcgggcggcggcggccggaggtagacgatggccctggcggacgcgcgcgcgcgcggcggcggactgggccgaactgggccgaagagagagagaaaggttttgggccgactttcggcccaaagccaaaagagactttttaaaacctttttcaatttaaattatttctttaatgcaattccatttattaaaaatactttcttagctcaaataaatcccagaaaaatctaggaattatagaattaagcaaagtatttaatgaaattttatctggcccctttttatattggaatttattaattaaaactagatcttctcttcaagacttttaaaattatttctaaaaattccatttaaacaacaatttataaattttaaattttcagggtgtgacaaacctaccccccttaaacagaatctcgtcctcgagattcggaagaattggcgaacagatgcggatgagctgacttcaattcatcttctcgttcccaagttgattcttcttctgagtgattactccactgaactttgcagaaacggataactcgattcctggttcttctctcatttgtttccaggatacggattggtttctcaacataagtcaaatcctcttggacttctatctgctcaatattagcttcttcggtaggtacccttaaacatttttttaattgtgacacatggaacacattatggactcctgccaaagattgaggtaattctaactgataagcaacctctcctcttctactgacaatcttataaggtcccacaaaacacggtgccaattttcctttgtgggggtggtggtggaggtagagcattatgctgtggtggattttggatgtgatggaggaaagcagccatcatgttggcctgctgggcgaggatttgggtgaggatggagttggtgtctggtgatggtggtggaggcgggggaggaggtggaggtgggccgccttggatgttggggttgctaccttcgggttggttgccatcaccggtagcagcacttctcctggttgtcaccatctgaaataccccatacagaaccagccaagagagagaacagactattaaagctaatcacccatgactaccaaaattattgaacttattactgatataaaatgggttcattaaggttcaggttgcttaagccaataaaataaaggcaggctccgacacagttataccacacaccggtataaccatgccccacatgactctagcagaaaaacaaatgagaagaacacacgcgcaagcctactaactgctcgtctacttctgcgacgggccagggcggaaggtgagcagcagcgcatcctccgtgctgccaacgccagaggctccctcctcttgcagaaccacgggcgcgggcttggcacgaggggtctcgacgaaacaggtccatgccaaggactgacgaacaagctcgggcctggaggtactcttgcgggcggtgatcttcaggctgcggcagacgcggcggcgcttggggtgacagacctctccctgggcgatcttgagctgacacagctgcgcctccactgcgtctaggtccttcttcagctgcagattctcctgacacagctccaggatcttcatgttgttctcgaccaacccgcggcgcaccatctggtggaagtcgatatgggccgcgtcgtacgcctccaccatgcgcgccaggtgcatgacggtagcgtcatcctccgagctagcatcccggaaggtggcgtagtcgcgggctcctccgcgacaagggtggtagcggtagggcgagtgctgcaactcgtccgggtagcgctggtgaagagtgccgatggcgaggcgtgcggcgttctggcaagcggtggagaaggaatctccacccgcggtgactgccaacgaagtcctctcgggtgagccaatgaggatcactgcagtgacctcccaagcagcgtggggctctgcatcgtcaccctcctgctccgggagttgcttgccctggtagtccactccatgcggataccccaagacaacgcacatgccccgcagctccaaaacgaaaccagtcaggtccagaccacgacggttgatgctgctagccatctacaaacaaaaacaaaagagaaaagcaacattttaaaggttagattttgacgataaatgaagcagcaggacagagagagactagaggattttcacaaataagaaaggatttttatttcgaaaatattgctaaggcttgggatctaaggctcgtcctagggtcaagggggctcttataccaacttgtcacgaccggaaataacccaacgggcgttccttacgtgcgtgcattattccttgtcccaggaggcaaggtacaccaaagttgatacaattcagagtttaacaagcggaagcgtaattaattaatttgttacatgggcggcgaagacccagcacacaagaagacaaacgaaaaacagcggaagactagggcgacgaccacaggcgcttgacggcaggcacgagctagacaccaaagccttcatcatctaggggctcctcttctgggtttgggaaaaattgagcaagactgagtacaaccaccgtactcaacaagacacaaccacaagtgcagaataaatgcaaggcagtacaagggagccataatataggaggttagggtttgccgtaaacagcattaaaagacacttagttgctcaaagctattttgtaaacacggtcctagagctatacaatattattaaccaaggccgtgaacccacacgaacctgccttaacccaaggcctacgatgattcagaccgaactggcaacccgaccctgggtcccagctcgttccaagccaacccaggccaaccattccacattttagttgttaagcaggttttaagaattaaaacactaacttgggtacattgctcggcttgcccataaccgagggcgcggctattcgaatagaatatactctgatcagaggtgtacatctttacccacaagacacatcttcctcacgtgtaaccacgtgccacataccaccacggtatacggacggaagacatgacatagtttccaacccatcctaaccataaacaagagtaccgacccaaccccacctacggccggaacccccggcacagataggcaggactgagcccctagcagcagaacaccggccctgtgccatgacatctcgactaccgggccacagctcgtgtagccttcatttgccctaaagatgtccatcgacccccgacttcgtccatctccatccgtgtacttttgtttataaccagactgagccacaaactaagccttacccactagacatgtggaagtatggtagtgctttgcaacagaggcccgaagaccggtccttatatggccgaggtgctactgtcaaaaccatgcaccccgagcccagcctaaaaccattttgatggttttgaatagagggggaggtgtgaatccaattccacaataatctaaccattccatagtgtccaggtgataagagtattcccaaagtctagagttgtaaaaccacctaattttgcctaattaaccagcgaagcatctacctaaaatcatactagtggtactatgagtagagtgtccactagttggagttttgtttattctagggtgaacaaggaaataataacaataacaataataaggtcataacaaaggtaaataggcatggctagataaaacagtgataacgcgggaatttaaataaagcgataatgcaataatttaaatcaaaataattttataaactgggattcaatatgttcaaggatgatgtgacttgccttgctcactttcccaaacgtcgtcttcaacctccacgaagtgcggatcttccaaagctgcaatgtctacacgactaacggaaaataaaagggcttttactctaataaactccatataacaagcaggaaccaagcacaaaaatgggttcttgacttcttaaggaaaaaaaagagacttgaatggtccaattccgagttcaaatggccaagttatggccatttgaagtttatatgctctttaaatgaatatttgcggatttcttcatttaaattttaatttaaaaagggtttattgcgtcagccgaggggagggggcgcgcggactgggtccacgggagtggggcccacgcggcagcctcacggtccacggtggaccgggcgcacccgggctcgcaccggccggcgccgtgggccccacacgtcagccgcacccgagggcgcgggcggctgacggccgggccccacgtggcggccactcggcgcgcccgaaggcggccactcggcgcggccggcgggaggcggcgcccacgcccctatggtcgccggcggcggccataggcacggcggagcggcggccgagagaggggaagggaaggaggaaaagaggcggcggtccacggctcaccctaggtcgacggcgacgacgaaaaaggcggccggagcggaggaaggcggcggcgcggctcgggtcgacggggtcgacggcgttccggcggtcggcggacttggcgagggggtggacggggtcgatggcggtgcggcgaagctggagaaggcgacgccggggcgggagacggtcccggcgagcggagaaggccggccggaggtcgtcggcgacggaggagagagagagcgacggcgcgagctcgattctggctgggagacggcgcggcaagggcggaaacgggtgagggaggcgcggagagggtttaaatagggttggaagggggaaagagcggccggaggggaaggaaaccggcgcgggaggtccggccgccatcaatggcgccggcgagatttgcgggggcagg

SEQ ID NO: 73904 - DNA, 2064 bp, Oryza sativa
atttgttgaactaaacacaatcttaatatgaataagcggactagtttcagctatgcttcagttttcgaatggaatcgtttctgtttctgttcttgcccatgccatatgagcatggcaatttcgcctacatagttatgcattgcatatgcgttcttgttgagaggtaggtttatacaagtgtttgcagtttttaattttaaatctgtgcaatgaatatgttcatttaaggatcagtgctatcctgccttcctatcttcattgccaggagaggagtatatatttttgttgcaacagcaaatctgaagggtccaaccggagcctggaggataccaagtggtgtcaacctatggaacctgttacctgtttagtacctagggtgtgtttagttacgccaaaattgaaagtttggttgaaattggaacgatgtgacggaaaagttggaagtttgtgtgtatagaaaaatttttgatgtgatggaaaagttggaaatttgaagaaaaattttgtaactaaactcggccatagtaagcaaaataatcactatcctatgagaaaaatatctgactgtcagaaagttgtaaaagcaaggtgctagatggaagattcaagattctcttgtactgtttgtactgctcatcgtatggcaccatcaggttgtaatacatcacatcacactgtcagattattactactatttgttttatatatatctaccataacttgtgatgttattacgtgcaggattaattgggacatgacaggttttgttgttatcagaggctcacctgtgcagtttagttgatgaggatgcttcaaatgatataaggttatcttcaaaaccaaggtaacttatttggacaattcatacggaaataaaaccactaaaactggaattatcgaagggcaataactggaattatcgaagggataatttctttgctttgtgtgcgttgatttgctgtgttctgtctggagtagtcccctttttttttaacaaactcatgcttaatagactctcaatttgaagtttgtatgttaaattatagtggattaaaattttatatttcatctaaaaagaaaataaaatgattcatcaaatcgcagatccatatcaatggatttgtggagctagcaatacctagcttcataaaatcttggatccgcagttgtgccaaacaaacacttgagaaatcttaagatactgaggctgtaagacggccgtgatgacaggggaagaacgttaataatcacaatctggatcagctgaccactgtcttgtgcagtagggtagaaatgatggaaacagctgtgacatgacacctctaaacttgctttgttacccgtaattagcagtattattgatttataatcctataatttctttttaatcatctgcagagatgttcatcttaggggccgtttggaacagttcggagacagtaattttacaggaaacagttcaattctcgtaggatttatgaaaaaaaaaatctgcatttcaaaaggaccttaactggtcattagtgcctttttcgaaatttatctctctccactcagcaaacaatgatattttgaatgttgtactgtgttttggcgaatagacgctcaatctcacaggatcctaatgcaaacaggacaatgacatatgcattgtgtttcaacaaacaatctacaaagtccaaactagatatgcagtagcaaggttttcttttttataaaaatgtgcaatggtattgagaaagctatcgatgttattggtgtggtggtgaagttgtgcattagtgtggtggtgaagtcgcatgactatacttacaaaggatcaaatctttgtgctcataggtattacgcatatgtaggtgcaattttaatagatttttagtgattatagggatcggttgctagtctatgtttctttaagcatgtgaagcacactcattggcatatgagtgcgcatcttccattaaattttatatattaagaatatacagacatgtactccctccaacttaaataacttcatttttcaccatcttatttgtttcaaaatattttttttcaaacaat

SEQ ID NO: 73905 - DNA, 881 bp, Oryza sativa
cagttcggtctgaatcatcgtaggccttgggttaaggcaggttcgtgtgggttcacggccttgattagtaatactgtgtagctttaggatcgtctttataaaatggctttgggcaactaagtgacttttaaatgctgtttactgcaaaacttaacccctatattattatccccttgtactcccttgcattaattatgcatctccggtgtggcttgctgagtactgtggttgtactcattcttgctcagtctttccccccttcagtaagagaagctttggagaagaagtcttaggtggagtcctggcttataccccagttgagcgcctgtgaagatggagccgtaggcccgctagtccgctgctgtttattttttattgtcaggcctgaagtgcctttgtaataatgtaaatattatcgatataataaagatgtgtcttttatatcatgtttgtgtggtgtaccccggcttttcctgggacggggattaatacactagcgttcgggaaaaggcaattttctcggtcgcgacagcaagggtagagagaaccttcaaagattggtcttttaaaatttaactctccacaagtgttgttactatctattgtacattactacaatcccatcataacattgttatgaaagtgtggtaaattttataagttttgcagtaacaaagcatcttactgcaattcttgaatagtgttactgcatacacttgtggtaacgtgtatctgccatgcagtaacacttacacttttgtgcaggaacaaatatatggttagcatgtagacttttaactcatatatttttttttcgatttctagttaactacaatttcactacgatgttactatcaaaagtgcagtaacatcctatatgt

SEQ ID NO: 73906 - DNA, 5088 bp, Oryza sativa
cgtgcgccacgaggggtgttcccgcgaatctgcgatgcgttatctggccagtagtccgcgcgcgcggctgtgtaccgtgtagtgtaatcccgggtcgcgtgcagagcagtggtgtggtcgcgtgcgcgtggaacggtgggggagtcgcggcggcgtggtgggtgggtggggtgggggaagtgaccgagggagtggtgggcggagggtcggggacggtgaggacgggagtcggaacggggtggcgcgaccggaggagaccgcgagaccggtccgtcgtcgtcgtgcaggtgcagtcgcttcgcttcgacacgtgaaacgcgtgcccggcgtgcgagtgcgagagttgccggttggcggcgcggcggtcagcgcggatcgtgtttttttttatactcttctccgtcacgttcacgttgggatcttcgtgacaacacgtcggggtcttcgtgacaaccgagagatagttgtagtcataggtcctatttagttctaaagtttttttccaaacttccaactttccatcacatcaaacttttcatacacataatttttcagtcacatcattctaatttcaaccaaacatccaaacttcagtgtgactaaacacttctatactggtggggataacccatcggcaagatcacatctgggatatctgatcaaactaccggcattagttggtgcattggtgcgctatgcatttgtgcgtgcattagttggtgcattggtggagcacccgttcgctgagatgtgatgttcggtgtgccatgatgatagtgaatctgtgaatgctgcgttggtcaattgccaatcagcacaacctcacaccggctaacctatgcggacgcagcaattttgcctgcataagctaatgaaagatctcgcttagagttgctcgtgcatattatttgagaaagggattgctggtcccaaaaattgacagcaatttttcgttcttgcaacgggaaagagtaacaccctgtacgcttcgtgactgccacatgggcgtacggagggcaacctatccgttcactgtactccctccgttccaaaatatagcaacttagaatcggatgggacgtatcccagtactacaaatctggacaggagacatgtccaaatttatagtactatgatacatcacatacgatcctagattgttatattatgggacggagggagtagctacctgtggtctgtgcctccttttgctaccttccgacaatccgacgaatggtttggtgcacgaatcacgatcgacagctcacaggagggtaggacttcgaccggagctgctcgccaagacgccagccggcccacctttttgctaaccttggctcgcaagcccagagtctaggcccaagtgcatctcttttccttcgagtgaaattaggcttacactagcccattcaacgcagatttttctattggggaaaagtacaccgaaggtccctcaacttgtcatcgggataaaaaacgtcctcaaaccacaaaaccagatattcggggtcccttaactatacaaaaccagtcacccgaggtccttcggcggttttgaccctggttttagtctacgtggcggttgagtcagcgtgggacccacgtgggccccacgtattaggatgccacctcatcacctctcttatttcccactcttctccctttctctctctttcacttttctcaggccggccatgggcggcgctgtggggaggaggccgccggggggaggggagagaggaggtccggcggccggcgtcgcgccggtggaggaaatgccgccgtccgcatccaacgcgcgcaccggctgctgccacaccttcctcctcccctccacctcgccgccgcccgaaacagcatcggctggggcacccggcacccatggtggaggcggccggatccggcgagggcacgccggctggcgtcgtgctagcccctgcaaggagtcgaaggtcgtcgagatggctgcaggcaaacggtgggcaacgtgccgcgggcgacggtggccggcggcggcatggatgacgacgggccttctgcggcggagatggaggacgcggaaccgtgcccggatctagccgtcccatggccggattcgaagctcccgcgttgaatcttgccaatggcggcacggcaacaacggcgtcggcggctggacggcggggaggcagctagcgctggcggcggggctgagtggtggtgccggaggtggcggcggcggcgtatggtggtggtggtggtggtggcggcagcaaatcccgagacctggtggtggtggtggtggcggcggcggcggccgacgaggtcatggtggaggcggccggatccgtgctcgcgctcatcctcctcctcgtcctcttcaccgtcgcggcgcgggcgcaacaggagtacgaggtcacctcctcctcgtcctccttgccgtcgtggcgcggcgcgggcgagggccatcggccgccgcctcgggcgagggccatcgttctgctcctccccactgctctacgcttccgccgtcttcatctccaacctcctcaacgtcaccgccaccgccgtcgactcggtcgcccctgtcgccgccgaccccctcgtcctcacgtccgttgtcggcgacctcatccccacccgctggctagcctgcccgagaggagaagtgagagagggagagagagacagagaggaggaagggaggagcggccattgacgtggcatgctgatatgtggggcccatgtgggtcccacgctgactcagccgccacgtaggacaaaaccagggtcaaaaccaccgatgcacctaaagtaaacggttttgtaaattaagggacatcagatatctggttttgcggttaggggatgattttgtaactcgatgacaagtcgagggaccttcggtgtacttttcccttctatcggccctcttcggcctgttctaggctgtggcaattagtgcttgagctatggatctgtctagtaaatctattttaaatcctatactgattttgtggaaaaaaagtccaaatcaccctgaacaaactgatgtggcaagtggcaaccacggagagttcgagttccaatacaatacaattaacctttttctaagtaaaatgacccagccctatgttgttgaggtatgcaattctaaatgcatacgttaactgaacattactttagctccacaaattaagagtaaaatggaaattgatacctaggtaaccgtgtagtgataaatattttcaaattttcaaaagtggtgaaaacaacgaagaagcgaatttcaaaatataagtattttttagattggtacgaatatttagaaaatagatagaaataattgaagaaaatttatgattggttgagaaaaaaagttggtgaataaactaaatggataattgttacagaggataaatatgacactttagaggaagactcagaggacgaacagaggttgagagataaagatcgatagagaaacaactttattcaaaataaggtgctatgttaaaataatatctatattttgggacatattaagtagtaagttggtttccagtattttttttaatgaactgcaccagacactcgtgttgtttcattgaatggagtaggaaaaaacacaaggctaaaaccctggaaaggcagtagccaggaacgaaaaaaaaaacaccaccgtgcaccaatattgcctacacacaagtacacaacaacgctagcattggaccagatgccgctagaccaacaacgaaactaccgctgaaccgcactaaaccaaaccctaacagccgaacaccaaactcaaactctattcacatcttcgggattgaaggggaagagggtgaaagagaaaaatggatccgctctcccccacaaggcccgccaatatgatcaacttgcagaatttagggtgtcgtagtaagaggacaaacatatagagagagtacacacaagctgtcagagagaagttttggtaaggaggcctcctagacgacatctccaggaagaagagtgacaatgagcactgacgccaccttcccttgagacctcaaggagaaccaagacatggttttcaccaggaacgactcaaaaacggccctaggagggagaacgacaccagaagcgttgtcattgcttgcccggcatggccgggctaggtttacacctgccgctctccctagtcaattcgcagctattgctccaccaccgactatcctatctcaatgcgtggacactgctgtaccgatgacccccgccaaccagcctccgcatacctttgtggcacactgtcgtcgtcgcccttcttatcatcgccgcgttgacctccgacgatgtcagccagggcggcctccttgccgtcgcctgcattgacctcttgacgccaatctccaactgttgtcacctgcgccgatgtcacctgcgtcgccctcccgctgttgtcgttgtctctacgagccggccgctgccgctgtctatgtcgcgctaactctggccagatttatcgtggggggttcggaaacgggtagggatgtagatctgggcacggccatgccgaatcagcgaactccatcaccgctcgctgtccatgcacggatatgtccgactgcgccatcattgtctccgctaacgccattgctccctaccccttcctgtcactaagagtcactgtacagggggacgacctcccttgctagagaggccaaatcccgacccggggaggagggaagaggcaccagatctgacggcttcgtgcgtggtgcacaccctctgccctgccgccttctctctaccttatgctgcctctgtgctctccgtcccggcaccggcacgacacctccgccttctgagtcgcctcagtactcccatccgatacgacgtcctcagagaagaagcatcataccccaatcgttcttacactgtttagttttgactaccacacttatgtaccgatcaggtggaggaggaagaagagagtggcgacggcaatggcggttggtatagttgttcaggccatcttttaggtgggaccaacgcgggcggtctcccgtacttggaggttggaggtatcgtgcatccgaacgacagacttcacccggtgagttc

SEQ ID NO: 73907 - DNA, 4753 bp, Oryza sativa
tgcctttgtaataatgtaaatattatcgatataataaagatgtgtcttttatatcatgtttgtgtggtgtaccccggcttttcctgggacggggattaatacactagcgttcgggaaaaggcaattttctcggtcgcgacagcaagggtagagagaaccttcaaagattggtcttttaaaatttaactctccacaagtgttgttactatctattgtacattactacaatcccatcataacattgttatgaaagtgtggtaaattttataagttttgcagtaacaaagcatcttactgcaattcttgaatagtgttactgcatacacttgtggtaacgtgtatctgccatgcagtaacacttacacttttgtgcagtaacaaatatatggttagcatgtagacttttaactcatatatttttttttcgatttctagtttactacaatttcactacgatgttactatcaaaagtgcagtaacatcctatatgttttgcagtaacgtgacgtggtactatacttatacgataatgttactactaaaacatagtaacttgttatgagttttgtaataacatatatatttgtcttctaattagcttcttacaactatggaactttgtgtcctgtagagttgtaacagtttatgtgcttttacagtaatcgagtgtgttactactatttcttctcgaagattggtattttgaaatttatctctccataagtagtaatactaaatcattattgttactactttttattgtgtgttactaccattccatcatggcgttactgtatgtgtgcagtaacaactataacttttaaagtaacactgcatgttactgcaatttcttaatagcattactgcaataagaggtggtaacaaccaaacacaggtacaggacctatcacccactttgaactagtaaaatgtaaatgcaagtgatatcttttgaattcacatctttaaacaataatatctctcacaccacatattatatttttgaaccgtttgcaccgtaatgctttaaaaaaaaagctctacaaaactagatccgtcatgactatattttaactatattttattagtattactgcaagtaaggtacagtgttactgcatagtggtcgtcatgttactgcaccgttcgtacgagacaaggacaacaaataggtggatgtgggaggaagttagcacacgggtttgaccgacatggcagcgatttgaccgtcctttgaccatgctttgactggggtagcaggtgggttttgagcccaataaaaggagggggtagtgggttgggctcttaagggcgacggggggtatagaatagtctcaccatatatatatatatataatgattctatactcccaggagtaggtactcccggttccatccaccgtccatcagcgaacaccaccgaccaagtcagcaagcggatccagataccgagcccgttttgatttttagttacgaaaaaaatcctcataatctgaattattccgtaataaccggaacccttttgaatagctcgtattaaaatctcatgggtggttgtaaacagaatcgatagatcgatccgcaggttatctcgatcagcgattcgaaggcgacggcggcgcgacccatcggctattcgaaggtcgtggcatctgctgatgtctacgccggcgtcttccattaccaatgccttcggtatgactatccggaggcgactggctggccgaagagctatgaccagacaacgacgccgttgatcttcgggcaagtcagtgtggccgtgcggcgacggcatcgatgcaggcccatgctacgatcaagacgacgttgagcgtcgtccggaactggaacatcgactatactgcaggcaagtccttccttcttccgattttcttgatttgctttttctacgttgcaaatcgataatgcatgcatgcagatcgaatttgtttggtgcatgcaaatgcgagatgcatgtatcgtggacgtagatggtgctgatgacagaacagcccagcatgtgtggccgtgcggcgacagcattgtcgtcggcattgaaccgtgattcctagctaatggtgttaatccaggaagacacattcttgtccacctctctccggcgtgcggtcagcgtgatcccatcgatgttaaccgagatctgtctgtggggatgcagagattcttcgatgagccacatcgaggggtgatcccgttatgttttgttcttagtttccgaaagtctgcgttgatctttttctttggtctggtaatgtccattcagaattcagtgcccttctagggtatttcattaatttaggtttattcataatgcaacagccgatactttgccagtgattcaggcatacatctgaatttgcacgtgaaaagcatattaattattctattcaactgaaaagcatatgcatccagcttccatggatagcaaatatacgacttatctaagaaatactggtacatacttatttatatactgagtgaaaaaaagtagtatacatagtatataccgatcaaacaagaaggcagtataacctcctttagcgaggacgatgcagtataccgaccaaacatgacaattagtacatgcagtatactgacagaacaagtagtgcatacaatatatactcaaataataacaaatgcatatactgataaaaaaaagaagcagtatatactccttcaatgaggaatgtagtatatatacactgaccaaagagcagttcataccgattgtagaagaaataagtatataccactccgagtagctgttcataccgattggagaagaaataagtatataccactccgagaaaagtcagtatatatactcgttccaaaaaaaaaatcagtatatactcattccgtgaaagaacagtatatactcattcgctcgttgcagtagtatatactgcgcgtaccaataaaaagacataatcagtatatatatatactcgttagttctggagtaagtatatgatgtgcactagggttcccgatcttccaaaaggttctgataaacaacgatttgggcggagtcgccacacaaatcgatccggcttcttgaacgcgcacgctcttgagccccgcaattgcagcaccacgtctcctctggttatcacccgtgtcgaaacgcgaatgaccacaccgagaaggctaatccctgtttgccaatcgaagaacacaaagaagaacgagatagaaaaacaaccaaaattgcagatgaatgattaagctcacgagttggggtcttacaaaccgaactagcggcgaaactgttctcgacagattaatctaagcaaaacccaaaaacctaaacatgatggcgggtactgatatatagagtttagggtcgtgcaaacccctctcgatgcaaccctaatgggttccaacacgatacacgggccaaaggcccaaatacggtgacgcagcactgggacagattttggacgtcaaattgttcggtcaattcctgttgactcggaaagaatttggatgtgggagcaaaaccatttgaaaggttaccttcttagctttccatccatataaagaacgccccaatctgagcacgtatgcgacctgggcgcccgttttagtgcagactggtcctggactccgaattgcacccgacgtcgacttggtttgggcctccaccttgacttggacgtccccgatggtcctccatgactctaagtccttctccaagtgtctctttgtcccctccattgttcctaagcacaatataatcattaggttgcaatctattctcgaattcatacaaagaagaacataggaacgaactcacctctaaatttaattgtcgcgcacgagctcttgttatcggtccttgaatgaccattggaggattgttgtgtgtatccgaggtagtgatgtccgcatcatcctccccctcttgaattgatgtcgtcctcgactcaagctcatactcttctcccaagtatggcttcaaatctgaaatgttaaacgtgggactaaccccaaactcgggaggcaactcaagtttatatgcattatcattaatcttctcaacaattttaaaagggccatcagcacgaggcatcaacttagactttctcaattccggaaatctatcatttctcaagtgcaaccaaactaaatcacccggttcaagcttaacctcttgcctacttttactaccagcaattctatacttttcagtcatcttttcaatgttgaacttggttgactcatgcattttcaaaataaattcagcgcgtgccttagcatcattatgaaccctctcactagtaggtaaaggcaacatatcaattggagcacgagggttgaaaccatacactacctgaaaagaacttaccttggtagtagaatgtgttgcccgattgtatgcaaactccatatgaggcaaacattcttcccacatcttcaaatttttcttcaaaatagccctcaacatggtacctaaagtgcggttgactacctccgtttgtccatctgtttgtgggtgacatgttgtagaaaacaatagctttgtacccaacttgttccatagcgtgcgccaaaaatgacttaagaattttgcatcacgatctgaaacaatagaaggcataccatgcaagcgaacaatctcatggaaaaatagatcagcaatatgaacagcatcatcacttttatgacatggtatgaaatgtgccatcttagaaaaatgatccaccactacaaaaatactatccctccc

SEQ ID NO: 73908 - DNA, 4283 bp, Oryza sativa
gcatttgcttccattgtagagctagtgtggcacttgatcatctccacaccgggtcattgcttgttactcttggaggtgccgcctcctagacggcttgtggaggagttgcccggtgacctctccgagaagattgtggaggaggcccggcgccggtttgtgagtggtttggagttcaccaccttcggagtgaaggaagaactaccctgagtgatcgaggcttgggtagtcctctccgtgggtcggctcccgccttgcccaccccttgacgaagggggcgtgcggtggcttcgtggttgagcggtgaagttgggctcgcctcaacggggagtaggaaaccggcgagtttccgaacctcggtgaaaaatctcttgtctcattgtctcatttgattgtcgcatttacatttgtgcaatttacttttctagagacacacttgagatcatatcaccctaggattgcaaaacatcgacataggagcgtgatttactttcctagagatatatttgagccactatcaccctaggtttgcaaaacataacttagttgcttagttagagttcaccctcaccaagcctagcaacttagattagatttgattaggtgttatttagttttaaatcgcctattcaccccccctctagtcgacatctcgatcctacaagtagcgcgtggtttcggaggcctactctcccaacgcgtgtgcacacactcgtcaggatgggattatcgtagcagcaacaaccttagaaaatggatgaaagtgtatctcacttctcacgcagaagatcaaatccattctctttttataggaggaatggaagatgaagagtaagagtcatggaataggaagaggaatagaataactaattctcatcaactagccatcaactatcctccactacacaaccatcaaccaaccatcaattaggagtaattgatgtaggttaccaatgtaataggaagagaaatggagcaactaattgtcatcaactagccatgaaccatcctccactacaccaccatcaaccatctatcaattaggagtaattgatataagttaccaattcactaatcaaatggattaattctcaaaactcttcatcccattgatatcctataagagaatgaatacatatgaattcatagcataatgagccttgaaatttatttgatttaattgatttaaatggatcaattacccaattaaatctaacagacacctccacatagggcttcggcgcatgctgcaggtcggccattcacggcagtcacgtcgtccctcctgaagctgcatgccagtgttccagatgaatgaacgatgctctatgcaaactagctaaattttcttggcaggcagttgatcgatcatttatgcatgatcgtttagggcaagttttacggtggaggtggatgtcacatactcacatctaatttagaccatgtcatcttctcattaattaagagcaagtataatagtgagctataaaagcttactataagcttatgtggaggagagaggtaacaaaaaaaatcaaaggtgttggctcttatgcaagagctagcttaacacaagctccaagacaaaaataataaatgtgtaagtgagagatacagataggagaagaaaattatagccaaccttatagctaatctattacttctatatgtgttagctttaagatgggctaatagtagatagtgatctctactattatccttgctctaagaggtaacacatacaacatatcacatataatacactaatcccaatattagttcactctcacattgaacgcgctgatgaagcctagaggggggtgaataggctgtccctgaaatcttaaaaacaaatcgcagcggtaaaattcaaacagacccggaacttcctggtaaggaactccggaacttccggcctgccaagcccggaacttccggtgttctaagacaggaacttccgagtaacaaaacagagatgaaattcaaattttgaaacaggagactaagccaatcttcacaaaatggtgcacaggtattctaagcagaggatatatcacagaatcattcacagaaacatcacagaaagagacaagagcgattttttcccgaagttcggatcttgcgatcctactctccgttgaggagctccaaagagctgggtctcgattaaccccttgcctcacttgtgcaaaaacccctgaggaaatccacagccttcaaccccaaacacccctaggcaaatttctagaattgagtgaccaccaagatccaactcaacctacttctataaatccactacaaatgtgggttgctctacttggaaagcctttagaatctcagcacaagaacttcactaacttacctcgtttcctttcggaggagaggaaatccttcacaaacttacccgggacatccacaatatgcaacggattctcgcgggcgacacctaaccgtctaggagatcatctctaagagtaataagcaccgagatgacagcccacgagatattccaagtgctcacccaagatcctagtcttcacacatctccaaatcttcttctctccctctcaatctctctttctcacaagaattaggctctagattcagtggagaaggcaagaaacacttgggaaaggctagcaatagctctaggtttgaaaagtgaaagtggaatagcccaggacgagctggaaacgagctgtatatgtataacggctaggtgacgtcatctagccgttactcacaaatttgaactggaaacttgacaggaagttccggacctagaagaccggaacttccagactacacttgggaaaatctttttcacaagaccggaacttccggacttggaagacaggaagttccagacttgcatttttggacagatggagtatttgcaaaaatgactcctagggaaacttgacacttggttcacactaagagcacttgatatatcttagagcatcacctggaacccctcttaatagtacggtttttcctaaaaactcgatttcaaaagataaactatcctatgcacttctcgagttccggtccgctttgattttgtactttttttttgggggtctccaagcttccatcttccacaccttggactaatgcacctgaaagtcactcaatgaactcattagtcctttaaccacatttgtcattaatcaccaatacccactaaggggattaatgcactttcacacattatcttgcatttttcttggagattgtgtagaggttgccccttgcatgaggggtggctcattttctctctcctacttctctcctccacctcatcatttaatcatatgtggcaaatttaggccattcccaacccaagacattagactagttactataaactccacatcatcaagaaactagtactagatactacccttccaatacaaacaccactattccatacttaaatttattgctacttatctcacatgatgtcttggatgttgtatagaaaccatatctcatgcaagacatggtttccttctctttcctaatttattcacttgccgcgtcatttttcatcctagggccgtgtttagttgcaaatttttttcttcaaacttccaactttttcatcatatcaaaacttttctacacacataaacttccaacttttccgtcacattgttccaatttcaatcaaacttccaattttggtgtgaactaaacacagcctaggtgtcaacttatttaatgctatggacaccatcctagtcattgggttgggaatggccttagagcaagtttaatagtatagccaactaccggcttcaaatcatctatagtcaatttaatagccgatttatacaatagtcacctataaacgtatactacacaattcatagttggtcccaccagtcatacgcacatgtatcttggagtctgcgctgcagctggctacaaatttgtagcccgctgtccttctctcttctattttatcttcctgaaatgtgtttatagctggcttatagtctgctattgtacctgctcttagagcaagtctaacagtacagcccactactagctccaattcatctatagtcaatctaatagccaattcatacaatagtttcttactatactattaatatacagtcccacctgtcatacacacagtgtgtcttggagtccgtgctgcagctggctacagatctgtagcctgctgctcttctctctcatcgtttatctcattaaaatatgtttatagctaagctggctaatagccagctattgtacctactcttaggggctaa

SEQ ID NO: 73909 - DNA, 5315 bp, Oryza sativa
ggctgcaagcttgacttggtgcgaggaggctggtttagcgatgtctgccctgttaaaccaaaggaaagggcttctttggcatatacccatggacaattcagggcatagtgtccttgctctctacaatcatgacaaaaggggacatgctcttttggcattggaggctcattgacctgggtggcaaatgctcgatcaaacacacactgattttggtcttgacttccaactaatggtaactgtgaaccaagcagcatgctcggaatggaccaagggtgtgcccttgttaactctcttgaggccagtggtggattgagttgaaaacttgagttacttgaggcatacccgctgacattctttcctttttctctgttaaacatctgttatagggattgaggtgagagtggaaacaagccaggaaagaatagaccagaactaaagacaggaccttaaaggaactaactcttctcgttgatgtgctgtttgtttcacttcttctgcaagttgattaagcaaacaacctagcatggttacatcacaccccacagatgcaaaccacgcgctacacacacaagcaaggaaacacacaactaacgactctaccctagagggtggcttaggttctgcgacgggttctccaagatcttcactgcttcctccacttcgctagcagatcctgcagccttccggagcttcggcagacaattggcgacatcttcttcttcgcaaaactaaccatccagtactagttgaaatttgaagaaggaagaaagagtaaatattttgcaaatagcacaggggaaaggaggaaaaagggactttcggaaatagtttcatttataaaatatgtccataggttttatccacttggcttatcctacagtcgagatggctctgataccagcttgacgcgaccgagaaaattgccttttcccgaacgctagtgtattagtccccgtcccaggaaaagccggggtacaccacacaaacatgatataaaagacacatctttattatatcgataatatttacattattacaaaggcacttaaggcctgacaatcaaaaataaacagcagcggactagcgggcctacggctccatcttcacaggcgctcaactgcgtataagctaggactccacctaggacttcatctccaaagcttctcttacagaagggggggaaagattgagcaagaatgagtacaaccacagtactcagcaagccacaccggcagatgcatgattaatacaagggggtacaaggggtaataatataagggttaggttttgcagtaaacagcatttaaaagtcacttagttgcccaaagccaattttaaaaagacgatcctagagctacacagtattattaatcaaggccgtgcacccacacgaacctgccttaacctaaggcctacgatgattcagaccgaactggcaacccgaccctgggtcccagctcgtcccaagccaacccaggccaaccattccacattttagttgttgagcaaattttaagaattaaaacactaacttgggtacattgctcggcttgcccataaccgagggcgcggctattcgaatagattatactctgatcagaggtgtacatctttacccacaagacacatattcctcacgtgtaaccacgtgccacataccaccacggtatacggacggaagacgtgacatagttcccaacccattctagccataaacaagagtaccgacccaaccccacctacggtcggaacccctcggacaggtaggcaggactgagcccccagcaacagggacacgggccctgtgccatgacatctcgactaccgggccgcagctcgtgtagccttcatttgtcctagagatgtccatcgacccccgacttcgtccatctccatccgtgtacttctgtttataaccagactgagccacaaactaagccttacccactagacatgtggaagtacggtagtgctttgcacaaaggcccgagcttaatccttatagtggccggggtgctacttcccacaactagcatgcacccaaaccccaccgaaaaacaggttttaggggctttgaaagaggaagagaggggtatgtccaattccaccataagccaaccattccatagtatccaagtgatatgagaattccccaagtctaaagttataaaaccacctaatgttgcctaattaaacagcgaagcatctacctaaattcatactagtggaaccatgaatagagtgtccactagttggggttttgtttattctagggtaaacaaggtaataataacaatagcaataataataaggtcataacaaaggtaaataggcatggctaaataaaacagtgataacgcaggaatttaaataaagcgataatgcattaatttaaatcaaaataattttataaactgggattcaatatgctcaaggatgatgtgacttgccttgctcagagagaacggccttccgaaccttcggcgacgaccacgaaccacgcttcgggaacctccggaacgacgaaagctacgcgaagcacacaagcaaagctacaagcctataaagaagcaataacaatacataaaaagaaagcacagggttctttaggttataacaaacattaagagacttgaacgggtcgattcagagttcgtatgaccaagatatgatcatccgaagtttaatgctgttacatggagatttgcggattattgtaattaagctttgcaactataaaacatgtggaagcgctagcctggaaaagacaggaaggctgcgctgttgacatgcggaccccacatgtcaacctaaaggaccacggtagaccgagtacacagagacggtccacgggtcgacggaagcggaccccgtgtgtcaaccgaggcgaggggccaacaaacggactccactagacaccacacgggctgcacacgtggaaaccacgcggctaccgagcgggcacactaacacggtcaccacacgcacaagcgaacgactaccaacaccggtacacgggtaccggggtcgacaaccgcacaacgagcacgggcgacaacgaaaggacgaggacggggcagcaagaggggagaccttaccaccacgcgacgaggcgtgggaacgacaacgacgaacgggcgcggcggagacagacggcgagggaacgacttcggcggcgatccttggacgaaggtgagacgcggccggcacgaggcttgacgacgcggaggcgaggacgaagacgacgatggggctgcagcggcacacttgacggacgcggacgacggacaagaacggcttgacggagggacgaacgccacaacgagcgaaaccgggaacgacgagaggacgacgacgacgacgaccggagccggcgaggaggcgacgagggcagccggcagcggctgcacggagacaaggacggcgtggaacacgccgcaacgatgcccacgacggaggcggcgccgcgagacgacgaaccgggcgaggaggaacgatgacgatgacgacgaacactggcggggttcggtcgaaggggaggcgaggccgagggcggcgtcgcggctgcgatgcggaaggtggtggaggtgcggccaaccggtgcaccggtgaggagggacgggcggccgaacaactccggcgaggcggatggagaggttcgcggcgatgtgcggcggcttccgggcgaaaccgaggggtggacgaggtggagggctacgtcaccgtgccgagagaggggacggcagcgccggctgacgcacgggcatggcgaaaggggttgccggaggagacgttgacgaggaggaaggtgaggccggcgcgggcgacggtgttccggcgaaattcgggcgaggaggaggtgatgccggggatgagagcggcatcgcggagccgagggaggtggtggcgacgtcgaccggtgctcaggcagggagacagaggcggctggaggcggccggcgcggaggaaagggaagggcgacggcgggaacgcagctccgggggtctccgcgggaaacggagggcaagccggggaaggggaggccactgcgatgctggaggaggcgacggcgcgaccggacggcgctccggcgaggagggagaggcggctggaggcggccggtggcacgggagagaggaggacggcggggagagggctagggaccacgggagatcgcgggagggggctaaaacgatagaacggagcgagggggttgcattttatagcggagggaagcgagccgagcacgggagagggcggaacggcgacgggaatggcggccggcggccatggaaagcggccggagaaaacgcgggcgttcccggcgattgggggcacgatccaagggggaaattggggggaattgaagaggaatcaatgggatttaaaaccccccaattaattttggaatccatggtttgatttgcgcggatttggaggaggaacggctctaggttttcccggagagggagaggaggctgagcgggaggaggaagaagacgacggccggcctggcgcgtgggcctcacgcgggcgcgcggcgtcagcgcgcgtgcggcgcgcatgcgcacgcggctggctcaggcagggggggcgccgctcgggttgggcccggaggcggcccaggtgggagggggcggaacggcttgggccgagaggcggcccgggaggagaggagggcgagggagcccgggagagagagggaggagggagtgggccgggaggggaggaggcccaagaggaggagggagagaaggagagggagagaaagagagggaggagagggagactttgggctgggcttggcccaaaggaggaagaggatttatttttaggtttttctttttaataaactttgattattgtttttgttgcttaataattattttcggtgctctgaaaattcaagtaaaatttgagggctcctttttgaccaaggagaatttaacaaaaattctccgggccacattcgaatttttcttgtacgtattttagtgtttgccaatttctttctgaattttaattaattctattattccttttcgaaaatgatttttatttcgggatgaatttatcaggacgtgacaaatccaccccccttacaagaatctcgtccccgagattcgaggaggctagcatgaagataggttgggcggtcttctcttcttgtctgacttcttccgtcgcatcttttataacaaacttgcctagaaaaacttctccactctaggctgcttgtctcgatcccttgttgcagatggaatcttctcctcacctgacttgtccctggttgaacctttagctgacttcgactg

SEQ ID NO: 73910 - DNA, 7371 bp, Oryza sativa
aacaagtaataataacaatagcaataataatgtcttaacaaaggtaaataggcatggctaaataaaacagtgataacgcgggaatttaaataaagcgataatgtattaatttaaatcaaaataattttataaactgggattcaatatgctcaaggatgatgtgacttgccttgctcgctttcccaaacatcggcttcaacctccacgaaagcggatcttccgaagctgcagcgtctacacgaccaacggaaaagaaaaggcttttactctaataaactccatataaccagcaggaacaaagcacaaaaatgggttcttgacttcttaaggaaaaattagagacttgaacggtccaattccgagttcaaatggccaagttatggccatttgaagtttatatgctctttaaatgaatatttgcgaatttcttcatttaaattttaattaaaaaaaatagatttattgcgtcagccgaggggaggggcgcgcggaccgggtccacaggagtggggcccacgcggcagcctcacggtccacggtggaccgggtgcacgcggctcacaccgaccggcgccgtgggtcccacgcgtcagccgcacccgagggcgcgggcggctgacggccggaccccacagggcagccgcagggcgcgcccgaaggcggccacgccggcacagccgacgggaggcggcgcacccgcgccccgatggtcgccgccggcgaccaccggcgcggcggagcggcgcccgagagaggggagggaagggggaagcgaatcggcggtccacggctcaccccgggtcgacggcgacaacgggaacggcgaccggagcggaggaaggcggcggcgcggctcgggtagacggggacggcggcgttccggcgatcggcgaccgaaacggagaggtggacgaggtcggcgaggacgcggcgaagccgaaggagacggcgccgaagcgggagaaggtccggggcgacgacggcggcggaccggagctcggcggcgatggcggagagagagagcgacggcgcgagctcgattccggcggagagagagagcggcgagtggcggaaacggtggagggaggcacggggagcgtttatatagggttgggagggggatagagcggccggatgagggggaaacgggcgcggaagatccggccgccattgatgcgccggcgaggttagggggaaagtttccgagcaaatccgagggagagagagagggaagaatggggggaaagagggagggaatcacggggaatatttcccccctcttgattgctcgcggggcggacgggagcggcgggattcgcggcggcggcggcgctagggcacgggcgaggcggcgggagcggcaggaggaaggggatgacgggtgggccccacccgtcagcgagggtggcgggcgggcccgcccgtcagcggcgcgcgcgcggggagaggccggatgggccgcggggaagaggagagagagggaaagggatgggccgagctggcccaagagggagagggggagggaaagggaactttttagggttttctttttataaaatcattttaactttgtttatttcttaataataattatttgtgctctgaaaattccactaaaatttatttacgcattttaggcttttaggaaatatacaaaaatcctccaagccttatttgacttttaactttgcacattttaattgttggaggctttcacacggattttaattattctaggcataatttcgaggatgtattttagagtcattttgggacgcgacatcaaccgattgttcttccttctcctctacatcaaccggtttttccttctctatggacttacgcctccataccggtggtggtcgcaactcattgaaccttttatctctttgctcttcggcctttttctctcttatctcttgagcccgaagacgttgcaaccttctcttttaagtagccgtcaaatccttaggcatccacctaggattcggttctattccaggaggtaaataatgtcctctattaactttgtttgaagacgatgaagccctcacatcgccctttacaatccggtgctggagcccggtcagaccggtcgtagaccaccggtcagaccggtcgtagaccaccggtcagaccggtcgtagaccaccggtcagaccagccagatgcgtcggtcagaccgacttttggagcgcagtcagaccggcctgaggcgtcggtcggaccgctgtcgggtcgacggtcagatcggcctgatggcccggtcagaccggccgtatggccgcggtcagaccggccgactgcgatgagctggtaccggcttcggattttttgattggggattctccaactttatctccagaaggtattggcacatcatgagaccccactttgatggtaattacttccgaagtcctcgcctccaccttgacgcgctttccttccctcctttcttcattagcccgatttttaccataaaaccggccgttgtttggtgaagacaaacgctcatgaattggcctccttggtcctccccacccttggttgaattgcattagaggcatatgattgaacattggcagcgttgccccccatggcatgtaataaggataaggataacttggtggcggcattggataagaaccccatgacatgtcttgtggatgatgatatggaggtgaatgcgaccgtcttggtgaatgaccaaatcgctccctaggaggtgatcttggtcttttacctttgttgcgaattttctcaccaccttgcttctcatatttctccaaaagcatatcaaaagtcactttggtcttcctcggggcattagaagttgaagctccactcttattctccttccaaacgccaacctccggcttctttggcactatcatcttaggccttggctcgccaatgatcaccccttttcccttagtagattcggcttgctccggccgaatcaacaccttcttatcattgaaattaattgtattcaccggaaaaggatcatgatcaagcttcatcttggagccatcggtgaacttcaattgtccttcatctatggccgattgaacctatcgtcgaaacacattgcaatcattagtagaatgagaatgagaatcatgccatttacaatatactcgacgtttcaactcttcttgagatggtatgacatggcctttaggtaatctaatttgtttctcttgtaaaagataatcaaaaatcttatcacacttggccacatcaaaactatatttaacctcactttgtcgatctttgcgaggagtcggcattaggttagagcaaacaaaaggcttatttttattagtccatgaccattcggcaacatatatatcatgatcaccctcctcctcactatcactagcctcagggtaatcaaccacattaacattaggccttttgtcatatggtctaacaagttttttattatccttaacctggctttcttgagccagagccctttgcatgagttgactaacatcaagaaattgttggctatctagtctttctctaagaggagcaattaaaccattaaaagcaagaccagccaaatctctatcagttatattcaagctataacatcggtttctaacatccctaaatctcttaatgtaatcaatgacagattcattatacttttgcttaaccgatgtcaaatcacataacctaagctcagtttctccagtatagaaataatcatggaatttttcttctaattgaacccaaatatgaatagaatttgccggtaaagaagtaaaccatgtaaaagcattaccggacaaagataaagaaaacaagcgcaatttaaaagtatcactattagcctcaccacattgcgccaaaaattgacctacatgctcctatgtggtcttaccatcctcaccactaaacttggcaaattcgggaactctataattacggggaaacggcacattatcataataatcaggatacggctttttgtaaaccctagcacgattcctagtttcgatcccgaatctatccataataatatcactaattatatcctccatattattaggcccatgttgattcagcggtggatttggtggcctaataggttgtgtttgtggcacaatatgattatattggccttgtctagtatcgggacgataccccctagcaacatcattataagcattaggaacatgtgggggaacttggggattagttgtagcagtagatataggaggatcaaatgtcctaagatgatacaaataactagcattagtcattggatctatccgttgtatcggtataatcgcgccggtctgaccggcccagggcccggtcggactggcgtccagaggcacggtcggaccggcctgagtcccagtctgaccggccgtctggccggtcggaccgacggctaggtcgcggtctgagcggccgtcaggcccggtcggaccggtcgtgtacaccgttccatcggttctattacccgtttgatctaaaaccgagtttaaaaactcgagggtggatgaataggcggttttaaaacttttggctaaaaccgagttttgtatgcggaaacgtaaatgaaaacggttgagaggaagaagctagcctatgttgaggtttgcaagcctagggtggtaatagcacaaataaactctagtatgtaaacttactcaaagtaaatttgcacaaaataaaagagacaggtgacaaaggatttttccaaccgatatttggaagtttgccaacttcctacatcaccgttgaggtaagaccaacttcaccgctcaaaccacgaagccaccacaagcccccatcgtcaaggggtgggcaaggtgggagccaacccacgaagtggtctcccaagcctctctcactatggttgttctttctccactccggagatggcgaacaccaagccactcataatcaacactgggcctcctccacaaccttctcggagaggtcaccgggcaactactccaaaccatctaggaggtggcaacctaggatgcttgccgaggatgatcaagtgtcacactagctctaacaattaagcaatgcacttggattagcttaacttactctctaatacctcactagataaactaagtgcacaagggtgtgtgagtccacatcagtagataatgcaatcgagtaccaaaacattacccatactgctggggagtgggtatatatacccccaaccatcaaaactagccgttggagtcgaaatccccaacttttgtgctctgccggtcaaaccgccatgggatggccggtcagaccggacatttctagccgttgcagtgcattaaatgcactgacacaagggggctggtcagaccggccacgactcggtcagaccgccaacatctcggtcagctggcctcggctctagcggctctggatcaccaagacgagacctctcttcaaattcagggcagcggtcagaccgctatgggagctgcggtcagaccggacaacacactccggtcaaaccaccataagggttgcggtcagactgcaggtcacttttcagctcaattggacgttagtaaaacgacgatatctcttgactcgggtctcggaatttgactttcttggactctatggaaagcttattcaaagggttatccaactcatgaacaattaatccaagatacacaacttaatttagggagaaagggctcacactccaaaggatatccatcggacatacccacaagatgtcgctcactccttttggacatgcatgcccacttctctctttgtttgggacttgagaaaactcatcacacttggataaacatgcccaccaaatgcacctacatgcatataaactaatatggcacaagatcaatgcgttcgcttcatagacccctcttgatagaatgacgcctatctagcaagtcaggtctacaccaaacactaacaccggggaaagactatgaaaacaatattagttctattatatctttgccttgtgccatccaacttggggtcaatgcttgagctaagatcaacactcgtgaccattcgcttgaaccatatttatgccgaagtcttaaccatcctttgtcaagactttcttctcatcacaatcttgacttcattcttgtcaacatggcgatgtccttggcttgttgaccatcaacccattgtgtcatccattagcctcatcatggtgggacctattcctttgcgcagctcaaaggagaacattagtcccaacaaatcggttgtcatcctccacttgatgaccaaccggttgcatatgaaagatatgaatatgtttgttgagtattcattatacattaacaccacaagtgccatatatatactcgtacgcaagctcaagtgcaaagatccgatataaataagaggagaataacatggatatagaacatacacaataaatgaataggatttgcaccccccaaatatatgcatacaaataaatttataagaggggcaagtgtatgcataagtaaagaagaagcaatgaggtttatcctatacacatggagaaggcatgtagcaatgataatgataaacaaaaacacataccttcatgatctccatgttctcaatgtaaaggagactaaataagataagactcaagtaaacattagtctcacacttatataacaataacatgaaaatcatatatatatgaacctatcaaaaggtaggagtaagaagtgatacatatcgctttatctccatgcatttcatccttatcatgattaaggtccatcaccaaagaatgcatatctaccacatctcatcattgggaaataacctagttgacaacttataaaaaagagaggttaatcccataaacattggtttatcatctatcaccaaagtaacaattacacaaattgtttaatcccagatctttcaatcttttctctctttagtgatagataataactggatataacaatatagaaagatgagatgaacgataattttaaatcaagctagagatcttataataaacaaaatataaaataaactcccccttaagatatgcatacatatggatataaaggaacgcatatgcacataatcaatcaagatcaatgacggagctcacactatattttggatccacaagagagaccaagttagaatatatgaagtttaatacatacctctcatcaattttattttcatatccaaatgagactagccaaagaaaagctcataaaaacattagtctcaattaattagatttgtcattaattaccaaaaccaaattaaggcacatgaacttacaatctccccctttttggtgattgatgacaaatccattaataataaccatatttggatatgaaggatataaatcaacattatatt

SEQ ID NO: 73911 - DNA, 2166 bp, Oryza sativa
actccaaaacgtaatgtgtgcatgataggtagaaccaggtattaatagtattgtaagcaactattgtatgaactggttattatattggctatagatgatttggagctagtagttagctctactaataaacttgctcttatagtacttgccctcattggtgcgcgggcaatgcattgcagaccgtgaacgctaacgcatcggcaaacacatggcacacaaggatcaagaaaactacatggttaccgggactcaagacatgtaccaccacgcaagggtgtgtttagttcacatcaaaattaaaagtttggttgaaattggaacgatgtgacgaaaaagttagaagtttgtgtgtgtagaaaagttttgatgtgatggaaaagttaaaagtttgaagaaatagtttggaactaaacacggcctaactaacatagttgtttaagatcagttgcacaagcaaactggcagatttgttcagaaattcagtttaggacttctgggtagggaggacagtaaagctctactagtactctatcgtcactcatgtgtgctagcatcatcgcgtggaatcatgcacccaagagatcccctcgtttgaggccatcagcaatgtccaaatcttaccaacggggctctcaacaaggctctgctaactcaaccaatcttatctatcttgctgcagctaaaattgatgcagcgtttcttgttgacacccagagccattaatttttcgtatgtactggcctaacggaagtgttatgtactggagagtttccttgtcagtgaacagatcatagattttttttagaaggatattttttacctagcctctacatccaaccggatatatacgtgttatgtactggagagtttccttgtcagtgaacatatcatagattttttttaaagaaggatattttttttacccggcctctacatccaatcggatatatacgaccattgaaataggtaacttagccccgaaaacaaactaatcagataacttagctctgcaaacaatctaatctgaaatttgcttctataaagatttgaactcagaaccttatcatactacgtaggtcactgtaactactagcctacgtaagcatgccggcagagtgtgtgggccaccgagtttccctctcggtatatttgtcgcacgtccacctcggcgaagcggcgcagcagttcgaggatctcctcgtgcgtcgccgccgggatcgtccctcggacagattgatcaagaagaacttgttctcatgaccaataacttcattaatgaatctgacggcaacatctcttcagggagcctgatttccccacatttgcaacagtggcagttcatagccaaccttccagtccattctccaggatcctcgcagcttgattagagaccaggacctgatgacaattgacaacgcaacctgccgcgtcttgtgttcagattccagatgcctctcaagcctatggaactgtaccgcatgttacaaacaaagcttcgatcgaactctgctcacatactagcttatcatgaatgagcttaattagtgactgtttcctaatctctaacctagcataagccttgaaaggcacaccatcacaagcgacagtagaagctcttttttagtctttctccaatccctcatttcatctgaaacacatattgtagccatctctaagcttgtgccctcttttatccttcagcacattggacaggtccaataatgaatatctgcagtatttatgcagtatttactgtttctgacaaacttctactactatgcatgatatgtgctccctccgtctagtgctgtgtttagttcctgaaattggaagaaatttagggaaagttggtagtttggaaagaaagttgggagtttatgtgtgtagaaaagttttggatgtaatgtgatgtgatggaaagttgggagttggggggaagtttggtgtgagttaaaccgggcctagaaatataggggacttttaagtactcgctccgggctgtgtgtttagttccacgttaaaattagaagtttgaagaaattgaaacgatgtgacggaaaagttggaagtttgtgtgtaggaaaattcgatgtgacggaaaagttggaagtttgaagaaaaaagttgaatctaaacagggccccggtccctaaatataaggaattt

SEQ ID NO: 73912 - DNA, 1643 bp, Oryza sativa
aaagacaggctccgacacagttataccacacaccggcataaccatgccccacacaacccaacaagaagacaaacgagaaagaacacacgcgcaagcctactaactgctcgtctaccgctgcgacgggccaggacggaaggtgagcaacagcgcatcctccgtgctaccaacgctggaggcttccccctcctggggaaccacgggcgcgggctcggcacgaggggtctcgacgaagcaagtccacgccagggactgacgaacaagctcgggcctggaggtgctcttgcgggcggtgatcttctggctgcggcagacacggcgacgcttggggcggcagacctctccctgggcgatcttgagctgatgcagctgcgcctccactgcgtctaggtccttcttgagctgcagattctcttgacacagctccaggatcttcatgttgttctcgaccatcccacggcgcaccatctgatggaagtcgatacgagccgcgtcgtacgcctccaccatgcacgccaggtgcacgagggtagcgtcatcctccgagctagcatcccggaaggtggcgtagtcgtgggctcctccgcggcgaggggggtagcggtaggcgaagtgctgcaactcgtccgggtatcgctggtaaagagtgccgatggcgagaagagcggcgctctggcaagcgcggggaaagaatctccacccgcggtgactgccagcgaagtccgctcgggagagccagagaggatcactgcagtgacctcccaaccagcgtggggctttgcatcgtcaccctcctgctccggaagcggcctggcctggtagtccactccatgtggataccccaggaccacgcacatgccccgcagctccaagacgaagccagtcatgtccaaaccacgacggctgacgctaccggccatctacaaacaaaaacagaaagaaaaaaccacattttaaaggtcagattttggcgataaatgaagcagcaagacagagagagactagacagttttcacaaataacaaaggatttttatttttgaaaatattgctaaggcttgggatctacggctcgtcctagggtcaagggggctctgataccaacttgtcacgaccggaaataacccaacgggcgttccttatgtgcgtgcattaatccttgtcccaggaggcaaggtacaccaaaagttgatacaattcagagtttaacaagcggaagcgtaaatagttaatttattacatgggcagcgaaggcccagcacacgcaaagacaaacgagaaacagcggaagactagggcgacgaccacaggcacttgacggcaggcacgagctagacaccaaagccttcatcctccaggaactcctcttctgggtttgggaaaaattgagcaagactgagtacaaccaccgtactcaacaagacacacccacaagtgcagaataaatgcaagggagtacaaaggagttataatataaagggttagggttgcagtaaacagcatttaaagatatttagttgcccaaagctatttcttaaacacgattctagaactatacaatattatttatcaaggccctgaacccacaccaacctgccttaacccaggcctacgatgatttataccgaactgcaacccgaccct

SEQ ID NO: 73913 - DNA, 2031 bp, Oryza sativa
tggtttataagcataacatgcatctactaaccatatgttagattctaaggtcgtagttttgtcatcttctgttcacgattcagcaaaaactgcactaccagtagcattgggaaaaaaggatgaaacatagaattgcagagtggagacttaataaggataggttacctcttcaatatcttcaccagctcttataaaacttgaaaccaaaatccgagctttgcgaacttcttcctgtgggtaagctttcaaacgcatgcctatttcacggtattcatttgttagcctttcttcctcagcttcctctttcttccgatatgcattccattccttagtcttttcccgctgacgagcttgccattcctgcatgaaaaatcctaggtaatctatgggtgcagaaaaatgtttgctgctaatataacaaggagaattaactgcactggtgtttaacgagaatgtagcttcatatggacataacagcttagctggcggcaagaaagctgtaggtatgcagacgttatttgccacaagagtaaaagtatgagtattgactctactgaagtagccttgatctagttaacggttgcagcacactggcgtagtgtcatttatgtaccattgtacctacatagtcacgcttgatcaggaaacatatgtggaaagccatcaacgttgaacagcacatatttgcctttttcttatgcatattgacgatagagacagagtcacctccttttttgtgctagtgatgaatttgattatcatagtgagcagagcaccagtccccaaaaaccaagtgccaaaaccctccctgtagtccttctatttgccaatgaagctaacagcggtaattgagggtataattagcccattatgaaatgaaatataaacagttgattgttgattgggtttgtaaacatttacaaacccaaacaaatttcccatgtggatgtgtggctacagataaaacaaacaggtttgctactattgaccacctagaaatgggaaggtcgttctaggttactgtacaactatttcctggtttcacaacatcctcgaatcaatacgcaaattaacgtgcctaacctcgtcgtagtactccggcggcatcccttccagctccacctccttggcttcggcggcggcgcccttgcccttctccacagctgcagtacgcgaaacaacacacgaaaaggttttcatcccaaccatacgagagggggcgctaccgaagagcgtacgagtagaagcactcgagccgagccgcacctgagatggcggggagcagcttgacggggcggagagcgccccggcgagaaggcagagggcggggccacgggatgcggcggggaggcgagctggatgaggggaggagaagcgaggcgaacgccggcagcgcgggcgccgcggcggccatggcgcgttgtcacggcctcacggggttttgtgggtatttttttttcggtgtagcggataaaccgcgaagggcgaagcagagagaattctatcgagcggagtaaacggacgcgcccgcagcccactgcacaagtgaacaccacaccaccaatctccactacaggcggagccaaaaatttaatcatgcgaggtcaactattagcttatatttaagttttaagtgagattatttctctaactttttaaatttatacataaaaatgaaggattttaagcgcgtttttcaaaaagttgtggggtcagctgacccatagattgtgcatggatccaccactgaccgtcaccacttcccctctcccttcaaaccctagggacaagaggctggccagtggcaaggcaaggaggctagccagcgtcggcaggtggcagggtgatgggcaagaaggctagggggggtgcctggcgacaaggctcaacgcagcgacgggacctggagacggcgtcgacgcaaaatgggagcgcagcgcacgcgtcggctccccttctacggtaaaaccctcatctctttctctcttttacatgactgttcgcgtcggccattcgcgccggggtgcagga

SEQ ID NO: 73914 - DNA, 2736 bp, Oryza sativa
cggcttctgattatttccctgttgtgtcttgaattgagcaatccgacgtttcttctgctccatgcgattgtacttgtcctcctgacgaatagccttatccactaatttctggaaatcaggataatctccaaccatgagtgggtaagaaagctcatcattaagtcctcccaaaaacttctcctggcgctcttcatcattgcgcacatcttccggagcataacgagcaagacgattgaactcgtgcagatactccgtaacaaagcgagatccctgggtaagcgacctgaactccttcttcttgagagacactactcctgatggtatatgcgtcttccggaaagcagcggtgaattcaagccaagtgataggttcagtagtagtcctattcaggcggaagtgatcccaccattcagaggcagggccatgcaactgatgtgatgcaaatgagaccttctcctgatcagtgcactgaagtaaatccaacttcttctctatggcatgcagccaatcactagcttcaacaggattagtggtactagagaaaacaggcggcctcacacgaagaaatcctgctaacttgttctggggagatgcatggttatttccttggttttgctgattctgaaattgctgcatcatcatgtacataagctgtgtctgttgagcaagaacttgggcaagagtgggattctctccattgttgttattggggttgttgggaccattcccgctgctgcgagtgttcaccatctggcatggacagggcacaagaagagaaaccggggaaactacttaggacagagaattactttaacttttattgatcttaactgagtttcattattacaaactaaagactctcacaccactaaactcaccaacttcctaacactcaaaagcaaacaaacgcatgcacttacatcccaccactgatgtaaatcacatgcgagccacacacaagcaaactttaagcaagcaaactaacacaacgatctaagacaacgacttaacaagtcactctagttcttccaagcatcggaggtcgattgaaggctcgtctttatcatcttgagttgctacccactcaatcttggaattgttgcgcttggattcttcttcttcatcacttatgatgatgaccggaggatccgcttgagctggggcaacttctttctccaccacacgaacctttggcgccagttgatagcgagggacaaatagagctctcttccttgcggtaagacgaatcctggccttctgcggcggtgcttctcccttcaatgcggctaattccttctccaaacgatccaccttgtcttctaacttgcaaatcttaccacgattccggtcttcacgatcttgagcggctaacacagtctccgcacgactttcatccatagcccacaacatctcaaccaaatgcttcgtggtagcatcattctcaattccttcagtctcaaggtactggcccggtcacttccctggggttggcgaggatggtagcgatactcagtgtcggccaactgatcacggtagcgatcacggagctctcctatggcgatccttgccacttcctgacatgcatggatgtagtttcttcctccagcttcaaacatcactgaggggatatcttcactattactgttcaaggtgactttgactcggcacttctcttcatgacgatcatgaggaatctgggcataaaaaggggcagtcccaaatccaatgacaaaggacatcgtacgcaactcctggacaaaaccctcaacaccaaacaggtactcaggcttgtaacgcggcatctaaagacaagtgaaaggagggagttaagacctttatccaattaatagcacaagtttttggattgatttgaataaagttagaaaatcagagtaaaaaggtaagtaaataaagtaaaccaagctttgcgagataagttaaaacagttggaaacgaggtcacaaattttgtaattttgaataactggtttcaaaagaaataaaagaaagttatgaaatcaacatgctaactttattttattgcagcaagattaaataaaaccatattgtaaaacttttgctggtaaataagccattagtacagtaatggatgtacagtactaataacactggaataaatttttaaatgagaaccattaaaagagattatgaagtgcatgtgccattagtttggtttaattaaaagagaaagggaggagaacagttctacttttccaatatttttagagggcttctatgggtaaccatttggcataacctagggtcaaagaggctctgataccaacttgtcacgcccggaatttctatccaaaattccaaacgcttacatgtgtgtgaaccctcatccaggaatcagccgaggcacacaataacaaattgataatagagtacaattattactctaattaataagcgaataaaatgtcgttacagaggtagatagttcctctcaatcaataaagatctaagcagcggaaaataaaataaacggcgcagacggctccactccacaggcagcttgaccaaggctacacctattcctccactccatcagaatcattgtagaactcttcctctgatgaatgattgcaaggtgagtatatgacatactcagcaagccacgcagcaaatatgcaagtgcacaggataacaaaggatggcataatagggttgcatttgcaaaagcagcatttagcaaacatttgagaatttgata

SEQ ID NO: 73915 - DNA, 6985 bp, Oryza sativa
cttcctcctctccaccttcaccctcctccccaacctcaccccccaaacttgctctaacccaagcttgtcacaatgttatctagacatgtttgtaggatacccatctcgcgtgcattcccgaagtagtttttttttagtttgctatattttaaaacagggtaattctatagtaataccaggcaacacaaatagctcgggcacagaactcttgttggtgcaacttctagttgcccacaggggcggatccaacgtgggtgcacgggggacttgagtcccccctaaactcataaaacccatggataccccccggagcacccctttaattttttcactataaatgataaactaaaggtccctagatggttggaagttaaagaataaagaaactgtgtaattgagtcccccaattttttttttttttgatccttatccgccccaggttgcccattttatttcgggattgcacaaatagcgtgttgggcatcggcgcctgaagctcaggcatccagtttcggacgccggactaacggactcatgctaatgaccctccaggcgatcaggtcaggcagcagcaaaaatcaggccaccaaccaaacaccaggggatataaaggagagctcaggtcaggctagctagccatcgacagcttaatagcgactccgtgacatatgctgacatgggagtacatagggcatccgacaaggcgagttatattacacacactatgcaggtcaaggaaatgcagagggcaaccagaacaccgtgacatgaatatatccaatgtttttattccttttcacagttcttttattattgcatctgtttgtttctttttcagtgtttctttgagatttcaaccaatcccgccttacaatacaaacatggcacaaccacttgtaatcggtgtatcttttcactggaagtatattatttgaacagtttccaccctatggcagcctgaagcaacaatgttgccattggggccaacagacttttgttcaccggacccctccatcggctggcaagcccagtgtgctcctgcaaccatggtagttcaaacacaaagcacgccctttggttagtcttccggtgaaaaaaaaatcagtaaatgaatgcttagtatttagggtaagattaacagacaagctagcaatgaactagcgatggttgaatccaaacccaaacttctgctatttttaaaaggatttaaaaatcaactgtgtatgataaagtttaactataataaacagttagtttcataattaaaagaaaaactagatgggattcatgttggatccagatctccgttcagaaattatgcacaagagtaccaccagttaatctgatttatctagagatgtgcccttctatgttccatgattccatctatacaaaaaaattgccaatcaatgcagtaccatgtattccttttctaaaaaatccagtactatgcaaatcctaatgtagcaacgatcttcaagtcaaatccaaccaacttaagactcagaaagtagaaatacaattgcataaccaaactgaacagctagcctgcacgttcttaactgaagcaggctgtcaacgtgagttgacatagcagaatgcattttgctgttgcaaaaattgtgtgtgtgatatgaggtcatcagaaagattacaagataatgaagtggaaggacttttaagaaaataaattttacaactcttttgctataagtagagttacgagaacccgacctcaaaaaatttggtaacaatcaatcaataaaggtaaataataacttagcgaaaacgtttttcgtgtacaacggtgctacgaggcaaagttatagatactacaaaaatactgcaagagcatgctactaacaagtctaagcagagagccagagatcacatatttacatgtcataattgccctataagctgtaccaggcaattttagtcttagatatatgctagagaacaaaattgaactggtagcacatacatgctactggtataatcgaaaagctactaccaataccaggacacttggtgtcctagagaaacagaattagtgacagtaaggatagagtagtagcattcattatgaacttcaaccatccagaagtgatactaatgtaaattggtgatccttttttaatccgattccagaaactacaaagctcaagctatcaacagtactctaaagtctaaaccaaggcggtttataaaaaaaattgtgcgtgaagcacaattaatctcagcagcagtgcagcatttttcaagtcatgccaaactgaaataaaacaacgatagacagtatcgcctcatcgcatcagtaccacaaacacagtacttccaaaccctccattgtcaaaattcatttcaagattttggttttctgattttcttagaaatggtataaacgtgctataaggtgtgtctataaacaaggtatgacacattagtgccttaagatatacataagtaattttggcctagcaagtgcttctcccaatgacggttaggggctagatgccggcatgttcccatgctggtgtttaatacccccaaaaggccaagtggactggtggctcatctcagagatcaagaatagcagatcaggagcaaggagctagctagcactactgagctggtagtggcccaatcagaagctagtgcatgagcttgcggcagcagtagagatagagcagggtagcagcagtgaatcaatttagtaccacctcggaaatttagatagggccaaacgaacttgtaaacctggcaggtatgaacagaacaatacagctttagtctttattctgtgaaattaggaaaaaagccaaaggaagtaattgcgcaggtgagctctaatccaaaattgggttaggcctgaaacggagtcaatcactcaaccctgtacttacagtggtgcaagagccaaccctcgcagttacaacagactctcgttgtggaccaagggctcgggcatatagtgcaaggcgcgtgtggtcccaaagtgggcacacggcatggcatgtatgtagggcactagagaaacaaatgtgtgctaagaaggggaaatcctagtcatttctcagaaataggtaagttagtttctcgaggacatacagcttgttgaggatggtagcatgtgatgccccgaatcaggaaggggctgctggcacatcagagatcaagcagagcagatccaggaacacggagctagctagctagcacttgtggcctgttagtggcccaatagggagctagtgcatgagcatgtaggtggtagcgatagagcagaacagcagttaatcaatttagtaccacctcgaaaatcttgataggccgaaccaacttataaacccagctggtctgaatgaaataactggtttaaacattttccacgaagcaacaactaaagcaaaagcaagttattgtgcagctgaggtctatccaaaaatggggttaggcttagggccgctagaccctggatgataatggtacctagcatcaagagaaacaatggtcccaaaaaaaatcatttacaccccagcgtacttgagaaaagtagcaatagaattcgaattatgtccacaaagacaagataaataagattaattaggtaacaatgtttgccaatatttgatcatgttaacaggatgctgcattcatttggttacattttttttccagcacagcaatttactcttgcagcctaattaattttccacaattattgagtcccaaactcatggccaaattttagcaacggtagggttcagcgcaaaccaaatagcccaaaataccatggagaccattgaatggagtattggcagaattcattggttttggagggaaaactagatgaaaaagttcacaccgacatactgatacagatgaatcaggtaaatcccctaatcacactccgaagatcacacagaactagatggccatactgcccatttacaaataaaaggacactaaagatatagatttaatgataatgtaacaagataacctcaaactgcaaacataatcttcatctaaacacattactaacttgtaccccccacgctgaggacagaaatgctcttgctatctgaagtgtattataacagatttgcattctagcatggaaattgtcggaactatcttgcaatggtgaaactgaactaatctgatggaagttgtacggaatggcatatggtcaacgggcactcacctcttgcttcggcgcttgctctttggaacaccccagccctccagcttagcaatgggacatccacaccggttgcggaagagcagtacagcccggccgtttggtggagccatccgccgtagctccgcgcggaggcactcgtaatccgggttgttcccaccctgcccgcccttccacggcagcgcctcgatctcgcgccacatggcggcgtcggcgccgccactggtgctccccgtgcctgcgcgcacggcctcctcggtctggagctggacatcgaactcgagcgccttcacgaggccccggcaccgcgggttgcggcagcggcggcgagggaggcggctgcaggagaggaaggtcgccccggcgagcgccgccgcggcgccgaggtagggcatcgcggccgccgcggaggcgagcgccgcggcggccgggggcgaggcgagcagcggggtcagcgagcgcgagacgtgcgcgagcgaggaggcgagcaggaacgcgaccgagaagagcacgagcagcaggatgaggagatcgagcgtcgccgacgacggcgtgtgcctgcacgccgacgacgacgacgacgacggcggcggcgggtagaccgacggcacgtggtgcccgccgcccgccgaccgggaggacgacgacgggtggggcatcgccgacgcggcggcgaagggggcggcggcgacggcgacggcggcggcggcggcggtgcggttggaggaggggaatggccggagcatgacgcggccggcgccggggggcggtggattaatcgggtggactcacttgggcggatgattaatcgggatccgattccttgcttgccttgtaaatggctttctcccttgcggcgagttggggttttggacgtttcggactttgcctttcccttttcatttttctaatcgagagattaatcctaatgatattgttttattaattaatggcttaatttggaacacacagtttgtgattgggtcgggtggtgttggtggtggatcagtagatcagtttcgtctggattggaacaatgtcttttgttattgatgaatcagatggggtgtgtgtgcgcaaattgacttgctcagggtgatttttttttgtttgttttgtttactcgagaagctcagtgtgttattttaattaaaaactatctaatttaaagtaaaaatattcttattagacgtcattttcttgatttcgaattagaatgtgctaaactgtggttgcaggtacagtgtctcgttggctacaattaacatacatgtaagagcatccgcaatggtaaagtaaagtgttatctataaaacatgtacatctcagcaatagactagattaatagtaaaccatttcaatggtatgtctacatgggtatttatagatctctaatccattgcctcgtttttctctatagactattttcaggttagtagatagatagttttgctctctctcttcatttaatctcttctaagtagaaaaatatgctgacatggatctcttgtagagagcctatagataaccattacaggtgccctaatagtttaagacgcgtgcttatgaaaaaggatggaatagttccacttctcattagaactcagcgagacgaaaagatgtctttgataaaattttcaaatgctctaaaacttttgctatttgttgtatccagacatcccaaagttttggatgcattttgacaaatcgtggtttcatctaaaaactctttcaggccaacgacaatactatttcgttccaccaactacagatgttgatccatcctcgcatcattttgatatcccacttaaatttaatcctttttttctaatgaattcagatttttgcgtgtttggacaaagagaggggagattagtgcctttgcttgaagctttttctaagatcaattcatgctggaagcaccatctgttcagaacttgttgtcgttgtcggcaaaatgacaaatggcataatttgaagcaccaaaaagaaaaaaaaagacgtagaccatatatattgtgtcccctttcacagcctcacagtacagtatccggttctagtttcaagggcaatgtcccgaaagatcatcaaacacttcttgggtatcacaacccttcctcctgaatatattgacaatgtaacctacaacaaactgtacaatcagttctactattcactaccgttgctaacggctttgactaggtccaaatcatctgacactgtaaacttgctttcatgtacagaacggcaacaaaatcttggtgtagccacccaaagaatcgacaaattgtcctcctagttttgaattctgttgagtacagttgggagcaattggttgcaaataaaatgcctgattgtcagcgaggtggtcttggaaaaaagttgttccccggaagaaacctaccaattatacgaatgaaattaagaggcatcctatggagtatggacatatgatccttagtaatatagattttcagctagagaccaaatgagacttactggtaagtcaaaccttgattcaacagcaagttcagtggaactgctccatccagttcattgttctgcaagaatctggatgaagagaaacattttaacagattgtcaaatggtgttctaacaaggtggtgaaacatcatgttggttatgaatccaataagcatatatggacattcaagatcatcttgttgacaatatcatattgcaccaaagaataaagcatgaaactgacataacatggtacaagcataaacctcgatgaaaccacacaaaatgggggcgcag

SEQ ID NO: 73916 - DNA, 1003 bp, Oryza sativa
atgccactgactttatcacaggtctatgatataccattgattttgttacgttttacaatatatcatcgacttttgcttaacttctacgatttaccatcgccatcgacttttgcttaacttttatgttcactgagttagtctccgttagtactgtacaaatttatcgaaatgaccaaaatacccctgggacagaaactttcaaaaattttgaaatatcggattttaagtttttgccaaattttggatatttacaatcttatgtttataatatgatattttagaatttttattcaaatttcggaagtttttttctaggagtattttggtcatttgggcaaaattgtacggtgctaatggaggataaccggacggcgatggtaaatcgtagaatttaagcaaaaatcggtggcatattgtagaatgtgataaagtcagtggcaactcatagatctgtaataaactcagtggcatataatagattctctctttccgaaattaccagaatttcggaaattttgaaactaaaattacaatccctgctccagggctgcattgttcataaggatgtagtacgtcgtagcatcttccactgcaagagtaaagacatgattcgaaagacaacaattagcgacgtgtccattttgcagctttatcggtctataaaattattaagggtgagtaatgctgtgaaaatcaaaattttatagtataaatgtatggacggattaactggtatgaacacgtcctcggccccaaggcccaacagcccaaggctaacattctgtcttggcccattacgcctactttccattgctgtcaagatattcttatggaacttgtcgagaaaacagaaagaaatcagtccagcaaacgcaacaggcagcattatatatcagccttgctaataataaacggcatcaattgtctctaattacagaaataccggctcgggttacaattatctatttatagccagcatcaattacgataattaacattatct

SEQ ID NO: 73917 - DNA, 1474 bp, Oryza sativa
tttgatgaagaatacaatgaaaaggttacacaggagagtacaaagacgaatccttctaaaagaagagttacaagacgttttaaaacatctaacaaggtacttcatttattttactttccaaattcactcaatttagttttcacataaattatttaccatttcaatatggcactatgatataggctaagaaaggaaaatgttctgaaatgaaaactcagagaaataaggtacaattcttacttttctttcatatacaaaacgatttgtcaaactattactgacatgttatatacaattgatgggtattaataggaaccatatactactgattgtgagaagatagcaaatgacaaaccaatttcgcttgatgatgattttgatgaagaatataataaaaatatggtcatggcggacaccagtacttctaaaagaaaagtcagacactacataggacaaactaacattgtacttcattgagttttactttctatttaatgttacctttcatgtttgtccattaatgtcaatatgctattgtgcaggtaaggggaaaaggttgtggaaagaagagtacaaatatgggaacttgcacaaaaagtgcaattgaaaatacaattcaagatgatgaagtatttgatatatttgttaaataaatcatgtattttaacataaaacttttttaattaactaactaagaacacaaaatttaggtgcatgacggaaaaattgctttaggaactgctaaaagaccatcaaggaaatttataatttcagatagtgaggtactgcatgagacaatttatcaagttattaattaatatatattttttttgtaacaactaatttttttccataggatgagcacagcagtaatacaaaggtgactggggacagcaccagctgtaatagtagtaaggaagatataaacaaaggtcgatgcaattataatattgagaacattaaagttcacatgaatgagcagtccagtcgatgcagatcaacaaggattagaagaccacccacccgatactcatattaggtacaacatattacttctgggaaaatgttggttgctttagatttggtttgattagtaaattataataatatggtctttcgtctgcaggtaatttatcgtcaagaaggcccaaaagaaccaattaaaaggagggttcagccaatactttttattgaagaatagtattatatatgttcctattaatttttatgttcattagatattgtcagatgtaacgtacaacttgcacttgccaaaggaatccttggattactttgtttatttctaagatagagagttaataacattcaatataaatgcatgcatgtaccttcagtacatgtatatgagtcgatccctgcttgcttcctctaccgttgatatcctaaaagcatataaaacaagatcagttgatttaataattcttaattaatacaaatccccgggctgcaggaa

SEQ ID NO: 73918 - DNA, 4800 bp, Oryza sativa
  unsure (1)..(4800): unsure at all n locations
catctctcctcattaactttttagatacctcggtttttgttttacatgaaaatgcatttaacactataaaaattagatgagatggaacgttgagtgcccttagtttatctccacatatattgttaattgactttgtttcttttggtggaggtgaacttaatgattcgaaaaggatctcttagcatgaacacctaataaatcttatgcaaaatagggtagaacaaagggtggattattgaccagaattgttgatgccattaattgttcgtggttcaaaagcctctgttgatgtaggtgttagtgtagtgcagattcacctgcagcagaaaactcaacgcaaaaatggattagcactggtgcatgtggaccttaattaagatcgatggcgtatgtatatggttttgggggtggcttaaatcaaagtccaaacatctttttaattagtctcgagaatactgatcaatatatatacagaaaattccttaggttcctcggagttttcaattaaatttttcccctaaattttgtttcgttccttacgtgtctgagttcttgattattttggattccaatttccaatccgtgcattctaaacccttgaagcccagacaccttaaagcaccatatgaccgtcctatatacatctagctagtcgactgcgagttaaccgttagactcttttagaaataataattagcatacttcctctgttttatattataagactttctagcattgtctacattcatatagatgtttgctataaaagtcttataacctgatgaaacggagggagtagcttcaaggtgaaaaagattcgtttatgaaaagaaaaaaacaaatggagcagaccaaaaatttaatatttgtaaatatttttaaatgtttccactgaaatttaaacccaactgaaaaaaactttgccttttcagtttcttggtgaatcttttgtatgtgtttcatcaaattcgtaaaaaaaaactattttctatatttggggtcataattatgtccagtttgattttatcacaattctttttagattatgtttacaaagtagaaagcataagtacgtatgacatataagtcattttgaaaaaatctaacagtcaactaatagaatagatataaaggagataaaaaaaacgcaaggacatgtaaagataagataaaattcatgaatatagaagggattctttgagcaatttgtttctatattctttgtgcaagttccatttaaccatcattttcaccatagcatacatatgtgtctgtgctaatgatttaattattgttttgacgttgtaattaattaattaatatttaataggccggagcaatggtgacatgttgggagagaagatcaacataccacctgggccgctatgtgcaaagcgaccagacctctgcaagaactgctggtgttgtgaggtcagcgacgggcaatgctaccagagtctcgaggcctgccaggtcaactgcccattaccatcgccaccggccatttgatcagatctcgatcgatgcatcatatcgtttgtgtgataataagctgatcaatcaaccaataaagaaggcattaattaagtatcgtactctgttcgttttggaaataaaatgctgatgccatcaatggatgcatcatgcatgcatgaattaatgttctggaaaatatgtgataatcacatgtcgtgaaaacttgaaaacaaccttggataaaataaaaggacacctgatatttatccacgttatttagagtaaaaattttacttgcggatttaatcatgagtaaaaattttactattgatgacgtggataaatctcatacgttcatttttaaatccaacggtagctttcaggtttgtacgtgatatattttccttcttaataacgtttatagtgccagatatgggacaattgatcttttgtccatattttaaagtctaactataactatacacatttgaccctacatttttaactttgcttatttgatcttattttttttaaatcgaagttgttatttggccctattgtataggaatagatttagaagaaaataaaaaatgaatttagagagggaagaagacttaactgccccctgtgatttaccaaagcacatacgcgcggctagagttacatgggcgcggaggagaccaatctcatgagcacagagccaatctcggtcagcaaccaaattgtacacattctgatatgcaatacttatattattatagtctttagacttatctttgtcggctttagtttctgcttgttccttggatttacattcttcggaagtttcaataacggatccaccaatatctgatttagacagattattgtgtgctttggtgaagaattagtacttaactggcccccgcgtcatcctcccttacgggcgatacgggaggcagaaaccaccgccatcgtccgctccccctctttcctcctccgcctcgccgccgcccgagcggccgcaaggacggcggcggcagggcttcgtttctctcactcgccaacggtgggggaccgtgcgggatggtgaaggccgcccagatccgggccgtcgcagtcggatcttgcagggacacagccggcggcagggtagtgtgatgaggcggcggcggttggcaatggtggcggtggagtatgaaagtggtggcgatgaaggagaagagaggggatccgtcggcggcggggatgaagatggcggcgaggatggcgacagcgggcaggactcggtcacgccgaaagcggatcctgccccctgaggacggatctggtgcagggcgaggttgcagcggtagcggcgcggcggagctgcggcgacggtgtcggtcgcaacggcgcagacttcgtggtgacggtgacggtggcaacggcgtggagcttgtggcgatggtggcggcagcggttggacggcggcgacagcacggtggctggtcgacggaaacggcggctgccggcggctgtggcaacggggtgcactcacggtggtgatagcggcgcggagctcgtggcgacggtcgcggctggacggcggcgagggggctactgctagtcggcggcgaggtgttcgttggcagtagcggctgcggtggtggtgaccgtatctacggttggaggaggcatggcagtcttggacagctaaccgggggtgtggcagacgcccgcacctggccggcgtggaccgattgaggggcgagngcagctggtaaaaaaaaaaaaaaaaaggggcacaacccgatggcagtggaggccagtaaggcgcaanaggcgtggccgcgacgagaaggcccgcttggagcgaaaggcgttaccgatggcgggaggccgaactggcgcaagaggcgcgtccggtgttgaaggccggcgcagcacgatgaggtgcggccgccagtaaagaagccaaccacggtgcgatatgaagctcccgggggtgtggcgcggtcttgggtacacgaaggctggctgaagggggcaccggtgcagtggtcccacatgtcaccagaggttgagtggtggtaaagcattggtgcgacaaccatggacttgcaggtgatgagcggcgggtgaaaacccagcccggcctttgccggaccgacaacaatggttcattccccctcctaagggcgttgtcgtgccgtctcatcccttaagggtgtttgccgggcgaaagcccagtcttgactcttttgagtccttgacggacggcggcagtggttttccatcgcttctctccttgaagacatcgtttaggcatctccttgtcgaaaccactcgaacgattggtgcaagcacactctagatagagttaggctttgtgttggttgtaagggcgtttttgggcattttcgtctgtgttcctttgttggcctagcggcggtcggtcacgcttagcggcaaccggttcggtgctagtcttctctcggacctgtgtgttggtggtggtatattttttctctttttcctggttacgaccttctaggaatgtaatcttgtaatttttttttctgctttatcaatagaacttcgcatcgtctcgtgcgagtcgctcaaaaaaatatctactttagagaatcaggttcttaggccctgtttagtttgcgagacgaaaagttttggtgtgtcacatcggatatacgggaacacatttgaagtaataaacgtagactaattacaaaacatattacagattccgcttgtaaactgcatgacgaaattattaagcctaattaattcaccattagcaaatgtttattgtagcatcacattgtcaaatcatggagcaatgaggcttaaaagattcgtctcgcaatttatacgcaatctatgtaattagttttttatctatatttaataatccatgtatgcgtccaaacattcaatgtgatagagtgaaaagtttttgtttgggaactaaacagggccttattcatctgaaagcctgaaacttatgtcattatcagattgcaaatcataaaatggtactcacaccgtcccaaaatataagcatttttgaccttaaaacaatctttgagacgctactctgaccaataatatctataaaattaagtcgttttaaataaaaagatatatatattatgatattttgtttaatgataaatctagtagcatcaatttaaaatgatcttttttatttttttcactattaatggtcaaaattaaaattgtttgacttagcattattttaaaaatgcttatattttaggatgaagggagtagtattcttgaataccattatcaaatatcaattatttatgtggaaaaatatgt

SEQ ID NO: 73919 - DNA, 1714 bp, Oryza sativa
tgcagctgctttattcctgcttctctccagtacaacattgattgtgctacaacatactctagcgaaaggctgcaattcaaaattaccatttacagtgagtatttttaccagctgaaataggatgatatttcaaacattatatcttcctttcacaaacaatatatttcatctttgtactatattcaataattactacctctgttttcaaatgaatgacgttgattagtgcaattttgaactaaccggcgtcaaacaaaaagaaatggagagatataaagttataggataattacattttccttctattataacatttttccccagaaagtaaacatccatgaaccatttatttttttagacaatggattaaacaggcttaaacatccaaaatacatgtacacagccaatgagccatttaatcacatcataattccgcaatctttcgtattatgcacataccgtctttccatagagctgtgaacaacaactccatcgctgccaattgtcccctggcgaacaccccagcagctgatgccaaatccactaatcaaggaaaatagagaggacataaccaatacagacgaaggaagatagagaggtcgacacaccgcagccgccaacccacccactgagctaggagataattcaaggaggatgttgaggtgaggacggaacatgggaggtggatatggacatggcgctgcaagcctgcaacagccactggagggagggagtcgggaaactacaggagacccacgccgtccccgccactcgctgctctccgcccgcggaccacgccatccccgcctcctaccatatgaagttttgtgaaggtctggtatggtaattatatataaaattatcaaattgaaagcattttttactttgaagttacaagctttttttactacaattagttaactacgaaagctcaattatacagagccatacagacacccttcatgatgggccaaaaaatctcaaatatgcagtacaagagggataacttgaacgtaaagcagagacaaatcgatacagagcaaagacatgggaacagagcaacaggacattagtgcagtacacattgacgatgcagggatgcacgatgcaatacctgaggacagcgcccgttgtacagcccaatcgcgagtgaagcggttggcgatgcagtagctcggcggcgcaaccagctcggcctcgcactccacaaccttgcgggagcgcacgtcagatcgagacctccgtccccgccacccgcgtcgccgtccccccgtccacagcgcctgcagctctccgctaccgctctctgcccgcaacccacgccatccccgccgcccgccgccgtccccgccatctacgccagcaacccacgccatccccgccgtctgacgccgtccccgccacctacgccgccaacccacgccatccctgccgcctgcgccgccgtcccccctgcccaaagctctccgctcgcacctccggcccgcgccatccgccatccgccatccgccatccgccctcctcgtccgcccttcccctcagacctcatcctttccattttcccctcttctgtcactctctccttgctatccatacgtatactcgtatagcggaatagaaaagaagagcaaaaaaaattagctgagacagagttacagagtattaggtgcctactactaattagtattttagtcaaagcaaagcgatgcaaaat

SEQ ID NO: 73920 - DNA, 4025 bp, Oryza sativa
gattttacacatgcttctaaaaaaccctacgctatcacatgatttaaaatcttagacctattattttggaccattacattatatcttttcaaaataaaaaacatatataaaatataaaaaaaaatatgaccattgtaactttaatcggtaaaacaattatttacatccgatagaccaatccttaaaaatacaaatccattccacctccctcccgtacataatcactcgtctctccacgatatctgtacgtacatgcaagatatatatcttgcatataacagaattttaaaaaattaccatcgagacaatcgtcaagctactaatgcaaaggttgtttgattattatttgtccagatgataatttgatctaactgggttaatacattttaaattttttacactctatccaaacatccattctattccatactatattttaaacattcatttctatcatatttatataccattttcttttcttttctcaaaatcatttatataccattttctattcttttctaaaaatcctgtgttacaaaggaaaccctaaattctttctaataacaacaaaaattatgatagtttaaataatatgcccgcgcaactgcgcgggctaccttcctagttcagttataaacggcagtgaagacaccatgcacgaaattcagaatctttttcttagagagtgagctttgagctagtcttcttgagctataggaaaagagagtttttcaagtccatcgggtggtacctccaggtatcggtactgcatggtaccaaagtaaatctaaccgttgaatcaatagggtcacgatcggaagaacaaaatgaggatggataaggcctcgcgagccgatcctcccgcgccaatgcgcgaccctgtcaaaggcgcgaggccaacctatcttggcattaacgcgagtccgtatctgtatttgttgaaggtggcctacgaccctaattcttttcgacggctgcggtggcacgtcggagaggcgagcccgaccacatttgatccacacagcggcaccgaacagatctaaggcagcgcagccaccctagttgcatatttctttcttttgcatcgatgtctcagcctggtgttgccatcttcgccaccagtgccaagccgcagtagtcgagtaaactaagccaccactagcgaccatctgtacgccgagtccgcaagtgaatccaccgccactagctccgatgagatagtcttagattggttgagggtaaatgagcatgacggtgtcaggaggtcatgtctaaaaggaattttgtttcggatgagaagatctagatcgagaacctccgtagccatggagaagagcacaagcttccactttctctgttctcatgagggtgaggacaaaggaaaaaaaaagcggatgagggtgcagagaaatcaaacgtggaagagagagagagagagagaggggggggggaggctgaggttgtcgttgatcttgggaggaaggaccatgctgccggcgtgtaggacggatgcagaggaggtgccttcgggtagatggatagggaggagcgagcttaatcaacacaatacaaaattcgaggtttgcccttccacttaatcatcctaatgcggacagaggggaggtacaacccaatgggactatggtacctcgcggtaccaacattcatcagccatcggatcaggctaaatggacgtacatgatttggtacctcctctccggatggatgatagtaaagctcatagggaaaactgcatgagcatattaggcccatgcagtttttcccatttttaaaattagcaatattatatatttaaatatagaggtacaggagctggtttggactactatttgtttcaatgtttcaatcttgaatcaataatagcctgagtttacaacagaaaatgtgcatataaatgatttaatgagttttgagtttttatcaggcttgatatcccagagttattttcctctacttatatccaataatacaagactgaagatagatatgagcaggtgaaagcagagtttagtaggtttgattctgtttgacaggagcataaattattttctctgttgaatgttcatatatagagaaaccagagacaaggtaaaaggcgcatacaaaacgctaagccattgatcagagtgagacacaatgcatcaaactttctaagaaaactgcatgagatccctccatctctgtacagctataggcttggaaagcatcaagaatgtcttcgaagctgcatgtcattccaacattgccgaacgctccacatcacccttccaattcttagataggctaggggatctctgcttcactatcttcagagcatagggagcctgacaattcctaatttctggagagcatggcgattctgtgatgctgtgtttgtaacatatggacggctcatgctcatgaatcatgattgcagtgctgctgataggtttttttttttttgaaagaagggcataagctttgccgcttttatattgatagataaggagtaaatagatatttacaggatccgacaaaaatcgtgccaggagcaaacaaaaagcctaatctcccgccggtaaaatctcaattagtttagtcgctcccgctgtttttttagataatagaagctttatttagactcaattaattacaatcaaactgagtcacctccggcctctgcataaaatgcacacagccaaaaaaagaagaaagaaacaactagaacatctcccaagcacaaaagtttaacagaaacatatatcgctcccgctgtgacccaagtatgcgcctcctccttgattttggcagtgatggtagcaggcgtggatgtaacttgtctgaagattctggtgtttcgctcgccccataattcccaagcaatctggatgatcattctgaaaattgtcaagggttgcagcagtagcaatgttagatagagtaccactggaaagccgtagacatatatctgcataataatagctgggaacatgctgaacaaattagtattacatgttcttaaattaaaatgataaagctgccgaatttacagagtcaatgtaagactgccgactgattgatgtctgtttaacactatgcaaataactgtacacactaatttcatgtcaaactacttgggacacggttgagtattgaaactaggctatggcaaattattttcaccagaagtagctcgagctgttaaaacagctgtgagaaaaataaagagtgcagatcatgagccacgcccaatcatataagagagaatcacataatgaaccgtgctcacggtacagaattgcaattaggaacgtgttgacattgaagattgagattgaagacgcacatctatatatatttctggagctaggtagctcgtttggcaagaaacagatgaccatggccaactgaagtacaaaagcctagctagagcttctgcaagagatgccatgagtgttagaaaattgcaagcatgagaacggtgaaatcatataggcttgggaagcatcgggagtgcatctgacacaggagcagcgaaggactgtgcagcggtacagctctccagactcatggcattttcgatatgaaacgaacacagaatgaatcatgcatatgacagttcagtagtagcttaagaatctatggagatataagcagcaacccttgacaattttcaggtgttttgtgcagggtgttggagcgatttctgctggaaacgtttcttggagctgtcacttgattggccagtcttgcaggtgcacattgtgcaccggcgtcatgtctgatagggagaaaccgaatggacagtacaagaacgcaaggatttcgcagttcttcgatccatattcgagaagcaatatgtcaaactccaattatgctggaggttgggagtgaataggcaggagtagaagttgcagagtaatgttgagatggaaggaagaagatgtcaagactgtactagaggtgaagatgtgatcctgcaagagtgattagtgttgttgtaaactctgctattgttcgtagct

SEQ ID NO: 73921 - DNA, 9441 bp, Oryza sativa
tctgaagtttggtgaaaagttgaatcatggaagcgagtcttttacagagtttggaccacataataaggattaatctatggggctttgaatgatcttcagttaagtagtactggtaagtggacaagtctaccaggacctagagctaagtgtcattgttaatggagtttttgcctcgcaaatgcaggtatgcaaaaccctggagcatactttgccactgtttgccactaccactgatgcactgattcatgctgaaccctgtgtttactttctacggcaactcacttttccgctggtgctcctgctttcccatgcacacgcatttggtaaatcatgagggggagggatttcatcctttgagtagacatccattcattcctcacataaatagtcataataaaataataaaatggaataatatgagatatatcattttacaaacatccaatgttaaattcgacttttacaaattataacaaaaggagtaatctaaactttttttataatggatagaaatatgatctctatatccataagcggatatagaatcaaggaacaatttaaagtgaaactagtatacatacatttacactagtatttgttatttttgttataatttgtaggattcaaatttaaacttgcatgttgtggagtaatatatcttatattaatctatcttatcaatcttttttttaaaaaaatgatgattatttaggtgcatgaaagaaacgaggaaaatgtctcctcgaatgatgaaaatcatgatatcaagcatgtgtgatcaagtgagaaattaaccattgttgatctgattaaccatcaaacactcattgattagcaatttagcaaagctagcacgctacctactgccaagtactgaatcatctcatgccatcctaaggcagaagaggttacatcttacaaccttgcaaattaacctctacaaggatcgatcataatatcatcatatctaatcatctcatcatgccatcctaaggctgagccgctgctgcagccatggcgctgccgccgccgccgccgccgtcgacccgtcatgtagcacatcgaatgccattgctctcgggcacggcggcggctgccggagcgagccgtcggagtcggtcgacgacgacgtcgacgtcgatgtcgccgtcgtgaggctcccgcccgagcagttggacgtgaaggggctactctcccgccgcttgttgttcctcctgccggcggcgcctccgccgccgacggccagtgtcagcgctagctcgtcttccctggacgacgccggcggcggcggcagcggcgtcgcttggccgccggcgtcggccacgacgatgtactcgtcggcggggagctgcaggttgagcgcccggcggcgggtgtgctgcttgcgccgctgccgccgccggcaggttagctccggcggcgacctgttgaggtcgctcatcagctgcttctggacgcggtacagccggtgcagctcatacaccttcagaggcatcgagacgaaaagaattttgttggttttgtttggtagaattttagagttttttctttttgttctttgcagtgatgatgattgtgatctttggtttgcgtttgatcgatatatatctaacctgctgcttgaaagtctcttcatgcttgagcatggccatcttcatgacctccatgtcgcactgcctcacaagcttctccatctgcaccatcatcttgagcttcactttgttcttgttatgttcttgtccttgactgagatcagcaagctgatggtactaccctgcaaaaaaaataaaaaaagaataaaaaaacagatgcaaaatgcaggcttagaaaggagctagctagcttttcagttgctgaaacacatgtactcgaactctgagaagaatcaatagatagatcataataacaagtgcaaattaatcagttgcaagatgctctgatgctggtgtgtatatctcaatgcataaaaaggtgaagttgtgcagttttcagaacacacactgaagcaaccacaaagatcacaacacacaacagaaagagctgtgcccccctgaacctaccgccctattcagcaagaaagcatccaaatatatgctcttgtcccttcccttgtttctcctcttgtcttcgtctctttaacctactagattcctcaggggatttacactggcaatgagacaaagaaacaaaaggggagagagagcaaagcaaagatgttgccactgctgaaactgagaacttgagaagggctttggttgggggtatgggggtttataaacattgcctctagagaagtgtggtaatgagaatgcaaagaaaaaaaaatgcaagagatgtgttgcaatgcaatggagtgcaatgatggctcaagagaacatctcacttggcaccttttctgcatgccaaacaaaggggatggcctatagccaatggcaatttgggggaccttttgggggtgcatcctttgcatgagatgctcctcccagagcagacaagttggcagggagcctaggtttaggccctgacccacacccacagggtatggcccgtacagtttcctctcttctgtgtggccatgctagttctccctagtagctgcagtgtacctcactgacagtaccatgtacgtgtacatgtgcactcttccaggtcccatgatcgtcttgctgcatgatttgacgagactccttttcaaccatgaaattttgggggatttccgcgagaggcaatattcctgtaaaaagagaagatcatataaatatggatctgattggtttactaattaatcctctttctcaaacctgatcattactctaattattgagggcctaaaacttgaccactcagagcgcgcagctgtattctttcaaacgggttgggaatcctttcttctccttgcaaaacaaaacaatagattagcacataattactcactccatcctaaaatatagcaacttttaactatgaatttagacacacagttgtccagatccataactaaaaatacttatattttggaacggatggagtaattaagtagtagctaaaaaattgaaaaatgaaacaatatgatttatacaagaattttctaaaaaaaattgaaaaaaatgcatcatttagcaattcagaaaacgtgtgtgtataaaaataaggaagggagagaaaagaacacaccacccgtgcatattattgatttccaaacgaattcattggcgcaagttctgatcaaattcaccagagaaattaatttcttcctcaagtcctcaggatcacctacagtgcatatatactccatatacttaagtatacttaattagaagtactgagtgctgatataacttctagattgctctttttcttctctctctactatgacgagatctacaatgatcacatgctttgaccgtttttatatatgacatgtatcatatatagcgaggctggaccgttaagtttggaccatgcatgcgtcaaactgatcaatatgcatgtatgcacccccacacgtaaacagtaggcagtgtcagcactgagaaatccaccgactaaatcattgtcacgtacacacagtacagtggcacacagctgctgcttgatggtcagatttacggtatgagttggtcagaattcagaagctcgtcagtgtaccatccccttccgagttttctcccttatcaaacagatgccaatttgtattgcgcgtggtccaatttcaaaaatctggagtcgtttggttatatatgtgcaaaagattgcaaggatttgatacgtgaaaatgatatcggtagataaatctgtcatgaaaacgccttattgtatatataattaaataaataggacgtattttacctctgtttttgttagcatgctgtttacaatgttaaacattatgtattttgtgtagaatttttctatatagaggttgttttaaaataccaaataaatccattttgaaagtttgaaataagtaaaatcaatcaatcgtcttttaatttaatggtttctcgttttaggtgcctgtccgtaggccttgtttagttcgcgaaaaaaaaaataggtatcacatttgatgtttgatcagatgtcggaaggggttttcgaatatgaatgaaaaaaataatttcataactcgcctggaagctacgagacgaatcttttgagcctaattaagccgtcattagcacatgtgggttactgtagcacttatggctaattatgaactaattagactcaaaaaatctgtctcacgattttcatgcaaactgtgcaattagtttttatttttaactaggaaggtggcccacgcgatgcgcgggcatccgtactattgtaacgtaatattatagtttctttagaaattatatcttataaggacaaactatatatcgggcatatctgaaaaccattgattgacttagaagatagatcaaggtcatgtgacttttgaattgacttttggaccgagtgagtaaatatcatgtataccatttgaacacataccgtacaatattgctacaagtaaaaaatgcgatagcaaggaactcaaagttattatgatcgaatcgtctcatgaagatgcatgatttagtgacaaccaaattaagatagattaacggttggattgtttttctcttcgtagaagttgaaatttttcatattcttttccaaagttttaaagaatttttgttaggacacaaattgcaaaattgcttggttgggtagtgcaaaatatcagcaattgtttgaagctattgttttttctttttcgcatgtttgatagttttcttcgaaacacctaagctatctcaggtacgatgctccatcatacatgcagaagataaatgtgcacacgtgcgaggtctttagaagtttttttttatttttacaaaagatagatatgacagtcttgttaataggtccttaataggtctagttaataggtccattagtttaagtgaaaaccgacatcaaaatatttttattaaaaatagtataaaatattaggttcattaattaatgtaaagaaatagttaatatagaccgtaaattggtaatttactggtacataatataattacgtaacatctatattaaacaatgtgtttttaaaaatttgatataaaataattgtttgatataataggtactaccttcatcccagaatataagcatttttagagttggacacggttattagtgaaaggttgtgattggttgggaaagaatgttggtggagaagtagttatattttgagataaatcttgagggctaaaagttgttatattttgggacgaagggagtacatcggtttaagtaaagaatattatattgttaatataaagggtaaaattatatagttatataaaatttattttcaaacattgtggagctaatttagacatatatatgatgatatatataatctatgtttataaagttataatttcttaaaatttattttcactaataataattgcaattttgtctatacatggagaagagaaggaagaagaaggaaacaaatgtacgtttttaatgatataagtaatttatatttttatgacttttgccactttatctttttaaatgtatgttacagttgtatatgtattttcggtttttttacaagtcatacgtacatacctttctctcgtcggtgcgctaagggagattctgagatagattattaataggatttaatctaatggtccgagataacggatccatcaatttaaataaaaattgatggctagatattttagtttttttctcacattttctagaatttgttttctaatttattagagtgtatttttacaacttaaaatatagttaatatgaatattgattttctatctcatctagccaaaaagggaaaaaaagaggaaataacaaagagggtacgtacatatgtacgtgcacatccatgaagagatagattctttttccagatgaacgtaatttcaaaatcttaagatagatctatgttaactaaataatagaagaagttagcttaaaatgaagagttggagggtggccagagggagagagtacgtactcgcggatgtatagtggagggtgaggctaccggatttttgagtgtcagagagatctaatggttatccccgcaaaaaaaatctaatggttaaaattaatggattaaccaatttaatagaaaattatagattttttctaatttattataaagccatgtgacaacttaatttggagcgtttttagagcatttacattatacatgccgttaggagtctcacgtgacgacttgagagcatctataggaagcttagatgttagtggccttctaatctaggccattcattttctttaaaatccatgcagttttttaaaggagggtaacatatgtacaccggatattctttttggctttttttagtacttatgtatttatatgtacgtgggatttttttttgggaggaattattttataatagatgtgatctaatgctataaaataactgaaaatcgaagattggaatttataaaatttcctattataattacataatttttatacgaagacgaatgatctaatatacacccaaatagtgtcaatagcatcaaaaagtagaggttgttgggtaaaaatgggttaaatgggggagtaaaagaaagatgggcacgtacctttcctgtgtacaaatgggatgaagcagttgtacatacatgcacgcaggtgagatgagagggagggactaactcttgttttaacctaatctaatgttctaaaatatggacccgccaatttacatctcacgtagtaaaaaaaattattcggtgaataatggagtactttttggctttcttcaggtgaatagtactatatatttatacatacataggatattctttttgatttggaagatattttttttatagatataatgtaatgtataaaataacttgtccatctgatttaagtgaaaatcgaggatcaaatattttattttattctcagaatttcctattataactatacaatttttatactaaaataaatgatcaaatatacgctcaaatgtcaatggcataattaagaatgaggtgatataaaaatattgtagggtattctagataaaattaaataaaaagtctaagggtgggggagtaaaaaaggtggggcacatatattacccgcgtgcaatcggtcaggatgagggaggcgtacgtttatctagataaaaacttgttttttaatctaatcaaatctaatggtctgaaataatggacccacctttttaagtgaaaatcaagggctagatatttctcatatattaaaacgccacgtggcaatctaggagcgtttttagaaatcccatgtgacggcttgagagtgtttgtaggaagtttaatggacttttagtatataatagaaatagatagatagatgttctatgcatatgtctaaagattcgatgtgatgtttttaaggaaaaaaatttagcaactaaaccaggccttaatcttcggtcgccatgttgtcctacggggcctatagtgtcaactgtcgtcaatgacaagagaaaaaacgaatagattgagtgagaaaaagatgcacgagatgagaggaacaaaatgcgtttgtcagtttccactgaaaacaagcaaaggcgtacacacacgttggggcgtgtgtgtggatgcatgcatatatagtcagcaagtagtagcatgatccaacgagcgtggtgatgagtattgctgacaggccaccaggggcgaggctttttagggcagagaaaactctattgtttggaggaaaaccaagcaatcaaagagcatgagctgagctagtagcaaatgatgtgcatatccctttgagagcaagcaagcatctgtatgtgttccccttgttggcccttgcatattccaaagatcattgctcccatcaaaccatcatattctacccctgaccctgatgtgatgatggcatcgccacatgcagctagccaggctcatgtttaactcttggagagtgcttgtatatattctttgttcgagtgatggatgcaacagcgaggagagcaacggaaagagatgtacagtgggcgatgcatgtgagctcgaacataacacatcatgccaaggaaatgaaaagagaaaagcgcgggtttggtttttggatgggaacgggccgggagtagcatggccgggtagacgaatgatcgattgagaggggaacaagggacagtggcgcacgcgctgccggcgacgggaggcgcagcccagccgtacgagggggtggtggggtacgttggcccgcgccacgctcgcatcgatcgcatgggaacaccggccgtttccctctcctttctgggctcccactttcggtccaacacgtacagatgcatggcgcaacgccaataacatgccccgtccgcgcgcacatcaacttgccggccggcctccctctcgtggccacacatcgatctctcgcgggggcattcgcggtgaaaaccatcggcagcgcggaggaagaggatagggagtttagtgggcattttcagtgctgcgctagcatcggcaaggtggacgcgtaggggagtgtcgactgttggattaatcagtcttgtgctcagcatttttattttctgttagcttgcatatgcagctgagtcacggtggcgaggccagtcggtcagtacatggcaaactgcaagaagtgtttcctgccgagaggataggtcctgaggagttcttttttttttcaagaacagtcagactattgccgacgtttatataaagaataagttttcttaattttttatataaagaataagttttctcattttaaggagaaaacgataccaaatcttacggtacatagttaattaagagaaactatacgaaaaccacaactacagcatcaaacagaacatgataaacctaaactacaaggctatgaaaactgaaaagccatgttcaacaaatgctattcaccacaagccttgcaaaagaaagttgcaagctaaaagatcaagcaaggctcctcgcataggcagatacgtaacgttattgtcatcacatcatcatgggcgataggaaaggcttgctgatcaacaagcttgctacccacactgtagcaaaaactcaaatgtcctgagaagtggaaccttgcatggcatatacacgttgtggcgtaagactagcttgccatggctggtagttaggcatgtgactagtttacttgcatggtaattaacttgagtgattggctaggtgtaattccttgcatgtatcttatcgatctctatataaatgaaaaccttctagaaccagtgtgtggcttgtgtcaacaaataatatttgtgttattgtgttctttcgtgtgtgccaccacacacggaaaaaaaaggaattgctacatatctgtcgccaccagattttctttttttaaaaaaa

SEQ ID NO: 73922 - DNA, 4066 bp, Oryza sativa
gctcggtaccctttaggaaatatacaaaaatcctccaaaccttatttgacttttaactttgcacattttaattgttggaggctttcacatggattttacttattctatgcataattttgaggatgtattttagagtcgttttgggacgcgacacacaaactaagccttacccactagacatgtggaagtacggtagtgctttgcaacagaggcccgatgaccggtccttatatggccgaggtgctactgtcaaaaccatgcaccccgagcccagcctaaaaccattttgagggttttgaatagagggggaggtgtgaatccaattccacaataatccaaccattccatagtgtccaggtgatatgaatattcccaaagtctagagttgtaaaaccacctaatgttgcataattaaccagcgaagcatctacctaaaatcatactagtggtaccatgagtagagtgtccactagttggtgttttgtttattctagggtgaacaaggtaataataacaataacaataataataaggtcataacaaaggtaaataggcatggctaaataaaacagtgataacgcgggaatttaaacaaagcggtaatgcaataatttaaatcaaaataattttataaactgggattcaatatgttcaaggatgatgtgacttgccttgctcgctttcccaaacgtcggcttcaacttccacgaagagcggatcttccgaagctgcagcgtctacacgaccaacggaaaagaaaaggcttttactctaataaactccatataacaagcagaaacaaagcacaaaaatgggttcttgacttcttaaggaaaaattagagacttgaacggtccaattccgagttcaaatggccaagttatggctatttgaagtttatatgctctttaaatgaatatttgcgaatttcttcatttaaattttaatttaaaaagggtttattgcgtgagccgaggggagggggcgcgcggaccgggtccacgggagtggggcccacgcggcagcctcacggtccacggtggaccgggcgcacccgggctcgcaccggccagcgccgtgggtcccacgcgtcagccgcacctaagggcgtgggcggctgacggccgggccccacgcagcagccactcggcacgcccgagggcagccaagccggcgcagccggcgggaggcggcgcccgcgcccctaacctatactaaagtcaacacatataatagattagctataaggttacctataattttcttcttctatctctatctctcactcatacatttaatctatttgtcttggagcttgtgttaagttagctcttgcatgagagccaacaccattctcttttgtttatctctttcctccacataagcttatagtaagcttatagatcactattatactggctctcatcctcgcgtgcatatgctattaattcctagtatgatgggattggattttaatttttctcatggctaattattctttcgggtatagacagtatatacgggtgacaacaagacgtccctgacgactttgacaatctcaagatatatctgccaagtgtctcagaggtgcttacagaggtagtgaaacggccgcggaggccaagacgacgaggacgacggcaataagggggtgccatttccgcccctgattatcggctccgctttgatcaattggcagaaaattcatcgatatgatgatgatgtgctggatcgagtagtgtacgtgcttcgatcgtcagggctgtatatatgccttgtatttatacacataaattagtaacgcgtgagatatatttttatacaactaggtgtctatatgtgtatggttcagtgaacaaatggagtgaagttttgtcaggaagcatcgatgtctattctccgtgatttcaggcgctggtgcatgacacattgacaccaattatttatatgtactccgtatataccggagtaggaattaagtggttcaaggtgtgctgcatatataaagaacgtagtatagatgctgtgagtattactatctttttgtgtggtcctggcgcacagaaagtataaaaaaacaatagggcggtaaaccgatattcaatatctattggtcactttggcttgctagtaatgatgtagtcttaaatggctcaagtattaactctctcttgcaggttattttcagggtaacgcatcgggctcgccagtggtctttgcttcttaaagaaggtgatgagaaagctttaaagattgggtgcctaaaattgaaagttatcattatggaattctactcaaaatctaggtggaattgaagaggaagattgaattgtgttagataaaatcttttgttgtgagacttgttctggatgtctttgtcgtccattcgccttctacggcatcgttgccttttgaacctgtttgtagcctaagtgcttgatgatgtaatactatggttgtgtacatccctcaggatatagaggccaggttttatttaatccattatctaaaaaaataaaacgggttacaaaatcaatatagtggtagctaaacacgaaagaatgccatagaatatccaaacttgatacgatattaaggcataatattttataagagagttagcctatatctttagggcactaattacggatgctcatccctacgacaatagcattactgatcttcaaatgacaatagcatcactattcatgaaactataatagcccatcctctacatccacagagtggatgtgctcatgtgcatagccaatttagctttcatatatcggacatgttagttgaattttacctacctagctagggtgtaaccgtgtagctagattatcatcccctaaatatatggtgctatcatgttcagctggtaaacgcagcaaaatgcaaaatctggatggctttcaatttagggttactttgatccatgccattgcaaatttggctattcagaaaaatatcattacaattcgtctattcgtaactgtgccactggaattttacaaaaatagaaccgcgtcacggcagtggcggctccttctttctcgcatttcttccgagagccaagctggcaagctcagagtagtcagcagcgagacccaagcacgcgagatctcgcgcgggagcggtagcggcgatgccaccggcggtcgtccatccatccatggccgccgcgagcttcgacagcttcggtggtggagcaagcgtcggtggatctggcacggcatggcgcgagcaggcctgacggtggcgacgaagacttaaagacggtggagaggtgtcctgccgcttgcggcgctcgcggcaggcggcgaggaggcatttggagaggcctgcggacgaggagagcagggagaacaccgccgtgagggacagcggccggcgtgaggtgctcaccgacctggaggccaaagcgggagccgaggtcgagcagcgatggggaagaagagggtcacgccgccggtcactctcgacgcgcagcctaggcttccgccggttccgcccgacgccactatcgtccgacaccgccaccaccggattcgtcggtcgtgcccaccgctggatttgccagtcgcgcctgatagagcgagctatggcaggtggctcggctgagggagtcccatgaagagctgcgggagcgtgtcgagctgcttgcccgcaccctgcaggagaccaacgccaggatccgcgccacgctctaggttgggttcgttcaccttgccagcaagctccctctccggcttgactccgggaagatgatgggagaaggaaggaagaagccggaaaaggaagagaatggatggaaaatgtgacggcagtggcacggttttaattttgtaaaattccagtggcatggttatgaataggcgaattataatagtatttttctgaatagccaaatttacagtagcatagatcaaattgacccttcaatttaaagctatgtctttataacctttattattaaaatgaaaaaaaaaccaaagatgtgggctaacggtagggctgtcaacgagacgagctcgaatgagctcagaatgtgctaataagactc

SEQ ID NO: 73923 - DNA, 679 bp, Oryza sativa
atctaccaaggcactgacttggatgccctatggtggatctagccaaccagtctttcagccgtcgctaccacaaggcattccctctcaaatcggctccgatggatgagtagtggaggagaaggtagtgatgagtgagctagatagattggagaagaatatatgttcagattctccgccgcctggccttcgccctcatgtggccattcgggacaggaagacaaacgcgaccgcagcgcagatatgtggccaggaagggcttgggaggagataacgatgtgcctgcaattttacactttggtcctgcagtggattttaatttataaatgagccctcagtctattatcagtacttcagtaatgaaacgtgtttagtatttaccaaaatataatgaatctccttaggatgattgtaaacctttggatgttctaaataaaaccgcatcaaaggaactttccaaatgtgtaatatttaaatggatttcacaataatttaattaacttctgtaaaaatcaggcaaaaaatatctaattagaaatttgacaatatatatatgcaatctattttcaagtacaataaaaaaaatataccatctattcagcttatcatccgtaccaataatttcaattttaaaactgccaaaaaaagccacattgttttttatataaccgtactaaaagta

SEQ ID NO: 73924 - DNA, 5953 bp, Oryza sativa
ccaaagttacatatgtaattttaattttaatgtatttacactataagtttcaaaatctatctattatatctttaaagtaatagaaaaaggagcctccacgttcgctctcatggcctagaaattctcacattaatcctaaaaataagaaaaaagaaaaatagaactagattagaattagttaaaaactgaagaaaaaaaaggcatattaagaaactcgaatcggataatcggtaaaaacaaaaacaacctaatcatactacccgaaacggaatcggacaatcggtctaaaacaaaaaaaaaggaaaacttaatctactggaaacggaatgtacaattggtcaaaaacaaaaaaaaagaaaagaaaaacctaatcatactatacactggaaacggaaaatattttaggaatacgcgtgtttacatcacttttagaaacattgaaatacaaaacaatcctaatcaaactctgccgtttccgaattgtattagtattgtcatgccaataaatacataaccaagccaaaaattagcaagccaaaaatacataaccacgttcgttgtggaggctagaaattcccacattaatcggagaaaaagaaaagaagagtctaaatagaaatacaatcaaaaatagctgaaattcggaattaaaaatatgcaatattgaaagagaagtccatataggaacccaatacatgattaattaaaattcggaataaaaataaaataaatttcgaaattagaaaaagaaaaaaaaagaggagttcgagtaggaatacaatttaaaaataactaaaattcaaaattaaaaagaaataagagtccatataagaatccaatacaagattaattaaaattcagaatgaaaatttaaaaaaaaatcaaaattataaaaaaagaaaataatagttcaaggaggaatacaatttaaaattaacttaaattcgaaattaaatataagcagtattgaaaataagagtacatataacaacctaatagtatattaattaaaattcgaaataagaaataaaataaaatccgaaattaggcaaattaaaaagagagttaaagtaggaatacaattttcaaacaactgaaattgaaaataagaaataaaaatatcaaaagaacacaatacgaaaaaataaaataaattctgaaattagaaaaagaaaaatactaggaataccatttataaataagtaaaattggtggtaaaaaatcaagactattgaaagaaaatatcatctaaaacacatggcgagattaattaaataacatgcctataaaggagtagagtggtggcggttgatatgacatataaaaactgttaataaaacaccaaatagaatcctaataacgattgaaatgaaggacgacgggtaggccgtgaagcaatcgatcaaggcggttgccgggacttctagaaagtaaaaaaaaaaaccaatgctaatcatattcatttttaaaatctcaatgagaataaaaaggagaagtagtgggcggggtgtataggagaaccgccgacggttggcgagacttctagaaaataaaaaatgaattccaacgatagttatgttcgatttttagaatcccaatgacaataaagagtaggcggcggatgggccatagaggagtatagtgacatcgtttaacgggacttctaaaaaattataaaaaaaatgaaaccaacaaagactataaagtctaaaaactacgaggtccaatttttataggtttggaacttctaaaaagttaaaaaaaacacaatgataatcatgttcgattttaaaatcttaataacgataaagaagggaggtagcgggcgtgccataaaggaaaacaatggcaaagccgctgacggtttagcgggactttagaaattaaaaaataaacccgaacaataattatgttcgatttttaaaatcccaatgataatatagagaaaaaaaagttgacggcccgtagaggagtataatgacaacatttgatgggacttctagaaattataaaaactataagatctgatttttaaaggtttcaaggaaatgaatagaaatagtggtagatcaagcaagcaaataaagaaggatatgacagaagtaaggggtagtagctggtgtgacttttaaaaactatataattagaaatacgggatggtaagatttggtctttcaaagtcttaagacaacgagatagctatttaagaaattttaagtaaaattatactgaaaaatatatgattttgtttgggtgctagccgcgcaattgcgcgggccacccaactagttatatatgtaagtaccaaaattacatatgtaagttaattaatgtatgtagatgtaaattgcttggttttctttttcttctagcatcattgacgtgattaacgtccggtgactaacgtgcgttgatatgttttcatttgaaccgcacttggtggtggcttgaaaatccgactgattttctacgaaaaatctgtcgaatgatttttagacagcaaaaaaaaaaactagagtgtttgtgataaacaccaaggagcaggagagattcctaacatcgacggcgcgtgtgtgggtgcatcaggaaggatgggaggaagatagatagtgattaggtttataatacttggagcaatagccgttcaaaaatgactaagatttagtcaaagttgggggaagagttataccttattttacagttgagagatgcaattctactgaggaaaagaggtgagggaagaaaaataaacttattccggtccaagcacagcagcttctcaacttctccacgttttcttgatgtatgcggaagcccatcccactgatctggcccaactggattgcagccaaaatattggttccctttcatttctccttgaataagtccacttgacatccctcaactttatgtcgagtttgtatgacgcccctaatccccaataccagaaatatcgacccctcaagtgtttaaaaccgtgcaaaataaatctcttgacagtatagatcatattttcccggtttttgctggcgtggcatatgtcggggctcatttgttagtgacccttatctcttcacctatctctctcccttcccctatgttcccatctcaccagggcagcggccggtggtggactaaggagcaacagccggcggtagacggtgaggagcggcaggttggcagccgatggggaggacgacacgaacgacgagcggcgacggcatcttggtgatgcgctgcacgatcccgtagtacatgtggtaggtgttgttggggttcaccaccatcccagggaggaacagcagtagctccggtgtcctcggcctctccaacgtcacgattctgccgctggtaagcccattcttctaggctggtttggggagagggggggtgttcttggcaatgaaatcgttgaggctgacctcgccggcagggaatatgttggtgagccccatcatctccttctcgaatgtgtccagatccacaccctccacagtcggcgcctctgtgggcttatcccaagaaatggtggtcgtagtggatggtggcgcggcaggagaatcgaaggtgagctccttgcggatgccgacctcgtcgttgcaaagttcgcaaccaacgacgacgtcgggaatgcggaaggacaccgaggaggttggcgagggaggggtaggtaaacgatgtggtgaggaggacgtgccatcctcctcaccgtccgccgccggtctctagggcctgctctgcctcgagggctatccagtgattgcaagttcggttctatatttcggaccgcaccggcaaatcaatatatcgaccgaaattttcggattttatcaaatgtttgttgaatttggtcaaagtttatttaaatccagtcaaaatatgtagaaagttcaatccgaaaagtgccgaaaatcacgaaattttgtaaattttggtcctaccgaaattgaaaatgcaaaccctggggctatccgccgctacgtgtcggggccaccgagtcaacgctccgttcgaggccgcgccgtcactctgccacgaggctagaccgccgcacatgttggggtcacgcccagaaatttagcccaaattttcagactattttgtgtattaaatctctgtccaggaccagccagggtacacaaaacgacaagtaatatacagttccaaacgtaaataaagcgtaaaatacttacagaaaaggcacttagtcctcacaccgaaacaaaagcagcagcagcgaaaaaggcaatcctagcggggcttcagctccactccacaggcaaaactcaactggggtctgagccttggtcctctaactccatcttcagctcagaagcactacacttctgaaaagggggaataatagcaagactgagtacaaccaccgtactcagcaagccacaccaacgatgcagacgtgcaaggggatacaaggagggtttgtggctatttgcatgaaggcagttgtaaaacactttattgagcaaaacagtaaaactgttgagtaattaaagtaatattgaatctccactgatcaacgctaccccacgttgaacaggcccaaccaacccacctgaactacagtgtattgggtcgatttattaagatgggactaatcacggtgaatctggtcgaccgcccataaccgcgggcacggctattcgaatagttttactctgatcagaggtgtacaactgtacccacaagacacagccccacgacacgtttccgtgcgccgacatgccaccacgacataccggaaagaggccgtgacaggacccttcgcataaccccctctaaccaagcacaccacacctcaggtttcacccccactcctcgcaaggcagcgggcagtcccctctcgtgcctaggtgaatccggaagccgcataggccgtcgcagggcccatccaaactccatcacgcccacccttgcctggatgcgttggctagaggaaagctacactacaagcccagccgttgcccacgctggcttgtggtaagtacgataagttcttccagggcatcccgcaaaccggtccttaactgccatgggtgcgaccagcaaaaccatgcacccacagcccaccattcagtcgcattttagttggataattacgaccatgaagcatggccagatgtctcgagcacgcggctcaatctgatactaaaagggtctaatactgtaattatcccatcaactgagctagtggtaattaagcatggctaagcatatagttctagctaagtcacataagtaacatgagctagtcgattcattacccaaagttgacaaagaacagatatcaagtaaacatggcacaagcgagcagataggtaataccctgaccccatgtaattagcaaaatatgcatatttatttgcaaacagtaaaacatttgtaaattgggatcaacatgctcaaggggaatgtgtgacttgccttgcttcttcactttgatcttccgaactcttttcctcgcgaccgcggtcttccgaaacgacggaaactacacgctggcacgcaaaacgaggaaaaactctaataaaaaccaaggaaacagtacataaaaactaaacaaacatgtagagctcaattttagatgaattttgcaagttgaatggctcaattcggagttcgaatgaattagatatgaattttagaagttttgagccatttaaatgaatttctagaattatcatcgaattatgacgcaattattatttatttttacaaaggaaatggtcctcgctgacgtcagcaaggggcggccggcgccgacacgcgggccccacacatcagcgagtcaaagggggagggcgcacggtggacatggtccagacgtgcctcgggtgcgcgtccaccacgtggacggcccagatcggccaaggccgatcggacggctggggacagccgggcggcgcggccctggccagcgctcacacaaagctgg

SEQ ID NO: 73925 - DNA, 21754 bp, Oryza sativa
  unsure (1)..(21754): unsure at all n locations
ctgcagccccaagacgggtataaggagagcagaattttattggacctagggtctatttgaaagagctccaacttctaaattaaatttagctataggatgggtctggagtggagttgtggagcagcctaaacccagctccacctctttaattcattttgtgagagtactccaccggccagctccactctcattttagctaggttgagctaaaactgtttggctggacttcatctctagaaaaagttgagctggagctatatatcaaacagtcccttactatgcgtacaccacaacgcacttatgttttcgttattgctttacaaatgcgtggacagctagctatatataatataacctagcctagctcttctattactagcaaaagtatatgacgaaatgatcctattcaattccctgctagcgcgcgcgcgcgcgcgcgcgcacacacacacacacacacacacacacacacacacacacacacacatatatatatatatatatatatatatatatatatacggtaaatttgtttggggctccatggggcctgggcaccattgttgaaattgagtatatatccaattcaaatgagtatgaaactttttcaattacttaggtattaacattaactactttactaactagttcaaagcatgtttgtactgaatttgaacttgtttttgttagattttgattctaggtatatagcatccatacatataattagttaggtatgtaatcatggattgtgaaataaagttaaatttgagttgttttgttgataggtatagatatgaatcgaattattataactaggtatatactcacaatttgaaaatacagttaaaccatgggttgtctcatattcagtcacaaaagccaatataccctagctctcatcacaaacaagtgatgttctatctgaacaatccaatagtaatgggatcaattaagccatgactactctctgttacacgaactgatcatcctgtactcgatgttgggcaatataattcagcacggtggaaatgcaaaaggttggtcgtctggcaacgcggagcggccgtgcagggatgttgtctcctccaggaaagttctccacagaaatgatccatgtgaagaacgtgaantancaccanctgaaatctgccgttcccnaaggccaaactgcagaaccnacactcttgacaccatgtagatgaggtaggctcgccattcttgtggataatgagtcagaagaggaggaggtgcattttacacacagtccccatgcctcctactcccaaaagtgcatagcagaagaaggtgtgcctgcatgtagaactgaagaacagaagaagcataagggcatacacataaatacaagagttgctaccgtccagcaggcagcccggtaccaaatctaggcccttgattttgtccgatcgaatggacagcaaggtctagtacctccaggtacatttttgtccatgcgatggtaccagcactattgagagaggtggaagggcaatactgtattttcgcgtgtgaacggcaatattgcattgcctaaatctctcgtccttattgatctgattccctcgatatatggtggcggcggttacagccaaggttctggtgacagcgcaggttgtgctccaggtcgtcggtggtcatggagatacctgatgtggcggtggtgctccattagtcgtggcgaagagaggataaaaagagcgatggggttggatgatgagaatgcggcggtgcgaggaagaagatagggctcgcgcgatggggttgttctctctcgctcattccgggtcctaccccctcaagttggacagctggattagtttcagtaccacctggtactggtacctctcggtacaaagtgctggatggtagcaaatctctaatataaaggatttttgaaggatgtggcacatcctacgaatctagacagtctaaattcctagtactaggatgtatcaaatccatccaaaatctcttatattttggaatggaatgagtattataagtcgtttgacttttttctggtcaaacttttttagtttgatgaactttatagaaaatatagtactaatttgaacgaagaacaaacatattatcaaaatacatttaattttagatttaatgatactaatttgatatttcatatatatgttactagtttttctataaaattaatcaaacttaacaaagtttgaatagaaaaaaaattaaacgacttgtaatatgaaacgggagaatatttaactaggacgtagcccaatttcatgatcagaatttaacgagttgagtcagactagtccactaattaagctgcctttgtgtcagctcctacagtcctatctcctcatctccactgtcaattcgcttgctaagccgaatttgcggcgagcatggcaagaacaatctccgtggctatggaggggaaatccgtgatcacatgttggtactcctcgctcgccatgaccgtcttcaacttctccggcggcgacacgacgaggaacctcaagatggcctccttgagccgcgggcagccatggagctcggccaacgccagcgacgtcgccaccgtgccgacgtcgaggtgcctcaccatcttgtcctcgcacaccttcttcagctagcctgtccatgtcgtacctgtccgccgggacgagaaggtgcggcgccataatcaccgtgcgctcgtcgtcctccatctccggcagctcgtcggtgtagacgaagtagagcagcgcggcaaacacggggaccttcatgtcgtcgacgcggatggtcctcgcggcgtgctccttcatggaggagccgaggagctccgccctgaacaccggcgacgccgctccgcgaggacgcaccggtgcgccgggaacgtctcgccgcggaccctgaacctcacgtcggccgtctcgtcgtcgaacaggaggcgctcggcgaggtggcagcccaggacgggcggcgggagctgcacggcgacgagccccctcacgcggaggtcctgcacgttgaaggtgaggtcgcaccggatggcgaagcggttgccgacgacatggccggacttctccagctcatccctcttgatgaagctattgcaaacccatcgatcggtcttcttggagatggaacacttgtcgccggattggctgtaccgtgccacccgctcgccggcgagatcgagcagctgatcttgacactcgcgttgacatggacgctggcgcagggtttgaaatttcgccccccaccggcatgctcaaatttcgtccgaaattttcagttttttacagttttttgtgaatttggtcaaattttgttcaaaattcaaaattattcaaattcagtcaaattttcaaataattttggcttgaaattttcgaaatttcggtaacccccggcataatatacaatttcgaaattgaaaaccctgcgccggtgacgaggatgcagtcggaggctcggagcgcgtaccagagatgcgatgtgtagccgccgacttggaactcgtcggagtcaaggtgtttgccggtggcaatcatcaccgtcgtcctcgtgtaaccatcgattttgaggacgtggtagctagccaacggtgacggcacgacggcggcgtcgccgggtttcttcttggcggtgtgagggtgagaaccaatcgtacacatgattaaggtgaccgaggatgcaatagatcgatggatgtagttttgcgtggcgatgtacgtttattttctcctttatatgaaagtggttataactgccacacaaatagtcaagtaccaggtatcctctatagttcatcttcagataaaattttggtagaacaccaacatttgctttctctaggatcatagtaggatttgaaattttgctaaggtagctttaccaatccataattcatccaaggaatcgctatatagttgtcgacagaattttgcggaaaaatcattctatttctgggctgccggattgtgatgagattcattcgagggggagggaaacaaaaccacgtcgtgtgaggaaagatcgaaccgatgaccttatgcgcacaggcgcgcatagccaattgtcccacatgggtttttgaataattatgtactactccattaaaaaaaaaccctagctaggattgggttttttttttacgaagggttacaaaatacatataagttacagtgtggtcacaatctagttaaaaaaatataatatagtaacatttgaaagttttttactttaagaaaaactagtggtctactttagatttacaatatatagtttcacaatattattttttagtacaaaattaggtacctcgaaaccttttcttaagaccggaaaatttctcctgacgaactcacgatcatgaagcattctaaacaggagtataacataagctactaaattaatggcaaaaaataccgatcagaaaaacatgctccaaacttcacgaatttccccaaaaaccgtgcacgtcgctgcctacgctgtggatcatcaccggtcgtcgtcgaatcagtcatcgtcgtcggcgtcgacatcggcgtcggcgtcatgctagtgtcgtcggcgacgacacgcctgcttaatttgtcctcgcagaccagcttcagcctctccactttgtacttgtcagccgccgcgatcagctgccgcgccatggccggcacgtccgccgacgccatctccggcagcgtgtcggtgtacacgaagtgcagcagcgccccgaacgctccggcgtccatgtcgtcgacgtcgatgacgcgtgttccgggccttccggcggcggcgggccttaggaatccgccacggctatatagctcggccttgaacaccggcgaccgggcggcgagcacgcacctgtgcgcggtgaacgcctcgccgccggccaccctgaacgtgacgtcggcgccgtccccggcggagagaaggcggccgaggtggcggtgcatgtccggctccggcacggcgagggacgacgccggctcgacgcggagctcgatgccgcccatgacggtgacgtcgcaccggacggcgaagccgtcgtcggcgaggtgccccgacttctcgaggtcgccgtgggtgatgaatcggaggaatccccaattcttgaatccgtcggaggaagggaagctgtgcacgctgctgcggtaggtgcgcgacggcaccggctcgccgtccttgttgagcagcctgaacacgaacttcgccttgacggcggcggcggcggcggcgccattattgcggccggcggcggcgtcctgcagctcgagcatgacggatatggcgtcaggattctggttgctgcggtcggtgccattggggtagtacctgatgcgccacgcgtgatcgccggcgtggaagcgggaggagtcgatgctgtcgccggcggcgaccatggccttagtccgagagtagccgtcgatcttgaggatgtggtggccggtgggcttcgtcgtcgcgacgatcgtcgacgttgagccattagcttcggctgcgacggcgcagctggttgaagccgccgcagacgacgacgccgccatggtcgcagagatcgtctttgctgttctctatcgatcggtgagacgacgactagttggttatgtgattaactagaacatggaggagactccgatcttatctctgtaagcaacagatgttgcgatttaaattacatgacaaagatttccagaatataaactctctcagatcgaaccctgaaacgtgcaaaggaaaggattcctattagagtcagggttcactctatcggttcaggggtttctatcaggggtcaccgaaatcccgaaatttcagaaatttcggaaatttcggtccgaaatttccgaaattttgaacaaaatttagttgaatttgaacaaatattatccaaattcatgaaaaaattgaaaaattcaaaaatttcgactgaattaatatcgtatcgggggtcaccgaaatttcggtccaaaatttccaaccctgattagagtacgtcttgatcggtaataattttcctcccgcatgcatgggtcccactggtaatatatttttttttgagaactatacagtaaaacgctgacactcataatgcacgagcactcaccaataacataataaactatcaatttttacgtgccatatttgtcatagaagttattttgtaacgcaaaagcatatgtatttatcctctgtagataacatagaggctattcagattatagccaaaataaaccttaacaaattttgccaaatgccaaaaatttgttcaagttggtaaaattaccaaaatcggacgttgtttcactcaatagatcgaaaatgtttcatttaatagataaataattttcaatcttttaaaaagctgaaacacaaccaaatcacctcatgaaatattttgctacaacgtatgaaacaacggtttccaaaaaaaatctgacgatgtttcaacctatataaaaataatgttttagcaaatagcgaaagaatgtttcagttcttaaaaaaagtgaaacacgatcagatcactagatgaaacaatttagttcaacgtatgcaacaaacgatttaaactcattgcaacacttaaaccccgtgtacatcaacaaaccacgtatccatcaagatgaaattattaaacagtatcaaaagtccactgcaatatttaatctacacatagagaaatatcacgagtgcactagctgaaacattgttaatgaaacaaaaaaatgaaacggatccacctgataaggcgtttccgtgatatgccggcggtttgtagcaatgggcacgtgcgtgggaggatggaatcggcacgcattgggtgcccgatcgccagcatttccgagatagataagttttatcataaaaaatctaactagtagttaggctcacttcgccgattacaaagcatgattttatattaaaattttacaatggcacagatcttagtaaagcatctaatgcctaataatactctaccgttccaaaaatcctctatgcgctagctaggaactcaatgtgcagcaaacattgcaagaatctccgtggctatggaggggaagcttgtcaccaggtgctcatacccatcgctcgccatgaccgccttcaacctcgccggcgacgccatgaacctcaggatggccttcttgagctcagggcaatcgtgctgctcggccaacgccagcgacgtcgccgccgtgccgacgtcgaggtgcctgaccatcctgtcctcgcacaccttcttcagcctctccatgtcgtacctgtccgccgccaccagcaggtgctgcgccatcgccgccgcgctgccgccgtccagctccggcagctcgtcggtgtagacgaagcgcagcagagcggcgaacacggaggcgtccatgtcgtcgacgcggatggtcgtcgcggcgtgctccctcatggggccgaggagctccgccctgaacaccggcgaccgcgccgcgaggacgcaccggtgcgccgggaacgtctcgccgccgaccttgaacctcacgtcggacgtcctggcgtcgccgaggagctcgccgatgtggcggcgcaggaggggcggcggcacggcgacgagctccctcaccaggcggtcctgcacgttgaaggtgaggtcgcaccggacggcgaggcggtcgccgacgacatggccggacttctccagctcatccctctcgatgaagctcttgcaaacccatggatcgcttgccttggaggtggaacacttgtcgacgggttggctgtaccgtgccaccggctcgccggcgaggtcgagcaagctgatcttggctctcgcatggagacggacattgtcgccggcgccggcggtccggacgagagcgaaggatatcgagctcgagaactcctggtcgtagccgttggggtagtaccggagatgccaggcgtagccgccgacgtggaactcgccggagtcgaggtgttcgccggtggcgaccatcatcgtcgtcctcgtgtaaccatcgatcttgaggacgtggtggccgctcgcctcggtgacgacgatggtcgagcacgacgacggcgatggctggacgtcggcggcgccggatttcttggtagacatggcgatcgagatgtgaacgtgcaattaatcaatcgatttgttttgtgattgggtatgtgtatggccatgtaattaactttgttgttcctaaaagtggtttgagtccaactccaactccgatataaggcggggctgcttctgacaatacacatacgcattagtttttgacgtggaacctaagcaatttgattaatccaaacttaatatacacagaaactcaaaagactttctgattgtggcctaaaattttcaacgctgtttagtaaaaccttcagttaatattctgaaattcacaaaactttcgttttgattgcaaaactttcaattcaattagcataattttgagttatcataataaaaaaaaaatattcaactccatttgcaaaactatcaattcaagatcaaaaagttagaactcaattttcccaactttcaattcataatctgaaagattcaactctaaaaactttcaacaagaaactaaaatatttttatgcacaaatctctgaaaagtttcaattcataattaacctcagcttccaaattttctaaaaatctcaaatttccaactgagggcagctcatctgtttcctgtccggtggctatcgcacaacgctgatatctcgccagccggtaggagaaagatggtgaattgaagctccctaataaggaagagaaaaaggaataggcaagacagattttgggagatggaagaatggaatgccatcgaatcaacatctaggtagtggtggctcaccaacagccactactagaaaaacgatttttcatggcgtttggaaaatatttttcatagcggctaagtgaaaaaaccgccagcgcagaaattcgcgggggtcgggggtcacgggccgctagcggaaactcatcttcactagcggtcgccttaaaccggccgccagcggagatatggtattttcgctgtcggccctcttaacttggcagattttcgctggcggtaggttaagaagaccgccagaaaaaatagccctatttttgctggcggacttgttaccattttcactggcggataatggagagtgcagcctaaaaaatcacgccatcaaaaaatcagcgcgcgcatccacctacccgtccttatcctctctcctcctccctccatatccaaccctctcctcctcccttgtccctccagatccaacacctcctccctcagatccacaggtggcagcactggcggacacgggcgatcggaggagagggtggtgatgagcttggggtggtccaatctcggggcgtgggcggcaagctcgggcgtgggtggcaacgcatgggcgcgggcgacggaggagagggcggcggtgagctcggggcggtccaagctcggggcgcgtgcagcgaggttgggcgtgggcagcggcactcgggcgcgggcgacggaggagaggacggcggcgagctcgggcgtgggtggcccgggtggcggcactcgggacggggaggcgcgaggcgacatctccacaggtctctctccaccgctcctcactactccccttcccccgccgccaccaccccctctccctttctcagatctggcgtggcgtggctttgcagcgctggtggcgaggcggaggtggtggaggcctacggggctctgtagtagcgtcgtcgaggcggaggcggtggaagctgcggcggggctcgacaccggcggcgtcgaagcggaggcggttgaggccgacggggctcgttagcggcggcggtgatggtggaggggacttcatggacgacgatgacaacctcgagtgcgacgacgccagcggcgatggttctctgtatttgtgatgtttgtaatatttgtgatgatatttgtgaagcactatatttggattgatgcttggtgttcaaattttttgttaatgtgttgatatttgtgatgcttcaatgcttgggtgaatggaaattttttgctgtaaattgttcatgtaaatttatgtggatttatggatggagcattgatggaggtggacggagcagtgcttttttatatatatttttgcttttcaaatttcctcttcgctggcggctagggcagctacatggtttttatttttgctggcggtcgatttaacacagccgccagtgaaaatgaatttttgctggcggtcggtggaagataactgccagcaaaaatgtatctttgctggcggctggcttaagacgaccgccagcgaaaataaattttcactgccggtcgataaccgctagcgaagatcttgatcttcactggcctttactttgtggcggctctaaattctaccagcgaaaacctaaaatgaccgccacgaaaaatggttttcgtagtagtgagccaccactactttgataaggtgttttctaattcgctcgctagtgtatgtgagagaaatagtcttccagcctaatgcatgcatatgattttaaaaataaacagaaagtaattaacaatactagagaaacgatttttttatgctaagccccaaaacacaattatcccgactagattaacaacctgtattaaagatagtttagtactggttctaaaagcccaagtcacgcccaagtcactagaaacatctttagttctgattggtatcactaaccgatactaaaaatatatcttcagtatcggttggtaacaccaattcatactaaagatatttttaagtaccggttggtgttatcaaccagtactaaagatatctccaaggttaattcaaaacgaaagcatctttatacaagttagatgtgtattgtagggggatggtcacacgcgtaagggctcaggtgagagatatttcgttcgaatcacacatatttttttaacttagtatgcatctttagtaccggttctcggttgctactgccggtactaaatgggggtttttaaccggtattaaggatcgtttgagatctttagtctcggtttctacaaatggtactaaggccctatttttttcagcttgggattattataatccagattattgagagtaagctgaaagaaacagacaacttattgaagtagcttattataatctggagcccagcttattataatccgataagctcatttaggtgagctttttccagattattgggtgaaaaattacccaccatgccaccccactccctctttagacttgcaaactaataatctaggctctaataatctaagaaagaaacaactaaccgattattctactacagattataacaatctagcttatagtaatctgactcaataatctagattataataatcccaaactgaaaaaaaacagggcctaaagaaggtttttaaccggtactaaagatcatttcttcggcagtgtaaggaaaaactgacaagatcgtttctgaacaaatttagttatatttattcctatagatgtaaatcgaaattatccatgtacgtttgtatatggacttatattatcacaatatgtctaaccattttgtttataggtttaaactgcatacaagaaactagtgcaattgcatgtatgggcaaaagatccttaggacacccaccagaaaaaaaaacccagctctaacacatcatggctcaaaacgaaaatatctaacagctacccaaagaatcccctagtttcaaggatacgtcaaatgaaacatctactatcacaaactacggctcaaaactaaaatatattcaatagctgtctaaagagtccctacatactacggtacgtacctctaccaaaaaaaccattttcacaaacgtggatatttttttttcaggtggataggtccctcggaactaaacggccgcctacgaaaatggcaacgggggtgagaacgtctttcgtctacgaaaatagattctttgcttacagaggtggatctttcccccacctgaaaaaaaactatttttggttgtctgaaaaaacgattttttagtagtgcattgcaatctcgcaattcgtaatgtttgacattactaacttttggacatatatttatttttttttcatatttaaaagattgcgtaattatcatttcacaagtatacaattttagcacacaaggtaggtggtgttgaccatctatcgcattgtggaactcacaatcatgaataacaaaaaactgttttgtatcggccatccttgtatcagcgctgaagtctctacagtatgatgaaactcccagatgtgcaattttcaaagaactgagccttcgcatctagggttttcaatttcgaaattgatctttctgccgggggattgaaattacagaaatttcgaatttttttggcttaaattatttgaaattttgactaattttgaatggatttaaataaaacacgaccaaattcacaaaaagttgtaaaagactgaaaattttgggcgataaacgagcttgccggtggggggcacgaaattaccgaaatttcgaaatgaaatttcaaaccctgctcgcagttcgcacctagatcatgtaattctgggggtagaaaaagagccacagccgttatttatgtgagtgaaaacaaactttaaaagaacaaacaaccagctactaacttcaaaaagatccccttaaaccacggataacgctgtggcatatcacatgtagctgctgaatcagtcggcgtcacgcttgcgtcaacacgcctgcttaatttgtcctcgcagaccagcttcagcctctccactttgtacctgtcagccgccgcgatcagctgccgcgccatgcccggcacgtccgcctacgccatctccggcagcgtgtcggtgtacacgaagtgcagcagcgccctgaacgctccggcgtccatgtcgtcgacgtcgacgacgcgtgtttcgggccttccggcggcggccggtcttaggaatccgccacggctatatagctcggccctgaacaccggcgaccgggcggcgagcacgcacctgtgcgcggcgaacgcctcgccaccggccaccctgaacgtgacgtccgcgccgtccccggtggagaggaggcggcccaggtggcggtgcaagtccggctccggcacggcgaggagggacgccggctcgacgcggagctcgatgccgcccatgacggtgacgtcgcaccggacggcgaagccgtcgtcgacgaggtgctccgacttgtcgaggtcgccgtgggtgatgaatcggaggaatccccaattcttgaatccgtcggaggaagggaagctgtgcacgctgctgcggtaggtgcgcctcctcgtcgagcaggctgaacacgaactgcgccttgacggcggcgccgttgcggccggcggcggcggtggcgtcctgcagctcgagcatgacggatatggcgtcgggattctggttgctgcggtcggtgccattggggtagtacctgatgcgccacgcgtggtcgccgacgtggaagcggcaggagtcgatgctgtcgccggcggcgaccatggccttagtccgggagtagccgtcgatcttgaggatgtgatggccggtgggcttcgccgccgcgacgatggtcgacgtcgagccattagcttcggcgacgcagcttcttgaacccatggtggcagactggcagatcgtctttgctgttctatctcggcgaccagtttaattatgtgattataattagaacatgtatgtaataaatgttgcgatctaacacgacagatatttccgtaaacataaactgtatctgaactctgaatcgtatgagagttattagtccaagaaaaaggatttgtataagagtacgtttaattagattttttattttttccttgggaacacaatacaagcgcaatagcccatatactcgcgcacacacccatagttacgggcgcgcatacaccccgtactatagtttgccatatggaccacccggcacagcaagtcccggccctggtcatgcccgggccaagatttgttgggccggcatggcccgatctacacgccgggtcatgccgtgccagcccacgtgcttcacctgtggcccaggcacagcacaataagggtcgggccgtgccgggccagcccgaaggcacgggcagcccatcatacccgttccggcctagccacaacttgacatagaccccttcaacaactcagtttgacacaaaaatggtacataacacatcaaattcatgaaattcacatttacttcatcaaattcacaatcaattcatcaaatacatcaacatttcaatccaatctcatagtcctcaatgatgagcaaaaaaacttctcatatttcagtcaaagcagaagaactcaaagttagggcttggaaatagagaaaaaagatagataaaaaaagagttaaggtttgtgtcagggttacaggttaggtataccccttacccttcgatatgcgccacatatcgacatggcatacccgcgcatacacggacattatctgcatacactaaggaaatcttccacggtgtttgagtcctactcggacaagacagggtcgtcaatatatcgtgtagggtccgatgtctccgagttctacttggagaccacctgatctgcgatataaaagggaccccctgggaggacctaaggcatcgaatctcatagccaacacaaccactacagcctacgaagtcggagcctgcaggagctaagttgccgggagatctagtcgaaccaactcgattacgatcttgccggtttcatcgagttccatcgttccctttgtaacttgtggttttccatcatataatcccatatcaactggattagggctattacctgtcaaggggcctgaaccagtataatcctcgtcttttgtttgctcgatgtcgtattacgtagatccttgtaccaacataccccaataccctctatattcggtctacgggtatcacccgtcgacaatggcgcgccaggtaggggcacttggtactcaaggttctactactatgtcatccagctttgtcgacaacagcgtcaacaccaacctcaaccacgggtttcctgcttcaacaatgttagtgtggactcaagtcggcaaaatcgtcttcccggtctacaccatgatactgatctcagccggtccatcaatgaccggaaatgagaacgcaatggctgcaacccaagatgactccgtatcgaaggatcctcccgccgaagcgaagaacggaacatcgacaacatccaagctcgagaaggattctaatgcggccgaaccttgttgttccgacaagaaccacgagccgacgagaacaacttccgaagcgacaaggtcctggtgtcctatccacaaaaccaggaaacacactttgcaagcctgctgggtttttctcaacgtccgcgccgaaattcgcgcttgcaaagagcgtgaaattcagcgtatttgtccaactcgtgatgtttactgtcctatccacaagacaaagaatcacgacctcttaagctgtaaggtctttctcagcgccacgaagacgtcatctcctaaggaccaacagtcaggcatatcccttagagatgaagacaaggaacaacgaacgctggtctcagatcgattcgtcggcgtaatcgacatcaattcccacgaaccatcagtcctacatctactcgaagactacggctcatcaccaacgagtacgccacgcgaggtattagctatcgacgggaccagcacgtcagcacacgctaatgcggaggcggaaaatcaagtgactacaccggcccagcacatcaggacccttaacacaatactgagagagagaccttacgatcccgttctcaacgatgatctcgcgcggtggtaggaacggctacgggaatcagtaaccaacctcagccacgcgttcgaagaagccgctgctgctacgcatcaagaacaaccaccaactggcggcgtcaatggcgaaaatcctgaacagcgggagtcaccccctcgagctacctctccacctcgcggcaccggcgatctccgagaccacctcaatggctgccgagaggcacgacgcacacgagacgacgggaatcgctcccgacatcacgtctcttcccgacatcacgataataaagaacaggagggccgctcgaacgaagaccgagaccgtgctaatcgccacaatcgccacgatcatgatgatcgtgagaggcggacgcagggcgatactggtcgaggacgccgccataacgacgaggacgacagagatcggcgccgggacaacaacggagggcgacgataggattctcgagaacccagccgacgaccccgtaatcccacaccggaaccaagcgattcatcatcatcgtcatcttcttcttcatcctcatcgtcagacagacatccacgaaggacacacgatcgccgacaacccaccgcccccagcgctgggtgtagagctttcggtcgttccctgcgtgatgtccgatggcctgagagattccgacccggagcaatagagaagtacgatgggagtactgacccagaataattccttcaagtctactccacagtactctacgctgccggagcggatgacaacgcgttggcaaattatttgccaactgcattaaaaggctctgcacgctcatggctgatgcatctcccgccctactcgatttcttcatgggcagacttatggcagcagttcgtcgccaatttccaaggaacttacaagcgccacgcgattgaagatgacctacatgcgttgacacagaactcgggtgaatccctacgggaatttgttcggcgctttaacgagtgcagaaacacaatccctgagatcaccgacgcttctgtaattcacgccttcaagtctggagttcgagatcgctataccacctaggagttggcgacaagacgcatcacgactactcggagactattcgagatcgtcgagcgatgcgcccacgtagacgatgcgctgagacgcaagaacgacaagccgaagaccgggggagaaaagaagccagtcacggacgcacctgagtcaagcaagaagaaaagtcgcaagagtgggaaaaggaaagctcaagcggaagttctcgcagcagaatacgcgaacccatccaagcgcccagacccacagagtagcgacgcaaagaaagcatggtgccccatacacaagacggacagacattctttggaagattgcctcgttttcaagaagtcgctcgagaaacatatggcgttggaaaaaggcaagcgagtacgcgtggtcgaaaaagatgcggaggcggctgctcaggaatcagactcagcatatctagactccgacctccacgtctaacacattttcggaggctccacaacgtactcctccaagcgagaatacaagaaagtggaacgtgaagtctgctcgacatggcagggggctgcacccaagatgaagtggtctgaacagaagatagaattctcgcaagaagaccatccccagactgccgtcatcccaggacgctatccgatcatggtcgagcccactattcggaacatcaaggtcccgtgagttctcatcgacggtggtagctcaatcaaccttcttttcgccagcaccttggacgcgatgggaatcccacgaagcgagttgacacctaccgatcaacccttccatggaattactccccagtcctcgtccaaaccattgggcaaaattacgttgtctgtgactttcggccaagtaaacaacttccgaacggagcagattacctttgatgtcgctgaatttgacacagcgtataacgccatcatcgggagaactgcacttgtgaagtttatggccgcatctcactacgcgtatcaagtgctcaagatgccgggaccgaaaggaacaatcactattcaaaggaacgccaagctagcggtacaatgcgacaagcggagcctcgacatggtcgagcaaacgcccagcccacccgccacaactgagcctcccaagaaagtgagcaagacaaacaagatgccgaaaccagacggcgcgatcaagatcattccactctctagtcccaaccccgacaagaccgtcaagatcggagcatcactaagcgagaaataggaactcgcgctcatcaccttccttcgcgacaatgctgacgtgttcgcttggcagccgtccgacatgccggggatccctagggaggtgattgagcacaaactcatggtgcgacccgatgccaagccagtaaagcaaagactgcggcgatttgcaccagaccgaaaacaagccatccgagaagagctcgacaaacttctcaaagctggctttatcagagaggtgctccatccagagtggctagccaatccagtcatggtgcggaaggccaacggaaaatggagaatgtgcgtcgatttcaccgacctcaacaaggcgtgtcccaaggatcacttccctcttcctcgaatagatcaactggtggactcaacagccgactgtgagctgttgagcttcctcgacgcttactctggctaccaccaaatcagcatggcgaaagaggacaaagagaagacagcattcatcacgccgttcggggtattttgctatgttaagatgcctttcggactgataaccgcagggaatactttccagcgcacggtccagggcgcactcagcaaccagctcggcaacaacgtcgaggcatacgtcgacgacatcgttgtcaagaccaagacaagtgactcattgattgacgatctacgggaaacgttcgacaacctccgacgatatcgcctcatgctcaatccagagaagtgcacgttcggagtactgtcgggcaagctgctcggtttccttgtctctggcagatgaatagaagcaaatcccgagaagatcaaggcaatcgagaacatgaagtcgcccacaagactcaaggaagtacaaaagctaaccggatgcatggcagcactaagcatgttcatcgctaggatgggagaacgaggacaacccttcttcgctctgctgaagaagcaagacaaatttgtatggacacaggaagccgaagaggcatttcttgcactcaagcgctacctatcaaacccccctgtacctgttgctccccaacctaatgaagaattatttctctacattgccgtcacgccgtattccgttagcaccgtcattgtcatcgagagagagaaagtacaacgaccagtctactacgtcagcgaagctctccacgacgtaaaggtaagatatccacagatccaaaagctgctttacgcagtaatcatgacgtcaagaaagctacgccactactttcaagcccacagagtcacagttgtctcttccttccctctcggcgaagtcgtgagaaacaaagacgttgttggccgcattgcgaaatgggtagtcgagctaagccagtttgatgtccactttgtgccacgaacagccatcaagtcctaggtgctcgccgacttcgtagctgactggactatacctgataacaaatcagacaaccaaatcaataacgaaacgtggataatggcgtttgatggtgcactcaacagccaaggagcaggggcaggattcatcttaacatctccttccggagatcaattcaagcacgcaatccacctcaacttcagggcaaccaacaacacagccaagtacgaaagactactcgccgagataagagttgtagccgcacttgaagtcaaacgactgatcgtgaaaggggactccgaactagtcgcgaaccaggtgcacaaagattataaatgctctaaccctgagttatccaaaggttcgatgggatcgaggtccgacacgtataccgcaaggacaacatcgagccagacgatctagcacggcacgcgtccagacgagaaccactcgaacccggcacttttctggacgtcctgacaaagccatcagtaaaagaggtcagcggcgaagttaacctagacgcccccgacagcagctcggaggccacaaaggcagaacgcgccgttgccgatatcaaaaccacagacgattggcgcaccccactgatcaaattcatcaacagcgacgagttgcccgaggacgacgcagatgctgagaaaataacccgtaaagcaaaaatctattgcataatcggcaacaatctatacaagaaagcgccaaatggggtacttctcaaatgcgtttcgtccgacgacggcagacacttcctcctcgatatacatgaaggcatctgtgggtcacacgccgccggtcggacgttggtcgggaaagcttttcgacaagggtttttctggccaaccgccctcaaagatgcatgcagcatagtccagcggtgtgaagcctgtcaatttcacagtaaacacacaaagctacccacacaagcgctctagactatccctcttacttggccgttctcgtgctgggggctaaatatactcgggccattcccacgaggacagggcggctacaggttcctattcgtggcgatcgacaaattcacaaaatggagcgaggcgatacccacgggggaaatcaaggccgacaacgccatcaaatttatcaaagggatattttgcagatacggactaccacatcgcatcatcaccgacaacggctcccagttcatcagcgccgatttccaagattactgcatcgggctgggagtcaagatatgcttcgcttcggtctctcatcctcaaagcaacggacaagtcgagagggcaaacagcatagtgctacaagggatcaagacccgtgtctacgacaggctcatgtcacacgacaagaaatgggtcgaagaactcccatcagtactatgggccgtacgcaccacaccgacaacgtctaacaaggaaacacccttcttcctcgtgtacggctccgaggccatgctccccagcgagctacgacatcaaagtacacgagtacagaagtattccgatgaggatcaggaggaacagcgaaacgacaatgtgaatctactcgaggaacatcgcaaatgagttgccgtccgagcagccggttaccaacaggccctccgacgttatcacgagaagcgcatccgagcacgcatactttcaatcggcgactacgtcctgcgacgggttcaatgccaaacaaggcaaaacaaactctcacccaaatgggaaggaccttacacgatcacacaagtcttgcggccaggcgcattcaagatagcagatggcgatggccgcgagttggcaaattcttggaacattgaccaactacgtaaattctatgtatgagtcaatataatccatgcctgtaagacaccttacagtatcaataaagcttattttcaggcacatattaaaatcacagtgttcctgcctgatgatcccttacccagatgacacctagcgttgaaacctatcctcatgtccctttacgccgtcctgacaaggcctccgaggaacctaagggatcttcggctggggacgctcagagccgataaggccttgccggatcctgtagagacgaaagaccatgtaagacctggtcatgtaagagttcttgccgtgcgtattaaccaagccgtgtaatcggaaaattaactttccaacatcacggctgggggctaggatcagtgctttctcaaccaaggcaggtcaaaggtccaagagccttgtcccccgagaagaatcctccgacgataaggctgggggctagggagagtgtacgactcaaacgactgaccaaagtcgcgaactgaggaaacactcttacacactatatccaga

SEQ ID NO: 73926 - DNA, 11577 bp, Oryza sativa
ggcgctgggatgcagcgaatgcggtggaggcggtggcgcggcgtgaagtagatggggatggcggcaagaggcggccggttggcggcagttagtggtggggctcgggtttgcggcgggaatggtgcttcgggggtggatttgaggagtgggccggtggccgggatgcggcacggagcggcggcgctgtgggaggcagccgcacgaccgggcgaggtcggtatcgccggcggggagcggctggagacggagggaagagcggcggctcggttttcacggtggggtggtatttcggtggtggtttgggggaaaaaggagtggaggacggggtagagcttggcagggcgttgccgacggcgcaagcggcgaggtgcggcgacgactaacgcggcggcagcggccggctgaaggcggtgtgtggcggtagtggctcggcctcgcgatgggaaggtggttccggcggtggaggagggagatggagtggatgccggggtgcggcacgacgcggcggagctgtcggtgcaagcggcgcggcgcggcggcggctacagcgacggcggcgtgcagccggagcttgccggaaagcggcggagcgcgggagcaacgtggggagagcggtagggagtgcagcgggttcgggaaaattggggaaatgggaaaggagaccacggggatcgtttttattggctcggggcggtgggatcatggccgcggagggcggaatcgaccggcaacggtcttcggagtgggctccggcgacgtgggcgaagtggggtggttcggcgccggttttggagggggaaagtgggggaggagagtggaggaggtggggcgacgcggtcccgcggtcggggcgagcgcgcgggtggaggaggaggcggaatcggcggcgacgtggggaggccgtggcggcggtttcggctgagggagccggaggttagggatggccctgacaggtgggacccacctgtcggtggctcggggggaaggagagaggaggagacggttgggggaggccaagtagacttgcgcgaaggagggggcaagccgggccgatggcccaaagagaagggaggaggggaaaaggagggcggccgggcccaagaggatggagggggagaagatcttgggccgaaagcggcccaaagacaaagaggggaaattttatttgttttctttttattctaattgatgcaatgatctttgtgctattaaaactatttctcgagctccgaaaattcacggaaaattccggagagtacattagggcacaaagaatattacaaaatattcccggccaatgatttttaaaggaaaatttcaaattctcccattatttcacttgattaaattgatttatcttttatttaatttctagaaaatgcattatttaatgatttttaaacccgaacgaaaatcggggcgttacagtcacccagccggcgcgccgtcgctccgccttgaggcgggctgccaccgctccgtccctagggatggcaacagggcggggcggggacgggttggataagaactcccccgccgccactccctgcatttgccccctgccctcggccccgcagggacatccgggtgaaaatcgttcgccggccctagcctcgtaggggacccggcgggtgagcgggcccccgtatcacccggggtgcacaaggctgccaatgttgaacggcaactcagaaagaatgaaaagatggcatgaggtgttactagtccagtcagtaatcagtaatcaatggatcacaaattcacaattagtagtaatatgcattctaggtaggggacggctaatggacgcctagcgatcaccggcccacccctccccctatatgctaccttctctctccctttctcctccccttcttctcttcttactacagtacaccatataattttaaaaaataataaaacaaagttggaaaaatttatgtatagaaatacaaatactatacataaaaaaattgaattcaaattcaaatttaaaatgggtatgtaaacttttgatttataaactttagatctataaactaatatttgaattcaaattcaaatttgaacgggtgtaaacttttgacttataaactttgggtctataaactaatatttgaattcaaattcaaatttgaatgggtatgtaaacttttgacttataaactttgggtctataaactaatatttgaattcaaattcaaatttgaaacgggtatgtaaacttttgacttataaactttgggtctataaactttaggtgtataaactttagatgtatagaaatattatatataaaaaatatttgaattcaaatttaaatttgaatcggatatataaacttttgacttataaactttggatctctaaactttagatatgtaaatttgaggtgtataaactttagatgcataaatttactaaaataggaaagtattacggtaccaaaaaaggaaaccaggtggaggaagtgggattcggatccaatcgccctgggcgatcgctcgcccagtagcaattcccttctaggtagccggatgcccaaatacacataaacacaagtactaatgtagttaagtggtatgtatgataaatacacaactaccaactcacaagcaaagcagcagccagccaattagcagtatactagtagctttgctcgaggttgaggagctggtcgcaggagtcaagcttagctcgaggttgaggagctggccacaggagtcaagcacttggacagtcggatggcagacctgcaacgcgcggcgatggcgctccactccggctcgatgttgcgggctccggcgctctggtcgccagcatcgcgctccgcttcaccgccacgccgccgtcgccgccgcacgcaatgggcgcctgggagctaccaaactgatttagggttatcgattcttcagattttcttttaggaataagttcactttaggtccctctatttgtcgtccagtccgattttcgtcccttgaccgtaaaaccgggtatgacccatccccaacttacgaaaaccggttaaacgtggtccctcggcggttttgaaggcggttttggctgacgtggcgcctacgtggcttgtttgactaggtcttcatcccaagtggcattgacgtggcgcttacgtggcaattatatctcggaaaaataataaaaaatgtggccccacatgtcatctgtaaaaaaataattttaaaatagtggggtccatgtgggccccacatgtcagccacactcctctcttcttccctctcccttctctctcttcttcccttttccctctctctctccccttcccgggcagcggacggcgtgggtgggaggcggagcaggcgagctccggcggtggcggagggcgtggtcggcaccgccccctgaccggagcaccaccggtccgcgtgaaggcagatctggggaggtccggcagccagcgctacggcagaagctcatctagatgctactcgaccccaacccgggcacccgcatcaccgtccctggccttctcgagacgccgtggttccgaaagacagcgcccgtcccgcgccccatcatcgccgaccccgtgccgacgccggtacacgcatggcaatgccgcccgaggtctgcacgcggttccacctaatctccctgtctgagggcttcgacctgtcgtcgctgttcgagcatgaccccgccgtgtcgccagggcgagccacggcgcgcgcgggcagcacgcggttcgcgacacgggaggcggcaagcggcgtggtcacgcagctagaggcgctcgcgacgggcggcgccacgcccacgcgcgtggcgaggagcggcgcgcgcggggtgcggctcgccatggcggccgatcgacgtcttcagcgtggcaccgtcgttgctcgtggtggtcctggtggacgtcaagaaggatggcggtgacactatggagtactggtcgttctgcagcgaagagctccggccggagctcaaggacatcgtctggtcgccggtggcgacctgacgacacggcgggacgtcgctgctgccattattgcacgtcatcgaatcgtatccgttgctatccaatggggtgcattattgtttggtgccggggtgatgtctggctcgctcgtttgtccgtagcaactcgaagtcaatggctgctgtagcctgctagtgttgctggctagagtagcttgctgccgcggatgtagtagtaggtcggtatcaagatcatgggccttttcatctccaaacggcgagggcggggacacggcggtggaggcggcgaagcaggccatcgccaccgggcacgtggaggccaagagcgcggcgaacggcgtaggcctcaccaccttggagaagggcggcggatggctaggtgagcggcgcgcaagagagagatggctgccgccaccccacacgcctcgtgcgccgtcgcccgccgccggccatgcgctgtccatctccgcgccgcccgccgctgccgcggtccgccgccgcctgccgtgttggacgccgtctggcgagaggagggaggaagatggggagagccggagagaggaggaagaagaggattggatttggtcatttgagaatgacatgtggggcccacgtgggccccaccatatttatttttagctgacatgtgggacccaccatttttaaattattttttttctatggctgacatgtgggtccacgatttttattatttttccaatatataattgccacgtcaacgccacatcaatgccacgtgggacggagaactagtcaaacaagacacatagacgccacgtcagccaaaaccaccttcaaaaccgctgaaggacctcgtttgcccggttttcggaagttgggggacgggtcgcacccggttttgtggtcaagggatgaaatagagggacccaaagtgaacttattcctttcttttatactatgctgggctgttgggatgttgggctattgggctgacctttgtgggcctatttcgcacaaattttaacgactgggctacataccctggggccccgcaggtacccgcgggtgggaatagccacctgcccccgcccccgcataattccgtgtcacgatcagtcagcgagattcgagattcagacagatattggaagcaggaatagaggaagaagacgagttcagggaagaatttgatagcaggaagagagaagatttgaattgagttgagatatttttctattacaagccatctctctctccactgccgacctttatagcacaacactattaggtctctatcactgactctggccccagccgatagctactggacccacactccacccatatatctcgtgttgggcttgggttgccttacggtgcgcttcatggacctcaactgttgaaggagtagaaatagactccgtgacattctccccccgttgagatgaagcttgtccccaagcttctgaagttggaaagcgtcgacgcatttcttggaggttctcccaagtaatggcgcgaggttcctctccggaccacagaatttgaacttgaaccaccatcttggagcccttgcgaatgagacggtgatccaaaacctgaagaggaacagatgcatgctctgcactggaatccaagacgggcaaagtaggttgcacagactcagttggcgctaaagcatgcttgagctaagaaacgtgtactactggatggatcaaactgcttgatgcaagagctaagtgataagccacagtgccatctttggccaagatctgaaaagggccatagaatctaaaagatagctttcggttggcacgagtaacaactgattgctgcacataaggttgcaatttgagatatgcccaatcaccaatctcaaaagaccgctccgaacgtttcagatcagcctgagctttcatgcgaatctgtgaccgcaacagatgttctttgataagagtttgcatcttcatacgatcctgtagccaatccgataattcggacgatgtgcaagcagcgtcaatagatagtccaaaataccgtagcttgtgtccatatagaacctcgaatggtgaagtgcccaaagaagaatgaaacaatgtattgtaccaatattctgctaatgccaaccaacgactccattgacgggggcaagcgtggacaaaacagcgaagaaaagtttccaagcactgattcacgcgttccatttggccgttggtctgaggatgataagaagagatcatacgcaattgtgttccggccaattggaacaaagaagtccacaaggtactagtaaaaatgcgatcccgatcagaaatcaaggactgaggcatgccgtgcagacgatgaatgtgttgcatatactattctgccacttccaaagctgtgaagggatgagataaagggacaaaatgggcatatttggagaatttatccaccaccacaagaatgcaattgaaagaaacatagcgggacaagcctttgatgaaatccaatgaaactatttgccaagcgtgattaggaactggcaatggttgtaacataccagggtacttaacgtgttccgatttggccttctgacaaatttcacaggcttgcacaaattcaaccacagaatgacgtaagcctggccaagcaaacatttgcttaatccgttgacaagtgatagcagtgcctgaatggcccccaatagcagcagtatgaaggttggccaaaatcttctgttgaaggctgacattgttcccaatccacattcgctaatcataacacaacactccatttttcaatgtataacgaggcacagaagcaccagcaatacacagcgtctgaactttactagcagcatctggatcgtgctgatatcctgccaccacctcctgaatccaatctagaacacaagtagacaaggctgatagttcaacaatcgcattctcaggatagcgagacagagcatcaaccactctgttatttgtccctttttttgtatatgatcttgtaactcaaacccaacaacttagtcagggccttatgttgccaaggtgtggataaacgttgatcacggagaaaagccaaactgcgatgatcagttttaatcaaaaactcatcatgctgtaagtaaggtcgccatttttccactgccaacataatagcaagactttctttctcatatgtcgaaagaccctgatggcgcggacccaatgcacgactgagaaacgcaatgggatgtccattctgcataagtattgcgccaatacctttgtcagaagcatctgtttccaccacaaaaacttatgtaaaatctaacattgccaaaactggtgtagagacaagagcatgtttcaaagcctgaaacatagcttctttatcggaagtccaaacgaaaacttgcccttttcgcaacagattagtgagtggtttgctgaggatgccaaaatgtcgaacaaatttgcggtagtagcccgctaagcccaagaaactacataaatccttgacagaagttggagaaggccaattgcgaacggcatgaatcttatcctaatcagtagaaacaccattagggctaatgatgtgtcccagatatgcgagtcgttgctgagcgaaagaacacttgctcttcttgactttaagttgatgacgatccaatatctgaaagacctgttgcaaatgctgaacatgttcctgaagagttctgctataaatgagaatgtcatcgacgaaaaccaacacacaacgtctcagcaaggaagatagaatactgttcataactccctaaaaagtagccggggcactggtgaggccaaaaggaatgactctgaactcaaaatggccactatgagtcttgaatgctgttttatgttcatcatcaggatgcatacgaatctggtgatagccggcacgaaggtccaatttggtaaaccattgagcacctgctagttcatccaatagttcatcgatgattggtagtggatacttattcttaatagtaatagcattcaagtgacgatagtcacacaaaaacgctacgacccatccttcttcttgactaaaagcactggagaagagaatggactggcactaggccgaattattcccttagtgagaatatcctgaacttgagattcaatctcatccttctgagcaggtgtgtacctatatggtcgcacattcactggttgagcaccatgaatcaagggaatggtgtgatcatatggtcgcgaaggaggcaaaccagtaggcttatcgaagacagttgcataatcttgcaataccttctggaccacttcaggaatttgctcgactgtaactggtgttgacaattcacacagttgcactagatgggccactgcatgacgatctccaaatgcttgcatctgtctaggagtggctaaagcacaagtatttactgctggtttgattccacacagagtgatggactgcctgtgagcactgatagttagaactctgttacaccaatcaactgtcattggactatgggtagctaaccaatcaatgcctaagatcatatcaaaactggtcaagggaagcacacgcaagtcagtgcgaaaagtgtatccctgcgtgaaccattcacattgagtcacaatcgaatcacagtgtaagacaccaccactagccacctgcactttcagtggagttggaagagaatgcagtcctgataatccagtagccaatttgctactaatgaagctgaccgaactacccgaatcgaccaaaatcagcacctcaaaaccttgaacatagcccagaattcgcatagttcccacagattccaccccttgtaatgcaagtaaagagacaaccattaattctgaccgtgcagggctctcgacatctaagatatcagctgaaacactgtcctggggatcctgcaaatgggcaaacacctcctgaaccgcatgcagttgcacagaattagcacatttatgattgtgagaccatttctttgcacagatataacacaatccttgagcattgcggtaagcacgaagagtagccattttgtcaggggatggtacagccttgactccatcagatttagcttcaatactaccagatggtcggggtggtggcaacggcaaaggataagctcttttgacctgagctcgagtaggtgcaccaccatcataacgcttgaaatcagtcggactcttagccatctcctcttcttgtaatgaagcaagaacaaaagcagtctcgaggtcgcgaggccgatgaagtataactgcaccccgaatctcttttcttaacccattggtgaacttatgagtgaaatatctatcattagccgctaggtcataaaccaagagctgattggctaattcatcaaatttctcataatactcctgaactgtgcctaactgctttatggtgtccaattgccccaaaacccaatcatgcagtttatgtcaaatttacacgctactgcaccacaaaactctgcccaccctagataacaaacatgagcacgagacgaatgtaaccaggaagctgctctacctcgaaaataaatggtggcaattcgtacccacggatttggagatgtatcgcaaacatcaaaataatgctcgcatttcatacgccaatcctgtgggtccgaaccatcaaaaatcggaaaatccaacttaggcattcgatgattgaaggacttttcccaaaattgcgtcccaaaatttccctcaccactctcccaattcccagcaaaattaagatgagagggggtggcatcgtacgtactcttgatcggagtcaggaccagggatgtgaccacccccgatgcccttccccggaaattttgtggtgcgcggtggccattggcccacttctctgctcctcccgctgcagtcgtctccttcgtcggcgaagcgggcgtgggaagcagcgacgccttcctttcctcatccgtcaacggaactcgaggggaagatgccgccgtagaagtttgcaccgccttgccgaggagatcaacttgctgacgaagttcgccgacctcctctcgcagctcctgcacggcctcctccacttgtggcctccagttgttcatgcctagatccagcttgacgatggcagcttgtgtctcaacctgagcccgattcaacactacgagcgactcctggatccggacaagcaccttgccgaaatcgatggtttgctttccatcgcctccacctgcagctgcagccgagatgtgtagcgtggcttctccaggatttgaggctctgataccagaatgtcacgattagtcagcgagattcatgattcagacagagattggaagtaggaacaaaggaagaagacgagttcagggaagaatttaatagcaggaagagagaagatttgaattgagttgagatatttttctattacaagccatctctctctctccactgccgacctttatagcacaacactattaggtctctctcactgactctaggcccagccgatagctactggacccacactccacccatatatctcgttttgggcttgggctgccttgcggtgcgcttcaactggacctcaactgttgaaggagtagaagtagacttcatggcattccggggccccgccccgatggacccgcggggtgaaatttgcactccccccccccccccgcgcccccgtaggggggccgtcgctgctcccctcgagactgcaccgttgctccaccatgagaccgggccggcgtcggggccaccacccagccgccgcgtgctccccctcgaggtgacgaacctgccgctggcggtggacccggccgtcatcaacctccgcgaggatggttacaaatgccgcgcgcgcgaaagacagcaagtggccgactctggagctgtggtggagtggtcacagtgcttgcgcggtaaaagtggcggttgatcgctcactagctacattcactctcagcccaccgaaacccatttcatttccacgtacgatttatacttcttccgatcctcaccattaattaatccacctcctcctaggcctagctctgcatcgatctgtccgtgcgggatcagaggaggagctaataagctaggtaggtaggtgaagaagaatggtgaagatctgctgcatcggggcggggtacgtgggcggcccgacgatggcggtgatcgcgctcaagtgccccgacgtggaggtggtggtggtggacatctcggcgccgcggatcgaggggtggaacagcgagcgcctccccatctacgagcccggcctggacgatgtcgtcaggcagtgccgcggccgcaacctcttcttcagcaccgacgtcgagcgccacgtcgccgacgccggcatcgtcttcgtctccgtcaacacccccaccaagacccgcggcctcggcgccgggaaggccgccgacctcacctactgggagagcgccgcccgcatcatcgccgacgtctcccgctccgacaagatcgtcgtcgagaagtccaccgtccccgtcaagaccgccgaggccatcgagaagatcctcgcccacaacagcaagggcggcaacatcaggtaccagatcctctccaacccggagttcctcgccgagggcaccgccatccaggacctcttctccccggaccgcgtcctcatcgg

SEQ ID NO: 73927 - DNA, 696 bp, Oryza sativa
agtcacccggggaaaggtgacgcgagagaagaaagagtttccgattggttgagagaaagtgactgaagcagactaaaatgtaaatataactaatatatacttacatattgggttttgtgtgattaattaatgggttgatgtacatgcttgcatgtaagttttaggagtgctaataaatattatacttgtatgttaagtttatgtgtttaataggtattagctttatagaaagaagagattggatatgccctcagagctcatagatgaccgaagacttgggctaatggtcttaacatgtgcacatctttgtaggaaagagccaaacactcgagactgcaaagtaagtggtcaaggtcttcgacaacgaaagctaatctttaattgagactagggccacatgtcttttggttcttaagaaatcaaatggaatcttttttccggtggatcctcagttccaaagagtacaacggctggactgtttttatgtggaaaatgctctgatattactgtatttttaaataatagataggaatttagcatatacaacattcacaagtggatatacataaccaaagattacacgagtacatactttcctaatctcataactgacataaataacaaacaagcgaaaaggaaatacttaaaaggctgggattaaagcttttcttgcttgcttcaaaacttaagataaaa

SEQ ID NO: 73928 - DNA, 8753 bp, Oryza sativa
agatggtctatctccaccggagtcctccgagaacgagcaaaaccctcacggagaaattcgaggtccaaacgccggcgatgatctcgtaggcaagccaacacgtgccccccggcgtatcggctcgatcgacgacactcttgcttcaaggcctcgtcaatacgcttaccgatgccgtcgagttgagcacaggccccgttcagccacgagatgtatccggccgccgactcctcaggttctccgcggaccactcgaagttctctgcagactctggccatggatgtgcagcaactcttcaagtacgagttaaaccacacctcacgacctcggagcgtttccacggcctgctccttttttacttccaacatggctctctcgagttccgccacttcaaatttcgttttccaatattggatacgacgatcttggccagcaaatgcgtcctcgaggtctgtccaacatggaaacgactacgtcagactgcttttctctctcgagaacacagctgatcaaatcgggggagcgaaaagcgatgaagagaccacaaacctaaggaagtcgtcgctgtccctgttctcgcgggcaaaatttcacccacgttgtccagcaacgcttgtcccacaaacgcaagatccggaaggatcgctgacaattcaggctgcccacgctactggacatcctcgacatcgacatctctacaaaggacaaaagttcccgaggtcaacatacaagagtaaactagaatgataattgcacgcacgaaggcggtcagaattcaagttttacacagcgtgtcttggaagtacaagaagtcctactcttcaaatagggggagaacagactcccccagatcactgacttctttcatcacctccttacgcgtgttgctagccaccccctgatcaaagatctcgcgcagatcgagttcaggacgcgacatctttactcatgcgaggacatgacacgccccggtgtagatcccgttcgacgtctcctccgcgatcctggccgcatgcttggaggggatctcccccatcgccgtcgccagttccgcaagggaggatgtcagcgagaattcgtcaggattcactgggatggtagacttgatgccgcactccccagcaagctggtgcaggcctgtgtaggtgacccgcaacgagccccggatttctgacaggttgttcccgagttccgacatgcggtcctcaagcccctgccgttgtcgctcgttgccggccaccaattccctcatcttcgtgaggtcttcacgagcttccgccaactcgcgcaccagccggtcagcacgctcgttcgccaacgctgcttccgacctcgcctgtgcaatctcgcggccgatgccgtgagcaccagcttcgaggaggcgccccatttcgacttggagctcctcccaggtgaggacggcagctggtggaccatgacctaccgcgggatcgctgactgggccgctagacgtcgcctcccggctcccggctatgagtacgacatccattgaggccgcggcaggcgacgcgctggaagcccctccggacttgttttgcgcaacctttgcccgcgcctccctatgggacgaccacgtatcagacaacgcttgaatggaattacggaaacctaaaaatccatctacttacttctcgccaaccgttacaagacgttgtcgtcatggagacgggggagacgcgtccgaggcctgaaagacaaccaatgcgaagtaaggcaaaatccttctggcggcacgatctggcgacaggataacttaccgagggggtcgacgtcttgcgacgatgtccgcttacagaggagaacttcctcccctttgtcagaacattgccaccactagtagtggccgcagcagcatcagacgcctccttggcgaccttctcttttagagacgccgccacctgatggtccgtgagcggcccgatgatgtcagtcagaggaagagcctacacttaatcaagtcataaggtgatctcgaaaggaaaatgcgggattcctatcgagtacacttacgttgatagcgtcatcacgttcggccgcccctttttcacaaaggggcacggggatgttacttgccgttgtcggaccactgatcatcacctgcccgacgtggcgctccacggctttgctgttcagacctgtgaatcgagaaccaaatttcgataaatcaagaggaacgcaaacataagcatgtcaggataaatgagagaaagataccccgaggagagacccgggtcgtgtcctccggtccagaatagttaaaggctggatgggcccgagcctggagcggctggatccgcctacaaacgaagtctgcaatgacttcataccccgacaagccccgtactcggagatcgtcaatgatgtcgataaacgactgaagagagggggtcaaagggggctttgcggtccaagacgaaatcttgtttggttgttctgtgggagcaatgaagacagggttcgaatttttgatctcaaaatagaaccacctattccgccatttgctgcgagaagaagggcactggaaggggatataacgcgacttcaggccatcccgaagtcagaacccgacgcaactagataccctgttgaactccatccaacgcagctcgtagtagaagcgaaagagatcaagaaaaggctctaccccaatgtaggcctcgcaaagatgagcaaagatgctaagaaaggcgatagaattgtggttcaaatgaagaagagaaagaccatagaagttcaaaaccaggaggagaaattcggaaggcggagggagaaaaccgcagagaacatagtcttcgatcgcaacaatgcaacctaagacgggctggggattagtacctcctgctgccctctccatggttccacgaccaggaagggcgccatcttcctgaagctccttcagcgacgcattggtggaagatgacttgccaaggtccatcgctaatcgaagattgctggagaaagggcctagattgatgaactggggtttttgcgggagcagagaagacgagaggcgcttggaggctggagaatttttccacaacaggcggacttcaaatgaatccccaaaactcccttaaatagacgcacttccgacggtgcgaattccaaggaaaggagagacatggccgccagaaatttctgggtccgttacgcgcggcggtttttcagacttcagtttaaattcactcgtgaccgttgggcttcacatggtgttctcaatcatgtcctgtctctatggttcccacaccgagaacgacatcagtctcgacatcagaagtcgctattggtcgcacgagttcatttaagcagaagtcgggggctactgtcaggtttacgggttaggtgtaccccttacccttcgatatgcgccacatatcgacatggcatacccgcgcatacacggacattatccgcatacactaaggaaatcttccacagtgtttgagtcctactcggacaagacagggtcgtcaatatatcgtgtagggtccgatgtctccgagttctactttgagaccacctgatctgcgatataaaagggaccccctgggaggacctaagacatcgaatctcatagccaatacaaccactacagcctacgaagtcggagcctgcaggagccaagtcgccgggagatctaatcgaaccaactcgattacgatctcgccggtttcatcgagttccatcgttccctttgtaacttgtggttttccatcatataatctcatatcaactagattagggctattacctatcaaggggcctgaaccagtataatcctcgtcttttgtttgctcgatgtcgtattacgtagatccttgtaccaacgtaccccaataccctctatatctggtctacggatatcacccgtcgacagtttgtccgtttgtacctgtgtagccggtgcaccggagttgttgttgaagacaataagctcacggatctacgagaatacaatactcaagagggatattggggccttggggtggatctgacaaagaagaacaaaagggaaagagatggcgcatgtggccctcgatccagcagttggagatgaagagctgacagattcactggtggcccgtggccctcatgcccctagcaggacgccgtcagtggccctcatcgggcaagacatctatcgaagacgaagaggaagagaggcatatcggtgagcgcctgagcggtggtcggtggaggaggaccggtgggcgggagagggacagaggcgggattggtgggtggctaggcggtggctgatggttgtggcatgtggcggctagggttagggttgaccgagagacgagagcaaccactggggggggcggggggagggggagacgctgccgcttatatatgggggcacgcgtggccttgggcttggcaggctggcaggcctggtcgaccattggatcgggccgctgttgtgcctaccattggaccatgccgtgccgggccagtccaccgtgccgacctcggtccgtgctgtgtcaggccagcccaccgtgccgaggcataggcccaagcatgacccaacagctagggcgtgccatgccttggccgggccaaaacctcgtgccttgggccgagccatcgggccctatagccaactataccccgtaccctatttttgtgagttccgaaaaactggatcaacatatatttaaattgactaaatcttatttatgtaagctaccactgaaaaataattagttgtaaatatgagcacacgtgttaagtctagagcttaaacctagatatgtgattcaacaacaaggaacctaattaattgaactacggtcttttcaccaattacaaaagaacaattttgtattaaaagtttacaacggcacaaatcttcataaagcatccaattaatgtcttagaacaatactctagcgttccaaaaatccttaatgcgctaagtactcaactgagcagcaagcatggcgagaatctccgtggctatggaggggaagctcgtgatcagatgctcgtacccgtcgctcgccatgtccgccttcaacctcgccggcgacgtgacgaacctcaagatggcgtccttgagctcggggcagtcatgctgctcggccaacgccagcgatgtcgccgccgtggccacgacgacgtgcctgaacagcacgtcctcgcacaccttcttcagcctctccatgccgtacctgtcggcggcgacgagcaggtgcttcgccatcaccgccgccgcctcctcgccatcgtcgtccatctccggcagctcgtcggtgtagacgaagtgcaggaacgccgcgaacgcgtcggcgtccatgtcgtcgacgcggacgatggccctcgcggcgcgctcccgcatggagccgaacagctccgcccggaacaccggcgaccgcgccgccaggatgcaccggtgcgccgcgaacgcctcgccgtcgacattgaacctcacgtcggccgccgcctcggaggcgaggaggtcgccgaggtggcgatgcaggagaggcggcggcacggcgggcaccgtgacggcggccgcgtcgtcgacgtcgacgcggatgtccgggacgttgaaggtgaggtcgcaccggacggcgaaggagtcgccgccaccgccgccgtcgtcgagatgcccggaatcctccagatcaaccctcctgatgaagctcttgatggcccagagatcatgtccctcgtagaacgtgcacttgttgtcgctgtggctgtaccgtgtcaccggctcgccggcgacgtcgagcaagctgatcttgacgcgtgctcggacgacgacatcgtcgtcgtcgcggccggtccgcaccagagcgaaggatatcgagctggagaactcctggtcgtacctatttggatagtaccggagacgccatgtgtagccgccgacgtggaactcgccggagttgaggtgttcgccggttgccatcatcatcttcgtcctcttgtatccctctatcctcaggacgtggtgaccactcgcctcggagacggcgacggtcgagcacgacggcgatggcgatagcgacggcgaggcgtcgccggatttctcggcggcagtgggaggctcaggtgtgaacgcgtcgacgaccatgccaccgaccatgcgtgatgcaaacttgaagaaaagctgcgtcagccatggacgctggctaagctgatcgtcggtggtagctgccgaatccgtcgtcgtcgccatggccatgctcgtgtcgacgcgcctgcgcaacatgtcctcgcataccagcttcagcctctccacttggtatttgccggccgccgcgatcaaccgccgcgccatggctggcacgtcgcgcgaggccatctccagcaacgtgtccgtgtacacgaagtgaagcagagccccgaactccccggcgcccatgtcgtcgacgtcgacgcatctaccggcggccgcgccgccacgaccacagagctcggccttgaacaccggcgaccgggcagcgagcacgcacctatgcgcggcgaacgtctcgccgccgccgaccctgaacgtgacgtccgcgccgtcgccggtggagaggaggcggcggaggtgggcgcgcaggtccggctccggcacggcgaggcacgccggctcgacgcggagctccgtggccctcatgacggtgacgtcgcagcggacggcgaagcggtcgccggtgaggtggcccgacctctcgagctcgtcgtggcggatgaacttgtggaatccccacgaggaagaacccctggggctcgggaacctgtgcacgttgccaccgtacgtgcgcgacgccaccggctcgaggtacgaggtactaggagttaccaatcacatctgtccgtccatttgcaaggggtaagattggaatgggtaaaacattgccgccgtaataagcccgcaagtagcgattgccaagtccagacgatatctttcccctgttccgccatcttatctcttggcgtcgctccaccctgaaatttctccgtcgatgtggtccgccgcctcggcatggtcacaatttgtcaatttccaagcggctgtagagcttttgggaggtcctgatggagagaaattagcagagtgtgttggagtgcttcgtcaagggggcgggaggagaaacgtgcagtgggagctcaccggagattgattgtagccgaggaatggaaaggcatgcagtgggaaactgggagctcgccggagataaaataaatgcactcaagcagcccatgctgcataggaatctaatactgcatagaaggagataatcagttcatatcggtgtttcttaggtaagaaagatcatcgatcaacgcttatgttgattagcgttggtccaaatatgatcggttaaaagctgtcaaaatttaattaaaaaaattcacagaacctcgccagtacttacgaacattcacggcaggtagtttataagcaaacagtcataaactcataatcacatccagacacaaaataacacaactaactccaagactaaacaacacgacaagtacagatcaattatgtagcctgagattacatagtttcaaattacataatgttacatactgacaggcctaagcctcagataagcatacaaaagaaaggtactggccacgtgcaaatattcttcaattctgatcatctaggatcagctgtgcgcctgtgccacaatggattgtctacatgcctttccttttctgctgaacagagagaaaataactgcacaagtcagaaataaaacttctcatgcctaaacatagctgagacatttttattgagagaacagaaactaatctagaatttgagaggccaacatgtcgtttctgacaatgccaagaaacgatgagaccaccttaccaacatcatagatatgttcatacgtagctaatgtttaattatacactaagacaatcagtaattgtgtcatgggcattccgtcgaacgccttgagtgcaaaataaacaaaagatcctacgcacgatgttcgctgacctctgcgacccgagatgtctccctcacaatcgcccaaccacacgatcgctgcatccgttgcactcatagtggtcatcgccaggcccctcgcaatctcggggaggcctcctgctgccagcctgccaccattgccaaatctagcgccccaacctcggcagcgaccggatctggctgaggggatgggcagagtggatgctctgggggaagggggagaaatattgcacagaatattgcggctgcaagtgtcggcgctcaaacgggagcggaggaatcggcggccgtcggtgtccgcgctcgagtgcgggcggaggtggcagtcggtggcaactcgcgagcgaaagtagtcgaggcggcgaccggggatgtcaacgcgcgagtgggagcagaggacgcgatggtcgacgccatcggcaagctggagggagcagtggtcgctggtcggagggagaaggaagaggatacgatggacggaggacgaagggtggcggatcggggagaaaagttgatgcgaaagtacaattctaccctcccaccacctcatcacaattggtgccgcctctcgcggggacgcggtaccgtgaggtaccgaccaattgcagccgttagatcctgctagatcgacggatagaatttggtaccgcttgccctcaaggatggtaaaaagcctcttgtttttttggttgaatttcagcggaaagaggagaagatggggtcaattattatgtcgttgtagcgtaatggtctccggatgcataggcctgtt

SEQ ID NO: 73929 - DNA, 12473 bp, Oryza sativa
cgagctgtccaagctcgccgccaacgccttcctggcgcaacgcatctcctacgtcaacgccatctccgcgctgtgcgaggccaccggcgccgacgtcacggaggtggccaactccatcggcaaagactcgcggatcgggccgaggttcctctccgcgagcgtcggcttcggcggctcctgcttccagaaggacatcctcaacctggtgtacatctgcgagtgctacggcttgccggaggtggccaactactggcaccaggtgatccggatcaacgactaccagaagagccgcttcgtgaaccgggtggtgtcctccatgttcaacacggtggccggcaagaaggtggccgtgctgggcttcgcgttcaagaaggacaccggcgacacgagggagacgccggcgatcgacgtctgcaaggggctcgtcggcgacaaggcggtggtcagcatctacgacccgcaggtgacggaggagcaggtgcagcgcgacctagtgatgaacaagttcgactgggaccacccgcgccacctgcagccgatgagcccgtcgtcggcgaagcacgtcgccgtgtcgtgggacgcctacgaggcggcgcgcggcgcgcacgccgtctgcatcctcaccgagtgggacgagttccgccggctcgactaccagcggatgtacgacgccatgcacaagccggccttcctcttcgacggccgcaacgtcgtcgacccggacaagctccgccgcatcggcttcgtcgtctactccatcggcaagccgctcgaccactggctcagggacatgcccgccgtcgcctgatcttttttttttcttttcttttcttcagttcagatttctcagggacatgcatagaagtagcaccgttacagattttcggtttttttttacgttagatttatatgtgatatccattgcacattcaaccttctagcgtcttccgtaatttgtaataagtttttgctctagtttactctatccgttttctaaaacatcgcgcaaaacctctatttctacaggtgcttagttgtcggtggttcgacaaacacgtgcaaaaaaatatttttctatacccgtgaatggttttttcgcattaattactacttactacatcctaaaataaacatagtactccctcttgttactaatatattatgtctttatattaaaatttattgatgaccagaggtagcaaattttttgtgtaagttattactctaaacaaataggaggagactagggatcggacgttcgatcgatagtgtttcaccgtatatgaaaaagttctattagatgttttcctactcagtaaattttttttcaacaaaaaaagtatttcacatgtttcattactaagaaaaatattttattgcttgatgaagaatgttttaaccaaatataacattgaaaaaagctaatggcaacatcaaataagacatagccatcatgtgaatcgtcccaataaaatagagtgaaacactctaagacaaaccaaatgcaacaaaaagaaacaatgtactgcaacaaagcctacccgtctgcaccaatatacgccagtgacgtctcaccccgtctcatgtccagcctccccacggcggtgctgccactgccggctagcttggagctctctccggccacgacgcattccgctcaacctcgcacgaagcctgctcacggcacagcatccacaaagcctacccctcgtgtggctctgccactgccggcgatctcggagccctctccagcgatggtgccttctgctccactccgcaaagagcatcttcatggcgctgcagccgctaccagggagcttgaggccctctccggcgccgcctctgcctgcggttcccacccgtaagcctccttctcgtgtctccacctgtctcctcctcgcgacggcggcgatgacgagtttgggcttccacgagattggatcctctccgacacaacgtgaatcataaaattagagaaaggagatgaggtagaggaagaggaaatggggattttcgaaagcattttcgaaacaaacacatacggatatgctcattaacctactcactattcagttttgtgaagtacgtatctttttctttgaccaatccaatacgaatccgaatctgaagtgaactagctggccggaactcaacgttttataaacccgccacgccaacctagcttcctccttgcttaattagcttacgatcgaactcaagatcttaattcttacgatctcagctagcagccggccccgatcgaacaaggaccgaacgagagcacctcgatcgagaagagaagcaagatggatctattacctgcgaaagtgatttcatctctcgaatggatatcccttgtttcttgcatgccaactaaatagtcataaaaaaatttagaaaattttggtaagatatattaatatgaaatatatcactccacaaacatgttaaaatttaaattctacaagttgtaacaaaaataacaaatatagctgcgaatgtacgatagataactattttcagtttattttgttcttttcgttgtaacttgtagaagttaaatttgctctgcatatttatggagtgatatatattttatattaatatatgttgttattttatttaaaaaaattgataactatttagatgagatgtaagtaaagaggggacatccctctctatggatgaaaatccatatccctattacccgacgacatgatcgcggaggtcctccggcgactcccacggtcccactgggcagcctcgccgcatgccgccgcatctgcacgtcgtggcgcgcggccatcgacgaccgcctccgcgaggacctcctcccgctctccctcgccggcatcttcctcaacctccacgacctcttctaccccacgcagttcttctcctgccccaccaccacgccacccggcggcggcggcggcgccgtctccggcaacgtcgactacacgaggcgcaggtccaccttgcccgactgccacatgccctcgatcaacatcaccgaccactgcaacggcctcgtgctggtcaacaactgcgtgacctacccggcgacacggcggtgggagcggctgccagactgccagttgccacgccgccacccgcgccacgtcgcgagcacggcctccgccaggttcgccgccgtccgcgagcacctcgtgttcgaccccgccgtgtcaccgcgcggctagctacgaggtgttcctgatccctcacgttgcccctcgcgagcgcgagcgcaggcgcaggcgcagggacgatgagttttaccccacgagcgatggatcggaatggccaccgtcgccgtttttcttgtccgtcttctcgtcggagacgaggcagtgggaggggaggcgcttcgtgcgggacgggccgccagcgggcaccgtcgctgccatgaggctgcatcacgcaagcgaagtaggcacaggtattcactgccaaactaattttgtcatgaggtaattaatttctaaatccttcacacctaaaaacgagatttggagatttttttttttaagaagaaagattttggagaagagtcgtcctccaaacatttttttttaagaagaaagatttggagggacagatgccctttcaaactatttttaagaagaaattttgagcgtgttgagtattgaacgtgagaaaccaaacaccccttaccactgtactatcaagtgcatctctaatcctttactccttaagcattattttcacctcttttattcattatatttatggtaattgatgttggttgtttactcttatgatctagtaattaattactaatttttgttcttggtatatgttatttttttctcccagaatatcattgtcaagtgaagtaccaagtcatcggaccgccgttaagttttgatgtgtgcagatacaaagaatttcatttaggacgatcagagaagggtgtgtattttgcacttttgagttcaaatcaacttttgaagaatcgtgtggccagataggttgggtattaaagcttgacaacaaccttaagcccatttagccacatttcaaagatggcaaaattaagtgatgatggaccatgaccttacaagatattgattattgcgaggatcctaatgaagacgacgatgcacaaagtcaaacagtacaagcagcatattatgattgggactttgacaatggtgctaagtctatcgatattcaagataatagtgttcaagggtgtcatagaggttttggcttccttgcattccatcctttcaaagaggtggttttcctacattatagcttggagagagaactagcctataatttgaacagcttcaaggttcaagacttgggtaacttatgcccgaaagattatggatttgacactgaaccatatgtagaatcttcttttccataccatgctggatggaggtgtttcctgaagaacaaatttgatatttaggatcttttttagttgtaatctgttcctagaacagaacatagcctactcaaattgaattgcacactaaagtgctcattgtattgtgctaatgaaatgtattgactgaccatgtccctggaaatgtaattgcactttagtatgacttgcctattatggagtcacctgcaaatctgtatatagcccattattcatctagtattgaattttgcgggcaagcataataaaacaataattttggaaccacagtgagtgcagcttcatattttgcttctagttttggttttcaatcagagaatgcagcttatataggctatttggtcaacttcatccataataagaatagcacattctttcatagtttcatggcatccggtattcctgaagagcattagtaagcacaaggaaaatacgacataccctgtgatctaaaacacagcaatcagcataacaggtaagttaagatattgatgggtatttgcagatcaaaagatggctgtaccaacaagaaagacttcatgcattaccttttggtagcttaaccggaaaatttgtaagatcccataacttgtcatgtttcattttaatacttctctgaagataagtaatgaagaacaaattaagttaaaaagggttttgctccagagtccagacatccagttcctatgccttagaagctacagacagaactcctaaaaatcaggtcattttaaagagtgagaaaaagtataactgtgcctaaaatttctcaacatcctcagtatgagggacaaatatgaagtcaagttccagggctcaactacatctaggtacattcacttctgaaatcaaccgacaagttaagccaaagcgagccaagctccttcaaacacaaatgctattgtgatttatgccccagcttgaacttttgaagcacgtcagaaaatatcacaatgagagtaaaatgaaataaaattaatcactcaaataatgctgtccacttgaagtaaccaaggaattcaaatcgtgagattgtcaaaattgtaacccaaataaacttctaagccatgaagtgaagataagatcacaaaactttgtactcagttacctggaaaaatataaaaatcaaacaaatacttgtcgatgcttttcttaaaccgatataacttttgaactcaataaaatgctctgagtcagatcaaggcatccgcatgacacacaaaatgaagtcatttgttgcgtaaggttttatcaacctcaatacatgcataaaaattatgttgtttggcttgagcccctgagaaaatattggtttgaaatgcaaacaattcatgcaaacatactgaaacatattccatataccatgacatttaagtattgaagaagtaaaactgcagaatatattgcgtcaaaaaaaaactgcagaatatactgcgtacttaacaaagataaatacaggcatgagctgaactagagtggaatccatacaaggtgaaccaaaatatagctaaaaataagcaatgggctgaaccagtttgggaacaatagcaactgctacagaagcatgtggcaaaaaataaaagttaactacaacaacctgaataggacagctctcccattgggaacaactaaaacttgaatcacatcccacactgcaaacagaagcacgtcagtataccgaaacagggcatcagattctaaaaactagttttgcaaagtcaatgtaaagagagcattggtggtatcatattcttgattcttcaactatctattagtaaccaaaatgttgttgctgccccttgactggtgcagaaactgtacacatttcagacaacacccatcattcgctcactctgaatgctgcttgcaacccaccatgggttcagttcagactctgtccttgtactgctgcagtccctgttactgagagctggaaggttgagttcatgcaactcattttgcacttcaagcagctgttttcttgatggagtcacagaagttttgggaaatgttgcaacctttttatgagcaggaacactgtgggacttcatgtggcctcccaatgcagatccagatgccaagaccttgccgcagagcctgcactcatggatagctgttgccttcaacacatttgaaagactgccaaacttgatctcctcataagaacttgaattttctggctttatcagctcagtatcaccagttacaccaagacgataagaactcggctccatctcagtcttctgcggaccgcattccaagcttccatccatctgaggatcttcatccagagaatctgagcccttgtaagcatcttttgaaagcatcacaagaatgcaggcagcatcctccacctgtgtcccatgtgtcaccaccactaccggggcagggaaaacgtccatgcggatcctcttcgacctcgctctcttacagtgagcataagatacagcagcaaaaccatggtcaccatcatcaacaccgcagaaattagcagaagaagtctttctcgatgccctctgctccaccatcaccatcttcctcccatggtggccatgcgccttcatgtgcatcgacagcgcgtcgcaggagtggaaagccttgaagcacagctggcattcggccttgggggccagcgtccatggctcgtcgtcgctggaggcgtgatccggctggctctgcggcgccaccggcctctggcggcaccgctcccggaaatcgtacctgctgccggaggcaccagtgatcggtggagcctttctcgggctcggcggcggcttcttcttcctgcgcctggtgctgtggaggttcatgtggcctccaagtgaacaatatgaagggaagctcttgttgcagagcttgcaccagcgctgcttttctgcttgtgccatgcctgaacggtgacaagaattgaggtaagaacgggcacaacaagatgatcagagcacgcatgcaagacacgattgaagtgttgttacacatggacagctaaatcctgctcctttacagcattttcggagaaactaagatgcatctgagcagtttttagtgccaaaaaaagatcttattttttagtggcggaaaattaatttgggaaaaccctttcgttttgaaactcgattccctttcccaaaaaaaaaaactctattccaccttactctgcgaaatttattgaattgcataaaaaatatgtatttttatctccccgttgtcgagattgttacatcaaaatgctcaagtacggaaaaaaaatcaaggaatggagggagcagagctaaaatcagagagaaagtaagagcggccacaaaaagatgatcggagcacgaaacgattgaaatggtacacaaggatagctaaatagtgcttctttgcagtattttccgataaaacaggacgcatctgagcagtctcttagagccgaaaaaacaccttttttagtagtggaaaatgtataaaacttgtccttttgaaactcgattcgatcttagtctgcatttgttgaaattttgctaaaaaagcttcaaacttgttgcccccattgccgagattgttcgatcaaaatgctcaagaacggcaataaaaccaaggaatggagggagcggagctcaaatcattggacacacaaccgaatcactcaagaaacccactaacaaaaacccacacgtcatccaagaacagggctagggttcaactcgattgttagcaaaaaaaagctttcatctttgccacgaagcgagcaaatcaagaaccccccaaatcagtgcacaactgcaaaaaagaaaaaaaagaaaagaaaaagatagagagaggctaggcaaagaaactaaaactagaaaacccacctccaactccaatctcctcgagtgggatgcctcgacggggagccatgaagagagagagagagagagagtgagtgagtcttggaggagtggctccgttcgctggatggtgtggtgtgcactgcggtgagcaggtgagggagagccggagagggagtgaggagagtggagagagaggaggaggaggaggcttgggttggaggcaaaaactggggggatatgggggaaaattttctagtgcgcggctgcgcgcccgttgcgattggaggaggatatttggaggctttggagggcgtataatcggacggcccagatcgggccaactgctgcctgcaagtgcacaggcatgaacgaacggaccgtcgcgtcttgcgctttttggaaggatgttttttgatgggaacttttgctgcaaatgctttttattgttgggagattttttgtctagggctctaggcccactcttctcgttttcatcgccgaattatcgccgtggattatttggtccatatgtctttaaaaatatctttttttaataaaaaactttgttatgttatgttgtttagatcgctttttcaagttatgtattcgatttatttctcaaaaatttactttttctttatcaattagataatctgcggcagtgaaatatggacactcaccgttcctaaatatttgacgccgttgactgttttaaacatgtttgaccgttcgtcttattcaaaaactttttgtgaaatatataaaactatatgtatacataaaagtatatttaacaatgaatccaacgataggaaaagaattaataattacttaatttttttaataagacaaatggtgaaacatgtttaaaaaaatcgacaacgtcaaatatttaaggatggagggagtatctttcaaccaccgttttagccaattttgcattttagtataactattgttaacagtgaaatttggtaaacccggagtagtcatcggcagtcagcatcgacttcgaagtcctgagattagccaatgagagttgtcaagtcggattcttgctatattcggttaaggaaatcgatcacctaaaggaagcttatccagcagagaccgagttcaaagagaatgcggcatggcaagttatctattaattaagaatagtttattagtttccttttatctttaggaaagtttctttcttgtccgacaaggacttgtatcaacccatgggtataaatatgtacgcccgaggtctatgtaatctatcttcacgatcaatataattcggcgcatcaccaccttttaccttttctactttatttcatcatccggcgggacttggcacctgacgcggggctgcatcggtgttcgatctccggctaaggggtaagtccaatgttccgccggcccgggcaattgtatcgtttacgtcggcgtcgttcaaggctgcatcagtacattcgacctcttggattgctctggtttggatgatatatttgcctacctatttatcatatgtctttgttaatctagtcttagcatatcaatttagctctatcggctgcttctcgttttagggtttctgccggtattggctaaatcgcgttgctagattagattagcttagacatctaccacactgaaaactcagtcaacggcttgattgtctagatattatatttcttttcatacttagtgctgcatcagttaagtttgatctactaagtcgtgcttagaaccacaatctctagcctgcttcttgattgccaataagggtttcatcggggtttcagccggtgagttatctggacgttgcatcggctcataaggattacatatacatataagttcgatttagccgatgacaacaaaagtttcactgtttaatctaatcttgtggatttcatgacatcggacctccagccgatgtatgcttttaaccttcggatcgatgcttatttatcatatcattatttaccgattggtttatactggattatattgttattttattacatcatcatcagccgattgcctttatatcattatctacattggacatatagccgattgcttaagccctatcgctatcggctggtatcaacatcggctattatcggctatcggctggaactactccatcggcttgtcagccgatcggctgttttgtctattatttgcatatcttgtcagttgcatgatcaaactgactggcacgcccgcatctttccaacctttggacctgcactagagctaagcagatcttccaggccgatgtgttcgatttttttcgtcaacaactataaaataacacacccagtgttcctgtatagcgcccaatactgggagtaacaaatttacttgtgtatttgagtaccaattaccaaatatatttattggtaaaattgtcaatattgccacaagacaatcaaattttgtgtaatttgctaatagacataaaaaacgtgttatagctgaaatacatcctaaaaaactggtaatttgctataggacactttggactcagttgaaaagataaatttttaagaaagacgagaatgtacccattgagtgctctacctcgggccatcgacctcatacgctttaatgcccttagggccacatgcttcaaacatgacattagagtaaaaatttaaaaattatgtaactctaaatttactatcaccccaaatacatcaatagcatacatcatattacatcttcacttccgtctaagctcaaaagcttttaatcctagaggcatttttgtctttttgaagaatttctctctccaattaagtcgaaagtgttttttagcaaattaccagtttttaaagtgtctttcagccgtgacacatttttatgatgcctaccagcaatttacacaacttttaagtgtactgtagcaaattttgctgtaaaatttatctcatcccatctgagaaaaagaaagaaagaaatgggccatgctcctggctaggctttatgaggatgcacctgccaataagctcttggtattatctgaggcatcgagaagatatgacatatgaagtgattaaagatctatctatgccatgacaacagttcccttcctatcaaaaattgtaatcaaagaagaatgcacagctcattaattccaaataggatatatgaaattttttcgtaactatctagttgacatgcaatagacgggtggacgtccactcgagctattagaatcctctcccctactctctatcatccacagaatactgtgaaaaaggacaatgtccagattttcattgacatacttcataaaagaaattgtgaactatcttcttgtgctacagttaagtatggaagaccatgaagctttcctccattcctaccaacatcaaagaccggagacaattacaaaataaccaaacaatatagacactctcactaaagaaaactagaaaatgaaacttaatccaaatttttaactgaacatcaaaactgaaagaacgaaagatggaaaaataaagagaataaaatgagataaattacccatgaaagtatagtgatcaaggtgaaagaaaaatattcagtgtatgctaggcattgtctggggttatccaatgtaatgctgaactgggtagcaattgagaaaactgagggagggcaaatcatggtagtgttggcgtgtacttctgaaaaaatggctcaattgcagatgaattacagattaccatgttcctgatcaagaatctaaatcatgcaggatcttttgcgttatggagtatttacacgatcttatcaggatggcagactacaataacacattacataagcaacaatatttgtatttaatattgacaggtaaacagtttgatactcatagcttacgtttcagtggacaaccaggtaaaaattgcagtaatatcaaagactgaaaccaagctgaaaacgtctggatttttgggttacagcaatatttgaatatctgattttcaataaatgctaaaacatcacaagattagtagagcactgcatgacaaaagtctcgagcaatgttcttgtgagcacataaaacacaacaccaagggcgatcgagaccgggagggccggcaatgccttacggtagaatgctagtagcagcagggtgataccgagcccagcaattatggcaagataacatgcatacactgtcatgtagtcatacattgctgccctcccgacgagaacgctgtagaatatgaagtcccccaatc

SEQ ID NO: 73930 - DNA, 10669 bp, Oryza sativa
tgggtggatttcactaaatccaagccgtcccaataatttcgatggcttccataagccatctcttctgggagtggattttaatctctcgaggggatgtcccctcgttctttgcatatcactcaaatagttatgaaaaaatttaaaacaatttgaaaagatacattaacatgtgatatatctactccacaaacatgtaagttgaaatttaacttctacatctcgcaacgagaaaaacaaatcgaagtacagttagttaaggtatattgccagttaattttttttagttgccagatgtagaagttgaatttgaacttgcatgtttgtgaagtgatatatcacatgttaatacattttctcaaattgtttcaaattttttcacaatcatttaaatgacatgcaaagaacaagaggacatcttctcgagagatcaaaatagtttccccatctcatcttccaccatagttatcttgtagagcctattttctttttaaaaaaatattgtacagcttataaaaaaaattatctcaaaaacattatctctcagagaacatgttatcttcgaattttctaatagcaattagagaagaacaaacaagacacgaacattgcaccgacaaaagcttaggcatgaattagtttaacgagggcctcaatgccgttaattttataacagctcggttaagaaatgtttacagataatttcctatccacgatgctcttccgacacgctatatccgaatggacagacttcgcaagataaaataaatggagaatagaattgttatttctgtcgtaaatgtgtaactaggaagaggtgacatggtcacatctagcctgtagaaacaaagtaaggggtcagatcggtccaaatccaccaagtggagttggaaggcaactccaggggatctacgtccgtcgaaaattgttgaaaactttccgcaaacatatttaggaactttccgaaaacaaatttagttttaattcttgaaatcagaaacaaattatttttcatatataaccgattagtttcagccttctttacttcaaatgtatattcagtattgagttggttaattgaatgtagatattttttctattatggtgctttagatatatttttttgtcttgttatttttttaaggaaatgacatatattttgataatatgtttgttctgcgttgaaaatattgatatattttttataaatttgatcaaaattaaaaacgttgactaagaaaaaaaatcaaagtgacttataatatgaattataaaacgaagggagtatatgctttgcttatcaatttttggaggcacctataaattgggcgctcgattattgttgtaaaaccaggcgcagttttgatactgaacaattaaaatgttgaaacacggttggatcgtggactaaaacaatttgttctgacacataaaacatcaaggttcaattattgtaacatcaacaacaagagtcaaagacaaaaattgaaacactttacataaaatgtttcagtgctgacaatggtgaaacacaatcaaatcacaccatgaaacaatttgctacaacgtatgaaacaacgttttgaatgtattaaagcatgaaacaaattcgaatacataaaaaaaacaatgaaacaccatcgaaaacccactgcaatatttcaatctaactgatgaaacatcatggtacatggactgaaacatcaaaatatttaagaggaaaacccagatctacctcttcctctactcgactggccggtttgcaaccacatctgcgtcgacgccgtgccgagctccactgcatccgcgtagctgccggcgttgacgccgcagctcggccgtgtccgcgtgtccgccatcattgacgccacgtggagctcagccctcattgtcgacgccacatggggcatggcccctcgtcatcgacgctgcatggagctcggtccgccgtttccagcgctgcacggcgcgaccgagaaccccgggcccattgcttcgccggctccgcctccgcggaggctcagcctccaccgccgagagcaacgatgccgttctcccgccgccacttaggcgtaggtgcgcagcagcaacgagaaagggggaataggtgcggagagagaagaagagggagagagagagagagacaggatgaggtaatggatatggacgtgtgggacacggacgtgggtgcccgatattctccttccctatcaggtgcccgagtcaggtcgttttcgttaaatttttttacatgatttcagtgcatgattatcttttcttatttatttaatgtgaagcaattttcatgatcggatgaagcgagtgctgacgtgataaaaaatatcctataggtagtggattttaaagggaacattctctcgtcattttcatgtcatccaaatagttataaaagaattttaaaaagtttaacaagatatagattaatgaataagtggtaaatcactccacaaatattttcagaaatatactatgttgcatcggatacacgattttcagaaatattttgagagatgaacaccgggtgatcatggcacttccgaacggctgtcacatcgacctcgcattggactgcgaaacaatcgtctcgaagatattccgatcgctccaattcctccctggcgatgaagtccttcaatccccagtcatggccatggtagaacccatgaactccggcgtcccgcgacggcgccgccttgccggcgacatcaaccaggctgaaccgtggccgtcgctgtcgctagggtggccgccggcggcggcgagctggaggaagacgccgatgtggtccctgtgcttcttgttcttgccgttggggtacagctggggacgccacgagtggccgccggcgtcgaagacgcacgagtcgacgtgctcgccgttccggagcacgccgacgaggtgcgagtagccgtcgaccctgagcacgtgggaggtcgtcgacggcctggagacgatggcggaggcggtgcgcacgatacggcccgccgccgccaatgacatggctggcagtgtggactggacggatcgagagacggcggccggcgccggagcaggagatgcggcgggacgttgttgttgatctttgttgcaactttgcaaaagatcgacacggtagcttacaaagaaagaaggtataatacgtgattgaaatccaactcttaatacaattccacttaatttcactcaaaatcaggctcgaataaacctttgaaacgtgatgttttgtgatatctttcatatattcatattattgttattgtctaaaataaatattacttacaacttttacaataataattgtttattcctaataatatacccttccaacatcaagtttccaccaaacaaaggatatgaattccctcctaattaaacactctcttatttctgtatagcaaattcaaattcccacattaattcccttcatcatctccgacggttaatttacatgccttttcccaattgttgattttacattatcttagctagactactgtgtctgaatgtctatatatgtattctattagcacatgcggtgaggtccctgagaggccggaggcagaggaagtttgtgatttgattgatttgtattgccgatttcgaggagaggagagcatagggatttccaaactgtaaagatgtgcatccataatctaaaaaataaacttttacccacaccttacactgtccatttcaaccactggcttctaattatcatggacacaatttttaaatgttgattaaatggtgtgaattttaaagatagcttcatatatgaaagttcttcaaaaattcaaacaaatcaattttttcaagtttgtaatagttaatacttattagttttacgctaattgagtgtcttctcaaataagccatgaacaaaatcgcttgatcatctcaatcgaacagaggtaaggacggtgcgtgcaggtgggttgggacacatatcaatattgctctctccgttccatataataagtcattactagtcaaacttatttatgtttgattgaatttatagaaaatgtttgattaaatgttgcagtggatatttcgatagtgttccatatttctattttcgacacacggggtttgttgatgtttcaatggttcaaaagcaatgtttccgctagtgtactcgtgatatttctttgtgtgtggatcattttttacagtggattttagatagtgtttaatatttttcatcttgatgtacaggtggcttgttttgatgtacacaaggtttaagtgtttcaatggcttaaatcattttgtagtatatgttgaaccaaattgtttcatctagcgatctcaccgtgtttcacattttttttataaactgaaatattcattcgctaagtggtaaaacattgttttcataaaaggtgaaacaacgcccgagtttttggggaaaaatcgggcgaaaagggtgaaacaacgcccaagtttttgggaaaaatcgggcgcccgatttgtaggcgcttccctattagaggcatgttatgaggactttcgaccgagactgccaaaaccgctatagcgaagcgccgatcgacgagcaagatgcacacctgggatgaaaccataaggcgaagcctaggagattcgccaccaagccgggaggccttcacctaaaagggcatgttcgctaagtatggcctaggttaaggcccattaaggagttctaggcaaaatagatccttttttgccctcataaatgcccctatcataaaggtatccttgtaaattcctcttacctattaaccctagtatgcatgagcttgtactaagactataaataatcccctaattaaggcatgtaacgggggatccaaaaaaattccatcattaatacatattgttttacttttccactataagagtgaaccacgttcttcgacgaacgcagttgtcattcaacaacaaaatggatttcttttattatatcacgtttatttttttttcatgatttgattgtatgatttcccttttgtcatttaatgtgaagcaattttcatgatcggataaaccgagtgctgacgtgatagctagcacgtgaggtaacatcaatccataataatatccaaataatactatataagtgcaccatgttatatacataatcctaagtagctaatttcattacgacgcagtgaccatatagtatctatctactctttataaaatggtgtagagtggtggcggatccatcaccattccaactgtcaactcccaactttttgttgaagaaaaaaaaagacatatgagactaaagcacccacatatcaactactcccagtaattctatttttttatgaaaatatattaatatgagtccgaaaagttccacaaatgattaataacaaatatgcacatgcttaagttgctaacaacatattaatgatatttttttaataaagattccattgcaatgcatggataaaatgctatatagttacagcaaaagcattagatatactatgttgtatcggatacacgattttcagaaatattttgggagataaacaccgggtgatcatggcacttccgaacggttgtgacatcgacgtcgcattggattgcaaaacaatcatctcgaagatactccgatcgctccaattcctccctggcgatgaagtccttgaatccccagtaatgaccatggtagaagccatgaactccggcgtcccgcgacggcgctggcttgccggcgacatcaaccaggctgaaccgtggccgggcacgcacgcggccgtcgccgtcgctagggtggccgccggcggcggcgagctggaggaagacgccgatgtggctcctgtgtgtttggtcgttgctgccattggggtagagctggagacgccaggagtggccgccggcgtcgaagacgcacgagtcgacgtgctcgccgggctggagcacgccgacgaggtgcgagtagccgtcgaccctgagcacgtgggaggtcgtcgacggcctggagacgatggcggaggcggtgcgcacgatgcgacccgccgccgctgccaacgacatggctggcagtgtggactggacggatcgagatacggcggccggcgccggagcaggagatgcggcggggcgttgatctttgttgcaactatgcaaaagataggagatacggtagcttacaaacagagaaagtattatgcgtgatgaaatccaactcttaatacaattccacttaatttgactcaaaatcatgctcgaattaataaacctttgaaacgtgctgttttgtgatatctttcatatattcatattattattattgtctaaaataattattacttaccacttttacaataattgtttattcctaataatatacccttccaacatcaaattcccacgcaccaaacaaaggatatgaactccctcctaattaaacactctcttatttctgtatagcaaaatgaaattcccacattaattccctccatcatctccgacggttaatttccatgccttttcccaattgttgattatattttagattatcttagctagactactgtgtctgtatgtctatatatgtatcctagtagcacatgcggtgaggtccctgagaggccggaggcagaggaagtttgtgatttgatttgtattgccgatttcgaggagaggagagcatagggatttccaaactgtaaagatgtgcatccataatctaaaaaatataacttttacccttctcacaccttccactgtgcgtttcaaccactggcttctaattatcatggacacaatttttaaatgttgattaaatggtctgaattttaaagatagcttcatatatgaaagttcttcaaaaattcaaacaaattatttttttcaagtttgtaatagttaatacttattagttttacgctaattgagtgccttctcaaataagtcatgaacaaaatcgtttgatctcaatcgaacagaggtaaggacagtgcgtgcaggtgggttgggacacatattaacattgctctctccgttccatataataagtcattactagttgtttgattaaatttatagaaaatgtttgattaaatgttgcagtggatatttcgatagtgttccatatttctattttcgacacacggggtttgttgatgtttcaatggttcaaaggtggcttgtttcgatgtacacgaggtttaagtgtttctatagcttaaatcgtcttcgtagcatacgttgaaccaaattgtttcatctagcgatgtcaccatgtttcacttttttttcacaaactgaaaaaaaagtgaaacatcaacctaggcaaaatagaaccttttttgccctcataaatgctccaatcataagggtatccatgtaaatttctcttacctgttaaccgtagcgtgcatgagcttgtactaagactataaatagtcccctaattaaggcatgtaataggggataaaaaattccatcattaatacatattgttttacatttccactataagagtgaaccacgttttttcgacgaacacagttgtcattcaacaacaaaagatgggtttcctttattatatcaagtttattttttcttcatgatttcattgtatgattcccttttgtcatttaatgtgaagcaattttcatgatcggatgaatcgagtgctgacgtgatagctagcacgtgaggtaacatcaattcataatatccaaataatacaagtgcaccatattatatatataatcctaagtagttaatttcattatgacgcagtgactgtatagtatctatctactctttataaaatggagtagagtggtgacggatctgccaccaccccaactgtcaactcccaactttttgttaaacaaaaaaaaagacatatgagactaaaggacccacatatcaactactcccactaactctatttttttatgaaaatatattaatatcagtccaaaaagttccacaaatgattaataacaaatatgcacatgccaacaacatattaatgatatttttttaattaaaattccattgcaatgcatggataaaacgctgctacctccatatttcaatgtatgacgccgttgactttttgtccaacgtttgaccattcgtcttatttaaaaaatttatgtaattatcatttattttatcgtgaaatgctcttttaagcatgacataaatatttttatatatatttgtaaaaaaaataaataaaacgaatggtcaaacattcgtaaaaaagtgaacagcgtcaaacattaaaatacggagaggagtatatagttacagcaaaagcattatactactatgttgcatcggatacacgattttcagaaaaattttgggagataaacaccgggtgatcatggcacttccgaacggttgtgacatcgacgtcgcattggattgcaaaacaatcatctcggagatattccgatcgctccaattcttccctgctgatgatgctctgaaagccccagccgtcgccatggccgaagctgtgaaatccagcgtcgtgagatggtggcgccgccgccggcttgtcgccggcgctgtcaaccaggctgaaccttggccgggcacgcacgcggccgtcgccgtcgctagggtggccggcggcggcggcgagctggaggaagacgccgatgtggctcctgtgtgtttggtcgttgctgccattggggtagagctggagacgccaggagtggccgccggcgtcgaagacgcacgagtcgacgtgctcgccgggctggagcacgccgacgaggtgcgagtagccgtcgaccctgagcacgtgggaggtcgtcgacggcctggagacaatggcggaggcggtgcgcacgatgcgacccgctgccgccgccaacgacatggctggcagtgtgcactagacgggtcgggagacggcggccggccggcgccggagcaggagatgcggcggggcgttgttgatcttcgttgcaactttgcaaaagatcgacacggtaaattacaaacacagaaagcatgcattattcgtgatgaaatccaactcttaatacaattccacttaatttgactcaaaatcaggctcgaattaataaccctttgaaacgtgctgttttgtgatatttttcatatatccataatgtaattacttacaacttttacaataatcgtttattcctaataatatatcttctctgtttatccttgtttgacaccgttgacttttggagctagatcgaacctagggatgcacgtgggccgggtaaacccatgtacccaacgacctagcccacgaaacatggggtcacaacctcattggcttacccatgaaatttcatgggccatcatgggtcgacccaatggagcattatgggctgaccctagctaggttacacacacaccgtcgcacgcataggcaccagctgtgccgccgccgcctcctgactgcgaaacaagctttgcagggagacatgagatggcaacggggctgcacccgccgggtttcaccaccccgtcccgcacccgcattgaagggaatcgcccgtcaccctccccatccccgcacttgggtgcaggttctcccccgtccccgtccccactgcgggtacggggcacccgcgggtcctcacacccgacaacatcaccggaatacaaattgcagcagcaacaatccccaattaaccccaactcaggaaacaagcgagcaacacaatagcagtgagaccatcatcaaatcggctgatgaaacacaaaattgacccaaagaataggaacaacaaacagatttcaacttcagtgcctgaaaacaacgtcaagcttccgtgctgttaaagaacagcaagttgtttcagttcatttcaaacagaaaggcaggaacgtcatgtaggtaactaactcactcattcacaggtacaaatcatctagctggttggttggtgatgcgtcggcactcggcacttggatttcgtcctggacatggagccaagatgttagatgtctcgtcttctcggccgtatggaagtttcacagtggaaccttgcctcgaacatgcggacctggttcccttgactcctggaagcatgcggcgacgactgcggcctggatcccttgtcgtggtctcgtggaggcgtcggccgtcgatctggtgtcgccgtgtcggccattcggcttggactttaggcggcgaggtagggcatggatgtggatgggagcgaagcggcgaggattcttctccgtgcgcttgggacctagggttttggcgtgtatatatgtgaacgagtgatgggcctatagcagctgggcttttattttctatgggccatgaggtagtaggaatgtaggatgtgctatacagggcccccgtggggattcgggtacggggagcttgggaacgcccccgaacccagctcacctgatgggggaatatttttcccgttaagacccccatgggtagagatgttagcctattaagaaaccctaatggatgttttacccatcgggtattggggttcggggccccattgccatcccatgaggatcaggacgagtctggttctatggctatcaacggctgcccattagctgctactacatccgtttcacaatgtaagtcattctagcatttcctatattcatattgatgctaatgaatctagagacattagattcattagcatca

SEQ ID NO: 73931 - DNA, 1523 bp, Oryza sativa
ctacagccaactttgacagaaaagttcagtatactgtcgatagcatactgtcgttgtaagcgtcaatagcttactggtttggggctttcccccaatccatctcgacagcatactgtcgttgtaagcttcaaaatgtaatgaaccccctcttctttcttaatgaaattggttgactgtatctttcggccgacccggcaaaagaaaagttcagtatatggtatccctgtttgattcatgtccacttattcagttcaggaggcaagctatctgtataactactgctgacagattaagatccattctaccatacatcattgccttaaaccatacttcacctgaagatctagctggggcaggatctcttggtttaggtcgcaagcttgatgactggccagctttcggcaatgtaagcttctggacacggttcaccgccctagtcctgcatgagaaatagcaagttacagataaccagtggaaataaatttcacattatacaaaacaagtttttttagataatgacattatacgaaacaagtatgcaataaagatgtcaaattcagaaaaaaaaaagagttagctagtataagaacaagattggaattactcacaaccgctctttcgcagcagtgttggatgttttctcttgctcttgatctgctacattgcttactgaactatcagcttctgcacccatggaaataccatccgaagcatcgcttaaccttccatccgagtcgacatccgcaaggccagaaatctcaggatcaacggagagcatggacccagcttcagattgcctgtcactggtgtcggagaagttatcaagatcagaagctgccccactgccaacacttgtgcccttccctagggatgtaatgcccggggaagaggacgaatgcttcaatacggaatcagcttgtctcgttggcttcaatctggtgctactattgagtaattgaagcctgtcgatttcctcatccttctttgaaatggtatctttcagaagtgaaagctgcaaggagaacattacaaaacaatagatgtaacagtatttttcatggtgaattactattccattgcttacatcacataatgttttgacattcccgaacaatattcttaaccttttgccatttcaatactgagaccattatgtcaagagaagtcagaagtgacttgatgattattgagaaatttggttacctgatccattaattctttgacatcttttccctccttcccctccttattgctcctagcaacaccaagttccaccccagacactcgttccgcaaatttcagagtacttaaagtctctgtgtaagatgaaacatctgggttgacctgcacaaacattagggtttttgcatgcccacctgcatatcaaactatgcatgtcaatacaactccgtgtatggcatgtaaaatagttctcaagtgaagcagaatacccagtgaagtctgcaggacttgtgtgagcttgctatttctgtatggtacatgagcattcttttgtgataaag

SEQ ID NO: 73932 - DNA, 4848 bp, Oryza sativa
aagtacctgaagacgctttatctttctcttcaagtatggttcagtcttcttccgagggaccaatctataggggaaccacttttacgattaattgacttcttgaattgggatgctgatttatttacagaattcaaaattgaacttccaaattctcttgagcttgaactctgcagaaaacaaatgagaagattgatgtagctaaatccacataaaaagaatgcttacaagcaggaaacagagcatatgaaaggatgctttttaacagaacatagatgttatgtcacccaaaaaatacggaatgatgattccttaagaaaaggaatggtaagagggtatatggcagcccatgctatgtgtgctaggctgctctcaccagcagcacacatggtgacctcctacttattgtgctcatttgaattagattgattctcgtaggtaagctttccaactgaaccatgttgtaatccttgctatatactccctctgttgttcattgtatcgttgtctcgttggttagttcaaacgtcaaataaacaaaaatggaggagtattactgtaccaaatcattggaatgattattgcgtgccattctaagagcatttggtctatcagagatacctctgttaacttatggaagcttaacccaacacttcaatggtcacatatactgaaactataatcaattgtgtaatagtagctatactttggataatactaatcgacaaaaaaaaaaacagttgccacactgaattgtctgaaaggagcatactggtgtttgatttcttccgttgacaataattttgatgtctacttagctgtcaagctccatccaacccgtctatagaaatatctatattatggagtacagagtaaacctggatcatattacagagtatagatcggactaaggagcagaacaagaataatataaccacataaataaattgaatgaaagaggcaagtacaaatgcacgaaccaccaacagagctcacatcagggtatggtgcgcatcaacttgaactgacgaaaacaattaaacaaagagttgcccatgtccattcacgcaaacccgtaaatggaaccaacctttaattagtgtttttagcaactccaagtccaggttgagaaatcactttaacaaactaatgctactgcacatcaacgaaatcacattagggacagcgatcaagtgctactgcacgcactttcgctaaactaaggtccaacaggatcgaagttatagcatccatatataataataggacaaatcatgcatagtaaaactgctatataccggagtttatgtggttggatacaccagaaatgatgagaaatttcgattcacagataacagattgcagagcaccaaccaaatacagggaaatcaaggtccccaaacactaggttctaagaaattaaacggaacacgcatgacacccaaactccgcccaaaactccccgtggagatccgaaatccaaaaccaaaatcgctacgcagtaccccccacccaaccaacagacctacagatccgctcgagttctactcctgcagttcgcgcggagtcccagccgaaacccaacgacctaaaattcgagcccgcgcgggctcgcggcagcgtcggacgcggaggtaagggggggcggggatctggagggcgaaccttgcgggcgcttccgccgctgcggttgggggagcccttcctgcggagggagggcgtcggcgaggcgcagcttcgggcctccacgccgtcgccgacctgctccggcggagtaggatgaggaggaggaggcgaggccaccatggcgagccgcgtggagaggggcgaggtggtggcgaggaggaggaggaggaggaggacggcgtgtggattcgaacggaattggaggggggagagaagaagtagccgtttctgccgatgtgatcgaaatggtaaggtaggcttataggcagtgggggtgtgactaggacagggagcgctgagaagggttgtcgccttgtcttgtagggcctacagtactatgtcaaatgggccctggaatatggcggcggcgcgcgcatctggcctattgggcttttgtcaactgggccctgagcccatctgggctggttgtgtaggcctcttgacatactgggcttctcctctgtccactgtcaaatttcgttaagcatccaaaaagtcagatggaacgacaacatgcacaggagattagggaaagaaaatgcatttttatattaggaaaagaaaatgatgtatttttttgctgatcacacggagttactcgcacgcacatcacacatgcatacgcccacgagaatgaaagtgcgccccatgagccatgactagccaggcaattggcataggtttatatttgttttctttcatttcataaattatttgttgaaaattacggcaatatcaaagaacttagtttattacgacgacatcaacacgtgtgctagatattaaagattatatttttctgcttagtaagaaaaattggagcactacaattacgccgattttttatatctaggcagagggacaccatcattaacacaactgggtggcccgcgcaattgcgtggctagcacccatataaatttatatatttttaatatgattttatttaaaatttattaaatagttatctcgttgtcttaagattaaatagttaccaaaccttatcatccatgtgtttttaattttatagtttttaaaagtcacaccagttgctaccccttacttttatcatattattctttatttgcttgctcgatctaccactgtttctattcattctccttggaacctttaaaaattggatctataaacttataggttttagagtttattggcctattgggcttctttttttataatttctagaagtcctgtcaaacgctaccattatactcctctatgaccgtccattgcatcttctctttattttcattgctattttaaaaatcgaacatacttatcgtttaggttcaattttttactttccagaagttccgccaaaacatcagcgactttgtcactgtactcctctacggctcgctcgctgccgcccttctttattgtcattgatattttaaaatcaaacataattatcattggggtttatctttttactttttagaagcccgaatctttaaaaattggaccttatagtttttagagtttattgtctcgttgagtttcatttttttataatttttagaaatcccgtcaaacgctgccactatactcctgtacgacctgtccgccgcatactctttattgtcattaggattgtaaaaatcaaatataactatcgttggaattcattttttactttcttgaagacccaccaaccattggcggctctgccattgtactcctatgcgacccgcctgtggcctctcatttttattgtaatcgagattttaaaaatcaaatgtgattatcattgaagtttattttcttactttctagaagtcccgccaaccgccttgactgattgcttcacgacctgtacgttgcccttcctttcaattgtcattttgattctatttgatgttttattaatagtttttagatgtcccatcaaccgccaccactctactcctatatagacctattacttaattaatctcgtcatgtgtttcagatggtcttttctttcagtagcctttattttttttcaccaattttagttatttataaattgtattcctagttaatatcttatttttatttttctaattacagaatttattttattttttgtattatgttcttttgatatttttttttttaattttagttgtttcaaaattatattcctaccttaactctcttattaatttgcctaatttcggattttattttatttttattctgaattttaattaatctactatgctcttatatgtactcttatttcaatattgtttatatttaattctgaattttagttaattttaaattgtatttctacttgaactcctctcttcttttttttctttttcctactttcgatttttttcatttttattccaaattttaatctcatattggattcttgtatggactcttctttcaatttttcttatttttaattccgaatttcagttattttaaaattgtattcctactacttggactcttctcctttttttttgctaattttggattctattttatttttatttcaaattttaattaatctcgtattgggtttctatatggactcttcattcaatattgctcacttttaattccgaatttcagctatttttaaattgtttttctactttaactcttcttttctttttcttcgattaatgtgaaaatttctagccccaccgcgaacgtggtgccttctttcaaagctgttttaataatataatagatagatttattcttccatttgttgatattttatactccctcagtttcatattacaagacattctagcattgtccacattcatatagatatcaatgaatatagatatacacatatatatgtcaagattcatttatatatatatatatatatatatgaatgtggacaatgttagaaaatcttataatatgaaacggaggaagtaaatataaagattccttgtttttacaccaggatctctttaatactttctgtcaacatcttactccatccgtcccaaaatataagaacctagaactggatgggatattttctagtacaataaatctagacaatgtcccatctgattctagattcttatattttgaaatggaaggagtacttgaattcgactgagtaagtttaccataagaaatgtaaccaattaagaatggaaaattttgctatatgac

SEQ ID NO: 73933 - DNA, 5072 bp, Oryza sativa
acaatcacttctcaaatttctcaaattattagcacttaatccatcctataaatgctacatccattcttttttctattttaatataggaatatatcaaaatggttaccgtgtggttttctaaaactttataatcataaagctaggttatatgtcaagtgccaaaatacctaacatttcgtgcaacttgatgcataaataggtgggatttaatgaaatttactctagtaatcacccttaagagctcgggaagcgtttccgttaatctatgtgtccatttcttgaaaaaaaaagacggggtaaataataatacgagctgagatgaagatgtcaaaaatgataaactccgatcagatgacaacatcttgttatgatatcatggcttttgcattagttgtattgacggtaggtaataactaagataatatttgcattttttaggcagaggtatcaacaaaaaaatgacatatggtttcttcagatggccatacatacaacagcttcaaatttcgctccatgaatatctgtaaagcggatagtgacggcaacaacaaaacgcaaaaggttcagcaacagccattctgccgaatgcaaaactaacaagaaatctaatagaagcgtagtagcgtgcagtctgacgaaagaaataagctgtgttcccatcaccagaagcaactgacgctttttaatttggggtactgacatgacgaccaaacaccggcagaaaaacatacgtcaaaatctgacgccgattactcatacgagctaactctgtgtcaactgattctcccttgcaataatactaataaggaagccataatgagcaaacctctttgtcatcctatatatatatatatatatataaagttcatccccactaagtatagttaatgctaattctcttttctctcataaaatcacatcatctcaattgtttttagcctttggatgattcatcaagggtgtaaattacatctcttcacatcacctcaactgtttttaagtttttggatgattcataaaaggtataaatttcatttattccctccaaaagacacaccatacaacccaatcatttataacctatgtataattgataaaggtaaaaaaatataaacacatgaaagaaaaattatatagtaggtaagaaagaaaattttagaagtaatgggtgtgttcggtagcgctactagctggctgccttgcagccagcagccacagtcccaccacaagaaagatactagggaagcagcagcgctgcggctgtacaaccacagttcagcactaccgaacagacctaatatctactatattatcacataatttttgcgcaacaatacgcgaggtacccatctagttagtccaaaattaaaaccgcagtccgaaaattccctgtcatcagtcctccaaattgaaaggataatcggccaaattcttttgtcattagtccaaactgaaaactcaagaaagaacgtgcgtgctccaatcaggggctttcttgatccgagatattttcacaagagtttccagaattgtgaaagcaagctgttatacttttatataactaataagatacccgtatattactgttgcggacattaaattactattgcggggaattttgtgtgttcgcttgtgtgcatcttagttatgcagatatcacaaaaattgtattaccttaatgtaatcgattgagtttaataaaaactttaattatctaacaataattatttttataggccaatggcctatacgattggaaatgggttggtagcgtgatagagtaaaagcgtggttattcagttttttggggatatggttgcacgccatgtgagatgtgaaaggggatgagcggatgactccctttttaaggaagtataaggttttggttttatgattgagatcgtgaaggcaagttcaagcatttcagctaggagtagaagtgaagaaaaaaactgatcagtgagcactgtcctagtgcagtgcaactgaagcgcttagcctaggaaagaaaacctgcagacagaagtttcattttctgaaattattgcagggatcccataaaagaatcaatggaccagagagtgatttgtgatttgaaaacaacaacacaatgagggggccaggccatatcaagatctacattggccacaagatatgtcatcttgtcgtcaggtctctgcaataaataattcaatgatctggagttactgaaaaatagtggcagcatttccctctggaactccttcgagatctttccagctcacgaaccaaatctcctgctcctatttgaacaataattcaataaaatgatgctaagcagagacttgggagcacaagataacaagatctgaaattaatcaacaggtaattaagcaagcatgcatgagttcagcttctgcagcttaacatgtgctacctgttccatcacaaacaatattttcctggatcatggaccaaatcaaatggcacgcatcacaagaggaaaatcacgaccatgatcaatgatcgatagccatggagaccaaactcaactagtttactcccttcggtcccaaatttaaatatttgcatgattcaaatttgtacatgatataaatatttataggacaatgattatttcagtgcatggaaattctatcattttcgaccaaattatctatgttccaaaatataagtatttataggtttagcatagattgatgttgagaagaaaatagtttagtgcccctcaataaataataagatatggatagggtgggagggtagacggggtaagatggaaagaaatttgaagagaaagtgattaataagacaaatggtattatgaataatgctagaaatttttataatttgaaataagatttaattgctagaagttgttatatttagaaagagagagtacttatgaccataatttaagtaattcaaaatttaaaatttgactaaaaatgtaaataaggaaaatctttcgccctgtttttaatctttaaaaaattcttatagtaatatttatgaatggttggagtagcatattcttgagttattttgcttttgatggtgagttcgttcgaagataattagaaaaaaaatcctcgtctttcccacgcacgcctctgttttataaaaagtttagtgtttaatttattgcttaccttattttacttattttttcaatcctatttgttctcctgctctcagtcactgagctagttgcataaccatcgtttcgcggaataagcgaaatggcacatttgtaaaagaaaggtaatttgtgaataaaacttttatatacgtgttcttaacgatctaaaaagaaatgctgaaaaataaacttcgataaaaaaaaccttaaaatcagctccaaatctctaaatttaatgttgaaaatttcaaattttggttgataagcgcccttagcctgtgcgtgtagtgtatgccatgcattgggcttgaaaagatcagcagatcgtgtgacgtactacggccggtctgctgccaaaacaccgttctagggtcaccaataattggatggaatctggcactacgttacatcaaattattggccagatttttttcccctttctttctctcctcgctttcacggtcgacaacagccacggccatggtgctggctggacccgtcgtctcgtccctgtgacaggcctaggcgtcccggtcgccatgggatcctgtttggattctcatgacaagctgctcaacgccgcattttttttttttgcaatacttatgcgaattgtcctaagtattccctccatctctaaatatttaacgccgctgatttttctaaacatgtttgaccgttcgttttatttaaaaaatttaagtaattattaattattttcatataatttgattcattgttaaatatacttgtatgtatacatatagtttacatatttcataaaagtttttgaataatacgaacggtcaaacatatttaaaaaaagtcaatggcatcaaatatttagtagcggagggagtatttgacttcttgtgagaggttttgtccacccttttaggattttgatctccaatagttttctcaaatgcatagtttctttaaagaaaagtgttataataatattataaatttattatatttaatgatcttaaaatttcgaaagattaattgaattttgtcaacattaaatggttatgatcagagagagcagatgaaatttctaagcttaaattagaccctcgatgaatacccgaatgttaaaagtacgatttgacattttatttggtacaaaggtttatttaaagttgcctcggtcgtcatcatatattgttggagaatttctgaggagaccagcagcatattcatggaaagaaaaaagagaaatggaatttacatggccttgcatcttatttatacaaggttggcgaggcatacaagtctccacttgttatggatagttggactctagcgactttcagatctcatcttgtggtttaattttctcccaaaaatatctcatcttgcggtttgcttgctcctagttttggttttgtatatatcctccttcatacatttacacaaaccttgcaatttgctgctaaaatttccgtgaatttttttttagtagaggaagtattcgtgtttctgtacctgtaggtatattaagggtgaataaccgatacggtacgtagagttttgctctagtatcaatttagtttccgatgtttcaaattgcccaaacaaattctcaaaatgtggtacacatgaattcattggacgcacacacatgtgtatatttttcaaaaactggtgaacactatatcgactctagaattaattggaatctcagttgaactggatgcacgaccacacatagccaatttggccaggccagtttccaacttgtagtgttgtttgacgctatttctttcaattcattagatgataatttatttagtgcgagtgacttcaagcgctttattcttcctttttttaaaaaaatcttttcaatttcccaatgcaattacactgggcctaggcgcgagcagtgggcctaggcgagcaggtttttggtccagaagagatatgg

SEQ ID NO: 73934 - DNA, 10081 bp, Oryza sativa
ttcgcgctacgtacataatattgatggtattgagaaagatatcgaattaatcttgcaaatgacgcatcatccgttttgtccgcgttgaaataaagtgtcaccaaataacacgtaacagaaacacatttcttgatcaaaggagaaaaccacaaaaagtgattgattgattgatcattgcggcccatcagctgaccataaacacatggagcttgcccatcatcaggccatgacatgatcggtcatcgatcgatcggtccatcaataccagcgtgtataatagcagtacggagtacttgcaaacgtacgctaactataattagtcgtctaattaatttcttaaccgaatggaatcaatggaatcatgggtgtggctgcatatatgccccacaggtcgacggtttagccggccggtctaccttgcatgtactacacgtgctgcttatatattcgttggtggtggtggatactccaaaacagatcggttggtgctccgagcggctgattaattaacaggaaccaaatattactcctatcttcatattagaagattttctagacaatgatattaatgaatctagacatatatatataaatatggataatgctaaaaaatttcataatacgaaacgaagtactatccatattttaatgtatgataccgttgaccttttgatcaatgtttgacctttgttttattcaaaatttttgtgtaaatataaaaatatttatgtcatacttaaagaacatttgatgatgaatcaaatcacattaaaataaatgataattacataaattttttgaataagacgaatgatcaaacattaaaaaaaatcaatagcgtcatatattaaaatatggaggtagtaacagggagccggggctactcaacaagcgatgaacaatgtgctagccagctgctagcgtacgtgcgttttgttggtgcgtgactgagactgcgtacgtgtttgctgctgcgaaatatccacacatgcacttggctaataatagcaacgcgcgtcgcggcgttgtttttggtgatagatcgatcgagtagctgccggtacttagtgactcagggttgttaatgtttggttaatttgtagtactagcgtacattgacataatttgtcgcactacagattaggaaggttactttgactaattaagttattgtcaccttgtatccaaggttccaatgttttgttgactgaccatataggagaggatctgaattgctccacggacgcccgataggagaggagagcatgtttcggcgttagatttgcggagaagaggcggaggcggtcgggctcatcgcgtctcgtcgcttcgggcagaggggcggggtgttggttggccacggtgtcatgtatctggtgggctgcatgggctgctggaggaatgggcttggcccagctcacatactgaaggtgcaagcaaccaagcagtacaaataccaacagtggtagtgagagaaggcatcgataaattagaatctgatggctgtggcctcttcttcctcctcttgatttctcctctaatcccctactctgtgtttctctgattccctttaccccctgcttctcttcccaatctctgctgctagttcttccaatatgtatccctgaacttaatatacagagttggagaggatatattgctcctgtgcttgtgttcaccagtgggattcatgtgggatcgtgacacacggcgaacggcgagatcaacggcgaccacgacaggcctcgggtagggcggcgtcggcttcacaggcgcggatcagtggcttttgcagcattgggcgcagacacggctttttgccacggcttgttgtgctcatcggctcagcctgcacgccaagtgcttgttgaaatgcctgcaaggagggagggagagagaaaggatttcaaaggaaggagagggagagatggggcactggtgcggttggcatgtggggtccagagctcctgggctcaccggtcagagagagatagggagaggacagggagatgcattctaattgctcgagtggacgtccatccgtttattgcatgttaactagatggttatgaaaaattttcaaaaaaaattgataagatagatcaatatgtaatatatcactccacaaatatacaagttcaaattcaacttctataagttgtaacaaaaataacaaatttaattgtaaatatacatatagtaatttaagttttgtttattatttttgttacaacatgtagaaattgaattttaacttgcatgtttgtggattgatatactacatattatctatcttgttcatattttttcaatttttttcataaccatttagatgacatgcaataaacgggtggacgtccattcgagctattaaaacagtttcccgagaggacatgaggagaggtgaggatgaattttctggaaattttggagaaggctgagagtttgattattgtttttcggatatgctacaccgctcaaaggcttgtgcaaatattactggaagtttgtgtggtcatgaacttcatttggtgagtgtttgagattcttctcaaggttgtttatttttgaagattcaaagaaaccttgcttttttatatttttaattaattgtgaatgtttttcacatttgtaactgacgcgcaacactgaattataaatttaaacctttcctgtacattattcaaggtgcctaatgtttatcaaacaaattctttttttgtcaatcctctccacctatttgtttatatctatgcaaatacatcatgagatgcatggacaatctaacaacaccaaatgaattcaaaagacagagacaaaatcaaaataaaaaatttactaattatttctttattttcttttctttgtttcttttttttttacttcaaaattccaggtatgttacatttgatgcctcagttttggccactcatcaaccccattcgagtacttctgtcttcttgagagacaggccaataatcatcaatggcggccacttactgaatgaagaacatcgtgtggcatatgcatagtatttcactgtgttaatattctgtaagtggtaccaccaatgcaaatacagtttgttgcattattgtatatatataattgattgatcggtgcccgcttatatcccttgaggacagattaactattcctcacctatgccattgcaggtgccaggggccgatggctaagattgatttttctcgtcaggaaaagtcgattgtctggtaatgacacttaatttttttctccctgaggacgagtcgacggacgacagtgctgatatggtacgtctagctggtagcctggtaccaagcgaccgtatatgtagctggtgtgtttagtgtgcatgtcctataaactagaaactgggatatctcgttaataattgatagtttgatactgcatcaagagaggagtcgttgattgcatcgacagatgtcggcccaggtgttcctatgatcgtgtatctattattgcatactggtctctcgatccatccacgaagtcaaggaggaaagaggaccacacatcagtcaattgaaactaaaaggtaatttatctatctatctatcttctattatatactaaaagtccattaaactctctacaaacgctcttaaattgccatgtgactctctcaaaacgttcttgtattgccacgtggcgtaacagagagaagttgagaacctcctagggccgacgcgtgcaatacatggatttatcgtgaaacttaaaccaacgaagattatagtttcataattgactaacaaagattagtcccataaatatatgtacgtaaggcaagatttaaaatcaatctcaaagcaaattttaggcacgtgcagcccatatatttgtcgtgaaccaagagattctataattgtgtacgtgaggcaagatttcaaatgtctcaaagcaaaatttaaattacatatccagtcaaaataaattaaattacatatggcaagattagtttcacgaggcaagattgttaattacaccaaaaattagttctatacacgtgaggcaatattcctaaggcttacatacatatatatatatatatatatatatatatatatacatacaccccgccagcaacacgatcttgggacattagtcaattccggcggacggagcagaataggtctgcggcaccttgcgacattagtcaattccagcgactcatctttggcataagaacacaatcatgccatcttctattaattagggctacatgatcttgcaactaggaaataacataagcatttatacagttttgtcataatattttcagcagaagaaactaaaattgcacctacgaaagaacacaattacgatatcctgtattagttacatctacattatgttgcatctatgtatactgttttgtcacattctttttcagcacaaaaaagtaaccttgcacctaccaaagaacacaattatgatgttttgtattaattagttctataaaataacataaacacgtatgcaattctctgtcaaatttgtttagtaactatatgcaatactaatcatctgcatataacatggcaccgggcaatttgaatactgcattaacaccaaagaacgataggtggagaatcaaagtagaagctattaggctatgcgaggcggttaatcctacaatggctgatgatttctatggtatacatatgattgtactagatgcagaggtatgattgttgtataaacatgtggtttaatatattgttctattatgtaaatacaatctttttggtgcagggcaactcaatacatgcctgtatctcaaagcaattggcgaaccacttcaggccaaaaattaagattaactcaatatatattttcaaaaatttcaaagttatggaacatgataagtaccgtgtcctaaaaaaagtgttgcaacgtataaaaacatttttggatcgcacacattatacgctttgttttaggccaaaagctcatttattccttccttttcagtcccagcctagcccgctatctctctgcttagcctacctctctttgaaatatcaaaatctgagtgaatctataaaactcggaataaaaacggtgaattttaaatggtaattagatccggtaaattaaagcataattaaaaggaaaaatcataaggaaaataatgaggggtagtgggaatcgatttttgcaatcaattagaggaggaacgcatgggaggaagatcgacgtggcggccgcgctagggtttggccaggctaggcttgctagattggtttcagttttatatatttcatctatgctggtatcttggtataaggtggtatcgaagtattagacgatacgcgttaggtttaccccatcggctatgctagcatcatacataatccctactttaggacgcatttagatattgtgtaatttatactatctcaacgcggtgaccgatctatcccaatcaccctatctaaatatgtcccatttgatggattacgcatcgctaacatctacagccgatcaagtataccgaacaatctccaagtttttatttgcctctgccgatctgacgcaagttacgtcggcatggcctcatacgatacgtcatcggcaatcctaccgatcagctatcgttgatggatttaactctttgtccttttttctatcttgttggttgcaggatcaaaccagctggcacgctcagaatccgaaggcaattcttttggacgtgcattaaagttaagcagatctctcagaccagtgcatgttttccgcgtcaacactaggacaatgaatctggataaagggtagtctagattcgttgtcctaggagggatcacatcctctcctagattgatttttttttcggagggagtacttcgtagcagctaacatagtttcaagaaaggatgacagttgtagcaggttagtgggtgggtccaatcatgatttgaccgggtcgaaaccatcgaagctacgtctgggggcagtaatggacaacctgggagtactctgtactccctccgtccaaaaaaagacaaaccctggtttttgtgtccaatgtttgaccgtctgtcttatttgaaaaaattatgaaaaaaattaaaaagacaagtcacgcataaaatattaatcatgttttatcatctaacaacaatgaaaatacgaattataaaaaaatttcatataaaacggacagtcaaagttggacacggaaacccatggcctttttttttgggacagagggagtagcagctaacatagtttcaagaaaggatgacagttgtggcaggttagtgggtgggtccaatcatgatttgatcgggtcgaaaccatcgaagctatgtctgggggcagtaatggaccatcaaggttgtgtttagattcaaaattttttcttcaaactttcaactttttccgtcacatcaaatatttggacatatgcatagagcatttaatgtggacaaaaaagagccaattgcacagtttgcatgtaaatcgcgagacgaatcttttgagcctaattatgccatgatttaacaatatggtgctacagtaaatatttgctaatgacgaattaattaggcttaatagattcgtatcacagtttataggcggaatttgtaatttgttttgttattagtctacgtttaatacttcggatgtgtgtccgtatacttcaaaaaattttggcacacaaactaaacacagcctaagcttatagtgtactcccaccatcccataaacatctcatatcaaaagttcatttgacctaatagcatcatcaagaaaatgagaataatccattcccacaattttgttattgggttttctagaatgaaaataggaattgaaaaaactcatcgttccaagagaaaccctaaatttaattcccaaaaattaaaagtgagcctttccattaaactaccaacagaaatatcccgttttctatcatccccgcaagaaaaaagatcgcgcggcccatcccacgcgctcctccctgccctgacgccgcgccttttgtagcaagccacaacttaccttaattgtgatttggcaatgttagccactaaccaaacaaccccctagacttggtatagttgaattcgatgagaccaaactcattgatcaaggtacataaaagagagtagaggaggcaaataattacactttttttaaacttttttccactctttatcagatcggtctaatctctttcacaacaacactctttctcataaagtggaaaaagttaaatatttcctacataaatgatgaactaacatagctgaaggcaagattttcactgggagtgctcatgtatccttttaccaagccgaacatgcacatcaatcgccgttattgaagacgttgtaactaactattccctccgttccaaaataaagcaacttttagagtttgaaatttgcctcaaaataaaccaacttctaccttcttacctaacaccaatccataaaacgagaaatttcattactttaatacccctgacctacctatcaaacaataaaactttcacattaattaaaggcattatggtttctgttcttaaaatcttctttaaggccttgtttaatttcaaggggattgagggggaataattgcacatcacaataggtgtagaataaattccctctaatccatttctcatggggattaatcgatctcgcattaagggtttgagatagagcgagggagtaaatcctacgagtagtactccctccaggttgataatacttatcgttttgaacaagggcatggtctccaattaaaaaaacaactttaaccattattttttattataatatgtataaaagggttaacaatatatgatcttattaaagtactttttaagaccaatatatatatataaatatatatatatagtcatcatatttgaaagagaaatattttgaaaatgattgataatcaaagattctaaagtttgacctcacccttgttcaaaacgatgagtattatcagcccggagggactatctagtagtagttgttgcctttttctaacagatccaaacggtttctcacagcggttattattcattggcctttctggcacgtctatatatacaccggttgaccgttgacactgaaaagcgaccggggatgggcgctgcgtgatacggtgatagccgatcaagatggatgcagtgcagctagcactcgattggtagcacgaaacaaacactgcaacaagccaacaatgcaagtaagtcgacgtcggtcgacgcagattaattcgagcgatcgatgaatgtacccatgccaattttatttgcactgattggatgtcagcgcagacaactaagggcctctttgattcggagaaaaaacatacaaattttagagaattttagtcttataggaaaatttcctaagaaatcctttaaaacaaaggattgaatcctatctaatcctttgaaattcttgtagaatggataattctatagagattttggaggaaatttagtaagagcttcaacctcttgataactttcctttgagtccatctctcccatccaattcctgcgtttttcttaaggttcaatcaaacggttattcctatgattttcctgtatttttacaattatttgttttacacttagatttctatcaaaatcctatgtttttcctattcctacgtttttctaatcctgcgattaaagggacgcttgtctacgaaacgctcaaaaaaaaaaaaactctccgagaatcaagctcaatcgatcgctagctcgcgcacatggactcgcatatcgatcggccggccagctagctgaacagcacgcacactggaagctagcagcaaccaagcaggcaagaaacacgcatggttagttgtattccatggttattggttggagcagagtcgtcagagaggtaagcagtaagctcgatatccagtgagacgaggagcccacactttggcgcgagttgcatgctttggaggtattagctgccccgtttggaggtttgcgtgcacgaggccggcagccgggcaccactcgcagaagcaatccaagcaacaggccgtgactgacgtgtggactccaacacacatacaggcaatcacattctatggccctgctatgagatgaacacacgcgcacaccagcacactctaccctttacaagcaattccgaaagactgacactactacaaaacatcaaataggtgtcgacactaaagataccggaagtgctaaaaccaacacctatagaccttttcccacctccgtagtctaaaaacacaaaaaaccggcacctttaagtgattataggtgtcgctctataaaaaaccgacacctttaattcattataggtgtcgatttttttaaaaaaccgacacttttaataaattaaaggtggggcccaccggtcaaccgagccgagcctaaactggaggtgtcaacttttaaaaaccagccgagccggtcaactgagcaggtgggacccaccggcgctcttttatctctacctctctctcgttattatctcttcctctcgaactctctcggttcttctctctttctcttcctcctcattcctctccacttcttccttccctcccggcgcgacccgacagcagcagtggcgtgtggaggtgggaggcggcgtgcagcggcgggagggcggcggcctcaggtgaaggcggcagcggcgggagggtggcggcgggatgggaggccgggcagcctccggtgaaggcggcagcggcggctgcaccctcccctccgccagatccagtgggagggaaggcggtgacccgacaacggtgcccgctggtggcggtggtggcggtgtcgacagtggtggtggagactggcgcgggcgaggtggcggccggcggcaaccgccggatccggcgatggcggtggcgttgctggtggaagaggctggcacgggcgaggtggcgaccggccgacatgaatttttctctttttgagttcttgagttcttcctctcttttcttctcctccatgtccaatttgttgagttcttgagactttgtacatgtagtggtgtgctgttcaattttggataaggttgatgtg

SEQ ID NO: 73935 - DNA, 1509 bp, Oryza sativa
ctcaactactaattttaataatacaaagaacatttcagtaattatttaaataataaattaatcattaaatgatcttgttttaatgttgttaaatacttagagtgtccaagtatgttcaagatttttcttgaaattatttgagcattggaaatatttttaacaattcaaagattatttcattggttaatttatttggagaagtaattaaaaatcctctctctttcttgggcctaatccacgaagtttacagcgccgaaagtccgtttcatgtccctacttcttctcctctcgggccagcctttttccccaaagtccacaccacgtcccagtcgctacagtgctgtcttcaacctctggccggagactgagcccgacccggcgccgctttctcctccaaatcctggctcccctttcgatcttttccaaaattggttaaggggaaatatttctcttatcctcctcttccgttttcctcaagaatcggatcttatcttgaagaaatcaacgcggaattgagctcgattcgagcttatctgtccaaaccgaatcctagtttttgtggacaaagcggaaggggacggtgacggacgaaaaaacgcgggtcaaaggatgcgacgagaggaataatatgaatcttttaattagttaagattaaaattgagtttaagatgtaaacgtagtgggggctttgtgtaaaacttcggatcgctaccaaatgtatcgactcgaatcaagggggctttgtgaaaatcgtatcagaagagaaatcgtggccgtcggatcatatgcgttgcgaagatcccccctcttccgcgtcagcgccggcgccgcctccgcgccgcgcacccctgaaacctccccgggggacgccggcgcctctcctccttccccccacccctagccacggattccatcgccgcggaggacgaggcgcgctcatcgatccgccgctccccgtcgacgacgaagcgacagcatcaagggttctaaccacctcttcccccgccgtcgccgtgagcgcctttttctcttcctccttctccggaagaattgggcgggggatttcgctctcatcacgaaggtatcgaaatttagtttactaccgcctgctgtctttgcttattaattgccttgataattctgaatattctgatatatatattccctggattcccaatatacagtagtaagctttagctgaagttttcctgtctccaatgcacaacattttcaccaaatttttttagctaaatgtatatgttatgcatggttgtatctggtttaatgaacatgtgttggcagcagcagaacaagcacagatatggtagtttaaggagtcctctaaaaataaaggaaaaaacaacatcctaggaagtaactatcattatacacagtatggtagtttagaggtgtaaagtttctggttttattgtttgaaaatgaaatctaaatactatcgataccactggaactggaacatcatatgttaactatttggaacatcgatta

SEQ ID NO: 73936 - DNA, 10143 bp, Oryza sativa
tttatatatcgtatcaaacgtccagaaacacaaagacaccaaacatgggcacattttcaagctccaattattgctcagttacagaacaaagaaactaaaagcctaggcagcacacaacgaaacgtacaagaagtttgcatcccccagcactatagtagccacccaaggaaccagccggccaattgatacatcacaaaccaattaaaggaacaaatatatatgtgcttctgccaacaaggaaccggaagtatacataactaataataagataacatatgatcagatgagcctcagggaaaccattgattgttatcaaatactatactagttacgtaccttgaatagatgaaattgcagatgaactatgtggcaggggttattgtgtgctcggtatggggattagtgatctcttcttgttgctcaatcgagtggcccccttcctcccatccttcctcccgcgatatgtcgatatcctccaatccttcctcccgcgatatgcggatatgttgtatgtagcagttgggaagtaggcttgcttcgttcttgatggcggccacaactgcctccacctccttagctgtcgcgccttggcagtcaatatagacattgagtgccttaagggttgagaggtggtggatgcccagatttcgattggcacatgcatactttgtggaatgtgccttgattgtaaagttgatgtctacaagcgttggcatggctccagcgtggaacatcatatcactagccgaacaatccaagtttagagactctagacatctgaacttatttctgtatatgctaaacctttttgtgttgtcaaatgcggacactaacaaaagagaaagcaaggcaggtaagtctcctaggatctcaagggtttcttgcgtcacttgttggattctaatgtccagataggtcaggttggccagtgacgccggcctctcaggaatcccatggagaaggagaggacggatgtgtaattcttgcaggagataagacggcgaggatgaaaaatccaaattgatataagcagaacccaactgccagtaactatcaaaatacaaatatctaagattgtaactaaggagtttgttgagcgatgaagttaacgtatccaagtgttttgatttatgattgttctcgtcagtaatggacaaacttaggtgaagtatcctaagtttggtcagcgttcccaactgttccaaggagtttattgagctcaaattgtcctcttttgttgatactgctagttcctctagagcttgcatattcccgactccatccggcagtcttgcatcatgaacgtgtaaaaatttcaaccgccgcagtttaactatgcctttgggcagctcctctgtaccaataccacgaggtagatccaatatctccaaaaacagcagttctcctatttcttcagtaagatgtgtaactagatcaatccgtaagtaccgcaactgaagtagcttcccaattccacaaatctccatcatcttattaccactctctatatgaagcactctgaaaacattcaagtcagaaataggaagcatctgttccctgtatccaaatatgctcactgatctaacattacaagttaccatggaacacattggcatcacattttcttggccacggtagtcaagtaaaagtcgaccaacttttccttgggacactaacgaatttggatcactgaaaactgtaacaaagttttcttcaattgccttggatacaatgagatcaagaataatatcatgcacacgacaagtccttatacgatcgtcaaataacattttttctggttggatcaaacttctgttgataagttcatttaaatagaattccccttcctccattatgtttctcccacaatttaccttgatgaacccttctgctctccacctccttaacaactgctgcacatcgatctcacaatcttctgggtacatactgaaatatttgtaagcgaaaactcaaaatcccttatatcgtgggacggagggagtgggaaagggcagggcccaggctccactaagcctgagagaatattgtgctttattcacatttcacgcgcctggtgtgaactaacagcgaggctttctgcgatgctgccggccaatagtgaccctgcttgactaatggcataaaaagcttggtagggaattgatactgaattaccagtcactggataagaaagacatcgttataggcctgtacaagcatttgtctcaagagagcattataaagatcaaatgatgagataaggtagagaagtgagggctgatgagagagtggatgaacaatatctatataaactcaaaaacagtacaaaaacaagcactagattagtagtaagcaaatgaagtaaaaaatattatggtttattagggcaagtgtgctagaggtaatttgttgtgtatgttattaataaagattaggcgagaataaataccggatgttattatgtttagaaaaaatcactggtgttgtgggtggaaacaaatagatttttgggatcacctatacatttgtcgataaattttcttttaaaaatttgacagatataattatagtataatataatttgtctgtgattgtatgtaacatgcaaaaaaatctctctgtaacatgttatttcgatgaaacggaggtcgtgaaaacgaattctcacatatgtgcacatagtgacttttttccttctttacttgaacaaatcttgaaacggtttaaaattatatgcaagttacattgtagttacatacaagttacaatgtaaatgatgatgaagattagcccgtaatcgcatcacttgtacagatggttttgctgtattgggccttgtttagtcaccgtcatttttgcgggcgggccatcttctaattgggcccgtaggctgttcacgacactttcgacgtcgcaccggacggtgacgcattccccgcgctcgccggcgccgctcccgaacacggccgtcctcggcggtggctcgtactactcgcgcgcgcggcgcggccgtcttggtcgaccaggctaattttgcacttcagttggtcctgctgttctgttcttgccgaagagccatctagctccagcaatagatatatatatacatgggtgtcttcaatcttaatcttcaatgtcaacacttcattgcaattttaattatactttgagtactgttcatttatgtcatgttatattattcaacatggctcatttatttttctcgatcacacagctgttgaaacagcgagctacttctggtgaaaataatttccatcaccaaattcaatactcaactgcgtgacccaggttatttgttacaccaatttccctgacaactcaaaaattgtcacaaggtattccttccatttcaagttataaaatatattgattttggtcaaaatcaaactgttttaagtttgattaagtttgtagacaaatatagtaatttttataatactaaattagtgccatcaaattaataattaaatatattttcataataaatttcttgggttgaaaatattactacttttttctataaacttggttaaacataaaacagtttgactttgaccaaagtcaaaacgtcttataatctgaaacggagggagtagtaactgtgatgaaaattactatatagttacagtgatgatttttatcatcactgaaaagccaatcctgcgaaaagcacctagtcacttagaagcttcttaagtattccctcattccctaaatatttgacaccgttgacttttttaaacatatttgaccgttcgtcttattcaaaaacttttatgaaatgtgtaaaactatatgtatatatgaaagtatatttaacaataaatcaaattatacgaaaagaattaataattacttaaattttttaaataagacgaacggtcaaatatttttaaaaaagtcaacggcgtcaaaaaaaaaaaaagaacaagactagtggtaaagctctcagaatgacgccatccattatccatgagtgcatcgatcagagcacaacaaagtctcatttgtccaaaaaaaaaaaaactcaaaagctacaaagcctaccgctataccatggcataacctcccacaatgatggatcggtcggcaaaggccacattcagacgaagtaccgtcaccgatactgacggtaataattagccgtgtagtgtacaagagctacgaatgacagcggctttgacgactgcactaatcaaactcttacagggaaatttcggaaattttagttctatcggaacccccactactacggtaccaattctcccgtgcgggctaaacgatttttgcgtgcagttgacagcccacacgcacccagtcgtctgggaaaatcgcgattttcacgtgcgggtggcgcacccgcatgcaaaaatcagatttaagcgcccgcacggaaaaacaaaaaatagaaaaaaaataaaaaaaaccctaaccctaagccgccgctgcctagacgaggcccgccgccatcgcccccgcggtcgtcggctacggatccgctgcccgctcctgtcaccggcaccggatccgtagtcgcacatcgacacacaatagatctcacatcaattccaagaacacatcccacataagcaacgaatgaactccaagaatgcttctcacaaatcacaaacagtcacaaataacaaagagagaaggagggggagagttagatccgccggtcgtcgacgccgtcgcacctcctaccggcggccccacctccacgccggccgcttacgccgccgcacctccaaccggcgccgcacctccagatccggtgcgggccacctccatcccaccgctgagggaagcgggcctcctccctcacgccgccgttccgctggatatgcaaggggggaggggaggggccaccgtggtggcccgccgctgctgcctcccgctcccgtcgcccgccgccgctattgcccacctgcagtcgagggagagggaaggaggcgccgcgcgcgcctgctgtcaccgccgaccgaatgacgataggagaatgggagagtgggaggagaggagtcgagtgggagagagggaggtgggaggagaggagcgggcggaggggaaggtgagggaacgacaggcgcgtgatgaattaaaagggatgggctattttcgcatgcggctgaaaaaatgcttattttcgtgtgcggttggcttaagccgcccgcacaggataacgcgttttcccgtgcgggcgacggcccggcgccggtcctcctatttttccgtgcagttccacttacggaccgtatggaaaagggagcggcgtccaggaaaatagatcatgtagtagtgccccccacccccctacggacgatacgatataatttcagccaaaatttttatttttttcattttttttatgaattcggtaatattttgttcaaatttggtcaaattttattcaaaaattcataatatttcgaccacccccaatacaaatcagcaaaccgaaacatttaaccctgatcacatcttcagctcgatctccagcagtcttgacatcttcttccattcctctctacgttcagctgcatcttctactccagccgatcagcttgtaccgttctttcgcatttccccaatcgcagataccgaactggtgcacatagtgcacctgcaacgctggccaatcaagtgacatctccccaaaacgccttaagcagcagtcactcctacactctgcacaaacatctgaaaattgtcatggttgatgcacttcatgttgaaaatgcgatgagtcgtgagaactgtgtaccccggcaccatccatccgttgttgcgtgtcggatccactcccgatgcttcccaagcctacatgcatttcacccttttcccgtgtgcaattttctaacaatcgtagcagttcatgcagaagcttattatctcatctaagggcctagttttgcacttcagttggtcatgctgttttgttcatgccaaagagcaatgtagctccagcaatatatattcatgggtgtcttcagcctcaatcttcagtgtcaacactttattgcgattttgtactatgagtacgtacagttcatttatgtgatgttctattattcgaacatgccactggtggagaaaccatctttggtcggtcgacccaaatccacatataatcccggttccattaaaaaccgggactaaaaacgatttttagttccggtttataagcgtaacaggactagatgatctttattcccggttagggttaccaaccgagactaaagatcaagttgtctctatgtcagatcgtgtcaggcggctaggatcttaactgggactaaagatctaactttattcccgagtggtgttactaaccgggaataaaaatcaacacgtactaataatccctattacttatcctcttttcccgtccacacaacgaactctttctctatctcttttttcctctctaactccctatccttatcctttcttcttccttcttccttagttcttcttcttccttagcccgcttggatcggagcgagagaggccagccgcttggagagagagcgggctgggcagcagccggcgcatcggcgcggatggacaggcggcggtggccggccggcgcggaggggaaaccggcgcgacggcgggcagcagcgcggagggccgcggcggcggcgcgggggctggccggcgctgaggggaggcggcgcggcggcgggcagcgggcggcggcggcgcggcgtcgggcagcgccgcaggggtcggccggcgcggaggggaggcggcacggcagcgggcgggcgggcggcgcggcggggccgcgtggcggtggccggccggccagcgtggaggctaggcgacagcggtcggccggctcctctgttattgttttttcttttttttaagaatttgtgatttattgcaggatcatgtgatgaatttgatttgtgtgtgatgtgaacttgtgatgaattttgtagaaacttgtgatgtaatttgatttgtgtgtaattttttttaggatttgtgatataattttttagaactttaagatttgtgatgtggacttgagatcttacttcgatttgggatatgcataccacccatattcaggagaaaataaaaaagatatgcataccacccagattcgggagaaaataaaaaaggaaaaaaaaacctagtcccgttgttgttaccaaccgggactaaagatcatttcaaccaggactaaagatgggcatctttagtcccgaattgctactcccggttggaaacccgggactaagggggttcccaaccaggagtaaaaagatttctctaccagtgtgcatggctcatatatttttcttacagctgttgaaacagcgaattgaactacttctggtgaaaataatctccatcacctagttcaatactcaaccatgacccaggtagtttgacatgaagtttgtgtacatatacaggtcacgttcttattcgcataatgttaatcagatatcaaccagtcagcagtcttacacattaactatgtaaaaattcactaggttggaattttaattttaaaacatggaatactgatttgttcagcatatgttcctagctattaaaataatgtagactgatctcactactggagaaaccatatttgattggtcacctaaaattcacaatagtcctggttcgaataggaaccggaactaaagattattttttatcccggttaaaaactttttgatctttagtcccggttaataacactaaccgggactaaagatcatttttagtctcgattcatgaagttgtcgggtcaagtcaggccccaattatttttagtcccggatgatataaacaaccgggactaaaaatatatctttagtcccggttgcatataccaacctggaccaaatttcaccccgacccgtgcgcctcatctcagtcagttggtcgttcttatcccttccaccttcctctctcctcccctctcattaaattaacagcctcatctcagcctccacctcccctctcccctccctggccttcctcccccttcccctctcctcccctccccgcctcctcctctccaggcggccgagcccgggcggggacggcggccaagcccaggcggcgacagatggcacggcgggccgcgcggagggcacgtcaggcggcggctggcggcaggcggatggtagggcaacgacagctggcggctggcagcgccctcccctctgccggagggtaggcgggaggcggcagcggtagcattttgtcttttttttgtttttagaatttgtgatacattggatctgagaatttttagaagttgtgattcattggatctgagaatttttagaagttgtgattcattggatctgtgatgtaaaatatatgatgtatgtgatttgtgatgcatttcttttagaatttaagattttttgttgagaatttgtgatgtgaatatatgattcattgatttgtgatgatactttgattttgatttggggatatgattggcgatatgtagggagcaacttgatttgggaaggagcaactcgatttggaaaggaacaatgaaaaaaaaaagaaaaaaatagtgaccaaccaggactggcgctgccatgtttagtcccagttggtaacaccaatcaggactaaagatgaatttttagttctggttattttattcgggactaaagatatctatctttataaaatggggagtatagagggttacaaaccaagagcaaaaacgctttctccagtagtgactgtatgtcaaatattgctacgtacgtactgatcaatatgtatacatgatgaggtcactaatagatactaactaatcagatcaacatgacctgtccgttatatatatgtcactaaggaagcatcacagagtcatcatgctctgcacataaaaaattgtcagggtagaacataacctacggtcgtttagaattgaacatcatgcagcagggagatctcaatctcacgggaaatgagagcgctactaaaatatgaaacaaattgtaactcttcaatttcttatggtaactctttcaaataacgggatcgtcaaaaagttccaaaatcacatatattctaacacgtctaatgctacgtcatccaaagtggaataaatggtctttggctatcgatttcaagagtatagcaccactgcgcatggtatgcgcatggtatcctgttttcctgtaaaagcatcaatgaccaaaagtagagcgaactggaacacatgaaaatagcctccattatattagacatctttttggtgttaaaaattatatcattttggtaacaccagagcacgcaacaataaggcactaaccccgaacaaaataagttctttagtagatttcgacactcccgttagccaattaacaaaaatatttttggcaatacagggaggagggatgttaaagcaaaatggttgcatagccaagtaaaacgtgcaatatcacctccaatggcaggcatattctctttaactctctatgcaacatctgaaattttccagggttgatgcacgtatccatcctgatgctaccaactagaatgcaagatcgtcccttgagtctgtccgttcatatcaaaaatgcgactagaacggtgccactgcaagattgatgccgagctcttgtgtcgcatatgctccagatgcttcccaagcctaccatatgatcgattttgctgtgatcttatgcaatttcgctagtgctatataactcgtggcagatgttgaagaacccttctggatacaagaccttttacacttgtagtactgctggtcatggggttttatatatatcttgccaaaggaaagcaagctcctgcaacaacatgcatgcaggagcttcaatatcaatcttctatgtcaaacactagtcaattgtaattttgtactgtcagtatacgatcatttatgagaaatcttgtgcagaccattacacgagctggctcatgtgaactctttattttgtcacagctgtttaaatagcttcagctttgcatggtactctattcaccagcaggacaaggggtaaagcaaagcagttctaggaatgacaccatatcccatcatcggtgagtggatgtatatagcttctttaaagcaaactaggaaggtagcccgcg

SEQ ID NO: 73937 - DNA, 2456 bp, Oryza sativa
ttatactctgatcagaggtgtacatctttacccacaagacacatcttcctcacgtgtaaccacgtgccacataccaccacggtatacggacggaagacgtgacatagtttccaacccatcctagccacagacaagagtaccgacccaaccccacctacggccgggacctccgggacaggtaggcaggactgagcccctagcagcaggacaccagccctgtgccatgacatctcgactaccgggccgcagctcgtgtagccttcatttgtcctagagatgtccatcgacccccgacttcgtccatctccatccgtgtacttttgtttataaccagactgagccacaatgtcacgaccggaaataacccaacgggcgtaccttacgtgcgtgcattaatccttgtcccaggaggcaaggtacaccaaaagttgatacaattcagagtttaacaagcggaagcgtaaatagttaatttattacatgggcagcgaaggcccagcacacacaaagacaaacgagaaacagcggaagactagggcgacgaccacaggcacttgacggcaggcacgagctagacaccaaagccttcatcctccaggaactcctcttctgggtttgggaaaaattgagcaagactgagtacaaccaccgtactcaacaagacacacccacaagtgcagaataaatgcaagggagtacaaaggagttatactataaagggttaggggtgcagtagacagcatttaaagacattagttgctcagggctattttgcaaacacgattctagtactatacaatatttttttatcaaggccgtgaacccacacgaacctgccttaacccaacgcctacgatgattcagaccgaactggcaacccgaccctgggtcccagctcgtcccaagccaacccaggccaaccattccacattttagttgttaagcaggttttaagaattaaaacactaacttgggtacattgctcggcttgcccataaccgagggcgcggctattcgaatagattatactctgatcagaggtgtacatctttacccacaagacacatcttcctcacgtgtaaccacgtgccacataccagcacggtatacagacgaaagacgtgacatagtttccaacccatcctagccatagacaagagtaccgacccaatcccacctacggccggaacccccgggacaggcaggcaggactgagcccctagcagcaggacaccggccctgtgccatgacatctcaactaccgggccgcagctcgtgtagccttcatttgtcctagagatgtccatcgacccccgacttcttccatctccatccgtgtacttttgtttatgactagactgagccacaaactaagccttacccactagacatgtggaagtacggtagtgctttgcaacagaggcccgaagaccggtccttatatggccgaggtgctactgtcaaaaccatgcaccccgagcccagcctaaaaccatttttggggattttgaatagaaggagcggtgtgaagccaattccacaataaccaaaccattccatggtgtccaggtgatatgaatattcccaaagtctagagttgtaaaaccgcctaatgttacctaattaaaagcgaagcatctacctaaaatcatactagtgataccatgagtagagtgtccactagttggggttttgtttattctagggtgaacaaggaaataataacaataacaataataataaggtcataacaaaggtaaataggcatggctaagtaaaacagtgatgacgcgggaatttaaataaagcgataatgcaataagttaaatcaacataattttacaaactgggattcaatatgttcaaagatgatgtgacttgccttgctcgctttcccaaacgtcggcttcaacctccacgaagagcggatcttccgaagctgcagcgtctacacgacaacggaaaagaaacggcttttactctactaaactccatataacaagcagaaacaaagcacaaaaatgggttcttggcttcttaaggaaaaattagagacttgaacggtccaattccgagttcaaatggccaagttatggccatttgaagtttatatgctctttaaatggatatttacgaatttcttcatttaaattttaatttaaaaacatatttattgcgtcagccgggagagaggagcgcgcggaccggttccacgggagtggggcccacgcggcagcctctcggtccacggtggaccgggtgcacgcggcttacgccggccggcgccgtgggtcccacgcgtcagccgcacccgagggcgcgggcggctgacggccgggccccacatggcagccgcggggcgcgcccgaaggcggcctcgccggcacagccgacgggaggcgacgcgcccgcgcccctatggtcgccggcggcggccataggcacggcggagcggc

SEQ ID NO: 73938 - DNA, 8817 bp, Oryza sativa
ccttttggctcgtggaacacagatataaatacgggcgcttaatctcatgcaactatatagtatttgctttaatgttcctatcaatctcttgcatctgattcttaatttgtaccgagagtacagttcaattaggaggaactaatacaaacagcacatggctcatctactccctattccaagcaagcagctcaatctgcttttgctatgaattcatcagcaatttctccattagttctgccaggatatataatccagtgcatacgtgaagcatcattcgaagaactggaatcacgcggtgttgagggaagacaggcgacttaattagatggggatatcgatcactaagcatgatcgtatgccactgtgaccagaaaagtgtcttaactgctgtgcatgctatcgatgcttcccaagcctacatatttcgccaaatggttcatattcagtctaattaattatatagctcgtgccatgtctagatgggaatctctaggaagagtttagaccttctgagtttgaagcatgatctcagagtgtctaagaactgaatttctgcatacacacacttgattgtgaatttgtagttttgtactgcgagtatatatggggcgtttacgataaactatatggcacacatcacctgcactcttatctcacatctgattaaacagctcgagctgctttttggtaattagttcatcagcaagatctccaaactgccatgataatcaaaacaacatgcctgaagcactgatcaatcttgcattatttttcttaggggtaaaaacaggagctctgacaatttcatattaggagaagagagaaaaaaccagatcgagttttcacaaactaggttacagaacgatcccacggaatctcctgcgatatatcgacgaccttctgaatcttgcattatttcaacatagaaacacgcaccatatatatcgacgacgaatgccacgcgactttggcctatcatatgcagtgcccaacaaaaataaggtgtccatatgggagttatatgagccgctcattttctcgatgcttcccaatcctacatctacatggctacatatatgctaattaactggattcattcagtctacctagctagctcgtgccatgtctcaaaatctctatgaaagttaaaccttctgaatttgaagcatggtgtttcatctataattgcatgagtagaactgaatgtctgcatatgcacttgtgcaccctctctaccttatctccacctcactatatatttacatgggtgcagctacttccattgattcatgttgtacggtttgatcctcatattaagttatttcgtcaattcaataataatcctagaatataagatacaactaccactaattaatgcaaggacaatgcatgcaccgataggattagaggttttaaaggtgatggatttaaaaaatgattttagggaagggagaggtactaaataattgcatgcatgtatgcgtgttttaaattatgaaacatgaaaagagtaggcattttttatatatatattaggatggatgaagtacttggaagtactaaaatatcgatcatataaattttgagaaggcaacaggacattaactttggaagcagagatggagtacaaaagaaaagaaaattaactggccaaaccgtatctaaagttgtaaaatatctatgcgtacgcttacatagttaattaattaggtgtatttatgagcaaaaagctagagatattttcatgctttttaaaaagtatagaaatattcttttgacacaaaaaagtatggtaatattgagacgtagggtaaatggatttctaactaaagttttacgaattataagttaatttaatgcagaatataaaatacaaaccaatataaaagttgcaatgcataaaaacaaaagttacgcttttttatattctgaaagttttaggctagttaattatcacattcaagtttaggtaaatgattgataaaaaggaatcaggcatagatacaagggagcacttgtagcttctgcaactatcttaacagctcgagctggttttttctatgaatgcatatcagcaagttatccatcctgccatgatatattcaagtgtgcagaggtgaagcatctatcaaataggtaatttcaaactggaaattcactcagtgttgaggaaaagcatgcgacttgggccttccaggtaggataagcaagtgagctcaaaagattttcccgcttgctagagaaaaaaatgagctagaagtagaataaccgggcaaaaaaatcctgcttgctcgcccgccgctcacatttactttcaggcagctaggaaagaatcctaaatgcagcacacatgttctcgatgcttcccaattctacatttataatcgttcattccactactttattccctccgttccaaaagaacccaatcctgaaaaccaatctctaggattaggttttttttaaaggacgaagggagtagattgaaaggctcctgtgtaccaggagcatgaaaaaataaataagtgaccttttacagtgtttgcattcctaaaatggcatagatctaacagctcacgatgaaaggtaccttatgaaaggtatcagaggtagaaaggtactaaggattaaaaggtaattgataacagggcaattatgtctaacaacgtatggacgtaccgaaaggtacggtgtaagtggatttaaaggtaccacaaggtactgcgtaagtagtttttaaaggtaacgtaaaatatgatttatgtggtggggacaaaaattacattctcttctattcggtttccaatcttcggtcgttctgtttgcgtcggtttctaaactttggtccgatttacgtggtacatatcatattcgcatgatcttgataattatttccagttagtcgttaattttcatagcaatttggtgatccatcgtttgatgaatgtaatcaaagatcgaaaggacaacaaattgagaagatttacgcacctaacaagaacaaaacaagttcaatgaggaagatttgcgaaaaaaactaaaccaatcgtctaatagatcgagaccgtgcggccgcttctagctccggcgaacataggcagtcctggaccacttcctccgggtcctcttcctccgccgcccctccctccaaccaccgcctccggccacacgtccaccgccagccctcaattctccacctttcaacttatcgaagaacacgtaaaccttacgtacgaacagaacgtatctaagaacaatgcaacgcaacaggctacaagctaattccttcgataccttctcataccttttcatatgtgtaaaagacacatttggcattctaataacatcatatttacattaatgccacctattacaatattttctttccataccttgcccctcgcagatcaacggctcacgtcgccccacctccttgtacctcacaaatatcgtaaaatccctcaacaaataaacacacggtaacaatattgttgtcgagtgccagcgcatggtaatagagacacacggtggcttcattgatttacgatgcacactttctcgatcggtctacccagctcatgctgtctctcgatcggaatatctaaaaatcaaaccttctgaattgaggcatatgtgtatatgtgcagtcaagcaccttcccaccttgtctccggtgtatggctgtgtttagttcacactaaaattgaaagtttggtttaaattgaaacgatgtgacgaaaaagttgaaagtttatgtatgtaggaaagttttgatgtgatggaaaagttggaagtttgaagaattattttggaactaagaccctgtttagttggggaaaaggaaattttttggtgtcatatcggacgtttgaccggatgttggaaggggttttcggacacgaatgaaaaaactaatttcagaactcgccgggaaaccgcgagacgaatcttttgagactaattaagccatcattagtacatgtggattactgtagcacttatggctaatcacggactaattaggcttaaaagattcgtctcacgatttcccccataactgtgtaattagtttttctttttatctatatttaatactccatacatgtgtccaaagatttgatatgatgtttttaggaaaaactttttgggatctaaacgggccctaaacacggcgtatatatattgacctgaattgaaacatcttgtcacattgattaattgctgtgtcagtacacactacaggttgatcctctgatcaagttatttcctgagttcctctaaaaaaaaagttatttcccgagtttaattatacgtggctatattagtttaatttggtttcctctcccatttagctaaagcaaattaatgtaaggagagttgttttataatgcttttcaccggtagtaaatctatctagaccacttttttttccaacttaatggattatacctacttatattaccacatcaatcgctaccactacaaaattgatatttaatttctggacaagaccctccttagattttagacggttcataagtgctctcatctgcgaaaatagtttccgtacgctttcgtagttattaattaggtgtatttatgagaaaaggctagagatatttttacgctttttaatacagaaatattcttttgacacaaaaaagtatagtaatgttgagacttagagtagatggatttctaactagttaatttaatgcagaatataaaatgcaaaccaatctaaaagttgcaacgtataaaaacaaaagttacacttttttatattctgaaagtattagattagtcattacgttcaagtgcaggcatgaagcgtctatcaaatactccctccgtttcaaaatatttgacaccgttaactttttagcacatatttgaccgttcgtcttattcaaaaaactttgtgaaatatgtaaaactatatgtgcacatgaaagtatatttaacaatgaatcaaatgatatgaaaataataaataattacttaattttttttgaataagacgaatgatcaaacacgtactaaaaactggaataaaaaatggaaggagtagtaggtaatttcaaactggaatcacgcagtactaaaagacatgcgacttgggactctaaggcagctagctagtactccctccgttctgacgccgttgactttttaccacatgtttgaccgttcgtcttattcaaaaaatttaagtaattattaattcttttcctatcatttaattcattgttaaatatatttttatgtaggcatataattttacatatttcacgaaagtttttgaataagacgaacggtcaaatatatgctaaaaagtcaacgtgtcaaacatttcgaaacggagggagtagaaaagaatcttaactgcagcacatgttctcgatgcttcccaagcctacatttgctctatctctcgatcgatcggaatctctgaaaattaatccttttgaattgaagcatggatcgattcatctataccagtacttgcatgagttgaactgaatgtccgtgtatatatatatatgcagttgtgcacctttccagtctaatattgatctcaattgagccaccttgttacaatattgattgccgtgttaattagtagtacagtttgatcctctaatcaagtaatttccttatttaataagtgattatttggttaatttggtatcaagtgattatttggttaacttggtattgattgccgtcttagtacagtttgatcctctgatcaagttattttcttatttaatacgtggcttctattgacaatagtattagtagagactaaagaagaaccctggcttagggaccctagaaaaaggcaaacggttcagattatgtgaaattcactcggtggagttgagtccaactccaagtctaactatagaaactgtgtttctactttctagctatctactacttatgcatttagtacttgactaaactcgaccaaacaaaaatatcaattagaaaacttttgacgacctgggaaagaatttaatttggattgacagagattacatatgagaaagaaaactcggccatgcattttctataataaacacaatgactcggtgagattactttgacactaacactaatgaccaattttgcagaaactagtttgacttaatacccactaattaaaaatctagctaaactaattgtttcatgacgagttcagtcaaaactgaaggacatgttgccttcagatgctcgaagccatcggtagccatggccgccttgaggttgcccggagaagacaagaactcgacgcaagcctccttgagcgcgcggcaatggtgctgctccgccagcgccagcgtcacggcgacgttgcccatggcgacgcggcggcgcagcctgtcctcgcagatcagcctcagcctctccatcccgtacgcgtccgccgcggcgagcagccgccgcgccatggcgtcgtcatcgtcgtcgtcgtcgggcagcgtgtcggtgtagatgaagtggagcagcgccctgaacgcgtcggcgtccatggcggcgagccgcagcgtcgccggcgacgacggcgaggcggagagcttggccttgagtacgggtgacctcgccgcgagcacccaccggtgcgcgtggaacgtcgtcgtctcgccgtcgccgccgtctagctcgatgacgacgtcggcgccttccttgctccagaggagctcagcgaggtgccggtgcaggtcggacggcggcacgacgacgccagcgtcggcgccggcggcgagagcctagtgatgatccagatcgacggtgagcaggtgttcgtccatgacggtgaggtcgcagcggacggcgaagcggtcgtccctgaggatgtccggcgacctctcgagctcgtccctcgtgatgaggctcctctggccggagaagtgcgtcctgaaatccaccacctccgacgaggcgtcgtcggtgcggcgcgccggcgagccggcgtggtcgagcacgctgaaccgggcatggccggcgatgccgctccggccgcagccgccgccgccggcgacgtcgacgaagagggagatggagtcggcgcagccgtcgtcgaggccgttggggtagtatcgcatgacgaagctgtggccgccgacggcgaacctcctcgacgtggcggactcgccggtggcgaggatgctcttcgtgttggtgtacccgtcgatcctgaggatgtgggacccggtcgccggccgcgacacgatggcggaggcggacggcggcgaggcacggcagccggcgacgccgcggcggatggcggcggagagcagcgaagcacacgacatgagacgagagtttggaacgtactacagatcgatcagccaatgatgatatgatatgttggcagcaaattgtagagatttttacggttcagataattttttggtggttatggagattctgactcaaagattacaactaaaaaaataaagattatgatcgtatcttggatttcaagtttatgacttcggtttccaactaatttactgatatgatattatccaacaaaaacttatcttaacctctatgtttatctgtagaaatgaatccttgaatcttcaggtcctactcgaacattttctcctgcatgtgtgcttcatctttcaccatcttctcttcattttctctgaagaaatgtggtgtcggatggttgggaagataatctttcaccatattttcttcattttctctgaagaaatgtggtgtcggatggttgggaagtagagcggttgcatctgcaatggcagcttccaacaccttcacctcttgaaccctagctccctcgcaattaatccatacattgagatccataagagaggtgaggttgcgaatgccaagatcaggatgatcagcgaatgcagattttgccttgtgtgctctaacaacaaccgagatttctctgaccttctgcatggatccatcctcgaagatcaggccgacgaacgatccatacagacggaagatcttcaggcatcggaatatgcatttgctgataatgagaatttccatgggatcatctgattctgaacgcagctccaggtctagcaatgcaggcaagtctccaaggatctggaggatttgctttgtcacttgcttagacctgatgcatagcctgtagagattattcattgaagccatccaatctgggatcctttggaaacagcatttcggaatgtataattcctgcaggagatgaggagatgatgaccaagaccaagaatcaaaggggatgtaaccagaaaaaggtccattgataatgctcaatgattcaaggctggaactgacaagtttgccaagtgatgaagccaagctatcagtataatgtgttctatccttgcgcgattcgcgaatgtaccaagttagcttgagagttctcaggctgttcaaatttcccagctccagcaaagaatttgttgagcattcgtcgtacacggttatacctgacagttcctgtagagattgcatttttccgactccgtcaggtaactgtgcaccattagcagaaaaacagctcaaccgtcgcaatttgacaatgcctgctggcaattttcttatccatgtacgacgcaggtccaatgttttgagaaactgaagctccccaatttgttctggaagatgtgtgattctactggctgcaatccgtaagtaccttaactgaaatagatccaccacgttgttaagatcagagttttgcaatttcacactgctctctagatccaacactcttaaagctttgaattctcaaataggaggcatttgttcagagtatccaaatatgct

SEQ ID NO: 73939 - DNA, 1651 bp, Oryza sativa
gttttttttctcgagtcctgaaccaattgaattccgaatgcgaacccattcttctcttctatctgatttatcagccaataggctagccatagtaataattgccaatggcagaccaccacacttttttataatttcagttgaaacatctttaaggttaactgggcatagatcttctgagccgaaaattcttctgaagaatagacacatggagtcagcttcacttagtggccttaattcataaactgtaccatgatcaggggagcaacatgacttggcaacagtaaaaattcttgttgtcactagtatcctgctaccacaagtattctcaaacaaggcaaatttaatggtcatccattcttgcgtgctccatatatcatcaattacgatcaaatacctagcaaatgagagatacaacgatttaatatggaacaaatcactgacataagtatggcctactgtacatacttattctctaatctatttatgtgcacaacatgtacatcaatcactgacataatgttgcaatgaaattacaattttgcctactggtagaatgacatgtaaattcaaacagagttaatgctaaatggcacgtaatttgaaacagagagcttacctcttgtccttcaggaaaaccctcagtatgtttatgagccactccacatcaccagattctgtgctactgtaatcttgcttcttgatttgagaaattacagctttatctggatttgtgctagcatggtatggttccatgatttgacaaattatgctccgtaaaatcttctttacatcaggcttctgggagaccgacacaaaagcctgacaatcaaatcgcccaccagtttttttgtaaacttcatttgcaagggtagttttgcctaagcctccaactcctacaattgaaatcaccttgaatgactgatcaccatcatctaccaggttaatcagctgatcccttggaatatcaataccaactagattcgatgcctcaacatagagtgcaggtaatcgaggatcaatgggcaccacatttgtggtttcagagtacaattcaggatcaatcttgtacctcttccttctgtggcttgcctcaacaatgtcatccttgagaacttttatctgctgagcgacctcgcgtcgagctagcagctccttcaccttgtgaacatagtcatggaagaatcccacaattccagtaggtctctgtggctcgtagtgtagctggtagatgtacctgtcgatgcaatcctcgatgtcgtaggccatctccctcacttggttcctccactcctccatctgggggtcaagcacctccatgccggccagtttctccagcagagcattcatgcagctcagctcaccattcaacaaggcgatgtcgcgctgtacccccttgtgcagcctgaattcctgacccagcagcgtggtgagcttgtcgattagggagttcatcgcccccgtggcgacgctcaccatgaacccatccatcgcctctgctggtcttctgcactcttggacgagtttgcacctgaggtcaatcctgttcagaaacaatgaagttgaaagcaattatcagttggcataacactatcttgtttatgccaaaaatgctgaaagtgcagatctctgaatattacaaacatctaaccat

SEQ ID NO: 73940 - DNA, 2486 bp, Oryza sativa
agactcgaaatgaggagcaaacaactgcaagcacttaattatagtgccaactatgtttgtactctctgaaatctgtagtatcataccaagaaaaaagttatcctcaggtgcagtgccatcattgtaaacgaagaacaccataccttctatcctctctgcaatgttattgggccgtatccaaaacaaatgttgcttgtttccctgaaccaatttgtactctagcatttcacctgcaagaaggtgcccaataagagggtcgaagaacaagtaacgacgcggtgtccctccagactccacagatctcagaaagtcattagctccatctgcaaaccactcgaatcttcgaacggtagatctagtcggctcgtcgatattgccataaaagatggacgatatcagtgacttggtggcatgggcaattcgcctaggaaagaaggaatcccttgctacttgtttggcctcttgttcttcctggacacgctgcctgcacatgcgtattgtgtcatcacactcttcagcaacacgtttcagcttcttctgccaacgtagcaacggctcactaatgatctgccacttcttggatgtctcaagtgcaagatctaacttgatttgtgccatctctaacctgtccatgtgttcctgcgcacttgattttcgctcatacttgtcaatcatgccagatatgattttgttcactgtctcatgaacgagagcagaactgaccacctcccccatcttcagtaatctgtaggattccctccctgatcaagaatcaatatatactatatcaatcactaaatcaaaagacagaccagtgaattcctaataagtactaacaaagtgcaatgctgtaggatatgaaaaggccagccttctgaattgaatcaattttgtgatataagagatattcatgcagggggcagtgaaatgaaataatgcatgattccatacagaaaaaagtgagaaattcaaagttcaatgtaaggcctaaccttctgggttgaatcaataagaagtaacttggggccttgggggtcagacaggtgcacccagagagagagagtacctagcacaagataactggactgcagttttcaagaatgaacagtcctgtaacacaaggaggtatttatgcaggggggcagtgacgtgcatgattccagggagagagaaaaaaaaagtgagcaagtcagagttgggtgctaagcgcgtctttgtttgatgtgtatggtggagagaacacatcactctagtctaatctcctgttgattcgtcaatcaacttaaaggactaccctctttttgagcttttgaccgtcctaggtgggattgatgatctgccacactcttttagaccggagatttgatggtttgcaatcttgggctaaagctaagcatcagtcgacactgcaaagtctgcaatcaattcagttccggctactaacctttacggcctgtttgaagagaaggaaagaggaatggaagttttaaggagggagttgatagtgggattggtcatgggagttatatttttagtccctatcctttcttttgtttcacatcgaattctctccaagtctcacgaattaacaggcctcctccaggtaagagattggtgggaattggacctcttaattccccatcccaaaccccttcgaattcccaaatctttcaatcaaactacaaacttaaacttccagatatcatacactctcattccccattatcaactcccaccaaccaaacaggccgttagtcctttaccatccctttcacctccttggttgtgcatatacttcgtcaatatagagcctggactaatgaaaatcctcgaaatttggtcggctccttcgctgacccggcaaaaagttaatgaaaatccattatcttaaaaaaaaaaaatctctttcacctcctaaacagaattacagaacagtaattaagcatggaaccaaagaaaaaactggttgcgagatgcggggaaactgagccgtaccacgggctagtgcgcaggcgcatgaagcggccgccgcgaggcgcgagcaaacagccgctctcttcttcttccctctccgcgtcgccgcacgcgccaccacatacggcgccacctagtggtggagttgcagcggatcgacgaatgcaacgccatgcccggacctccctgcgagcgccctcgtcggcgcggactatcgatcgaccagaaaccccgtcctccggcgacggcggcggcggcggccgcggccgcggaggccatggccagccgcggcggcgtgcttgtggtggtcggccttcatgcggcccaagtgtcagtggaagcttggccagcccatcgagggcccaactaaagcccacactaactcacctggttgttacccttcttgcttcgctgccacaatacaactttgtttacaaataaagtcatgcagaatattgtgtatgatcatcgagcacaatattatcatcaccaactggcgtcatcacaccatt

SEQ ID NO: 73941 - DNA, 12690 bp, Oryza sativa
taaccccaaaagaaaggaaaatagaagtgcatgggaatatccaatagcagaaatctgagcgagatactgatatatgctaattttctcatcaccttcaaggcttcaaacatattacacgcatgtaaattcaaatagaatatgacatccaaatatccagtggtgaaactgtacattagatttccagggaatgaacatcaagttatcaccatttactaagttctgcgctgcgcaaacagcagcagcaaatatatggagcacacatttcagatcaatacactcctaataacttggagataactccctaagtcacttcccctgctagaatattactccctttgtcccaaaatataagcatttttatccatattcttagctaaaagtgcttatattttgtgacggggtagtacattttcattctttgaagtatccctatttccctgacaagtccctattacatgatctaaaatttcagatgtagtagatgaggtgctaactgtgcttccttttctttctgagtccaatcgaggattgagccctgcagctggacaggcgcatgcgcagcccaaagatttaagaaatcagagatcacatctatgcgactctgtgtccaatgatcatgtcgtcgcaatagcttcgctttcttggctcctcgaatggttctctgcctcagcatgttcttggataccttcacagcctgaagatatgcaccaccatgtttggacttccaaaccatctgatacactgttgttcctgcattctgacgaaaacaatctacagcccttggcagcatgatcccttccatttgttccaaggcaatgtttgtgtgcaagcaatgttggtcaacaccattaaccatctctatcacagaactctcgactgctgggaataggtcttctgaagagccatggggcgtatagacaaggtgaactttcagatgcggaaattctttgagagaaggtttgctctcaacaactgtgacctgatcttttaacccaggcagtgaaacttggcactgcaaactcacgtcaataactgattctagagaaatgtctggtaaatatgtcttctccatgttgccactactacataccttctgactacgatgcttgcaacacattgggtttgggcggaaccattcagtaactgtactgtgaatactgtcccaatggtatgaatgagaacgtggcacccatgagaagtcctgtgtaggtagttgactaagttccttcctaacagtttcagttgtagacttgaaatgaggggcaaacaactgcaagcacttaattgcagtaccaactatgtttgtgcactctgaaagttgtagcatcatacctagaaaaaagttattcacaggcacactttcatcattgtaaacaaagatcaacttagcttctactcctcgctctgcggtgttatttggccgtatccaaaacaaatgctgattgtttccttgcactaatttgtactcaagtgtttcgcctgcaagaaggcgcccgataagagggtcaaagaacaagtaacgacgtggtgtccctccaaactccacggatctcagaaagtcattagctccatcagcaaaccattcaaatcttcgaacagcagatctaatcggctcgtcgatattgccgtgaaagatggatgatatcagtgacttggtggcatgggcaactcgcgtaggtaaggaggaattccttacttgttgttcagcctgttcttcttcttggacgcgctgcctacatttgcgcagtgtatcatcacactcttcagcagcacgcttcagcttcttctgccaacgttgcaagggcccaccagtgatctgccacttactggatgtctcaagtgcagtctccaacttgatgtgcgccatctccaacctctccatctgctcctccgcacttgaattttgctcatacttgtcaatcaagccagatatgattttgttcactgtctcatgaacaacggcagaactgactacctctcccatgttccctccctgatcaggacagagcaatatatatatcaatcactacatcattatgcccgatagaatcaaaatacagacaaatggatacctaataagtacttaaaaagagcaatgttgtagtatgtaaaaaggccaaccttctgagttgaatcaataggaagcaatttgtggtcacacaggttcaccgaagagtacccagcagacaataactggattgcaatttgcaggagagcttagtgcgaaagacggaaagactgacaatagtgtaagataacagatatttatgcagggggcagtgaaatgcattaatgcatgattctggtgaggaaaaagtgagtaattcaaagttggtgtaagcgagtcttgtgggatgactatgtcatccaggagaatacatcattctagtgacctagtctagtctctagttgaaactgccgtctcttgattttgactgtccgatcctgggctagctaaagttaaatccttttgtcagttgtctcttgtcagtgaatggccatggcactggcttgcttgtcacctgcttacgtggtggtggtcaaaggggtttattgggccctttgtcagtcaaagcttggctggcctatcgaggcccaagtaaagcacatattaactctccatatgccatatggattttccctttttactactattattatgttaataaccctgacctcctctagtcctatagtaaaatggaagaaaataacttgagatagagaggtgtataatagtacaatatcaagatttcagcagaaaatatactcacctcaccaaactagttgaaaataatgatgtaaacagattgcactgcaagcctgaagaccataaatgtgcgtccagctggaaatggtaagaggagagttcagttcagttgcattcactgttcagttcaattcagctggaactgtgcgtccaaactagttaaaatgtcaattggagggtgaaaaggcattattacctctggtatttctccagatattctgtaactgaaccaacttttgagtaatatatgttcagaccggtgaaattgcctgccacactctgtttcacaggattgcaagtcttcttcctttgcgaaagggtccatcagcatcaattataaaatgaactgtacatactagtgacacaattaactattctgaatcatagactaccaaccggtcatgctttgtaattggaccaagtattgggattcttctgaacacttttaatggcatacctgtcttccatatgcattgaaattgttctatttggcaccttatgttggcttggcatgcccacctccacacagacccaccaacagacacaaaaaatgacttggtctcctccttgctgcattgttctgttttctgtttcagcacatgatgaagtcagaatatattattacatatatgcatgtgttgtcttctctcaattcaaaatctcctaaacatatagagtagtttgaactaccatagagatggtacaaatgtcaaactgacaatttctgtaaaaaaaatgcgtgctggatgcaaacaacccaaacaaaaaaagaagtgcatgggaatgtgaagtacagaaatttgagtgagatatgaaattttttcatcactttcaataacgatacatgcatgcaaattcaaataaaatatgacatatccaaatttccaatgatgaaactgtacattatattaccagagaatgaacatcatgttatcatcatttacaaacataagttttgagttagaccaacagcagcagcatatgtagcacacatttcatatcaatacactcctaatgacttagaaatcaactccgtatgagttacttttctctgctagaatattacatttccattcatttaattatccgtgttttcttgaccagtccctgttacatgatctaaaatttcaggcgcagtagaggaggtgctaattgtgcttccttctctttctgaatccaatcgaggattgagccctgcagctggacaggcgcatgtgcagaccaaaggttgaggaagtcagagattgcatttgtacgatgctgtgttttatgaccctgctgttgcaacagcttcgctttcctagatcctcgaatggttctctgtgtgctccgagtgttcatggttgccttcataacctgaagatatgcaccaccatgtttagacttccaaagcatctgatacaatttcgcttctgcattctcatgaaaacaatctactgcccttggcagcatgatctcttccattagttccaaggcaatgtttgtgtgcaagcaatgttgcttatcaccattaattacctctattacagaactcttgatttctgggagtaggtcttgtgatgagccatggggtgtgtagacaaggtcaactttcatatgcgggcattttttaagagaaggcttgcctttgacaattgttccctgttctctgaactcaggaactgggacatggcactgcaaactcacttcaataactggtcctagagaaacaccctgtacagatggcattcctagattgctactttcacagctgtggttctgaccatgctgcttgcagcataatgggttagggcgaaaccattgggtagtaatgctgtgaatattatcccagtgttttttgtggcatgattcagcatatggcacccaggtgaaatcttgtgaaggtagctgagtaagttcattcctaacagattcagctgtagacatgaaatggggattaaacagctgcaagcacttgattacaatgccaagtatgtccacactctctgaaacttgtagcagcatacacaggaaaaaatcatcctccagtgcactagcatttttactgtcaaagatcagcctagcctctattctattctctgaaatacagaagggccgtatgacaaacaaccggtacttattttcagacactaatttatactctagtgttttgcctgcaagaagttgcctgataagaggatcaaagaacaagtactgatgtggtgttcctccaaactccacaaatctcaaaaactcattagctccatctgcaaaccactcaaatcttcgaacagcagatctacatgagccatcgatattgctgtaaaataaggaggacactaatgacttggtggcatgggctattcgtctaggaatagaggaattccttacttcttgttctgcctcttcttgttccaggatgcgttgccggcatttgcgcagtgtgtcatcgcactcttgagcagcacgcttcagcttcttctgccaacacagtaatgaagaatcagtgattcgccacttacaggatgtctcaagtgcagcctccaacctgatgtgtgccatctcaagcctctccatgttctcctctgcgcttgattttcgctcattccagttcaccaagccatgtatgatttggttgactgcctcatgaacaaccacagaactaacaatctctgccattaggactcgatcacatatcactatgcccaatgtaataaagggacagatcagtgattcctgatctgtaatgaattgctctgattatagtagaactacttcagcctgctgagtttgaattggtagaaaagaacctgggatggaaggtattgccaaagagcacatgaagtggcactgtggcagtataagaatctacccagcaggctgagaccagattgcctgaatggcgagctcacaattctgtaatatatactgatatttggaagggacagaagaaagtgatcagattattgtggaattaatgaaatgttcaagtgggcctcttcggccctccgctgatggctcaaaaaagaagaagaaaaaactattgtggataggaatggattgtgatacccaggacttttgagggttaatgggtcaaaagtggttagcgagtcctgcactcagttggttttgttatattctcaaggagaagaaaatggccaaatggggaccatttgctacaacaatctcttgcgatgaggtgactggtctttgtcatttggttaattcttcaatgacccttgtcaaactctggtcattgtttaatcatttagggagaagaacggaataatatctagtccgatgcctggcatcacgttttcctcgtacacgaaagtgaaatcagtttccctttcataatgggatgtccttttctacagcataaaaccgattagacggtagtatcttatcactattgcagaaaatgtgaaagcaaacgtaagtaacttctaaagttgttgacgatgcaactacctataaagcacatccatggtggaaattaaattgacccctagctaattttactcccttagtatgaacagatggtagaaaaatcaaattgatccctcgctaattttactccctagtgtgaaagatggtagcatcattcgagcaggcggtgaaaaatcttctccatcatctgacgggacgccggcggtaacaacagtaaaccaaccggagatgcgagtgaaccgagcgtgcatacctcgagcgctcgccgcggcggtagtcggtgggtgcgcttgtgcttgcgcctcctcatctccgtcgcgccggggcgcagctagcttccccctccatgctccgcctcctacctccccgtgccgccatgcgcgcggcggctgcggcggcggcgccgccgctcgccgccagcgctctcggtcaccgcggcagtggactgggccgaaagcaacagcttgaaagcctcatttggctaggccgaaatgacagcccgcttacatagattaatacacgtgggtgggccagaattgaggcccatccaaataaggcccaagagataaatattgctcatctatttcagcaatgagatagtaatgccgattttgttatatatttgtcgacgtttttttctaaaaattatattgaaattacaatgaaattttttctgtcaacaaattttgctatatataaattacaatgtaattatattgagattgtactatatttacatttgtcaaacttttagtacaatctcaatgtaatttcattgtaattacatgtaactatcatgtaattttgaaccattcgatttgctttaaaattcgtgtatgaaaaaataactaactgtgacagaaaaaaaataagaactgaacaatagctagcagatgtaaaacatgtacatttgcattgaacatacaggaaattaattaacatagactggcttgtcaagagtcaagactaagatgggccttggctaaacctaaacacactggctcgtactagtacaatattatacatcttttaatttgaaggggaacatcttcagtaagcatatacataatacatgattaaactgtccgcccctaccaaaacttacactagttatgtcttgtctttgatactctcctggccttggatctgcaactagaattggttttgcagctccggatgcgcggcttcatcagacaaaggtatccataaccatgaactgaatgaaaagacagtgaataaaaccccaagtcaggttgacagacgaagcaatccattaccttgggcactaacactgccatctcctgcatttcgtgcagactagcatacatacacttatcagttgctccccgactactgtaactcccccgattggcttcagggtgcgagaaatgaggcgaaatattgatcaccatcttcaggatagaccaatccctcacaatattgcttgagttgtacaagtaattgtactcaacagccgaaatgtagctgctgcagcgcacatagataacttgttctggaatatcatatggtaaattgggcgagatggtgttgtcagcacaaggatcgagcctcttttctctgcaacaaaatggatcagggcgagcaactgtagctcgaaaggcaagaaagctccgatggtagtccacggcctgaagtgctagcagtggttcgaggtcttgaggatgtgagtgttgtagagcagcaagttgaccaattgcatctttagccaaacgcgtgaaatgaggcccaagtaactgcaagcaattgatgataatcctaactatgtccgtgctctctgagagtcgtagtatcagcaacagacaaaaatttttcagtggcattctgctatcctccttatttaactgtatcaatgcctctacgccacgcccttcaagagatacaggtactattgtaataccaagggttttgcttccttgcaatggcatgtcatacttgagatgtttcccttctagaagtggtctgatgagagagctaaaaaagttgtagtgccaaagtgtacggccagtctccacatccctcgcaaacttaccagccttctttgcaaaccattcgaatctgcgaacatgggagcaactcaaaagatattgcttgttcatgccaaggaaagacaagacatatgatttcatggcttttacggcttggacaaactgcttgggaaaatagctgtgtgttaccccttgctcttcagcaacttccaaaatccgcaccttgcatttctccaccacttcactgcactcctcataggcacgtttgaacatcctcctctgacgaagcaaggaaacatctgtgatgggtagctttgaagatctctctagggcgtgctccaattgagcgtgtgccatctccaacttctccaagttgtgcctctcggacaccttctcccggttgctggacaagtaggagacggctccgcccaaaacctcttggacaacagttgaggccaccatttctgccatgaggactgtttctacagaaaaaaaaaagaaaaaagggagcattttgacagaagacataaagtgaaagtgattaggttgcagagagagctcgaaatggggcaccatattcgcttaagggacgtagaaattatcacattaattgaagaaaaaaaaagtaaagatattggccatttgatcgtgataggtccaaattataatgatatagattgatcgatatagttgtatataaaaaatacagccatgtctatataaatagtagaaagtaagagttgtctatcaagtatcaaatccaattctaatgttagaatctgttatatacaaattacaattgaatctaagaaacttaagctaagaattgttactaaacctgatcctacttttgaaatctaggtctgctcaaaattgcgcagggaaatcctctaaattatgttacatacatacatacatacatacacacatacaatatgtgcgcgcgtgtgtgtgaagctgtttttaagaagttaaggacaaagtgatttatatttaaaaattataagatttaaaaggaaaccaatttcgggctctcaatttagtggtatcctattaatttaatgaaattaaaaattgacaattagcaaattgtaattgatgtctattcttctttcaatctaagcttataattcactcccactagacggatgaatggatagaaggtgagtgagaaaggaggaactattactagatatgtagtggcagcaatttattcactgcttttcctattaagatattttcttgaagtacccagttagtataagtataggtagatggtatgcataataaaattctcacctttgcctcttaggctcttactaaagaaccgagatactagccactgatcccaactctgagaagatttggaagctggccaggtcacatgcagagaattggcctagtggcgtactggtgttattgatttgtattgatggacctggacaaaccatgcatgtaggacagtaggagtaagcagctgtcttacaaatgaactaactgtctatatatgaagaagtagagcagattgagattattgtaatattactaaaccttaataatataatgagtattcaaaaaagtaatattactgaagttgaacatatgaaagacagaaagagacatgaaaagtttccacgaaggaggaggaaagttcctaattaagatgtcacattcacccgcaaaaccgtaggaagttgcaaacgagggtagatttacattagcatgggtttgtctaatctgtgtttatctacttaagcgcgtcatttagccaaaaattctgtaatcaactatgccatttccgcatttcgtttccaagataggagtaatcaatacttgaatcgttctcccaaaaagaaaataaaacaatccaatccttatcatgctcgctggcggaggctactcagtcatcgacaacaaatcttgaattcttaagatcatcacccaccctaccacttcttttatctggtgtttgttgttacctaatgatgatgggatcatgtgacagaaggtgccttagttccctgcaatttacgatcatatagataaataggataagaccctatagataaatgatctcaattaacgcgaaactacgctataatcgcatcgatgaaaaccaaagtggaaactaacacgcgcttatattaatttattagacccaaaactcagtggaaattataggagactactagaatgaatcaagcggaaaatgaaattgagaaatagtagttggtgcatgtacttgacgcgcggtggcaggtgaagcctccttcatcctcttcaccctttgcctccgcggcttctccggccgccggaggaccgcctcgcctcgccggacccgtaccccgtcgtggtcgacggcgccaccgccgccgccgccttcctcatcgccgttcctctctctctccggttcttccccttgtgactcttacggcctataatactatgggctttatctaatgtagtgtaatgatgggccgggcccattagcgcaatgggccaataaatttaccaacctcgaatgaatttccgagaatttcaggcaaaaatcaaaaacttttctccgaatttgaaatcccaattcgaatccaccggaaggggagaggcggcgcgacgcgaatggcgcggcggcggcgggagaggcggcagctcgctcgcctctgcgacctcgtcgcctgcgcactcctcccccacctcgtaagcagctctctgcactggcctctgatgactctggtctcctagtcctagcctatcactccgtgcgcgccgctcacaggaacccaagccgccggccacgcggctcacacgggaggacgagcggcggatcctcctcgcgctctcccgagtaatcctctcactagggttcgcgattgttactgctgcgctctattgcccttcccttccgtgatttttttgggatttttttaggtaagtaaggcgattcgaggatgggaagaggaagaggaggaagaggaggaggaggacgacgacgaagggtgcgaattggatcaggtattgcctccgatagcctttttttggtcagtttgattgttgaactgctgtaggtttagtcgaaattatgcgactgactgagcatttgctttatattggggttgaggaattagaacgtaatgataaaatctattattagcacatggctttaaccctgtagtgtaaggtatcatcacggagcagagagggagtggtttgggattgtgatgatgatgtagaatggcttgtgaaatgtctttatggcatcaaattacttagttcatgtagtaactgatttctgttttgtgagggaatttgtttgattctgtcactcaggttccaagtattacattcatttgtttcttaccctttttctttaggagattatttcatgttccgcggaagttcacagttgcagtttaccagctaaccagcattttgatgatggatttagctgcctggccaatattatctccatattggtaagaatatttcatatacagctttgttgcgtcagccatcaactttccaatcatagtcagcgggatcctcatatggtcccagttcctcataaccacctgttacagtattaaatatgaagtgcacaatattacccttcgtccctgccattgagcaatggctctttagactaaatacatctggcactttttatgctactatgaaccaataagtaattgttggggtctttgggaagcgaagggttctgggtgctagtgcctgactgcctgagtcattcattgtttatatagcaacacaaagacaatgagcaacactggattagtcttcattttcattaaccttaatcttttacatttgttcaggcatattggcatcaggatatataagtagggcataggcgttatcccgatcacctgtgggtctctatcaacaactttgaatcatgtcatttgatccgtaagtagtgttaatgtgtcatccactcttaccaatagaaaagggaggcatgaaaaaataacaacaaaattaaccagaggaagttgttgaaactgtggctccacaaaaattttaaactacgtatactgcttcagaattagatattattgacaattgtggtgactgtatactgttttattacatttcgtaccctcatgctttttttcttcaacagcttactttgttagtatatgacatcatccttttcaggttggcttctttggtttctgtagcagttatgttaaacactcagctgggaatatcctgattgtcatctctgactctctaatgaagtttgtaagcttctcatgctttctcattttcaatctgatccacacttctctctcaaaaatatttattattccatggttgttgctctattttaggaggttgtttggattcaatttgttgagctggtctggatagctatacatacagtatcaacatgcgctcatagtgctttaccttctttaattgactccatcagcagtttcagaaaagactcgatttgggctgcaggaa

SEQ ID NO: 73942 - DNA, 14768 bp, Oryza sativa
ggttgcaaaccccacaactggcacctatatttgttataggtgtcggtttacaaccgacaccgataacggaactcatatgtgctatcctcatggtagtagtgtgagtcgacatatcttgagattgacgaagtcaccacagacaccgggctgtcaatgggtatgtcgcctatcactgaaagaataattagccgtaaatgtgagcacccgtgtcaaatctaggatttgaatctgagtgggatagattcacacttccaccacaaggaacggttgagctacgctcacttcgcatgagacaaccttttaaatttcatcaaattattgacacagattgtatatttgattaacattataaactaatattttaaaaattaaattttgcaaatagcttagaatatgtggtctaatcaatcagtaaaaagaatgttcttctaagaatcctatctttggaactatggacgaaataatccgtgttaaaaatttacgattttgttatatatttgtcaacaatttttttctaaaaagttaacaaacgtaaatatagtacaatcacaatgtaattacattgtaacttgcatgtaactacaatgcaattttgagccgttcagtttgctttaaaatccatgcagggaggtagaaaatgatgacaaccttggtaccattataccttcattttatgaaaaatagcatgttacctagcgatttttaaaagttacatataagttatactacaattacttacaacatacaatgtattacatcatgattctactatatttatatctttcaaataatttagttaaaatttgactataaatgtatagctagtctaagatatttttcacaaataacccttgtgaaaatatatattacaaatacacccctagtgagaaaaatattcccttaagaatagaaatggagctttctaataggtagaaggtctattttcagaagaagaaaaaaaatcagaggttcattgtttgctaaaaatggttttaaaaataggaaatttgtgaataaaactacacgttaccattgatcatttttttttcgaacggtcaggccgttgccgacattttatataaagaagaaggtgtctcattttaaggagaaaacgagaccaaaccttacaatgcgtagttaattagggaaaactgggcgaaaaccacaacactcaaacctaagctaccaacaccgcgaaaaaagaaaaaatggcggagcccaaaacaaccatcgataaagaacttgttgaaagcgacacaaaggcttcgacttctcggggcaagtgttatcgttgctgagcttgttgcctagcgatacaacagcttcgactccacagctatcacatcatcgttgccaaaggcatcacagaaaacgagcaagacaccgaatgaccactttgaacatcagcccaagccacttgagcactactacttgtacacagctaacaccaacctccctcgaaaactacaacgtgttatcgttgccaagcttcatcgcatcccaataaagcagctccgacttcacctagaagaaaacgaagaaagttggacgcttgccacatccaagagcagcacccaggagacgaaggcctcgccaaatagctaggcttatagagcttcgacatgggggatccacgaatgaccatccttgcatggaaaaggttcttggtagcgagagagacgccataacgacgcctccaaggaggggaacgacgcttaatggcgtcgccgtcgtcaagccaaccaaaggctagccaaggctttcgccagcgtcatccaaaaccacacaacccacccgcataacgtacatcgctggaccgccacatcatccctctagccaccaagcctagcccaccacccacaacataggtaggctcgcgagtccgccgtggcaccaacctgtcagcatcctctactgcactgacaagatctggccaaggcggccatggatccggccgtcgaagctcggcaggccaacgtcactgcgagcgcccacactccactgcaccgtcgccaccgcaaccgccggtgggcgcagccggtggctgccactgtctccgcgccgacaagggcctgccgcaaccaccccctccgtcacacgcgccagactccctccgtggccagcctcccgtagctgtccccgcgccagcgaggccacgccggcccccacctcacccttggcagctcgttgtcatcacaggcggcggatctggcaaaggggcgccagaaccggccgtccatcaccgggccgagggccaccgtcgccacggccttcccggccggatcccggcgcttggggcggatccacggccgccctcgcaggggtgcgccgcttctgccctcgccgagccaacacgccgccccatgcctcctccggtcgccgtcgccacaagctccactgccatcggggaggccagatcggccgccagagggggcggatccgactccgccgtgcccggagccgccaagccgtccgccgtcttgccgccgctgagcagcccctcggtgtcccgccgctgggcttctcgtggggagagcgccccgccgccgccgtccttgcagccgtccggctttgctgacgagccactcaggcggcggcaaggcgaagggggggagggtggggaggggcggcggcgaggttgctgtcgccgtccgtgtcgcccctgggacgggagcgacgcggacgaggacacagtctcaccttctgaaattactgttgatcaatttttagagcaaaaatatctgcttggtccactcctcttcttggtccactcctcttcacagttcacagtacacaccccatgtaccttatcgctgatcgtcagcgtcccgtgacgaaaattagaggaccacattttagaagcacatacgcatcatattcatgtcacctttccttttcctctggtgatgctggactgctgcggtctctgcagctgcaactagcaagtgctacgtcccaatcatctctttgtgaccatgctactacgcccgtacatttaaccagaagaagaaaccaattgtaagacaaatcttgaggatcaatctatcatcttatactaattacagtacattagttataatttttttcgctaggagcctaggattattgggaattagtgaaattaaacagctaggataggtgggatgtttgtgagaaagaaggtgaaaaaaattaaagagatcattggttgagatgattttttttttttgataaagaaggaaaacggatgaatgagtagttggtgtattctcagataaattttaaacgatagaagttgttttttttaagacggaagaagtacaagtatcattggaccatttggacggtagaaaaggagaattaggttcctttcgcagttgctttttttaaattcacagttgctttttgacgggttaggaatttcgccacattgatcacgagttcacgacaacaaggaaaacggatcacaaatgtaatcgtgttgtgaacaatagtactccacatgtttgtgagccacgcccttgtttggataagaagacttacctgcaatccatttagaatgcgatgaaaattaaataatggatcaaacggactgatctgaaggttttttttttgtccttttgccaaacaacccctaaataaacggatgatcccgaccattgcacctccgtatcagaaagtaatactccgtaaaacagatgaagaaatttacacctcttctctgttgtgtgttagggtgcattcgagttaggctaatttatttcacgtaaaatgagacatgtcattatcaaatgattaattaagtatattacctattacgctccccgttcatgtttgatcatcgcatttgttcatggcagcaaaaccaagaaggagaagaaaagacgtcatagggtctgtttgggggagcttctaactgctacaacttctcccagaaccagaagctccctaaatagtctagcttttggtccagattttgagaagctgtagttataaaatccagaaaatgaactagaagccagaagctggaaacccagcttttccagattctcagaagctggttaccaaccagctgcttctcgaaatcttaagctctcctaaacaggacaatagtctattttctgcaatcgttcctttcccgggcttttcggcatgtactactccgtccaataaaaacccctatcaggctagtcccaacccaaaacactagatatatagtttccataaactccacatcatcaagaaactaggactagacactactctttcaatgcaaacactactcttccatacttaaatttaatggtacttatctcacatgatgtcttagatgttgtgtagaaactgttgtgaaacaaatctctaggagataagttttttgtgggccaatccgaaccggagtagagataagatctatctcctcctaagacccctatatatacagaggcagggtgtgacatctatggctaatggctggcttttactacagatgagatctataatgaagagagagctccaccctacatctgtgttcattgtctacttctgcaatgttcttgagggtaaagggatgggagcgggtgttctacatcatctcacgcctctactgctgtgggagggacagggaatggatccggtgatctgctaataggcgcgttggtttacaacacgttatcagcagctctgccatcaccggcttgccgttccaatctaattgtcgttattagattgttaatcacagattgatcttttgtgtttttcctgtatgattgcatgtagcgcagccgatagtggagccgccgccgtgcttgtgttggccatcgtccgttgggtcgacaccgacgccagcaagcgtacgtgcatcaggaaagccgatgctgaacggctgtgtcgcacctcgcacgcaggcatggagtccaaccaccttcgtgcgatccaagctgcacttgcacgagcggcctcacacgtttgtgtggctccttgccgaatgttctgctaaacaaaggtattggcaaaatagcatgaaattaaatatgcatttaacgtatttgggaaatccataaggaggtcttgaatagactccgtcgtgaaattgcagcatgcaaatctcgtaccaataggtattccggtaagagtaccatctcccgttgggagaaaatctcattgacggaattttctctgagggtgagacctcattgatgaattttcctctgagatacaaaaattagtaagtctgaacacatcaaaaattgtgtaatcccttggagggatgatgacccatttgtgacccgataagattacaatgagaaatctgatgagatcaaacagacggggtctgtaggcacatgtgcttctcacgattatcactggagtatgtacactcgtgatatctgttctacccgatggtatgaatggtggtgtcctctaatacctgctaaggtatacttggtgttattggctgtgtgttatcccccacagtgcttgagtttttcagactagctagttactctaatcgttacaacatgtctttggaagacttgttgatgaggacatcccttccaacgatacaaccacgcctattgcacagcaaggaccagtgactagagctcgagctcgtgaacttaattatcaggtaaagtcattcctagctaatcatacaagttcttctcagaattgggtgctactaagttattgttgtgatctacttgttgttaggaatatgggagaggaaccagatcgcaagcagcactagcagcgctgatttgatgaagtcaatgctcttctctccggagggcaaatggggaaaatgagtacttgttggaaagatctcgtcctctactttcagctatgtgtggtctcaccatcagatttgacccaggctggtcagaatgacgaaaatagtttttcacattagaaacttgggcttgggccttgtatctttaaagcccattagaggtccacaaaacctagggtttgctcccacctcctctcctggtcattcctccacctatataaactcctagcagccaccattttgcattttgggttttgtttggatgtaagtttagctgcagctacttccttgtactcgcgtgtgtcggctagaccacccggatgcttgtattcagaacaccactttggtttgtttcaatttcatcatttgacaagtactatgagctgtttccttgtcaacttgtttttgcttgtttttcgattgcttgcaggttcaaggttgttcttggcacgacaagaacagcaacaacgtggagtcggtgtaccggttgctaaggcgcagcacccctgtggtagttgtagtcggaccgccaacgttgtgtcctctcccaaatcgaagtttatcctcctctcatcaaaagatcgggaacccccgttgctgcatcacttgtggttgatcttatggatccccaatttttgttgatactgtcagagagagttgcaataatcaaggcttagttcttgatggggtcatgcccaggaggtgcgtgccgttgtgaattatttatcccctaatcctttggaaggatgaaacagattgtgttgcacaacagtatggtattgtggtacatgatagtgatggaatgcattactctctatgttccctattcttactttaatggtgaaatgagataagtcttttaagactaatggtttgaggatctgaaggattcttgcctacgcatacatctgagagatgtttaatgctatgggaacatgacatgtgacaatagttgttgtcagggggagtatgtgctatgtgttgattgtcatttgcaagacattgaaatgtcttaagagtatgcccggggcattgactcgatgatgatcacttagacctatttctaaggtcctatcataagaagatttgtctttattgactgacaccaaatacaagtgggctacctcacagactcttgaggcaaggtgaggtgagtagcaattcaagttgagtgataatctagttgattgatcacctagtttctcccaactgttagttctcggaagctgtccggagaattgggatgagaagacttgaggcttgctaagttcagggggagagcacccgagaacatgacccacaatatggaccggttagtccatagtgttgtactccttttcccttgggtgagtggagctgttgttcctcacataaggtttttaacgaggcaacaacgtgcaatgcatgagcgataactatgtactctttctcctagcctttttcccattgggttttggtaggagtgttgatgaggcatgagttggtcgcggattagtccaagggggagtgttgtaaaataaatctctaagagataagtttcttgtgggccaatccgaaccggagtagagataagatctatctcctcctaagatccctatatatacaggggcagggtgtgacatctatggctaatggctagcttatactccagatgagatctataatgaagagagagctccaccctacatctatgttcattgtatacttttacaatgttcttgagggtaaagggatgggcgcgggtgttctacatcatctcacacctctactgctgtgggagggacagggaacggatccggtgatccgctaataagcgcgttggtttataacagaaaccatgtctcatgcaagacctgatttccttctcttttctcatttattcacttgccacatcatttttcatcctaggtggcaatttatttatggtaaattggaaccatgccattataattttgcagagtttgagatatgcccccggtatatcaataacatgtaggacccacatgagtcaatggcatgtgggtcaggatggcatatcccaaattttgcaaaattataatggcatggttctaattttcctatttattttaagagagaatcccttatatactactctaaattaaccggctcccttatatgccactttaaattggcttctcccttttatgccaccggttcaagtttctcctcccttttatgccattgccgtcagtccaccgtcagttgaccgttaactttattgtaaaaagacgtatttgccctttagaattagtatacaaccaataataggtattttagtactaatatagctattggatataacatatgaaaattgattttttctgcatcacatgcaattttagccatcaccatcacaaataaattttcaatgtaagcatgaaacatgcaattttccaacaatatttttaatataaagagcatttttcactggttctgacaaaattttgttcactcaaaaaggatttaaaataaattagttatgattttttgaagtttacacattttttagttgagagggcatattggtcatttaagaaaaaaactaacctttgactaacagtcaactaacactatagtggtgggagtggcataaaagggtggaaaaacttgaactagtggcacataaggaagaagctaattttgagtggcatataagggaactggtcaaattctagtggcatataagggattctctcttattttaatgctatagacaccattctagtcattgggttaaaaaatggcctcatagttacaaatctgggcacacatgtgtctagatttatgattaggattgatttttttttgacggagcgggtatgtgatttttatgcaacggattggtcaaagccttcgcatgccaatagaatagctagcgcatccttgcatgtgaagcaataaaggccgagtttagttctaaactttttcttcaaacttccaacttttccatcacatcaaaactttcctacacatataaatttccaacttttctatcacatcgttccaattttaaacaaacttctaattttggcgtgaactaaacacacccaaatccgcattgccgaaatctgcatacaaaactagacgcgacaggtaaataggctgatcaattttgaatgttttgtttttttaacgctatgatcaaacatgaacagagagagtgttgatggtcgttatcgatcagtttcgaccgtcaatattaccaaaatagaggagaactagtaatgattgcaatgcatacatatgttagaataataatatttcactagtattaggtatactaacctcttgcagggaatgatactaaagtggaggagaatcgacatcaacatagacgataaatcaatcagacgatgtcgataatcagacttatgaatgaaagggccaagaacgcagaattgacacgatgaattaggacaaaattcacaagtctacgaagtgaagcaacggaggaggccaccagccgaaattgggctagattgggccggccccaggttcggccgaacctccctcgcctccgttggatccaggttttggctggacggttgatataaagccccaatgacggttggagggtattaccgaccattccaaccgtcacaatcgtcatagttcagctataaaaggacttcaccttctcatttcactcacacaactcaagcaatagctctctcatttctctcaagtttagtttagtagtatctagctggtggaataggaatagagtagaaatcaggagtccgaaagccgtcggaagagttcgggtatggctctagcagctttcttttcctcttttgtaagctttgtacttttattagaatactcttctaaatacatttatggtattggaatactttctaagtatatgagtacctactttatattatgttcatgttatattgaatatacggctagcttatctgggagatgctttggtgcgagtatagtgtttgcttatgcaattactctatgtcatgacgatgatattagagtagtatctggtagtttagacgtggtgtctagattacgggatatcattatttggggttatatattgcggatgagaggtgggtcacttttggtgacagctcagtacgggtattcctccgcgccggtatataatcctaagttaattccctggggagggtattcctccgtatttagccctggtcgtatggtcatgacggactgtcgtaaggaactcggcagtcaggggtggcttctcgaagtaccaggagggcatcggatagagggtattagctagtatatcagttaactagaatgtatgtatactatgtatattagaagtataggattagattttctttctcttttcttttccacttagctcagataatatattatgagaatgagtagtaatgcttgtgtgtcactctacccttagattatcttaacccctgcttaggatataattatcacatgtaatatataaattattagttgatttctctctacatgatcttccacgggataaaataaatacgatacccttggaatactctcgggtgaaatgctacaatggtatatccgtgcgcttgcagatgaactctgtaaccataatataccaggagtatttctatgccatttctagggattatatttctagtaatgtcgttaagaaataccaacagggagtataatcttgaaaactgaatttatttgatttatttaaaacattttatatataatgtttttgcacgaaacacatcgtctaggaatttaggaagcatgcccttataaaaactgaggaaatagaatagctactaagtagctgaatcaaactcagcctcaatgtcagtaaggcaattgctctgacaccctacaaattgttgttttagaaggtagaagaaaaatatgcatgtaaaatatagagagttggattggcatctgtataccaatataacataaaaaaaatggactagttttactaaaactggccatctatcatgcaaaccgtcaagtcatccattgtattagacgatgaatgcacatatttaaggccctatttagatcacacctcaaaatttttcaccctatcacatcgaacatttgaacacctatatatattattaaattttaggcttaaaaaataactaattgcacagattacgactaatttgtgagacgaatcttttaagcctaattgctccatgatttaataatgtggtgctaaaataaacatttgctaatgacggattaattaggtttaataaattcgtctcgtgatttactgacggattctgtaataagttttttttggtagtgtccgaacaccccattcgacaccctatataatacccgatatgacacgctaaaactttacacccctggatctaattaaacaccccctaagtataaatattgtgttgatgtagtaagcccacgtattctttgctaatagtataaataacatgcatcttttaatagttaattggctaaatagttaaatgattttgtgataactatccatagtacaatgaagcgaattaactcagagtaaatttcataaaccacgttttatagtcaaagtttcgtaaaaccacgggtattataatttttggcacataactacaagttttatgatgtaaatgttttataaagctccacttttattaaaatttcaaattttcaattaattttagtatatctaaaatattttttttaaatagcgaagagttaaaccgataatcaataactaaaagtttcatatacattctatgctttaaaattttaaataaatatttatcaaatatatataggagtctggctttgtgaaactttaaaaccataatagttgagattatgtgtcatcggtcataatgtgtggtgttttatactactttaaccataaaacgtgagatttgctgatttttttctcattagcttattatgaaatcgaaaaataaattaaaatattattttaaaaaataatatatatttttattaaaaaatcgtttataagcttggaatgcatgccggtgaattaaacagtcattataaaaaaaagcacacccgagtgtgttctatgtataaatgggggatgggatacatagctcacggtcttgtcaggtttttctagtttcgatagattccatgctgattgttgcagctgctgactggattctttctcttaccctgcctatcacattatccaaatccatcgattctgctagctactgggagaagtcccacagggttagttgcatcatcacgtcaagcatagcagataaacaatggtatgatattggatttatccctctgatgattttatatctgcaaattaagaggtcgtttgagtaacctcatggctcacctttgtgtgcacctttctaaaatctcccattttccatcgttcttttgatgttgcaattgtctttcgtttcgggttatgcgtacatgtgcacggttggtaagaaacaattcggaatgagcacaaagaaaagggaataaggccatagctagctaaatagaaaaattggcatgattgtatgaattaaagacgtacacacaccatcatgtacgcatatgtaattaagtacacgtatataagtacggctccttaacacagaccgaaatgggggcataaatcaaagacaatgaaattcgatggtgaaagccatatctgattaatgagagaacagattcgccatggccacaagcacgcattagtaacagggaacaatttggttccagaagatcatcatttcgtccaccttttcagaatccatttgccgactcaaattgccaagcttaattaattatgccaaagaatcatcgcactataccattaccatcaatcatgcaagggagagagaagaggtggaatcgagcgcaacaatatagtacgatatgctacatgcggccgcatctgtcaaactgtcaatgtgtcattatattgtgtgtgggcttgaagcaggaaagctaccgaagcactgcacagagtcacacaccgtcgatccagtggagactcagaagagcgagacacacgatccacggcttaaatcttatcttagctaaagctacgctttggtaacagctgaggctactccgaaatctgaagaatctgcactgcagcagtgcattgcatatgcttggccatggagatggccagggccagggccaggcagcccgacagattaacagcacgggggggccgggccatacgtactgcgtactctgaatttcacgaaaaagcaagcaacagacagcacaaaagtcccaaagttagggaagaaaacaaatccatgtgaccatgcggtttccgctctcttttatctccctttcccttggtttaattacccgtaagccatcgcttaaccacacaaacaacaatacttcgtctcacatttctctctttcttttatattgattttcttgctctttccgggcttaattaagcttgcacgcaccaaccgtccctctttcgctcacactcttccttccactctcccaatactcactcactctctctaagtttttgtgtataaatatgtacacgtcgttgtagtggctctgtgctcgctagcttcgtcatctaccactgcaatttacacgacggccatgatgaggctgctgctggtggcggtggcggtggcgatggcggcggtggttgtggcggcggaggagagggcgacgtacatcgtccacatggcgaagtcggcgatgccggcggagtacggggacgaccacggcgagtggtacggcgcgtcgctgcgctccgtgtccggcgccgggaagatgctgtacgcgtacgacaccgtgctccacggcttctccgcgcggctcaccgcgcgggaggcgcgcgacatggcggccatggacggggtgctcgccgtcaacccggaggcgaggtacgagctgcacaccacgcggacgccggagttcctggggatcgccgggaacgacgggctgttcccgcagtccggcacggcgggggacgtcgtcgtcggggtgctcgacaccggggtgtggccggagagcaggagctacgacgacgcgggcctcggcgaggtgccgtcgtggtggaagggggagtgcatggccgggacggggttcaactcctccgcctgcaaccggaagctcgtcggcgcgcggttcttcaaccgtgggtacgaggcggcgatggggcccatggacaccaccagggagtcgcgctccccgcgcgacgacgacggacacggcacgcacacgtcgtccacggccgccggcgccgccgtctccggcgccagcctgctggggttcgcgtccggcacggcgcgcggcatggcgcccagggcgcgcgtcgccgtgtacaaggtgtgctggctcggcggctgcttcagctccgacatcctcgccgggatggacgccgccgtcgccgacgggtgcggcgtgctctcgctctcgctcggtggcggcgccgccgactacgcgcgcgacagcgtcgcgatcggcgcgttcgcggcgatggagcagaacgtcctggtgtcctgctccgcggggaacgccgggcccggcacgtccacgctgtcgaacgtggcgccatggatcaccaccgtgggcgcggggacgctcgaccgcgacttcccggcgtacgtctcgcttggcaacggcaagaactacaccggcgtctccctctacgccgggaaggccctcccctccaccccgctccccatcgtctacgccgccaacgcctccaactccacggcgggcaacctctgcatgccagggacgctcacgccggagaaggtggccggcaagatcgtcgtctgcgaccgcggcgtcagcgcgcgggtccagaagggcttcgtcgtgcgcgacgccggcggcgcgggcatggtgctctccaacaccgccaccaacggcgaggagctcgtcgccgacgcgcacctcctccccgccgcgggcgtgggcgcgaaggaaggcgccgcaataaaggcgtacgtggcctccgacccgagccccacggccacca

SEQ ID NO: 73943 - DNA, 1126 bp, Oryza sativa
tctatgtatcttttgaaagatttttataatcatatcacacagatttttaatccttagattaaaatccaatagacacagtaaaaatgcaaaaaacaactaagaaacaccataatggatactatattaccatatcttcagaaaaaaaaagaccaaatccaatataaatttcaaaacttatatgcgaagattcaaaaattacactgtaacttacaaaagttaccgtgcaaatttcataaattatattgtaacttacaagaaaacacactgtaaatttgagtgagaaaatcgagtgagagataagaaaaaatctttcgagtgagatatagcaaaatcgatgttttaatatcaaatccaacattgtcagtagagaagtagagggaatagaaatacaggcaaaaacgctacgatttcatagaaacccttgtcttgttggtggattggagtcgtctgcattttcgttctcgcgttggtgaagtcgtctcgtctgcattttcattttgcacaggcacacagcaccaactgaaccagctgcagagaggagcaacacgagacaatggcaatttgcaaagctgctactgctcctctcctctgccaagaaagcccaaattttgccagccggtcgccacgtggacaagttaatctgcctccaatgcaatgtactactgcaacagtatacacgtcgtcctgtttggtcggtcacatcacaacctgatctcgattactcgtactactcagctcacgtgttgttctaccgatttgtagtatgctaaaggggtgtctacgtgtaaaattttagtgttacatcaattattatatatggtgtcatatagggtgtttagatactaataaaaaactaattatagtatccactagtaaactgcgagaccagtttattaatcctaattaatccgtcattaccatagtttactgtagcactacattatcaaatcatggagcaattatgcttaaaagattcgtctcgccaagtagtcccaatctatgcaattagttctttctaagcctatatttaatacttcatgtaggtgtttaaatgtttgatgtgacagggcgtaaaattttagggttggatcaacatgccctaaggtctcctttgaatcgcaaaaag

SEQ ID NO: 73944 - DNA, 2447 bp, Oryza sativa
gtaattttgcatgaagtttcaagcaaggttttgcatgatatctaagataactattttttccgcaaattgtgcaatgtgcctttttttttccatgggctcacttcacattctattttcagttgccaacagatgttacaaatttacaaaacaggaaataagaaaaagcaaaagataactccattgagaaagcaacatcaatgtgatcatgggagggagtcgtagatgcataactctattcactgggattcaaatattaatgttatcatttatttttgcagaggccaaaggtaagcatctttttggtttgttgctgcccaaaccaaccctaccaaacttggtaatacccaagtataaattttgttattaccaaaatttgataatattgattatgtttgattggtaggctttaccaaaatatgatagagattttaagagcgaaaaccttcgggacggccaacttttagtaagatagaaatgacaagaacatgtttgatttgttgcattatcaaatcttggtaataccaaaatgctaataccaaaatttggtacaggaacagaatggtcatgaaagttgcaacaatccaaacatgccctatttcttctattatctttgaagggcatttacaatataaaatgagtggtttcatgtttcaacattagatccgagctaccactatcagttgggagagtgatcctgttgagggtgcgcgcaccctattaaatgccttgaaaagtagactattgtgctgagaaatattaaactctctccattttataatatatgacgtcgttgatttttaatgtgacgtttgattatatgttctgtttaaaaagtttatataaatgctatttaattttttatgttttattttatcatataaaactctgacctttacttatatttttaaaaatttacgctaaatttttaataagacgaatagacaaacattatacgaacaaccaacaatgttatatatataaaaagcggaggtagtatttgaaaagagaggaagtatcacacaacataagacccctttctacataaaattctccaacaaaacaactctccattgcttgctccaagaatcaatgcattatgcatgccacacctgcatccctgcaattgtttacaggtgcaacgcaatgcaaggcaccgaaacaaacaaacaaacgaacccagagctagcgatgagtactctgatcccaactcacaagaaaggaagagaaaggcagctttcttgagccaacaacccgtcgtccgttggcatgccaacaaccaccaactcgggagccggcctcgcccgcgcgcaagaagaagaagaggaggaaatcatcaaagccaaagcaatgcaaagcaaagcaaagcatattttggtttggttgtcacctttgcttgcttgcttggccactgtaaccttttcagtgctctgctgcctctgcctctgcctggcctgcagtttttctgcactgcatatttgcatttgcatttgcatttgcccctgaatcctgatgaccctgacgacacacggatagacagacagggcaaccacaacagcaatgtgctcgcggcccaacgcaggcaggcacagaggccatgagagagagtagaaaggaatactagccgaataggaatagtagagtactacaggtctacagcagcggccaaaagagcaggatcctgcaaatcttctccgctgcacgcctaattatccccatcaccatctcattctcacccacctatggccttgtcgcttgctgttctgcctccataatcatcatcatcttcttgctaatactactctattactagctgatgagcttgttaatggcactttaattagtctaaagcaaaaccaccacattattagagcaagtttaatagtataacccactacttagtctaattcatctatagccgatctaatagtcaattcatacaatagttgcttactatactattaatatatggtcccacctatcatacatatattgtgtcttggagtccgtgctgcagctggctacagatctgtagcccactgcttttctttctcatttttatctcattaaaatatatttatagctagcttatgctattttaactgctccatctgccaccttttgagtgagaggaatatagagaaagagagagagagagaatgcagtaggcagcagaagcaaacacgaatctctctctatcagggcatgataggaggagtagcaggataggatgtcatgggcggcatctcagctcagctcaggctcagctagacgctactcgcatcggagcatcacattgccgtgtgccgttgctcgcattgcagctgcagctactactaccattcccacaccttttctagctctctgttccacacctctccctcttgcattgcagccaagacagcaaccagcagcagcagcagctcagctagctagtttctgctttcttg

SEQ ID NO: 73945 - DNA, 2242 bp, Oryza sativa
cactattttaaagttccttaaacacactgataatgaactgaaagaggacttcatttgtatatctgctcatcatattcttatggttgattgggatttgtattatcaactcaatgttggagaacctctaaaccttgtcaaggatagcacatttagcttgagtgatgatttgaaacagttaggatttctttcaagcagtctcctccaactattgtgctctttacttgagcaaagtgacctggaagacaacaatggacaagatatctatgctaagcttgtaggtgtaattcctaagttagtggctatattaccagagcatcaggatgcccccaaaagtctctctcagtacttaaagcacaaatttctggtaatttcagacatgcaaagattttctattactgcactgacatttttgttgcttttcattttttacgaataagaattgtaaaacagtttttgattaatcaggtgcatataaagttcttctatgaaattaaacattttgtttttggaccatcatcagtctgctatttatttttcaatgcagatgataatgatgcggctaaagccttacatccagaaggattgctcatatattgtttgctgcctgaaattacttcgacaacatttccaggatcttcttcatgaacctataatgcaacatattgctaaaccagaaaactgtttggaaggatccccatttttgttgagcactgtaggtctgggtgagactcatgataaatccactaggcacttacaaagacaggctatgtatttgtttcttagcttttgcatatgtttggctcacaatggcaatgacagtgcactgcaatgttcatgcaagagagacgatcaaatgcttggtcacaaagttctagactgcagtgatcattgtgactgttttgccttatcagaaatttcagactggtttcagagatgtttcttagataagatttttggcttcaaatcatctacagacaatgctctgtgctttctgcagttatatatggaggaggtatgcatctgttacaattgcctggtagctaattaaccttgatcaatgttcaaggtagaaaatatgtttcatcttgttggttttgtttaagtagtttttggtaacttggatttggcagtagttgcaagtatgctgtagttgtcttcggaagtgggttgttgtggacataatttgtttccttacagtaggatatttctcatacatttatattactctacactactatagagttgcctgttatgtttggcataagccccagtgaaaaggcatgttagttattacagagaggtgctaatgcttttattccagttgtatttgtcttctctgcactttctgtttttccaaaccaattcatctagatgcttaagttatttgtcagctaagtttgttaattttcctagtgttaagtgttaacataatactgatctgttcctttatactttaggatgacatgctgttcaacgttctcttacaacttcttgatgctccactcatttcctcgaaaatgtaagcaaagagtaaagcagtttgtcttagaaagttatccagatctgggtgtagttaaaagttatgctctttttttttctgaacttgcagagatagcatggagaatagatgggcttctgaactgattggtggcaaactgttctcgagcatttttgacccagttcatgttttccatctcttgcttttattggtgagtcagtgaaaatacttttacttcatgtcactaggtttataagaagcacaactctctgcatggtggattggtggcattttaaatttcagttcttgttcatttctctgcacaggcatactgctgtatgtagtaaaaatatagtagcaagctttagtaatcagcagtgttcaaaactgtttaagataggggggcatcctttactatttatttggttgcggattccttcttaccgtagcttgtactcaaaaaaaaataaataagacactcttatttatgttccatgttctttcaagttcagacaatcatatggagggttatacaatgtgtaaagggacattacaaacttaataaagtctcatgcatttgctggctcatgcaccattacttttctgtagatttccaatttcttcttctgattccactctacaatatgagtcttgaggataatagtatttgtttattttaatgtcattctgcagctgcactatgatcacttggtgcttgttgattatctgatatctaaagatgta

SEQ ID NO: 73946 - DNA, 3303 bp, Oryza sativa
cctgatctgaatgtagactactacaatgtgtatgttttaatttgaacatcctttttccagagaaatagtttctgatgcataggtgatttaggatttgtacaaaaaacggaaattgaaaggtaataactatagctagtcagatactctattttgtagtttgatgtagttattctttgcaaaataatatatgataccatttctgaacttttcaaccttgaaaaatagtaactatagctagtcagatactctagttttagtttgctgtagttattatttgcaaaataatacaggagatcatttctgaacctttttcaacctgacaacctcgaaatgcagatctcctagtactcctgttgttggttggcctccggttcgaacattcagaagaaatctggctacatccagcaaagcatctcttgaactgcagaatggaaagaaggctgcaaaagcagaagagatcaagagagctccattcataaagataaacatggatggtgtccctattggtagaaagatcgatctgaatgcttttgatagctatgagaagctttctttagcggttgacaagctattccgaggccttcttgcaggtatatgaacctcaactctgttgttttgtaacacaattaaatcattcaattgcgactgcagtttatgatagagtatctgaagagttttccactgatactgaaccatggcactgcataaattatttccttattgttctttcgaaagttcgcaaattatttctttgttattttcagtattttgaaatttgaatggctgagttatcggattagtatctgatccaatgtgttcaatttccgtcgttgtatttaagcccaaagagaccccctcactgctggagcaaaggactgccagcaggaagatgtggcaatatctggcttgctagatggaactggggagtacactttggtttatgaggattatgaaggcgacaaggtgcttgttggaaatgtgccatgggggtgagtttttcgttttaccgttgcattttcagagagtagtaaacaaagttactacttttattggatgctgattatgcaaacagcaatgcttgaaaatgatatgcagtctattccctgtgttttttttaaaaaatttattgattatcaacctgggagaaaataattttaccatcaaactggaccatatgcctcctaactgatagtctgatactgcaattcatgcagaatgtttgtttcttcagttaaaagactgagagtactaaagacatctgacctctcttcatctgtcagtacctctttccaccttagttctattacatcaaactctgttatctccgcattattttgaaatttgttcacgccatgtaatccatgcagctaataacctctggacggaaaagaacagctgctgagtgttgaccttcttttttggagctgctttgacacattcagtgacctgctgtgaagaagaatatgatcttctgagcttgtatcatcgtctctttctctcaatgtcttgctgtgctgatcttttggggttttcctgttcctacttaaccaacttgcttccttctgtttaagacacttgtgtgaagtgagtacaatttgacatggccatcatgtaaatgttcagctaaatgctctacatttatgcagtttattctctggcagatgatatttggaatgttgctttgttgcatgagacccatttaatagttttgttctctgttactggacatgaaattgttgttgctaggaatcaatctatctatctattatatactaaaagtccattaaactttctataaacgttcctaagccgtcacgtggcactcctacaaatgttcctacgtcaccacatggcacagtctaatcttagcgtcgattttcacttaaattggtggacccattattttacactattagatcaaatctattattaaaaaataataacttccgcatgtttataatgtaccagcgctactactgtccgtacgtatgagtttgtacgttacaaatcctactgctgttctctccgtacgtatacaaacgtacatgattgtgaaaacaaaacgataaagtttcctgatcttcgctggaagaaaacaaatacatatacgtatacataagaaagacagaaaaaaacatacatacataataatcaacggtctttttaaaatatgattttctactatataaggataaaatatattacttcacaaatatcaatatgtttagttaaattaagatctataataaatattcaatcaatgttcttttaaaccatcttctaaacctatctatcaaaaaaattattagatctatttttttaaataaaatcttaagttaccttggggcacgtcctataaaaaaggggataatccttggaaattcttagaaaaaataaagcaccttgtcatcagctttcacttaaatcatttagaaaaattagaaaaataaaatctctacctcctcactctcacatctacacaacagtgttgtcccatccctattgttttatctatttttctaaataatgtttgatgtgtttttaaaaataaagtacaaacgcgggtgttcacaacgcacacactcagctctatgaactcacgcatgcacatacccctatgagtacttccgagagactaggctgacatattttgatattgatgaagtcactgtgtacttttcgctgtcgacgggtatgtcacctactactgaaagaatttgtcctagtcctttcgagagactaggctgacatattttgagattgataaagtcactatgcacttctcgctgtcaacgggtacgtcacctactacttaaaagaatttgtccaagtctaggacatgaacccaagtgggcaaattccatcacaatgaacctaaccagttgagctacgtttacttcgcaataatgttggatattaaaacaaccataatttttaagctacatttctggaatactcctatgccttttaaactggtggaatcactatttagaatagttagatctatcttatataagaaaaaacatatgtgtatacatggtacatcacatttcaaaaatattattattcaattatatttcgctttcatgttagcttgcgtagaacttctgacccactccacataaaatgttcataaatggatctcaaattacataaatcatattaggctatataaatcatatatttagtggagcttcatgtcccacccaattaatcctcgaataaaccatgataatatatatgtaattaaaaaaagtaaaataccttagttttattttacacttactttttattgacatgttt

SEQ ID NO: 73947 - DNA, 667 bp, Oryza sativa
agagggttgcagggatcaaacaagtgcagctcgccgacgagatttggtgtttgtcctgttgctgtaaacgtccaatgttttaggttggccatggcgatcaaagtcctgatgacaccgaatactgatctggaatggaaatgcagagctgtgatcattcagatttcagagtttcgcatctctgatgatcgtcatctgaatggaaccagtccctgtttcttggactaaacttctcacataatccagttgcgccaaacattcagctggatgattggctttcaggttccgattgttcacactgtcactacgattggaagtactcgtagtataataatcaacaaacaataacagtatattatggtcttacagtttcagataataaactccggttgtcagtcagtcgccatttcaacgagactgaaccagaaggttcatactgaaccaaacatttctcaataatctgaactgtatttctgtaacatttgtcagccaggcaggattagtttttccttgagccgtgagaccctgacaccagtggctatgtcgaattctcgatcgattggcaaggctagtactctactgctacttgacaaatgaattcagtcaaaagagagagttgcttcgagactttcaaccagaagcactgtatcaagttaggctgctaatgcat

SEQ ID NO: 73948 - DNA, 1679 bp, Oryza sativa
aaatttgagtagcatgttgttacatgctactcgtggaatgaccttctggtaatcagtttatcctttgctctggtctttatgttgtatggtccgattcatgcaacaaacaaatgttgaattaatcttctgttctccacaaggctcatccgccgtttggcatccttgtcagggtggccgctgcaaaatggaggtgcaatcagcttgattatcttctcttgatttactagtatacctttagccctacttttctgggcctaatttcatgttgcttatgagttacatgaaccattagcagtgaaatactcattctcctgtctcgccttaaaactgattgatcattttcatacgtgaacactagcctgccccttgaaacgaatgaaattatcctgtacatgttactttctaactgaactctcctgctacatcaatacatataaggcatttcttgcctaagttttcaaaacaagaaaaagaaaagaaaagaaaatgaatgaacgaatgaatgttacttcactagctagtagcctagtacgaagtactatttatttaactagcgtgcatatactagttactttgatagattgctacaattcgatagagaaaatgtgaaacttcttaattgatttgagagagaaacaataattttgtagtgttctatgtagtgcagcttggtgagcctaacgtattggactggaccagcgctagagctgctacataaatgtcatttcatattggccaagttttatagtcgtatctggctaactaacccgtacgttggtttcgccgtggtgtgcggctaactgttcctactatatgcgccgtgacaagtgactcaaatatgtttcttttattccatttgcaggcccggattgacttggtcagtcaggtacttcgtgcgatagacaatgcacggtcagagaaggcgagagagcaaagtcattgctccaagacttccattgcttgctagtctgaaagcaaagcttgtgtctcattcagaatgaacagcacataggctggcctctccgtgcatctatataaactggccctgatcaatctcatcttccatcagagcaagctcatcacttcctgcaaactaaagctactcttcagtgggattgcatttcgaccgagctagagagatttatagctaagccaatggcatcacaggttgagagccaccgtgccggcgcggagatcgtcagtggagacggcgtcagcaggaagaagtccatcgagctgctggaggagctcggcctccccaagggcctcctgccattggaggacatcgaggagtttggctacaacaaggaaacaggattcatgtggctggtgcagaggaagaagaagatcgagcacaccttcaagaagatcaagcagaccgtctcctacgccggcgaggtcacggcgttcgtcgagaaggggaagctgaagaagatcaccggcgtgaagacaaggagctgctgctctggctcagcgtcgtcgaggtctacgtcgccgatgcctcgccggagaaggtcaccttcaagactggaactgggctctctgataccttcgatgccactgcttttgctctcggggagtaagaactaaggtctaatgagtcggctactcctatcgtctaaattatgtaaaaggcttaaagccactttcttacatcaccatgtactggtgtatctctg

SEQ ID NO: 73949 - DNA, 1609 bp, Oryza sativa
cagagaaatgtggccaaatttgtgcaaacgttgatcagggggcctaaactgaggctccaacgtgtgttgcaacttgcaaatggctcatccgatcagtggccaaagctcagatgtttcatgatgcttttatatgctttaattgggttagtaatttaatatagcacattcaattgttataaaacaaatcagagaagtgagttaaattagtttcaatggttaattggactcatgccattgtaatttcttcaattttgaaaaataccattactattcatctatttaaagacatgctgctataatttgaccaaaattagagatatgccactatgtacccctccaatgcaataagaatttacaccaaattatcccttctccttccttcacttccttcttccttctccctctcaataatctatgtcatctcttccaccggtccatccgtgatcccatcgagtccgctggctgcgccctttcaaacccccctctcaagggaggcccaacttctcaccgtccatccccataccatagagccgcgacctctccatcactagccatcccattgagctcgtggtagataatcgcggatctcgtcgtcctcttggatgacagtggtggcggcggggctgccccgatgaaaaccttggtaactgggatgaccatgtcgaggagcggtttgtggtagccccttcaagctcgaatcttgctgtcaccctttttggagctcccctggcggtggtaggggagaaagcaaagtagaggaggacacgagggggtggttcaccttcaacattagtgtgtgggtggcggaggttctagtgtaaggaagaagggggtgaatgaaggaggggtaatttggttcaaaattttttataagtgcattgaaggggtacgtagtggtatatctctaattttagtcaaattgtaatggcatttttaataagtgaatagtaatgtcatttttttttataaccgaagaagttacaatggcatggatccaatagtttcaatgcttaaacatcgacattatgtgagagaaaaagattcacgtttccaaataactgaacactctgtatttggttaaataattcatgcatctgaaagattataaacttatattacattcagctaggaaagacaatttgctagaaaaaatttactagagataagtataggcatgaagtatattaacaccaaataataataagttgaaactcaacctcatttgagagtactactcaccaaaaaattatcttttttctactaccaaataaagttgagttggccctactaggttatttttcttacaaaatatgggggagttctatacttctactagcacagtgctcgtgtgttgtaacggatgaagtcaattttgattttacatacatactctgcacatgcaagttagtggataaggagtcgaaagcgatgacacatcaaccgaaagcaactccactaaatcgaaccttgtattgtggtgcaacgaattgacactcactacactcatacctatttgattgttgctttaaatccagtcgatttatgattataagaaagatattgataccaccttgaaataaaattgctttttattgactcctatatttat

SEQ ID NO: 73950 - DNA, 3299 bp, Oryza sativa
ccacccaaaccctcgctccagcgacggcgagcgagccgcgtcctcccgcatggcgtcggcgccggagttgatcgacgacatcgccgccgagatcctcctccgcatcccgccggatgaacccgcgcacctcgtccacgcctccctcgtctgcaagccctggcgtcgcatcctcaccgaccccgccttcctccgccgctaccgcgcattccaccgaacacctcccgtgctcggcttcctccacaacgttgacggcaacaaggcgatctcctccgtcccccgcttcgtccccactaccgccgcgtcgccattctccccaccggccatcgatccccccaactggtggtgggcgctcgactgccgccacggccgggtcctctcccacctcttcaatcccatggaactcatggtctgggaccccatcaccggcgaccagcatcgctttcctctgcccccgcacccgcacgcctactgcactggcgccgtgctatgcgctgcaagcgactgccaccatctggactgtcaccaaggccccttcctcgtcgtcttcgtgggcacaggaaggcatgatcactcatgggcgtgtgtatactcgtcgaagactggagagtggagctcgcaggcctccattgtgctcgattcctatgttgagatgttgcccagcgtcctcgccgaaaacacactctacttctactgtgagtatggcacgaaaattctgggatatgacattggcaagcatgagctttcagagatcgacccaccattggggcatgatggtggcatcctcatagaatcagaatatggtgggctgtgatttgctactgtggaagcttgcggcctcgtactgtggtcgcagtatgtgtgttatgatggcattgaggaatgggaacaatccaggataattgagttggacatgctgatccctaacttcttttactcaggtggtctggttggtttcgcagaaggcacagatataattttcatgttgacagatgttgacttgtttgcaattgagctcaaatcaggccaagtgaagaaggttggtgagagcaggccctactatgccgtcattccctacatgagcttctacacttcaggtaatagcctagatcttgtacagcttgccttagttgaaatttcaaaaattcagactaggcattgtttgagttagtggcttaaaaagtatgggttaccacatatatgccctgtgcttcagaacagtgtttatatatatatatatatatatatatatatatatatatatatatatatatatatatatatatcaaaattcaatgtcacatatcacatagatctctgttgttcttacccaattttttgtttggttctagtacatgttacgaaatgttcctgaaattagctaaattgcctaggcatatcttgatgacttgatctattatacatttatacttccccaaaaagtattgcatgccttatttgggtgttcatgttgagctattatatatggttatgagttctattctttgcatatcttcagatcttgctaggaagaggttagcgcagccagctggaatgcagtgatccattcagaccgatccattgagctgcttctaccttacagagctagtcctttgaactttaagtcttctttttttcttttatcctttttggtggggagtggaagtaagaagaaagtatgtgatcgtgcgcaatgaaaatgtttgatttcagtttgtaatgcaagtgagaaaggatgactcacgcaacttgtttcttctcgtttaactgcttattatcgttacccaggatctatctttcaggtttacatttcttcttatttgagacaatactcaatccatgactgggaagccctcttggaactgatatattgaatattccgtttttgcacgtgccctagtgagtagtgataaatttaagtggttgactctgtgtagtccagacttcgaaaccgggagatttgactacatttaaactgctgtaatagcttcagttaaatggagctgggatttttggccatgttattctaaaaaggatttgactgtatgactcatcattcaatgttcttaagtatagtaccaacaagcctgccatgaggaactccatgcctttagtttgtcatttgaagtaaaatacagcagattgaaagctgtcaatgttgtggttttgcacttgtcttttttttatctctttttgttcctgtagctttttctgaaaacaattgagtggaaataggcatatagcacattcacttgatgtttacttaatgctttaacaaactacatagttttttttttggtctcctgtagcctatcacaaaccatgtgcatcagtctcttgacgtattgattattcctaagccacagtgtggcgcactagcgtatatgaccatatgcaaatagggcacctgactccctgcatttttttaggctgaatttgggtaggtgtgtttgtttttttgacacagatttgggtaggtgttcgttttatttaaggatgaggtttatgaatttgcatacggtgtttgtaaattaacttgatgatgacaggtcacttgcagtccttttggtggcatggcagctttgttttcctccaagctcaaccttttgttgtgtgcaggatttctatatctgcctttgtgaattgtgatcataacttagttttgttgccttcctctggctcggattagttaaattaatattgagctagtaaacttaaactgatgaaccttactaaatggatgttccacaatatctatttcatctggcaatgaagttcattagtgcatgaaaaacttacctgtttgctataattatgctttgcctttgattctgatgctataattatgttttgctcttgatactgaccgaagtgcttgctgcaaggcatgcagtgttcactggcatctctaaaggaactgagggcatgaggtgggctgcaagagaaagttcctcacgacagaaggcaaagctaatgactcttaagctttaggaattcacaaggtgagtaaggatggggtgttgcagaacaattcattgtagtcaatccaatgcggatgctgtgttaaccctttaaattgtttttcacatcgctgaacacacaaaaaaaacttgaaataatatgtactcaagttgtttagtttgagcactacagtctatgtgattctttttttagctaaagctatgccagttattatcactagtagtagaatactatggggatcaacaatcttgtatgtctgaactctgaacatcatttcagattgaacacacatgcattatttatctcaatatgtattgcta

SEQ ID NO: 73951 - DNA, 12398 bp, Oryza sativa
gaggagcgcgcacccggagtggagccccgccgccgtgcggtcggcgctcatgaccaccgcctactccacctacgccggcgccggcgacgccaacccgctcctcgacgcggcgaccggcgcgcccgccacgccgttcgactacggcgccggccacgtcgacccggccagcgccgtcgacccgggactcgtctacgacctcggcaccgccgactacgtcgacttcctctgcgcgctcaactacacgtccaccatgatcgccgccgtggcgcggagcaagagctacggctgcacggagggcaaggcctactccgtgtacaacctcaactacccgtccttcgccgtggcgtactcgacggcgagcagccaggcggcggagagctccggcgcggcggcgacgacggtgacgcacaggcgcacgctcaccaacgtcggcgcggcggggacgtacaaggtgagcgcggccgccatgcctggcgtggccgtggccgtggagccgaccgagctggcgttcacgtcggccggcgagaagaagagctacacggtgagcttcacggcgaagtcgcagccgtcgggcaccgccggattcggccgcctcgtctggtcggacggcaagcacagcgtggcgagcccgatggcatttacgtggacatgatgagcgccgccaagtcagagtggtcaccacacacacacgcacactaccacggttaaagggctggagtgtaaaaaaaatatttgggtggatttgggagggggtttaaaaatttggtggtatttcgaagtgttcataatgctattaatcttaaagtttagatggtgatttttgagagtgaatgttgatgggaggtcttgggtgatgggttggatggatgttgctttcttggaatcaaattattagagttaggttggaatcttggggctcttggctagctaagattggggccagggcagggctggaccagattgcaacttttgcaagggcagctacacactttcactgtaacaagaggaaacttgttggggggggggggggggggctaaaacataaatgtcctcaacaagttcccagcaaaatgtttcacctaaattattctttgttcaatggcatttcctggagtgttaaaaggtgattttgcttgtgtgatgattgtttttttcttatgggctgctagttactctcagcaaaattactacacatctacatcaaatacatcaatgatgtaatgcagtggacagcacgatgtaatggtgcctttggggcgaagcttttgtgacgaatttcaactcaagtggattgaaacaggatccatgctgtgcgtaatcgcactagaaactctttgctgtttgtcgcgtccacgatgttttcttggctgttatttatttgagcttgtacgacccatgacgtatgcttgcataatataaaaagcatgtcatacatgtgtttgtgtactcctatatacatgtattttttttatacttatctgtactgcatattttttttcatattttggccaagaatcatgaatatatgcatggatttgccctgaagagtacaatcatagtatcctaaatctattagattttataatattattctaatacaaaattgactatcaaagttttaaaaggtctgataatatattgtactactaaatataaacactaagtaattatataaacattaaatacccctataaatcatttgttgtcacgcttttccttacaacttaactttgtactccctccgtcccataatgaggtatgtccagattcgtagttctagaatgggtctcatcccattctagattgcaacattacgggacggagggagtatataattaacgctcccacaagtcaatttctcttccatatttcccttcaatatctcgtgccctagtaaatctccaacatggcatcctacacaggaaatttgccttaaatatttcgattgatcgatatctcaatctgtttacatgagctcttggtttccagttttttgatatagagacatcgtctcattggaatcggagcagatgaacggcgccggtaggaggcacggccaacacaaggccttcagcagtagtggcagcaccaatttggcatccttaacacctcagctgcggcgacaagtgactaccatcacatttcatcaagatatggattaggaagatactcgtagatgtggtgtgtttctctgatcttagccttttgtattgacgcacttccagcgatcaacgttgaacgcttactagctactctctccgtcccacaatataagggattttgagttttcacttaaaacgtttgaccactcgtcttattcatttttttttgcaaatataaaaaatgaaaagttatgcttaaagtacggtagataataaagtaagtcacaaataaaataaataataattttaaaattttttgaataagacgagtttcaaacgttacgtaaaaacttaaaatctcttatattataggacggagggagtagtaggtatgagaagtttgagtcagccataagaaatcaaaagaaacaaagagggaagtggggtgatggaagagaaattgacttgtgatgagtgttttgtatatatagagttaagttgcagggggaaagtggagaaaacaagtcacttgcagggatactgggatcgattgcttattattttatagcctatctctagaataaataaagtagaggactaatgggggataagtttgacactcgtgtgcgtgctagctctagcacattctaacacacatggttggagtgtttggtaggaaaaaaatatacaaataaatcagaggtaaattcttttggaccttgtatagtcgtactcttaatttgagtccaaatttgtcccatgaattaagaaaactagctacaaattgggtagggagagaaacgtcaaggaaaaacattgttcaaaccttaaaagaaaatatgtctggctgccagaccttgacctgctaataaacggcggcatgacagtcgacctcatggatcaactcatcaccatatggaatgttgtgcaacaggttcattttgccgaaggaaaggaagaccagataacatggaaactcataaatcacggtgaatacttggcagcctccacctaaaatgcccaattctttggctcggtccaaataaagttcgagatgctaatatggaagccatgcatgggcactgaagaaatgcaagtcctttacatggctagttatgcaaaacaaagtatggatatttgcctaacaacaccttttgctcgctatgccggcatgaacatgagacatcctactaggctaccacctcctcgccagttgtaggaaaggatatggaattatggagcatgcttgctgcctggacagcattcaggtcactagacccgtcatcttggaagacgagaatgcatgaccgtgcacgagtggtgggaagggccgtcaaatgtggaaggagtgcctaagcaagtgctaatattgtccttacctcgtgggagatctagaaagagagaagccaaatagttttccaacataaataactctcaacgctagctatcatagcaaaaattaaagaagagacaagaacttgaacttggacactggcagtggcaaggtgattatcctggactaccttaggcgctcatctcttcctttcttctgtagaaaagtctttattaccatatgtgtataaattttactttatctttattcaccgaaattggcgctagcttgttcggataaaaaaaggccttattaaataattttcataattttaaaacctgacaaacaataccatatactccgctactctgtcgtatcaacgtcaataattttcattggcatgacccttattaaatatttgggatcatttgatatggacttaatcaaatgacatccacaagaaaaatgtgttgttttttccagctttaaacattaaaagcaaatgtgaattcgggaagtgtttgttgactgaaaatactagcattatcctaaattaaagcaccataaagtatcaatttggaagcacaatatgcaagaaagagtaacttaacgtggaagtaaacaatgagatggtgtggcattaaagatgcaggaagtctataccaatgtctcagagcatggaagaagataataaacgagtcgtcttaaagcacagccattcctaagatagagggaaagcaggaggggagggagagagagagacatctcttgatgaacagacatcttggacgcaacttaccatacaatatatgtacacatcatattcgttttattagatgacacatgactcatgagacatattattgcaataattctttcagtacaatccatatataatgagaagcacaatagagacagaaattatccaagctaatattgtacatgcttttaaagcctgtacagtgcaccttaaacgtatggcaatttaattatatttaatttttctatcactagatgcagtctatcagcaatcatgtcttccctaattaagtgcatcattaaacaagctgtgtaaggtaaagagaggcaggagcagagcaggccagtgaggctatgaaaagaaggcgaataaaagccggaccgctggttcaggtggtgagaaagcaggcaacccaaaaaaaaaagattaaaaccaattaatggcactgtgacagtggtcactttaataaaagcctaaagtgtgcagcatcctcgtgacatttgccgcttaaacaacagagagcgatgagtaaagaagacagagtcagagagaaaaaaaataaagatttgctagtagaaagatggatggatacgacgaataaagcaaagcaggggaaaacaattgttcgtcgtcacgatcttgtgcttggaatcgatagacatgcatggccccgtgattttaacaaataatgcagggctttgatagatccccagctggaccagtgtttgttgtgccttttgatagccttctagagaggccaagttctttttaagatcagggggttaattgtttgttgggatgaaccagaaatgtgggcgatggtgttgtttaactatgaacaaaaatctattcattgtattattcaggttactaagagaagtctgaatatttgctgttgaagtgaagaaattaccgcattactttattcttctttcaaaaaaactagtggtggacgtgggcggtgaatttccccctacacccacaaactccctaccgtttttaacgataaaaaaaaagtgcctgggtcaaaggcttcacttatcagatcaaaggtataaacataaattaaagagatgtatgtatataagtgatagtaaaatggattgatgacattctacttttttttttgcaacacataggtaatatgatagttaaggggaaaaaattaatgagaaaaagttgttccatcgatcgtatatggttttggtctaggctatatcacgtagatgctacatatggatgcaaaagcaaaacaaaattttatttttaaaacaaaagtataggtcgtatatcagaaacatttgtattttcaactgttaagcttcacataatttaccccagcggctttgagtttggaagagagttaataattgtcaaaatgtcaagcccacatgcacatatattcccactttgttactaaatctctttctccaaagtcgcaatgagcatccactcaaagcatggggtacaagtgatgagaaaaaaaagggtgaggagattatgtttgaagcatgtgacaagggcacgacttaagccatgacatttaaattctagtactatattcactcacacgctaatatatattttacgagtattataacattcagaaatctatttgtcgatcactcaacctcgttaaatgcctcctgaacttttacaaatgtggtgtttacgtgtggtggtgacgtggtatgtatgtacgtccatattcagttctatttagtagatgagaaaaaaaaggcgagcagattattttaatgtaactctgttttcaacgaacttttaaggtaacacttttatgttgcaaagaggctaatggtagaagaatagcaagagaactagactcaaaagtatacctgtagagcatttcggccccatcataattttcagactgcatatgagcccaggcaaggttacccaacaaccttcaagacaaataagagcatcagaatgatatgtttactggttgaataacaatgtatgaaagattttaaataccatgctttttcatccctgagagacaaataaactactcttccatgagatttagacaacttagttttccaccggccagaagctagctcctcatcaacaaatatcaacttcaatgtcagcatttcaatctgctcttttgtcctgtcgcatttctggtttcacattaaaatgactagtatcagaacagaaatggtcacatcttcatctaaaattaacatgtcatcagtgcagcaatttagatgtgtttaggatctactgctatagacctaccaaatcacagaatttctttacaatagaaagatttagctcgtaggttcttggtttacaggccaatataccttgtataggtcaagaagaatattgtcaagagatttctaagcttcatttgggcaacgatcatgaaaggatcttattgcctcaatagcctcttcagctcaatttgcttgtttcagtacagtagccatatccttcagtgcgctctcaattcgatcaccactgtttatagccgcccagaacaatggaactgccttgtttgggtccttttcaatcacctgcagataaaacaagacgagaaaacaaaaacctcacagatctagcttatgaaaatttctagattcaggattattacatgcattttcgttcacaagactgaaagagctatagaaaaagaaacgccgtcactttgcaaaaatgcaagtaacatgtactgaattatttagcatgaatatgttgaagcaacacttaagggaaaaattaatacccactacagttactagttagaatagcatgcatagtggcaacccaagtagtgtggctggtgtctattcaatcttttttgagatggtctgttcaatcttttggtacaatagatttctggtaacaagggaacctagtcatgagaacacaacttccatgtcactttaagatttacactaatactggttttgttaaagaagcccagaagtagttttgtctgttcatggaaactaccttcgtattctctcttctggttcaattaaaagtgttttttttttttttgaaaacagagaagcagagcttcccctttccattactggaaacacgttcagattacagagttctagaaagcagaaactaagcaaaatgctaataagcaagaaaagcttcacaccaaaacgatgccaatcccatcgctttttgtaaagtttttgccccaggatatcctaaattcatttcaaacatatcatgaatcaatggaagatactgtaagtctgtaactaaaaaaagccacaaaatgcttttgcccttcctgctcccttacaaactactcattagctaaattaatctagcacacacagtcaacatactgagaatgcttaagtcaccgaatttgcagcctatctatctccagagtaaacgaaattgcatcgtccacatgatgggttgcttccaattacctgagcctgcttcgcccgcacgtagggcgaatccaccgacgacggcggcgccctaggtggccgggaacacccgccgctcgtcggcggcgtgacgcggtagccgtaacacccgccaccgccgctcgctgggggcgtcacgtgggacaagcacccgacgctcaccgggcggcgtggcgcccgcaggtgtgcaggggctccacctcggcgcggcccccctcggcgacatccacggcggcagccgcctccctccactcggcattgcggaattccgtcaaacacctggcacgcacacaccaaaatccaccaaaacgaaccagatcaaacataaccaaattaaccccgcatgcggcgtcccccacctcgatcgagaagacgagaacccgccgcctcctccgccgcgctgtgctcgggctcgacgcggatcacgccgccgcggagtcgaagcgagtgggagggtgacgcgaggacggaacggcggcgcgcgcggggaaggaggatttcaaacggggaggttggggcgatgacgtggactgggaggtgggccccacggatgcctacgtggacgtcgtgtcacgggtttcggatgaaacggcagagtaggtgcaggtgcagctcatgtggctcctgtgatgtgagattgcgtttgtgtgaaccacgcatacaatgtgttgcttctggcttattattgataactttgtgtgtgaaaaaacacaaaacaaatgtgctacttactgcatgcattttcaaattggaatttcttaacttactgcgtgcatttccaaagtgaaatttcttaacttactgcgtgcatttccaaattggaatttgtttttgtttgaaattgctgtgtacatggtgactgaataaggtgcgaaagaatctgacaaatgaggcacgaagaaaagaatctgcttttccgttatctgaaaatatatgtgggttgtagcttctgttgaagcaaagaccgggtttaatatccattatctagagatgcatttgatagtgcaatggtaaaggatatatggttccaaccctaaggtctcgtgttcaattctcaacacgctcacaatttcttattaagtaattgtttggatatatacatgcaatatgtgttataatgtacaatattttgaaacatatcatatactaataataatgaaagagtgaaaaaagtagtgatgacctcatgttctattaaaaattactagtaatatgcccgtgctaaacgctacggtgcaactctatttttctttaataatttttaaaattttcatgttagcaaaaaaaaaatattatatgaactgtgcatttgagttttaattcaatttatgtcatacatcaaatatatttcgcgtaaagtataataatatgaaataccaattcatgcagatatataatgcatatatctataccccatgttataatacataattatatgatattaaagatatatgataatgtgtatatctatgccttaagtcatattgcataataatatgatatataatgcatatatccaagacacgcaaaataattcacaatagcattgatatcaatatttactcatctcacaagcgttctttttgtatgtagcgtgcgtgtgtgtatatatttgcgtaattataatgcctcacaagtgggtggtagtttttatataatatagtgcattttcatattataattatttttatattacatgcccatgctaatgctatgaggtggtatttgatagctcaaaatgaaaaggatataacaccacaatgactttaaacttttgatattttaaaggcattacatttccacatagaacggatgttattaaggttgaagaaaaaaacataaatagttactccagtgacaatcacgtggtaccgtatatgtttctcctgacgtgctatacaaaatgaaatgataattgtcagcaggattcaaatttttaatttatttttctaaaacatgaatgtaaaccatgaatattgaaatgatcttttacaacaaaacttaaaagcatgtgttattacccgtcattgttcaccaatccagaacatctttatacacgatatttcttgtgctccttcttgtggggtccaccttttttttaaggctttgccaaaatctttgtcgttttccttgacacccctcttgataatgcaacataaagctgcccttgcgagaatacaggctctagaaaatagataccgacatgtgttaattttataatatggtcccaatggccccatcctccttttattcagcatcaatgctcgagacactaatgtgaagggacaataacaatgcacattttagtgctctacatttcggacaacttaatgtttattaaaaattaacttgctctgtacctcctctcggtggcggagggaatttgggttggctgtggtggcgcttgaggcggaggaggtggcaacaacgtgttggcggagcagaccggcgagggatgcaatggagttgcggtgcggagatcagattggcgacgatatgcaccagaatccgagcgatggcgatctggcggcgtggagatggagatgaggggcgagatcgatctggactggatccctattggtaattgcaaggtgcaaaataataattaatattctagggatcagagaatcaagagaataatttaataattactaactggaaaatagctcaatttggaaaatatctcaatttggagcagtacatgtacagccaaaataacccatgcatggagttcccctagtcattcatgagtagtacacaatgcgcagctaatatatatagttccaaatggacccgtgctaacgctacggtgacatttaaaatcaagtaataaaaaaaggcgtatcctccaacaatcaggatgacaagacatgttaggacaaccgaaaattaaccatgacacgttccataatagtaatcattccataattcataatagatgcacaagcaatttaatttgtaaaactctttttcacatcgtaagtgcccagataaaattaatgtggcaccaaatgaaaactattaaacatagttatgagccaatggcattaaatacacgatttcctccactgcatttacactcctgtcactatgtttaaactcaggactaaaagaataactcaagagcagattcaaccacgtgaatgatgggtacaaataactctcctatcaccaaacacatattatatttaaatgttataatacaccacaatatggttgtgcagcaaggtatcttctatactctcattactgaatcttgattattatctactgtacaaaaccatgtcaaatatatgagcaacaggttctgttgaagagctaattattagtaaacgatacatctgtgatgggtcctccctagtagcaatatattgaagaggatattttttcggcccgtcagagatgactcatctttgacgagttgtgttggcccgtcacagatgacccgtcactgaagcccggatccgtagtagtgctatttggtttcctgcacttcacactatctcaattcttatcacagtacttgggaacatcaatctccaattcagtttagtcttgaaaatagttttgcagtcgagtatgtcagtatttctaatatgatgctgctcgtaaattgaaccaatttcttaaatttgccaaattcagatttcttaaattgaaccaagccaaccctgcccatctgattaggtggacttctcatctgctggaatagatgtatcagttgatctcagtttggcagtaaccaaataaaccagaaaatgttgtaaaaagtacttagagtgaggataagagcatgtgcacaataattcagatgtttctagcaccacagaaatacaaataaacagtaccagagggacataatcaagcacaattcacatatatttgagagatgagatatataacttcatggaattgacacaagagaaggtttcttggactcaccttggagagagcggatagtaggacgatcctgatggagagcaacactgatagggaaggtagaattttgctttggtatatatttagctcagtatctacctaaatgaaatgaaacaaaatcagcgagggagttttaaaaataaaataccgctgacctcctaaatgcagtaatcacagctacagcaaaaccaacttcattcagcttggatgttttcattagtaaaatcacaactcagacactaccgcaaaaaaaagataagaaccaatgttgaaatccaatcatcagaagaacaaaaacgatggagtatagtataacagtggaagtacagtaaatatatatgcttaattctctgatcccatacttcccctattgtcacatcaataccgtacacttgatgatttgaaattcgaatcgtcatatactgctatacatgtggcaaatgtgaaaaaataactgaaagatcaaaaatctgattttggagatcttaacaaatgtaaattgtctaaaataccctagaaagaaaaagatgctcccacaatcacatggtcactcattgaaagtcacaatctgattaggtggacttataatgtactgcaatagatgtatcagttgatctcagtttggcagaaaccaaataaatcacaaaatgttgtagaaagtacttaaaatgaagataagatcatgtccacaataatttagatgtttctaggaccacacaaatacaaataaacagtaccagaggcacataatcaagcacagttcacatatatttgagagatgagatacataactgaatggaattgacacaagaggaggtttccaggactcacct

SEQ ID NO: 73952 - DNA, 16733 bp, Oryza sativa
  unsure (1)..(16733): unsure at all n locations
cctgcagcccagattatcgatacatatgttctcagcagaaatagataccaatacatgctttgttgttggtgaagcgctcaacagtcaacatggaagtttaacagcagaaagtagaaaagataatgtaggggtacaatagaagaaactaagataagaaaaaaagactagaagagtactgataagatatgcatgtaataggcaaaagaaacatgttagtcatccacttacagactttcatgatcagagaaagaagatttccttccattttctaagctcactttttgttgcgatgagctgtgggctagattaccatcagacgccaccactccttgttgctgcattaattcaaaagaatcaatgtgtggtaaagagtatctaattaagaaatagtagtgaaaggatgtgggaaaaagttcttcatcgatccaaaatcagcattacacactagtctgaaaataggtgtctaagtgccaaaagtaagtgtgttgtgtgtttgtttgcatgtgcttggtgcttccatgaaggagcaacgatgaagtcaattaactaaaacagagatgtaggtaagaatcaaagtacgccgggtgaacctgatcaatgaccatctcaattttttccttccaaattaaagcctcctggatattgaatgcagccatctggtacaagttatgcaagactgaatgaggaacattagattatttagaaagtaagatgcaaggccctctctccatgccaaaaaaggggaatacctggccaaaacaaaatggtacttaataaagaaaagtggattatattgttggtatactaaacacactaaaaaaggcaaagcatgtcttctgtttgtttgtgctggaaaaagaaacattagattttccacctcttttatttttcttttccaacgtaaaggaaattcctccctatgtgaatatcatatgagagagacagaccaaatagaagttactatatgacatatgtgcaaatgcagtggaagtaaaaaaacaaaaactatgattattatgcttggtgcaatgagtaagggatgaatgagggaaatattaaccgtgatgcgctggtgcttctcccttttgttgtaaacgcacaaaacataaagcatctgcaagacgaaaaatgaaagcaaagaaaatcaatggaatggaatgcaaaggctacagtgaggattaggaatcaagagcacggaagagaagagatgtacatggccatggtgcatcttgaggccccggtcctcaaccctgcagttgccgtcgatgtgaagggacttaatggggagcttgggcatcttgtgctggggcttgcgtttgtagtaggacagcagccgggtctccagcacgaagtagcgcatgtggatgaatgaccgcccaattttgcggcgaccatacctgaccatccacccctcatatactacggatgacgaagacgacgacatccctcacccccgcttccaatacaacaatgctgcaatcgcaatgaagcaattgcataggtcaattatgcaatcagtgtaccgaaaaactaacctgaacaactgaattcgatccaactagtccttgttaagcacaacatttacttcacagcatcatagcatcctcttccagattaccaaagtgtcaggacacataccaactactaacgtttaacacccatctaccccgcagcatcacacaagtaaattaatacgaggagattgcccaaactagcacaaccgaaaccagcatcccgaacaacccctcaagcacatgataacgatccaccaaacaccttagagagcaaaagaaatcaatccacacctttcagaccagcagcgaacggagggaggggggcggtcgccgccgcctttcgttggggccgacgacgagtcaccgtggcgcgggcctacctaccaggacagcagcgcggcaggtccccgagacgggcggcggctcggctgcgacgcctcagagcgtccagatctggggcccccgctgcgtcggtggcggcggcggcggcggtggcggccacgtcgaggccgcgcggcgcagcgacgaggtgggttgggggggtggagagagagtgggcaagtccaacccggaaagaggcggagaggagacgagacgagacgaggacgaggagaagcacgtgccacctgcctctctctctgctgtgctccggcttccggcggaagccgcggccgaaaaggtggagacgttgcggggtcacggacatgtggggcccacgacgacagtgggctgtgtgcgcgaggcagcggaggagaccggcaactgccatatgcgcaccggcaacgacacggcgccaggtggccagtgttgctgggctggtaagatgggctccgcggataagtccacttgacattcctcaactttacgtcaagtttgtataacgtccctaacccctatacaagatatctttacccatcgaatgttcagaaccatacaaaataggtctcatgacagtcagaaagaagagaattaaaaaaaaacatgtgaaggccacatgtaagtggcacatccacaggaagatttcgttgcctcacgccggcgctcctcctactcacccacgcagaggcgccctctagccgcccgcggcacccccatttctcccacctcatcgtccgcaccgaccactacacctcgttccacgccagccactccccgttcaagcagcccatcactgagaacctccactacggtgtcatcaacctcaacaaagctgtctatccccttgtcgcacgaggtcgtcgcttggatcaagcgcctcctccttgtcgagaagaccaaccacagcgggacccttgacccccaaggtcactggcaacctcatcatcttgtgtcgaccgcgccactcgcctcgtcaagtgcagagatggtgactgcagattttgactttttgagttagtcaaatcttgaagtttcttcagaatttaatcgatgatgccttcaaagcaaaggatgatcccttgagagcacgatcagatgcagctacattaggaaaatcattgctgatgaacaacccgtacatacccatcccaaaatcagcatgactattctagcgagctactccttcatcccataaaaaccaatataatactagatgtgacacatcctatgaatacgaatcatccagttctagccttttaggttttttataagtacacatttgccctcaaagcagcagttttagttggccgtttcaaagcagcgagatacatatctgccatcaaatccggaattttttttgaaataatacgattttaatggaaaattgcaaaaatataggtcagtcaggtgaaatcacaaatttagcaccatggtttgacaggggtacctgttcaataggccactgccgagcattgcgcaaccctgttcatgtacttttttatttttttaagtggtcctgtcaaactgcggttgttcgacaggtacccacggttgttcaatagaatgctaaacttacgatttcgtctcaccgacctatatttttacgattttccattaaaatcacattatttctaaaaacaattcctcaaatcaacagcaaggagtacgtctgtgtggcgcgcttccacgcgaccacattgcccgtggcaatgccagacaccgcccacgtcgcacgcgcattcgaggcgccaggcctgctagagtccgtcgtggattttaggaaaaagtacaccgaaggtccctcaatttgtcatcgaattacaaaatcgtccctcaaccacaaaaccagatatatgacattccttaacttacaaaaccgttcactttaggtccttcggtggttttgaccccagtttgatccgatgtggctgctgaatcagcgtgggacccttgtgggccccacatatcagggtgaccacgtcaccactctccctctctttcccctgttctctctcttcctctctcatgtgttccagtttcccctggcgtggatggcggcagaatcttcaacgcagcggggaggagggccagcgactggcagggcgcaggggaggagcgcggcggcggcgggcgagcgccgggaggtcgccggttgcagaggggggagcaacggcgggtgagcgcggcagtgggctgtggcgagcggctggagcaggaaggcggcggcagagagcggagccggccgagcggagcgggggcggctgcgggcgagctctcacacgaggatactgaggtcgacatcgtccttggccggccgcagcggcgccgccaccggccacgccatgtttattcccatcagcatcctcctatccgagcacatgactggttgtcttgctggccgatggcgccgtataactcggcagcgaaaccattgatggcttcgattggcacatctggactcaaatcccatgaatcttgcctcattgcataatattgttaagtctctgatattcttctcaagggaaattaaagcactcaaatttctgtagtgattagtatcctggcgccacaatgtgctttcctattgaatgaatgcagtgacgcagtctaattttcttcattggtttagtaactaaatgcagctctgccatgatctgtgtgtttcgatctatttcccagagatgcagcaccatgtgatgagctttgatggtgttctaaaggattcaaggtggcaggcgccggttcagtaatgaagatagtaaacaccgagtgaaactgctcgggccacgtagtcggcacctgacgagggccgctgccgccgacgaatgccaccgccgcggcctcggattcgtcagcgggcggcggcggcggcggcggcagcggcatcagcgattcctccggcttaggctgattttattggagtgggccgcaagaggctgtcccgggttcatgggcggcacggcggtcgtgatcatgctgcagcagctcaagggattcctcggcaggacgtacttcaccaccaggaagtctccgcgttcgtcgtcggggccgtcgcgctcatcaccgcgccgttcgccgtccctcccgcgtcgttcgcccatgacatcgggcgcgccgttgccaagcgcgcggagcatgacggcggccatggacgaggggaggcggaggcagccgggggagaagtgggaccccgcggcggcggcgaggacgtggaggtgaaggaggagcacgggcaccgggagggaggcgcggcgcggcgcggcgcagcggggggagaggagaaaagtgtgtgtgagagagaggaggggaaagagagtgtgatgacgtggccacgctgactcagccgccacgtaggacaatactgggtcaaaaccaccgaaaaatctaaagtgaacgggttttgtaaattgagggatgcattgtatctgattttgcggttagcggacgattttgtaactcgatgacaagttgagggatcttcggtgtactttttcctggattttatggactttctcggataggccgaaatcttggcccgtacatgggtgtgggctaggtttttttagttcgaaatttgggcccatgtaacgcggatgggacgggattgaagcccatctaagtaagggcagaatatgggctatcctctccttttgcggcctttggcacaatgaagcgatggccctatctactagcccagtgttcaattcttcccccacacccattttttttttttgagaactcccacacccattgatatattcctacttaattaaccagcttgtcctcgcaaactacaattagtgttgtttttctcataacgggatgattagtagtagggattttttagagacttctcatatattcacaatcatgtgtcttcacactggtaaaaaaaaactgcctatttgatcgtgtcttagagagtgcatttttccgtcttcgttgatgttgcgtgtctgctgtgtaatcgtttttcgataatccagtatgtactgtagtaccagtattattaggggtaaagtaataatttactaatacaatgattaggagttactttactctctccgggctgataatacgacgataaggatgaggtcaaactttagaatatttgattgtgaattatttttaaaatatttgtctttcaaatatagtgactacatgtatagattggtctttaaaagtactttaataaaatcatatatttgttaacacttttatacgtattataatggaaaataatggtcaaaattgtttttttggagaccgtgtccttatccaaaatgacaagtattatcaatccggagagagtatcatttatgttattttcccggctaaatcgatctatgatcatctattgcgctagcatcactcgtatttcatcgaaaaaaccaaaaaaataggtaaataaaatttagtcacagctaaataacgattacacttctccacacctattattttttacaataatattattttatgtttctacaaccgttaacttaggtggtagtataaatatatcaaaaccctttaatcaaatgagatcaacgattaagattattttagtgagtaccgaagtagtgaggctcaaaaaaaatctgcacgacctccgcatgcaaagtaacttaactagtatatttatggcgccatatttttcaccaaaaaatagtcggcatgtatttacattgtaagtccctaaattacatatgtaattttagtatatctacaatgtaaattctagaattatatatgtaagtcctaaaattacatatgtaaatattaaaattacatactaattacatatgtaagtggtatgtaagtgcggtgtaactactgtgtaaatttgtataagagaacgtatcagtgcaatgttaaatgctaatcaaccgagaagattagggcttgctgcaatgccgccgtgtgtgaaaacatccaacgaccagcgaatactcgcggagcaatcgtacggccagcggcaccgactaaaatcaggcaaaaaaaaaaaaaaaaaacctgtcgacatatttttagcaattccgcttaactattagagcacagaaggcgagttcggcgcggtcgtcgccgccgccgccgccgccgcagccgtttacttcgctcgcctcgcgcgcgcttgctactactcactagaaaattagtcatggcagcatcgatcgagttcgatcgagttagatcgatgcgagctagctgagacgatccagatcagtgtgcaactggggcaagttgctgatgcttgcaagatctcacttcgcggtcaaactaatgcaatggatatacatatatccacctggaacagtgaagcacgcagatcgatcgatcgatcgcccggcattagtactactacatgctgtggatcggagtacagggtttagctagcttcgatctcaaagcaaagcaagagcagtacgtacggcgaagtacatcaggactgaactgaagttcctgacagttgaccctagctctcacatgcatgattaagttatacattatactgatgtactctacgtgctaatcaattgctatacttatgatcagcttaattaagcaagttgatcgagctagctatagcttgctttggatgcatgttcccgagatttgacaatgcaaatgttgctagctgggcgggtggatggatcgatcgcattgcttgtgctcagtgtatatagctgtactgtcaggaaagctcagaatgcaatatatacgtatacgcccaactcttccatcacatcataacttttctacacacgtagataaacttttaacttttctgtcacatcgttccaatttcaaccaaacttctaatcttgatgtgaactaaacacagccatactagcattagaagttagtgctgatcaggaaggcgatcgatttgaatgaccagtattactcgaattcttatatatcaaacagctaataaggcctcgtcgtttgctccacccaaaatttgaatttttaaactcaatttgaaagtcaattttaggatattttcaacgtatagtatattttttagcgttggcttctaagttactcttatctatgacaaaattttaaccacaaaatattctttatcactaggctaaccgatgggaaatcgagaggagagatatataaagctcttggcatgtcacatcatggatcgatcaatatggacgaattattctaaactctcgagggaatacgttgtttatatgaaactcaaatggttttaaaaaagtttttaaaaaatcaacaagatagattaatatgtgatagatcactccataaacatgtgcaacatcaaatttaacttatgcatattgcaaaaaataaaaattgactacgcatatacgttaactaattgtaatttaatttactttcttttgcaacatatacaagttaaattctaatttggatgtttgtggagtgatatattacatgttaatacatcttcttaatttttttttgaaatttgtttataattatttaagtggcatgcaaacaacgaggggacgtcccctcgagagtttaaaatccactcttaatcaatatatcattttgtaattgtgttaattaatttattagctatctgcaaacgcgtttcttaatttagctaaagtaaattaagcagccaatcagtaaattcagtttcttttcgttgacaagctgatcgcaagcgaccaagcagctccgatttcctttggctgacatcaggcacacaatcaccaccaacccctgcaggttacggagctggatcttctacatgactaaattattcagtctactgtcaacgttagtattgcaattgtattaaaatgatcgtgtgtcagcgcatctcactcatcccaatctccgcatacatcctgttcttgttgctagcttgtattccgtgtggcccccagtttgaattcgtcaaagtcagctgccatggatcgaaagttacgaggtcgatcgccctctgcatgcaatgtcaattcttccagatacaacactatttatcattagagatgcttgtgctgatttgcataattaagtgaagtcaaagtattagtccccgttcaaactagattaagataaatacagattatacctcggttttcattaacacgttttttcaaactgccaaaggatgtattttgtgtgaaactttttatatagaaattgctttaaaaatatcatataaatccattttttaagtttatagtaattaaaatccaaatcaatcatagagttaatgacttttttatttttcgtgtcctgacttcatgttcatactattcagaaatgaacaccatcgatctaagagctaactaattctctctctctctctctttttcgttaactaattccgctaggtatggtagtggtttaatttgtttaatttaccgtggtagttcctttttttttttagaaacacagtacaaacgcatgcgcttacaacgtgcgcacactcacccctatgaacgcacacacgcacaccatacccatatgagcacctccggaagactgggccggcatatcttgagattgacgaagtcaccacaggcgcctcgctgtcgacgggtacatcgcctatcactgaaagaataattagccgtaaatgcgagtacccgtgtcaaatctaggagttgaacccgggtgggctggttccaccactgtggtagttcctgaagctgtgttcaattaaattaaagatatttcacgcacgatctcgatcttgatatgcacccatggctagaactgatgtttgaattctcaccaaaaacattttggagaaataacattttggagcggtcctggagaaatataaagtggcaataaatatttgtatgaggagaaaattgcactttaaagtgtacgctgtttcattttacgctgggtttaacccatgcttacactttacattacaatatatcaaaataagttttactttagtttgcacgaggtgcgtcgtataattgaaagaaaaatcttgcaaattatgagtaaaacacacgaaacttgttttatttagaccatatttcacaaaatttataaatttcatgaaatttatataggtttgatatactaatacaaaaaatggtatatgtgctggatttcccagccgtcacctcccaagcggcattgatgaggaggactgaaatgtgccagtttaggaaccggcacctttaagttccacaaattaaaaaaaaatgacttgatgcattgaatcgctcctcatcaccccagaccaccatcgatccatccgacaacatcccccaaatcacacaactcaagtcaccatcgatcaatcctataacaacatctcccgcacgaatcacaaaaatttcaacaggatatccataaacaatttcatattatagaactaagcattcatgaaaaaccaaatcacaaaaaccgcagaggagatccaattacaaaggagtactctgctttgctaccatcactcactgggatgtcgaggatgtcgaggttgccgctgccgctgttgcctccatgcgcgagagccatcgccgctgccggatccacccatgagagtaggggtggaaacggagtggattcggatggataatagtcataccatatcctaaaccaaatattttaagcggattcggagcgggtgcggatagtgtatggatgcggatgcggagcggattgttttggatgtcggaaatggtgcggagttggtgcggaatcggttcgggaacggattaaatttatcggatgttacgtgtgtatgcaatcaatacaacattaagttagcaatgcaaggaacaataatacaataatcaataaacgacccatcgtaagaattatgtacttaagtgttaaacaacatgaatacatgatgttcatgatataaaaatacagctacgcaagtgtgacatgagacggcgaaaggctcatactaaaaaaatctaggttaattgatgaattaggctattggatgaaccaacttatgttatatgcaatagattgagtggttacatgtgttgataattttggattatccggtaaatggcctatcggataatcttacagaaatatcggataatccgcatccgccggattttaagataccatatcctcatcagcatccgtatctgcatccatatccgccggatttcaaaaagcccataccatatccttatttaggacggatttggctcggttttcacccctacatgagagccaccgatgctgccggatccgcccatgggagccgtcatcagcaccgacggatccgttcgggagctgccattaagttgttgcacgtagtgaatctgagcgctgcaacccgtggatccgccatcatcaccgcccatgggagctgccgtcgtgggagagaactccatgaagttgtagtggcagcgaggggaggaggggctgcagtggcggtggtgcgagaggaggatgagaggacggagagagaggacatggtggtgagtgggagagaggcgtcgacgataatgacgaagggagaaaggagatcgaagtaaaataagcgtggatggagaagcgattttttttcttccactccgcttggctaggcactatcttctctacatgtcggtttaataaaagaatggcaccgatgacaatttatgggtggcggttaaattaaaaaataggcaccaaaactatatgtgctagttttttctaataaaccagcacatataagaagttggtgtcggtttttaattttgggctcctctgagggggtaagaggaaggggaaatgctcatatgtgctggttttagattgaccggcacctatgaggcatcccctactacatttttagcatttatgacatattccggtgttaagtgaaacttattttaagacaatttggtgtatagtggaagtatatgttaaacctgctgcaaagtgaaacacggtgcattttatcgatgtaaaatgtaatttaatcttctaggaatttagaagtgttatattttggatttttttgagtaattttacggtccttgagaagttaaggagagttgtaatgtagcattgtcaatgttaatgttgaatttgttgtacctagtatcataacactagagtaaaaaaatagggacatctataagacatcttgagttaacctgcgcaaattccatatattgctaaattgaaatatatatatatatatatatatatatttgaaagtataaatgtatttgatatatataactatttcttaaattctataaaaacaaatatattaattttgcatgtatgtataacaatcaacatgcaccatcataattaggcccaccatgacgatttttctattgacctggttacttctaactttctaagccttcacaacaaatataatggatatttttagccttgtactctaaataatataatttaataaattaatataatgtaagtagtatatattggatacaacaagaaggatgatgttgtgatagaaggaagcaatagtaatgtaacgtccggcctctctcaggctaggcccacttatatctgacagcttttataggtcatagaatgccctcacagaccaacacaagtcttttctacacactttgtccttcccaatcggtcacccatcccgagattgctccaacagaccaacacaagtcttttacactttgtctttcccgatcggtcacccatcccaaaattgctccaagccaagcacgcttaacctaagagttctttggagatcggcttccgaaaaagaagttgcaacttgttgagtattctattaatcctattaagccctgggctgggatgtcacaagtaatctagtttcactactagaaaaatgattttttatggtggtatcctatttttttttccactggcggttatatgagaaatctgcttgtgaaattctatcgaggggtggagggtttaggacagccggcgaaaatctgtttttgctgacggttgcttgagaagtccgcttgtaaaaataagcttatttttactagcgtagattttcgctggcggttccttaaaaagtccgcttgtaaaaaataactctatttttactggcgggcctcttaactaaccgccaacgaaaatccattttcgctggcgggtactaagagcaccgcccttaaaagaaattcacgcacactaaaaaattcaccgcgcgcccaccaattacaaataatcgccgcccatcggccactccttatccactccactccagattaaaaatctcctccagatccaccaaccagcatcctctcctcctcccttcccatgcaaagggaggcggcggtggcggtggctcagtggtgacggtggctcacgcaggtggtggcgacggctctggcggcggccatggcccaccacccatccgccctagatctggcggctgcagcagcatggaaggggcggcggccggctgcggcaaagagtagagaaggtgaagaggagaggtggtggcaggccgagccgggcgacgacgacgacgagggagagcgtggtcactgggaaggggtcagcagcagtggcacgggagaggggggcggtgaggagcggatccggccccagcgagtctcgggaggttgatccgccgccgccgggcctcgggagcatcgcgtctggcggtggacggagcgtaaggtggtggtgtccgcgtcgtctgcgagaagccctgccggcaccacgcagaagttcctcggcctcctctagaggaactcaaattgaaaatctgtgagcaaatctatgatggaatttatagaatttgtgctgtgatgtgaatgtggaatttttgtgctatatgatcatgatcaaaccattttgtgaattatttgtgttcgttgtggatttggaattcggggatatggatttgggaatgcagggcagcagcatgcggcatattcattttcgcttttcatctttttttcatctttgctagcgggtagaggacagctgcatggcgtattttcaattttttttgcccccaaaacgattatcgctggcgggtggcttaaaaccactatcagcgaaaacgaataatcgctggcggtccacgtaacacaactgccagcgaaaacaattatcgcaagcggacctcttaagggtccacttaagaggtccgcctgcaaaaatcgagcggattgcaaccgccagcgaaaatcttagatttttactggcctttgctttgtggcggcaccaaatgccgccagcgaagattcaaaatggccaccatgaaagatggttttcgtagtagtgtttctaaacataataaataataataatacgatattgtgattctctgcatgcgtaacattatttcctcaagtaaaccatctatttgttgtagctatgtaacaccaacttgacatatatataatttcctacggaggttttgccaaatcaaaaggcaaagtggatcttttaagataagtaactagtgctgcaaatggtctcatcaagtactataaatactaaccatgcaatccatcacccagcaattctcatctctgttgatatattattcagagtaatctcacaatggcaggcattaaacttgcagctcttgggtttgttgtcctcctaagcattggactagctagtgctgcaagagtagaaagatactctagttccgaaggttcaggcacaggaaatggagaggggggaggatatgtgaacggtgggggagttgggtctggaagcggtgccgggtctggtagcagtggtggtaactatggtgcccatgcaagcggtggaggagggggcgaaggtggtggttacagccaatacggtgggtcagggtcaggtagtggatctggttcgggctcaggctctagtgaatatactcaaaatggaggttatggttatgccggttcatccagcgctggtggtagtggtgccggtgctggtgccggacaagctggtggttattggccatccagtagccatggatctggtagtggtatgggctctggttctagtagcgctgctacttactggaaaggaccatatgcaagtgcatatggcaatggcaatggtggcggtaacggccagggccaatacggtggcagtggcgttggtgcaggttctgggtctgggtttggcgatgctagcccttaatttccttcaaataggaaatttggaaattaatggagcccaacctggggtcatatttatgaagtaggatttgtttttcatttacttgtacttgttttatgcattatgcaaaaagaaataaagggctcaattgtttcagtaaaatttggtattgtgtaactaatgatgagagatgtggctattaagaccgtcatgtgtgaattgatagatagctctgcttcgacatcactcggatatctatacatgggccggtacatcattccaatgtgctaactataatcacttaggagaacattacgtggtgttatccacagttatgatttcagcttccgtgatagaagaaacaactttttttttccaattatatatggctcaatggagatgttctgtcctacttgtgcaagcaatgcattactccatccgtccaataaaaaacaaatctaagataggatgtgacattttctaatataatgaatctggacacacatctcatactagattgatattttataggacagagggagagggagtatgtgtgtatattgctctatggcgtaaaaaacatatggtgactgcaaaacgatatactaagcaagcaaagcacgcagaacgtatggtgactgcaaaacgatatatatctcttaagcaaaacgatatggttttgcaagcaaagcatggagaacgtacggcaaattaagtacctcgggcttgtttcttgactgatctcacatgcacgatcaattaactatacactatactaagtatgtgttaagagcaattttatggtacttgagaagttaccatgaaataccattttttctattgtaaatttggtatctcttggtacctaggtactatgagataccaaattttacactaattttttggtacctcatggtaccttcttaaggacagtagaattgcccatgtgctaatgaattacattgctaattagtacttgtgatcagcataagcaagttgatcgaactagcttgctttggatcgatgcaacttctgagatttgacaaatgttgctggtgatctgctgctcatcggtactgtctgtactgtcagaaagttcagaatggaacaccagtatttaggtggtgtttggatctagtgacttaactctagtccctgtatttaaacactaatttagagtattaaatataggctacttataaaactaattacagaaatgaaagctaattcacgagacaaattttttaagcctaattaatctataattagataatgtttactgtagcatcacataggctaattatggattaattaggctcaatagattcgtctcgcgaattagtccaagattatggatgggtttttattaatagtctatgtttaatatttataattagtgtccaaacatccgatgtgatagggacttaaaagttttagtcccatctaaacagggtcttaatatttaggtctggtttagtttccaattttttcctcaaaaacatcacatcgaatctttgtacacatgcattaagcattaaatatagataaaaaatactaattgcacagtttgcatggaaatcccgagacgaatcttttgagccagattagtccatgttagagatatgtgctnngtaacctacatgtgctaatgatggattaattaggctcaaaagattcgtctcgcggtttccaggcgagttatgaaattagttttttcattcttgtccgaaaacttcttccgacatccggtcaaatatccgatgtgacacccaaaatgttctt

SEQ ID NO: 73953 - DNA, 13020 bp, Oryza sativa
attcctgcagccctgatgttacatcagttggtttagcatcgttttttactatgatgtaggcgtgtcaacatagtgtgtgggtagttctaaagctgaaatctgggaagtaatttgaactatcggagtagtagtgagaattcctgggtcaagtattctagatgggagggttggaaagctgaacttattttcgccgggtgaaagctgaacttattgcaatgtagttttctgtttagctggtagtgtaaaatatacgtgttcattctaatactagtgtttactatgtgctcttgtaccagttgactttcaatggacagccatggtggaatggccataggcgcatctgatctgtttatgcgatggtgattgacaggaaggaggcatcatccctcctgatgcagtaacttgcgggcgatacttcgaggcgaacaagtgtaacaagaagaagtgatcagccacatgatgggtcagtgcctcgctttgtatgtgccgtgcatcttctttcaagacagaaagttaagagttgaagagcaagaaattcagagttcgcaagggaagatgagagctctcccaggagagaatcaaaagcttacatggaactaaaggtggtagacttcaagaatattggaagtgatcagaatagagccaaatcttgtaattacagctattcatttgcattactttgactcgcttgtgcattcatcttaggcttagcaggtttgtaaaatttctctcttgaaattgtattagttggtacttgtaaagtgagcatactttacgaacctgtactgtgcaaaattacatggactgaagttgtatgaaagtgtgtgaaacttgaatgttagcttgttttcgaagaacgggaagtagtattcatgctagatcatgagcccagcgaattggaccggaccagtgctaattggtcagataagtcatctctggctggctgcccagcgtacatccataaccgtgctgtgtaacattgcttgctgagatgctgaagtgtgtagtattcatcagtggatggacttggtcaggaactttgtgctacgtcagagtgaatatgcatggtatggtcagaaaaggctggggtacagttgtggcatgactcgaggctttgttcttcacgacttgaaatccaaagtccataatctttgcctctacagtctgaacaaatcttgtcagaatgaacaaactttcacaattctatataaacagaaccccacatctcatcttccatcacaacaatctcacaacccatttgcacacaacccaaatttcaaactaaaacttcttcacctgaaactacatacccaatggcatctcaaattgagagccaccgtgccagcgcggagatcgtcaatggagatgccatctgcaggaagaagtccattgagctgctggaagaacttggcctccccaagggcctcctgccattggaggacatcgaggagttcggctacaacagggacactggattcatgtggatggtgcagaggaagaagaagatcgagcacaccttcaagaagatcaagcagaccgtttcctacgccggcgaggtcacggcgttcgtcgagaaggggaagctgaagaagatcaccggcgtgaagaccaaggagctgctgctctggctcagcgtcgtcgaggtgtacgtcgccgaggcctcgccggagaaggtcaccttcaagactggaaccgggctctctgataacttcgatgccactgcttttgctctcggggagtagaaattatgaaagaccataatctcaactgtgtaaaaggattaaagccactatcttaggtcaccatgtacttactattatctcttttgtattacaaacattcgagtatagtcctatatatatttgttccctttcatcataaagagaaaagaaaaaaaacagtgactaaggactaacgtgcacattgtcattgctgtttaaattgctgaaaattcttttgggtgccagagttcgaggtgcaaaacaaacaaaaacaaaggacccttcacccttgtactcaaactgatatgagcatattatccctgccaataaataaataaataaaattgagcatattatgagcagctgtgattgtacacgactctcatcgactcgtgggccccactcgagacggttgtcttgtccaccaccgccttctttcctctcgaccccaccccaactccaaattcccaaaccctcgctccggcgacggcgacggcgacggcgagcatggcggcggcggcgccggagttggtggacgacatgacctacgagatcctcctccacatcccgccggacgatcccgcgtccctcgtccgcgcctccctcgtctgcaagcgctggcgtcaactcctcaccgatcccgccttcctccgccgctaccgcgcattccaccgaacacctcccatgctcggcttcatccacaacgttgaccacagcagcaacagctcctacatcccccgcttcgtcgccaccacctccccctctccattctaccccgatttccctccaccgagcatcgagttccccacctactggtgggcgctcgattgccgccatggccgcctcctcctccaactcttcaatcccatcgacctcatggtctgggacccgaccaccggcgaccaccgcatcttccctcagcccccgtacctggacttctactgcactggggccgtgctgtgcgctacacgcggctgccgccatgttgactgccatggaggcccctacctcgtcgtcttcgtgggcacaggagaggatgaccactcatgggcgtgcgtgtactcgtcggagactggagagtggagctcgcaggcctccattgcgttcgattcctatgttgagatgttgcctggcctcctcgtccaagacacgctctacttcagatgtgagcgtggcaagagaattctggggtatgacattggcaggcatgagctctcggagatcgacccgcccccattggggcatgaggttggcatcctcatggaatcaggatatggtgggctgggatttgctactgtggaagattgcagcatcctactgtggtcgcggtatgtgggtgatgatggcattgaggaatggaaaaaatcctgggtaattgggttggactttctgaatccggtgggtaacccgtcgttgtcgtgggaactggccggtttcgccgaaggcgtgcataccattttcatctcatcagagattggtgtgttcacaattgagctcaaatcaggccaagtgaagaagctgtgtgaggagggctactataccgtcgtcccctacatgagcttttacacttcaggtactagcctagatcctgtacagcctcccttaaatcggaccaggcattatttcagttagcagcgtaaaagtataaaattacgccattatggatatttgactgtaagctttagttttcagttatagcgacttaaaaagtatgagttgccatatatgtgctctgtgctcaacaacattgagtttataaaaattcaatatcacataaagtattaaattctgtttctcttaccttgttttttgtttggttcgacatgttacgaaatgttcctgaaattagctggattgcttaggcatatcttgatgacttattctaattctactatttttcttaagtatacattccagaacaggactgcactacctccaaaattgcatgcctcatttggatgttgatgttgagctatttcatggttataagttttataattgtgtattttcagatattgctatatggaggccggaggaaccagctgaagactgaagtgcagtgacccatccattaagcttctggtatcttacagagctagtcctcttattatcttttaagatggggagttgaagtaagaagagagtactatgtgaccgtgctcagataagatgtttgatttcagtttgtaatgcaactgagaaaggatggctcacacagtgaacatttgtttcttctcatttaactgcttatgatcgttaccatgcatatatatctttgaagtttacatctcttcttatctgaggtaatactcaatccatgatttggaagccccactttgaaccgatatattgaatcctttgttattggctccttgctctgatgagtagtgacaaggtttgagtggttgaccctactaccctatagtagttcagactgtgaaaatacagaggttactgacttagtgttctttttattttggggagcacatggtttagtaaaaagtaaactgaataataacttgaagaaatcgtgaatataaaaacctgtgagatttgactggattttctgttatttaaacttttgtagaagtttcagttaatagaactggggttttaggccgtatcatcctgaaaaggattgggcagcatgactcattaaagcatgaacttgatgttcctaaatagagtagacactagcctgcctgccatgaggaactccatggcattaatttgtcatttgagatcactcaatataattatataggagtaagattgaattgcattgacagcagagcactttgccttctggtgctgattgattttgatattattctaaaatggatttggctctatgaatttgatgttcttaaagagagtagatcaaactagcctgcctgccatgaggaactccatggcattagtttaccattcgagctctatataattacacaggagtaagatgccttctattgctgattgaagctgccaatattattactttgattttgtgatctgccttttgttcctatcatcctatggctatttctggaaacattgaattggtggtgctaggggatatggcactagtgtctagtactgatcatgaaccaaatgaattggaccagaccagtgctaattaattggtcagataagtcatccctggttcctcccaaaaataaataactgaatgaataacagtcatccttggctggttgtatagtgcatgctgggatgctgaagaagtgtatgcactacataattagtggacttggtcagggattttgtgcttcagaattataatttgcagttatcaactgcatggtcagaaaaggctggtttcaattgagaactctatataaacagaactcactatctcatcttccatcaccaacaatctctcaccaacacatttacaaaccaaagcattttttttggcctgaaactacatatccaatggcatctcaaattgagagccaccgctccggcgcggagatcatcaatggagatgccatctgcaggaacaagtccattgagctgctggaagaacttggcctccccaagggcctcctgccattggaggacatcgaggagttcggctacaaccgggacactgggttcatgtggctggtgcagaggaagaagaagatcgagcacaccttcaagaagatcaagcagaccgtctcctacgccggtgaggtcacggcgttcgtcgagaaggggaagctgaagaagatcgccggcgtgaagaccaaggagctactgctctggctcagcgtcgtcgaggtctacgtcaccgaggcctcgccggagaaggtcaccttcaagacgggaaccgggctgtctgacaccttcgatgctgccgctttcgcgcttggagagtagctttaaggagtcaatcagctactataagctagtagaaatgatgcaagactgcaagtccttaatcttaattactatgtaaaaatggcttgaagccactatcttacatcaccttgtactgttatatcttttgtactattacaaacatactcctacatgagtatattcctgtagtttattattttttttgaacgagtatattcctgcatttgttcctgttctgagaaacaattgttttgcacaagacaacacaagtcaagttgattaagcaacactggaacagggcacttacaaaattgtaagcttgaatctttaggtctcctttcccaaaaagaaaaagatatgcagagactaacatgcacattatcactaacttggagtgggtttcaacttgcagtttaaactgataaaagttctactggttcgagtttaaggtgccagctgcgccgtgcttataactgggttttgttcgtcttctctgaactttgcgatcaggttctactgtgttcatcaatagatgatgttggtcttttgacagtaatctgatatttcatctcatttaataattttgcacaaatatatataaaaatatagtacatgcttaaagtgcctttaaaaataaaccaagtaaagaaaatgaccattacatatgttttaaaataagacagaggttaaacttatgtacaaatattaacggtgtgatctactccatccgtcccaaaatataataatttttagcacttcagatttatcctaaaatataacaacttcctcaccaacatttccttcccaatcaatcacaaccctctaccattaacttttctcatctacctccacttcttaaccaatcacaacacattcctatttaattctatctactttcttaataaccttgtccaactctaaaattctctatattctgggacggaggaagtattgaaaaaccggctgcccatttttcggttagttataattttgggttgatccattgtcacaatgtgagggcttccttttcattttcgaagtaaaaaaaccgctccccaccagcttacgaaaaaccaaccgaaaaccaataaaaaccgatgattttcggtcaacgccgtacaaaaaccagctaataccagtcggcttccacaaactatacctagcggtttcacgaaaactgaccggttttttactaggtgaatttggaattcattcctatgttcaaactggccggagcgcagctgtgattgtacacgaaaggagtcccactctcactgacttgcgggccccacttgacagcgactcccgtcaagccaccaccagcgtcctcctgcccgcgacgagttcatcgcctcctcaccacccaaaccctcgatcgctcgctcgctccggcaatggcgtcgctgccggacttgatcgacgacctcaccaccgagatcctcctccgcatcccgccggacgagcccgcatccctcgtccgcgcctccctcgtctgcaagccctggtgccgcatcatcaccgacccggccttcctccgccgctaccgcgcatttcatcgaacacctcccatgctgggattcctccacaacgttgacggcgacaaggcgatctcctccgtcccccgcttcgtcccaaccaccaccgccgcctcctcgccgttctccccaccggccatcggttctccccactggtggtgggcgctcgactgccgccacggccgcgtcctcatcaacctcttcaatcccatggagctcatggtctgggaccccatcaccggcgaccaccatcgatttcccgtgccgccgcacccgcacgcctactgcaccggggccgtgctatgcgctgcgcgcgactgccgccatctcgactgccaccaaggccccttcctcgtcgtcttcgtgggcagtggagagcacgggtaccattactcatgggcgtgcttgtactcgtcagagactggagagtggagctccaaggtctcaatcgtgttcgattcctatgtcgagatgttgcccagcctccttgtcgaagatatgctcttcttcatctgtgagaatggcattagaattctggggtatgacattggcaggcatgagctttgggagattgagccgccattgtgggatgattaccaagggggaaccctgatgacagcggaggatggtggactgggatttgctactatggaaacccgcggcctcgtgctgtggtcgtggtatgtggatgatgatgatgggattgcagattgggaacaactcagggtaatcaagttggaaatgctgatcccggtggataacccctcagtctcacttgatctggttggtttcatagaaggcacacaaaccattttcgtgtcatcggatgtcggcgtgttcgcaattgggctcaaatcaggccaagtgaagaaggttggtgacagcaggccctactattctgtccttccctacatgagcttttacacttcaggtactagtctagatccttattgtaatttcagttggtggcgtaaaaagtcttaaattacgccattatggatatttgacagcaagcatgatttttcagttagcaacttaaaaagtatgggttagcatatatgtgctctgcacttaagagcactgaatttatgaaaattcaatatcacataaaagtgtaaaactctgttgctcttacatcattttttgattggttcaacatattatgaaatgttcctgaaatttggtaattgcctaggcatttcttgatggcttgatctattatactgtttattttttctgaattatacattccaaaatagcactgtgttaaattacatgcctcattttgggtattactgttgagcataatatggttataagttttatacattatgtattttcagatcttgctagggggaggtcgtcgcacccagctggagtacagactgtacagtgacccatccagacccttccgttatgcttctggtatcttacagagttattcctttttattatcatttcagataggcaatcgaagtaagaagagagtatgtgaccgtgcttggttgaggtgtttcatttcagtttgtaatgcaattgagagaggatggttcatgcagtgaacaatttgtttcatttcatttaactgcttaggaccgttaccctcaatcttataggtttacatttcttcttatttgaggcaatgctcaatatggaagcccacttggaaccgatatattgaagcatttgttttttgctttttgctctggtgagtagtgatattgttgagtggttgaccctactacctgttgtagttcagactgaaaatacaaaggttactgctcatgttttttctggagcaccttatttagtaaaaataaattgaataataaattgaagaaattatgaacacaaaaacctgagagatttgactgcattttttgtgctttaaattgctgtaactgttcagtaaaagcaaactgttctaattgtttctgttaatggaactaagggttttaggctgtgttattctaaaaagaatttgactggatgactcatcaaagtatggatttgatgttctttaatagagtagagaccagcctgcctgtcatgagtttgttattcgaggttattctatataattacataggagtaagatcgaatcgcattgactgcagagcactttgccttttattgctgattgaagctgccaatgttatgattttgtttttgtgctctggctttcgttcatatggcactagtgtccagtattgatcataagcccaacgaattggaccggaccactgctaattaattggtcagttaagccatctctggctccttgccaaaaaaaaaaatacagaacaaataaagggtcatccttggctggctgaccagcatacatccataactgtattgtatattgcatgctgggattgaagaagtgtatgcattacaccattagtggacttggtcaggggctttgtgcatagaattaatatgcagttatcaactgcatggtcagaaaaggcgggtgttcaactgagccatgaatcattgagtcatggctcgaagctttgttcttcacgagttggaatccaaagtccataacctttgcctctacagtctgcacatatctttatcagaatgaacaagcagacaagtcttgagaactctatataaacagaaccccatatctcatcttccatcaccaacaatctctcatcaaaccatttgcaacacaataccaaaccaaaacttctttgtgtgagccacatatccaatggcatcacaaatcgagagccaccgctctggtgcggagatcgtcaatggagatgccatctgcaggaagaagtccattgagctgctggaagaacttggtctccccaagggcctcctgccattggaggacatcgaggagttcgggtacaacagggggactgggttcatgtggttggtgcagaagaagaagaaaattgagcacacgttcaagaagatcaagcagaccgtctcctatgccaacgaggtcacggcattcactgagaaagggaagctgaagaagatcaccggagtgaagaccaaggagctgctgctctggctcagcgttgttgaggtctacatcaccgatgcctcgccggataaggtcaccttcaagacaggaaccgggctctctgataccttcgatgctgccgcttttgctcttggtgagtaaggcttaaggagtcagtcagctactgtaagctagagatggtgcaaatctgtaatcttaattatgtaaaaggcttaaagccactatcttacatcaccatgtactgttatataaatcttttgtattgtaatttgctaacatatatgagtatattcctgcatctgttccagtattaaaaaaatactgttttgcacaagaccttagtcaacttggttaatgaacactgggacagggcacttaaaaaatcgtaagctttgtagactagtgcacattgtcagtaactaggagtgattttcaacttgtagtttaaaggcaaaatttgctacgggacatccaaaaaacgtgtaattagctgggagacaccgcaaaaatacttatttgctataggacaccacaaaaaactggtaattagctgctggacacccgtgggattattttactatatccggagaaattggagagagaaaaaatcattaaagacaagtttgcccttggctcaaaggaatccaaacatgggccccacatcgctggtggcttctccgagttcgagtccaacctgcagctgctggccggcggcgagattcgtcaccccgcgcagcctcttcaactgcggcagaagcgcaccgccgccaccggagttctagtatcacgatgtcgcgccgccgttccccatgtccctcgtcgccaacacccacctcagaggcaaaaccaaaatcatcttgttcttgatgatgatttaattcttgctcaattactgatcggtaagtaattcttggttaattattaatttccgtgtgcaggtcgcgagctgagatgctgctacaaggccaacgtggacggcttcagcgcgacggacttccaccgtcattggctgcatggccaccgccgctgccgccggcggggtcatgccgtcatgttcggcaggttcagcccacaggggtaccgaagcacggacgactactacgacacgctcgacgccttcctcttctactggccggacacggacacggatgccgcagcgacggcggcggtcgtgctgccaaaggtgggcgggagtggggcggcgctgttcgactacgcgagggccgcagttcggcgccgacgggctgctcatcgggccgccgctgatcgccgtgatgggggggggaggtgttcacggggcccgactccagcaccggcgccggcgacctccgcagcacgcggtcgcgtttcgggctgtcgtacgcgaagcgctccaccgtcttcatctacaactcggcgacgttccggtggaccaaggtgcccgcgcaacgccgccccaaccgaggtgcccgcactggcgcgcgcctcgctgcgccggtcaccggcgctccctcgggctaaagagagaaagaatgagagagagaatactaacgaaggagtagagaaggatggagaaaaaataaaaataaaaaaaaattcaaagggtagaatcgtacttacacagctgtttctctctccaatttctccggatataataaaataatcccgcaggtgtccaacagctaattaccagttttttgtggtgtcctttagcaaataagcgtttttgcggtgtctcccagctaattacacgttttttggatgtcccacggcaaattttgcctagtttaaattatcttctctgaactttatgatcaatttgtgttgggttctttttttttatcctttcggatggggagatgaagtatgcgatcgtgttcagaggtcagttaagatgtttaatccagtttgtaattcaagtgaaaaaggatgactcacacaatgaacagtttgtttcttctcatttaactgcttatgatctttacccatgatctgtttttcaggttggcatttcttcttatttaagacaatattcaatccatgattgggaagcctaattggaactgatatattgaattgctctagccccactgagtaagcattaaaattacagttctttttttgttttttggttgtacctggttgaccaagtagtaattggtaagctgaataataacttgaacaaatcgtgaacacaaaaactatgagatctgactgaagttgctgccttttaaactgctgttcggttaatggaactggggttttggctgtgttattctaagagatttgactgcatgactcatcaaggtagggttgatgttcttagatatatagcagaggcaagcctaccatgaggaactgcatggcttcagccttcagcttgtcatctgatattttgaatcactatattatactacagcggagcaagatcgaacctcatttaacagcagagcactttgccttcttttgctgactgaagctgccaatgttatgagttttctgcactatattttgttcctatagtagcttttctgaaaacattgaatggatatggcacattcgctcgatgatttgttttatgctttcctgccactctgtaggctgtagcaaacggcaagttttttcagtctcttgtaaccatgtgtatttgcgtcttgacgtattgcttatccttcagatattgccggttgccgggcaccatcagcgaggaaatgagcatgtgttggaccagaccagtgtcatgacaaaagaaattcctgatcagcaagcaacatcgcagagcagaggctagcagatattgtacagtttcaggctcagcccttactgtatgcaccgaagtgatgcagcaactgagaactactcttgaggaaacgcaaattaaccgcaacactgcagaacgggctgcaggaat

SEQ ID NO: 73954 - DNA, 677 bp, Oryza sativa
cgagcgaaagccctgtctcggttctctttgagaccttgacggatgggggcggcggtgttttccatcgcttctcttcttgaaaacgtcgtttagacatcccctagcggaaacccccaagcaattgatgcaagctcgctctagatttcatcctcttatggcggcgtcctagacactataagttggtcacatcagagggcctaaggggagaagtgtttcattcttctctctcaccctctctctctaacttctgaagacttggatagagcggggtttgtgttgattgtaagggttgggttttgggcgatctcggctgtgttttgttgttggcctagcggcggtcggtcatgcttagcggcggccggttcggtgctagccttctcctggacctgtgtgttggcgttgccggtgtgtgggtggtggtatactttttttcttttcctggttacgactttccagggttgtaatcttgtaattttttttctgctctatcaataaactttgcaccgtcttttgcgagttgttcaaaaaaaatttacattttatgtcattctaaaactaaacatacatatgctaaattatcaatctcaaatcattttcataatatttcaatccaaatcatttcatcatttttgcaatatctaacatatattctgcagcaaagcgtagagcatcatcta

SEQ ID NO: 73955 - DNA, 1810 bp, Oryza sativa
  unsure (1)..(1810): unsure at all n locations
atgttgcagaaaaattgtgagaaacatcaatcatatgatttttcctttgtttcaaatgggttctaaaatctatatttttgaacatgttaatttattcgaaattttcaagcactcatctctacaagtaaacataacttaaaacaatcacgttctgaaacaaaatttatttttacttctatgccttcggcaattggacacaaatatggtggacacacttttacccttacacaacccgtttgttccctgcacactctacagtagaagtacataatttacagcgaggtgtcacatcggttttaaaccggatgcgctatggcagcagcgacttgtgttggttccccttgccctaccccttctcttccctaaggccttatttggtttggagggaattaaagaggattgaaagagattgagggagaataatttcacaccacaataggtgtgaaataaatcccctctaattcctcccttatggagattatccgaacaaagcctaaagcagcggcggcaagtacccccgtcttgccgtctattccatctccagcggctctccaccaccaggtccacaaccgatcacggtgtcctaatcataagctctaatcatggccatgactccaaactcattgatcttcctttttccccttcccctcaacctcctcccataaccccctttttcactacgctgtacagtagaagtagaaaacgttacatccaactacataatttacagcgactcgtgtagttgccacgtcagcttaaactggatgcgccacgaaactgccgctttcctcgtcgccggggccggcgccccacattttcccggccgtcgttcccgccgacgagctcttccccttcccgtctttcttccccttcgataacgacggtgcgccgccggagtcatcgcggcaggcggccgccacgctggacgtacggtcgtactggaccagctgctcgagcacctccttcatcgtcggccgcgacgccgggtcgtcgccggtgcaaatcatgccgagcaggaacaccggcacggcgtcctccaggaacgccggcctgtcctggatggcctcgtcgacgacgtcgggcagcttcggcggccgggccctttggggttaaccccccgggggcccccgggcacgcccacttggcaggcaccagtccgggccggcggtgttcgccacccagccccgtcgtcagctccagcagcacgacgccgaacgcgtacacgtccaccttctcgttcaccttcgctctgcacccgtactctgcgaccgcgagacagacatatcgtcgaacacttgactctcatgagctagctcgatcgatggcgagcaaatcaaatcaaattaacgaacaacaatcttgtgatgaacctcacctggagccatgtagccgaaggtgccaccgatggcggagatggaattcggctcgccggacttggcgaggatcctggcgaggccgaagtcggcgatcttggcgcggaaggccgggtcgagcangatgttgctggacttgacgtcgcggtgcatgatcggctgcgcgcactcgtggtgcatgtagctgagccccctcgccgcgtcgatggcgatgcagagccgcgtcggccactggagcggcgccgtcggcgcgccgccgtcgtcgcggcggtgcagccaccggtcgaggctgccgttctccatgtactcgtagacgagcagctttgtgtcgtcgccggagatgcagcagaggaggtcgatgatgttgatgtggcttaccctccccgaggatcctcaccttcggcgcgaaactcttggtngctcttcgcgtccgactt

SEQ ID NO: 73956 - DNA, 2584 bp, Oryza sativa
gagttaagttcagaatcatttattctaactatcattataatttttcatctgatttacaggaagaaacttttgccaccttcatgtagttgttatccatgttttcttcatgcatattttcaccagatactggttataatgggttgcatggctgttcttccgagatttccaacagtgtgcagagctgatataactcaatcatgcatggtattattccatccagaccaatctgaattatatttgttgaatcgacaacccaattgagaccatatgaatccttgcaatgtggctttctattggtaaattagagctaaaaaacaatatcactacgataggaacgtttttttggtcaaactgaactgaaaagaatttgtggaaagtcagaacataattgaactacaaaaataatatcactacaactgttttaaccataattgttgccctatgatggaaagtcagaactattgatatggcatgtcagcaagatttgttttcttttcagcaacagagaaactgtcaaataaaactataaggagtcacggaacattcgctcatttggaataatagatgaatctgttacaaagtaataatatagtctaatatgatacaatcagataagttttgtacaggttgaatctcagttgatgaggagcagttgataataatatgttgttgatgatgtgttgagctataccgtgaaatgagatggcagtgagatgggtggcgagcagggacagcggtcaggccatcaggatcgtgttggcgtccttataaggtcaggccatcagggtcgacggttggtgaggcgttgatccagggtcgtgtcggcgtccggcgttgatcggcgtccggtctccaggtggtgcagcatgatggcgatggcgaaggtagagccgtagaggtgcgggcgcggcggcagggagggatgagggcggtggcagggaacgttacggcggcaggggagggatgcggttcagagagagaggagcggatctgggagagcgagagacgagcggatctgagagggagagagagagagagttgcgtgctgatttagggtggtgggaggtgggagcgatctcgatcgttgaatctcagcaagataatctcaaccgttgagtgatgaatgaaagaatgaaggaatgattgaaaccatttgttgaactatagggtagaagatcattcgtccagtatttcttaaaataaaatcttcaattatatcttcataattaatcatgtccaagatatcattttcaagtgctattgttgcaagcagcaagctatatcaccgcctccccgttgccgcgcgtggaattggatcgatgtctcggtctcggcagtcggcgcagcacggaattaggatcgtcgcgcagcagcaggaggtacaaattatgcgatcacacaacctaatagtgccacaccttgtctcggccttgttggtccatctatctattgggtttgcattgcaatagctgaacaattggaagtggacattcatgtttatatagggcccaaaaaacacagaggccatgttcgatcgcctattggcacatggccatcaatgggcctgttcttttttgcgctgctaggctgagttcgaatcctttgaaggcatgttttctcaccattttcctagggaataagttcatatgaggtcccttaacttgtcaacgaatccgattttcgtccctcagccgtaaaaccagatacaacgtatccctcaactatcaaaaccggtgcaaattaggtctcagggcggttttggctgacgtggcgtccacgtggctaatttgactcatgtcttaatctgacgtgacgtttaggtagcaattcaattcgaaaaaataataaaactagtgggacccacatgtcagtctcacatagaaaataaaaaaaaaatgtgggacccgcatgtcagtccaactaaccctcttctttttcctcctctctctctccccatctctcctctcttcatctctcctctctctcttctctgccgacgggcggcggggagacgggcgggcgactagcggggagaaggggcggcgccggcagccgatgaggatatggcgctccgggacaggcggcgaccggcggggagaatgggcacggggacgggcagcgaccgacgggagagaaggggcgccgagacaggtggcggccaatggggaggacgaccgacgagcggcggcaggcggggagaagggcggcgcacctcaccatcgcggcccccgccctcgtttccaccgtctccacggccacgcacctcgtcgcgttcgagctccgcccgccacggccacgcaccagcagctgcaacgctgtctcctcctctactaccgccgccgcatgtttcccctcggcgaaggcgggcctcacgggtggaggagcatggccaccgccaccgccacaggccccctccctccgcggcattcaggtcatcgcctcgcgggcggaggagcatgcccggtgccatcgcctcgcgggccgcagccgcgcggggcctcgtcccttccgccgccgacgccaatggacgctgctgccgtcttcctcccactcggtgtcaccgagtggcgcccgagctcctcct

SEQ ID NO: 73957 - DNA, 22556 bp, Oryza sativa
aaaacgatggaatcttgtcatgatcgcagcaatggacatataaaccgagatataggctgcatatttactgagcaattctggaaccgaagatctcaatgctgaagatatctggcagacaaattctcctcaaacttatgcttgcccgtttctgttgcaacaaaaccaggccgcatcgtggcctccgccacgtccttctcctctaggcctccctgacgtcacggtcgccgtctttatctctgcaacgacctcgcatggatcggagtcggactctgggctaacatatcagcgaattttaattcccatgtgttggatggaatgctgaaattttgttgggatttcgcaagcgacagagatgtgtttcatgtgtttcaagtggcctgtcaaattgagctaccagcagcctgcaggcaggcaggcaggtaggtttgttccgacaagtgaattactgaacatcaatcaacatttgcaaatctacagactgcagcttacaattcacagttcagtccagctccagcagcaatagaattgactgcaacagctgagaacttgaaccctcagatcgatcgtgcacacgtgcaaattaacttttgaattcgagtctttgagattttcgtctcaatctgttgaaatcttcaggataccttcaacgatacacaacggcactttggatgatactcactgatacaataacaatagttgatgatacatgtttatacttgcttatattgattaatgcacgacgtgacgacaacactcaaggataatgactgagtttttattataaagaacacgggtttcttcatcacactatgggatacactaaatctcagtatcatgggggatctcgcaacatctgcagcctggacagatcttcatcacaatgaacaaacaaattaacatgatacttgggaactctatataaacagaaccctacatctcatcttccaccacagcaatctctcaacccatttgcacaaacaaacacaacacatttccaaaccaaaaacttctcttctaattttctccgaaactactgctccaatggcgtcacagatcgagagccaccgcgccggcgcggagatcgtcaacggcgatgacatctgcaggaagaagtccatcgagcttctgggagagctcggcctccccatggggctcctgccattggaggacatcgaggagttcggctacaatcgggagaccgggttcatttggatggtgcagaggaagaagaagattgagcacgtcttcaagaagatcaagcagaacgtgtcgtacgccggtgaggtcacggcgttcgtcgagaaggggaagctgaagaagatcactggcgtgaagaccaaggagctgatgctctggctcagcatcatcgaggtgtacgccgccgaggcgtcgccggagaaggtgaccttcaagagtggcgccggaatctgcaagacctttgacgccgctgcgtttgcacttggggagtaaggacttggaattaatttgcttgcattgttcgaaatgatgccaaaagtttgtggtaaatgtccgttcaaagaaagatggtagtacttttgttgtttcatgcattaaactcgagtaatcagcagtgccatgtacatgtacactgcgttgtgatcaaatctattattttaaaaaatgtacattatattttttaacaaataggcgagccgccaatttcattgaaaatgtaaggagtaaactgtacaggtccaagaaagtgtacaagctcagtacctttggaccaagctatctataaagttagtcagttgccgaggatttctgcgcccgctagttgctagaacccatgttttttttagagaaaattccctatctagcataaaaaaaattgctcttccctctatagcacccaaacttcaaaagttccctatctatacaccatcaaaatttttgttccctatctatcacttccgttagttttgagggtgacggtgttaagtagcatgaggaaagacggttttgcccttctgtattttatacttttttctctttctctgttcacagtttttttttgttctttatttttttcatttagtgtcctcccgtgccgccggcgctgcactcccatgccgcgacgggctggcttcccgtgccgctggcgctgcccatccgggggagcccgccggcgccaatggccgcccgggggcttgccatcctcgccgcctggctgattcgccgtcctcgctgtcctcgccacccggggggtcgccgtccttgccgccggccatgggggcggtgatctagggttttggcggcgtggatttggtgagaggagcgcgcgggttggggagagcaggtcgcggtcgcgatcagtcctggagaaagagcaacaaaaaaatcctgagggtgggtccatgcttgttttgacggtggaggctaacgggagtaacggaagtgttagatagggaacaaaaattttgatggtgcatagatagggacctttgaagtttggatgctatagagggaagagcaattttttttatgctagatagggaattttctcttttttttattcacccttgatcttggctagaaggctagttgacgggagctccttttgttggaaggtactacgattccttccattccatatctcccagaccactagcaacataagggtccgccacgctttcttggacgcatctttggtatttacagtggcctcccaccactcaagcagcgtcaaggcgttttgccactaggttgtcctaagctggccgcatgctgttcattccgctagtgccgtccagattcttttcatgtatctgcatccccctagtaggtggagggctgtttcctggttcctacgacaaagggggcaaatggagtcattctgccatcctcgtatcacgaaccatatggtatggtttatctaaaaaaaattctccagaatgtgcatctttgcattagagcatcaccgacaacatcccaaagttttggttatgagaatggtaaacagaatttgagatgtcaaaattttcatccctccaaaagattaattaaaattagcttcctaaaaactaaaaagtgagtcccctaggaaacttccaacataagggggtgtttagatcccactccaaaattttacaccccatcacatcgaacgtttgaacacctgcatgaagtattacatataggctaaaaaataactaattacacagattgcgactaatttgcaaaacgaatcttttaagcctaattgctctataatttgacaatgtggtgctacagtaaccatttgctaataacggattaattaggtaataaattcgtctcgtggtttactgacaggttttgtaattagtttttttttgacccaacaccctatgcgacaccttatataatacccgatgtgacatgccaaaactttacgcccttggatctaaacacaccctaaatatttggtattttggatatgggtgaatagccaaagtggtccttcaagttctaaggctcagtctggtccttcacatttcaatctgtccatatcagttcttcaaattttattttagttcaaacttatccttagacccacttaaaagccatatgggtaaacataaccaacagctctctttaccccctcattcacatatataagaaaaaaaaggtcttaccattcatacgatgaaactgtatgacgagaccctccccgcaacacacacaaattcccaacttcctattgaagtactgatatgggtgtttttccattgaaatttgtgtgcaatgaattcgttttcccattttattttacttcagcctgacgtcgcatgacgcatgcgtgcaaactactttaaactattttttcttttaaattatttatccaaatcatgatcatattgcaccattaaattcgttacaattaaatctttaaaacaagaccacacatggatatattccgacaaaaaagtttagcttattattgaattatttttaaatgttacacgctgttccaccaagtatatcggaattgtttcactaagtagatcaaaaatgtttcaatcgtttaaatcaggtgttgtttcaccttatataaaaacaatgtttccgcaaatagcgaaagaatgtttcagttcactgcaacatttgatccatacatagtgaaacattataagtacactatatgaaacattttttgtggagacacgtggcaggtgggggcaggacacatggtggggcctagggggaacgtgcgtgtcagggggcgggggagcactcgattttgctcccttggccggtcgcccgagcagagggaaaatcagttagttagtagtagtagtaatatgatgttttattcacttcatcccaagtaatagaatggaaacctggcaattcaggatgtgttttccctcaccctaaccatggctataaattgcgtgattggtttgataatgggaaaaccttcttcttcttcttcgtgtaaagatctccttcctcgcttaggctttttcaaagtggatcttaggggtttgagtttgagggtaccttccgggtagctttaccttatgcttgctactcaaattttccataaggccacataacctgctatatagaactcaatttttccataaggtcacataacctgctacatggatggtgacactaatttgggagctttcttcatctcttcttggaatgagttctttttattgatcgacttggcaagcatattgcacttctgccttcttttttttctatgttaggctaatgcatttccaattgtgttgtaacattgaagtaagaaagaaacacattttcatcttgggctcctagtctcctatcgttaagcctagttatccgatcatacttctcagaactaaaattttaagcagcacctcctcgtgtcatcatgatatatataaagtcagcaacgccagctattaagatagacttttaatgcgtagatgatgtgatggttccatgatattgttttcatctaacggttgagtttagtaaatgattttgctatgattatgtgttgcccttaatattgacaagagcgcttgtcgtgtcatatctaaaaggtacaagagcgcttgttgcagggccagcgtgtcatatctaaaaggtacaagagcgcttgttgcagggccagcgtgtcatatctaaaaggtacaagagcgcttgttgcagggccagcgtgtcatatctaaaaaggtaccaagggtatgaagtgagcatggcagaagaggttcctctcggcagaaaggaatgctaacagtggtgctagcttatggaatcagcaaggttagtaatgattagatgtaacactatagttcgtgtattcaatgcaataatatatttgctattttaaaacccagctggttatggtcaagttcgttattgttactatattagccataaagatctacctgaactttgagaatgtatagtattattagtatctctatatatcttaatttagaatgcttattatatcttgtaatatatattctcctatggatactagctagctagtgcattattgtaaatagaatgtattgtatcttgtacggtaattagtaccaatagtagatagaatacacttagcattattgtactcctagctccatacttgtttaaacattatttgaaatgattagatattttggtaagctaaccaacgctgtcttttttacttacccttacatgccgacagctaggaggatcaatgaatggggtagtaggccaattagatcaaaaactgagtttgttcttatagcaatatttaatgtgatatgtcttgggctgttgttgtcagcatactatgaagacgataacacagaaatgtatcatagtatgctgcaccatagattggaaagacttagcgctgagataagagtgagatatgatggaaattaagccggtcatcaagtgcccttgagttgataagacttgttgcgggatagagtgagttgtatttgattaaggtggtgtttggattacatggactaattttagtccctgtcacatcggatgttcggacgctaattagaagtattaaacgtagactactaacaaaacccattctataaccctagactaattcacgagacgaatcgattgagcctaattaatccataattagcttatgtgatgctacagttattgtacaaacgaaaagcttcacgtcgaaggacgtggttctctcagtggaatgattagaaagtaaaacattgtattaattaataattttttttgggatccccccattacatggtcctaggggctagttatagtcttagtacacgctcatatcctctagggtttagtgtgtacaggggaatttacatagatactctttagatagggacaccagtgagggcatacaatgtctattctaattatgggcccctaggtgggtcctttggcccagcccataagaggcaaatggccttcatgggccacgctagcttgatgggcttcctagcgaagccagtcttccatggggcgaacccttcatgcttcgccttaaggcttcgcccagagggagaccagatggtgagccctccgagcttggtggcgaaccctcttgacttcgtcctttggctttgccttgaagcttcgcttaaggcgaacctcctagacccggttggcgtcttgctgatttgatggtttcggtaggttcagccgaaggccctcatgacatgcctccaacatgcccctcacgggcaagggtgagtagggagtttcggccgagaccgtgcaaacatatggtatggcaatgaggctcaccctttcggccaatgttcctaccgaaacctctcttaaccaacaaagccttaaaacttattattacatatttttcattttttatgtttctttctactctacttgatttcgcacccttatttgaatcagtaactcgtttggagttgagtcggttcggatgcttggacagactccttctctttgcctcccccttctttatttagatcagttttgggccgtattgcactgtttccgcggccttttactgttcagcccatccggaagaggaagttactgctgcctcccttcaagggcaccacgtgtttggccactattggccggtagccaaaccgttgcgtcttcggggttatatatacccctctgggtcgctttcattcttaccgcagtcattctcatttcaactcccccgctcttagtgacctctcttctctcttcctcgtttggttgccgtgcgtgttccttcgcccccgcaacctttcgccacttgcaacctttcgccctgctaccgatggcagcgtgtaagcctgctaaggccgccgctaccgtccccgatccaggtcgccttggcgaagatctctcctgcttccttggcaagtctctcatcaaggagtcggatcttgcctccctggtggcctccggagccatcgccgaagggcagggcttcgtgtcgggcgaagctctagttccaactccgggcgacaggtgaacgctggtcttctccacgttcttcgacaccaggcttcgcttctcgtgcgatgatttccttcccgacgtcctccagctttacaagatcaagcttccctagctgagcccttccgccctggcgcggattgcagtgttcgactaggcatgtcataccgcgctggcttggccccaaccgcggagttgttcgacgccatcttcactgctaccatcctttccaaaactgtgcagacggctgctgggccgaagatgatggtcttcggcagtgccaacttcattcttcgaccggaacggtcagatgtctagctcgtccatgcttccatgcccaagtggcatcaccactggatgcaaaagtggttctaccacaacattccatatgtggtcggttccgaacgggcggaggccttgcactgccgtcaccatgccatctccatcgaactgaaaccgaacgtggaggtggaaggcacgctggagtcgaggctcatacttcttcgcaagatcgccctccggctaagcacccgcgatcttgttgaagaatactacatgcttcgcatatgccctctgtcccgagactgcggtgtttagcttagtgcaaacgaggaagtctatggcctcccccgtctcgtcttgcctgcatgttttattattacttcgccatcattcgcgccttttcatcttcgcaacccgattggtgctggagacacctctttcatctttgtttggcttggacagtgcagtcgctagcagaggccgagacaaaggcgaataatattattggcgagctaaccgcacgagagtatggtatgttgctctcgcgacaaactagcggccgcgcgaaccgtgttttcgacagcgagcctcccgctcgggcgaacccgatcaaggttgtcacgatcgtcgacggagccgagtcgtcgaagaagcgtaagagaggtgttgcgaaaaccacgctagggggttgaagcaaaacccgccgagcaaccagatccaccgccccttcacctgctgaatcggatgcgaacgatgaggaagaggaggacgagagggatgaggaggaggaggaggaggtggtggtggtggaggaagcggccgaagaggatacggagggcaagaactattcgccaggttacaccccaagtccggatcatccggaaactggcgtggcctccagctcgtcaccccttcgccagaaagacctagagggggcaaagaccctagctgctatagtgggtgccacctcgaggaagggtacttcggctgccggcaagaggccagcgaaggccgtgaccaaaggtttcgtgaagatatatattcaatgttacatctaatgaagctaatttgacgttgtatatgttgttaaattttctataaatttgatcaaatttaaagaattttgacaaagaaaagtcaaaacgtcttataatataaaacaaagatagtatcaactaagcatatataaagataattataaacaattattattattttttcacgtccattctacctatgcaacctctatgggtggaaaagaaccgggttcatgagcggcaaacgagtcaagcccaagcctcgtccatgaacaaagccagagttggcttggcttgcgagcattggctgtcatgtagtattcacatttctcgtttgtagaatattattcacgtaacgcatattagtctcatcttttcatttatgcttatatttattagacaaaatttaaattttcaaccttaaatttaaattgattttaagatttttttttcatcataatttatttttcaacttttattggtagggaggaaagaaggcgatagtggtagcagctgccactgcctccatggtagaggtaacgttaccaaaacttttagtacaaaatttagagtaaaatgcataggcgggtcttaaacttgaaaagttatgtcatctagatctcctagctctcaaaatacggattcaggttccagaacttatctaagtgtatcatctaggtctcaaatcgacacagcctctctaggatcctacctgatgctatagatggccatatggcccatggcccacggcccggcccaaagcatggctgtttggcccggcccaagcatggcacggcccaactggggtcgtgcccgtgccggcccggcccgacagccgggccgtgcttgggccgcaccttcggcacgctgggccggcacggcacggcctggtcaaataaaaaaaatatagggctttaaaatagacttaaataatcatataaggcaaggcccaagataagaggtatacaaaatagacttattttccagccatttaaacacagcccacaaagttgagggaccaaaaatagactttttctgcgaggaggtatacaaaatagacttgttctccagcatttaaacacagccacaaagttgagggaccaaaaatagactttttctatgaggaagcacggtgcgccgtcgtgccttcgggccggcccggcatggcccgagtagtattgggccgtgcctgggccgcggatgctgcccatgggctggcacggcacggcccggtatgtcggtcgggccgtgccgacccgacaagccttggcccaggcacggccgtgcttgggccgagccgtgccgggcggcccatttggccatctatacctggtgctgatgtggcatgccacatggacgtgacatgtccttttcttttgtttttcttttttgttttcttcgcattcttcttttttgttcctttcttctgctcgggtcacagagaaaggagaagaaagaaaaaaagagaagaaggagaagaaaaagagaagcaaaaagatacactatcgccttcttccctccctacgataagttctggtatttggatatgtattttgagagtttaaaaacccagatgacacacccctacaagtttaaagaccgcccatacactttactctaaaatttaagtatctcgagatacttcctcaataaccataaaatttcttttcatataaaagcgaaaataaagcttgcatgtctcgactttcatgaacaaataactaaggcaacttaaccagaattcagtcatagacccccaatcttacgtgtcaacttctactccccaagagcaaatgcagtggcgtcgaaggtatcagacagcccggttcccgtcttgaaggtgaccttctccggcgaggcctcggcgacatagacctcgacaacgctgagccagagcagcagctccttggtcttcacgccggcgatcttcttcagcttccccttctcgacgaacgccgtgacctcgccggcgtaggacacggtctgcttgatcttcttgaaggtgtgctcgatcttcttcttcctctgcaccagccacatgaatcctgtttccttgttgtagccgaactcctcgatgtcctccaatggcaggaggcccttggggaggcccagctcttccagcagctcaatggacttcttcctgcagacgccgtctccggtgacaatctccgcgccggcacggtggctctcgatggcctgagacgccattgagatcgatagaatgtgtgatgaagcagagagacacgaattatatgttgtgtggaatgtttgatgtgggttgatgctgagatcgagttggttcttgtttgtgatgagtgcaaggcagcaggtgcaggttgcatatatagcagcggtgtgtgatggagttgatttgagtggagcgtggattgtttgaccgaaaatacatattactcgttttgttagcccagaagggaatttgtcaagcttttgtgctgttgcaggcagatatagtcttttatgagtataatacatatatagtggagtatacgccaaaattgacttcacatgggagggaggagaagaattggtgtacaaaattgactttaagttctggcttcagagtcacttttcacattttctgaagcgagtgtgcacggttacctacttgcctatcgacttgagctaccggcggcacgtaggcaggcagttctgttcatcacaacatatgttactaatccttgacagatgattgattagcatgcagattgtggagatcaatactggaagatgtcttcttggaaagccactgtttgaacttgccaatagtggccttgtttagattccaatttttttcttcaaactttcaacttttccgttacatcgaacttttctaaatacacaaacttctaacttttccgtcacatcatttcaatttctttaaacttttaattttggcgtggaactaaacacagccaataccaagaaaaaaatgtgttgtcagatacaggaaagtatggactgaaatattacaaggttggactagaaaatgtcccactcttgttcaagtacactgatgatcaaattcaaggatgctacgttgagcgacaacatcaaactaacgagcctaattaatagctgaaaaatgttgactgttacatggtcgtagtctcatttgtttcctgacccctaggctcatcatgcagacactagctcgtctctcaagcaggattgttgatttgaagcagtagcgcccgtgtagcaaaacaaatgatacaacgcattgactactccctccggtttcattttaatcgacgttttggacaataacatggtctacaagatatatctttgaccttatttttctactataatatatataataaataaatgcatgtttacttttattatagtgctttaaaatataaatatatatatgttgttctagttcctttaaattaaatatttttaaagttattgatgatcaaattataaaagtttgacctcaatcttgtccaaaacgtcaattaatatggaaccggagggagtagttgattagattaagttatttcgtgttcaaatacgagaactatttattccagtgtttggttggttcatggataatatataatgtggtactccatgcgaccagtccaagacttctatctattgcagttgcaggtaatcttgagtcctgaaaaggattaataacacagtaatatatcactctttttcagctgaatggatgatcttgttgaagcacaatattcatggtggcatttgcatttgttgcatatggagaagtttgatgcagcaccacattaaagtgttcccacttccaactgcactcaacaatgcaggtgtatttccccattcgattcaaaactttgtgcgtttgcaactgtttgccaggtgtgggcctagttagggcccaggagcaaaggcccacgaagaataatcggtgtggaccgcaaaaggcccgatccaatggcatacaaaacgccatacgggtacgaaacacatattttgacaatttgaacctttgcaaaaattaaggggccctttgaatcgaaggaatgagaaaacataggaataggaaaaacataagattttgataggaatgtaagtgtaaaacagaggattgcaaaacacaggaaaaacaaatgaatgaaatcctctaaaatttctatgaatttcctttgaatcaaagggggcctaattatacaacgagcaaatgaaccgtggccaaaacatatttcaaaaataacccttttcagcgctaaatcccatggcgctaaacttaaacacctcggcgccacatcaactggcgctgaatgtcgtgccactgtggatagaagtctgagttggcgtgccaactcacattcagcgccacgttatttggcactgaggtatctaacttcagtgtcatgggatttgacgctgaacaaaagggtcattttttaaataagttttagccacgatttatttgtataattagttttacaaagggtcaaattgtctaaatttgtggatacgaaacatccgcagccaaagccgagcgaaaccctccaaaaagccctagccctagccctcgccgccggcgagcatggcgccaccgccgctgcgcgttcgccgggcgctgatggacgaggccatagccggcgagatcctcgtccgcctccctcccgacgagccggagcgcctcgtccgcgcgtccctcgtatgcaagccttggcgccgcctcgtcaccgaccgcttcttcctcctccgctaccgcctcttccaccgcgcggcgttgtaacggagggagtagcttatattcttacccaacaacccagaagtcatatccatcgagatgccaagactgcagctcgttctccgtgttctggaacaccacctcgatgaactcgtgcaggctgagcctcaccaccggcgtccccgaccgcggcgccgcgccgggacgctgtcccagccgatgacattggcgatgttgtagttgtccacgagcttgagcggcgtgtcggggacgacgaacgacacgccgctgacggcgtaccggcgcggagctggcgagcatcagcgtcctcgacgtcgcgatggtgccgtagtggaacgacccctgcgggttgggcctcgccgcgctcgccgtcaggttccaccggaacgacatcgcctggtattatgctttattataatatcatgtattatgacggtgcctttaggttaatacaaaccgcaaccgttaataaggtgtctgttactatgagctactccagcagagttgattttatttttctttcggtaatagtatatactgcaggagtagttgaaaagtccgattctaattttggcaattggcatggattagagtttcaaatacggaaggccgcgtggttagacttaccgagtcggagagggaacggcaaccctatctagtcgtaagtaagatcgagagagaagaaaaaaaaaggaaaagaaaaagaaggaagagggttgaggaggaggaggagggaggtgatggcgatgatgcgatcggctttggcgagggtattccaccgctccgcctccggatcctgttctgctccagcgggggtgtgccgccgccggccggagatcatcgaccaggcgccgccactgccctccctccgccccgccgcgatgccgcacatgtctgtagccgccgccgctgcagctgcgcccactcgccgcctcctccaggtcttcttcgattcgcttgctcccctcgcaccttttctttttttaaaaaaaattattatatatatctatctatctatctatctaaaacgtaggataaatttctgatgcttggttcgcttgctaggttagtttcttgtacggccgcccggtcgaaaaatgttactaatttcgtgtaggtgtttcttttgattccagagtagggttttatgatcaatatgaggttaatttcgtgtaggtgtttcgtttgagcttttgatttcagaagaatagggtttatgatcaatccgactacaaattgattgcgagctttgtctacagtggaactttgctagtctatggcagatctcctgctgctttaacaagatctctagaaacaatgaaatgatgttctattattcactccattccaagtgcttctgcgtatacacaactagattggaggaacctggcaacgcagcacatgttttctaggggctgtagtggtattctgtggagctctagcttccattgcgtgccacctaataatttaggcaggtggcgtaacacccttcaacccattttccccttgatttccaaatggatgttacctggaagcactatattttgggctgctaatgtaacttctatcggtacatacttaaaaattttcatcagtctaattatgaaagcttttggatcattgctagagaccacagtccacaaatcggttcaattcatttttctcttcccttgctgtttttctcagtttctctattagtgtattgggaatcgggactaaactagtgtttttttcaatattttctataacataggttgaggtaggaaagatagatagaagcaacacttttgttgtggcatcatgatatatttaagagtaaattgcaacttgggctcggtattattaccaaagtttcactttagactagggtacaaccaatattttcactttgggctaagggacatggcttttgtttcagtttagacctcctcaatctttcttgtccgctcctagctcctcaccaccgcagctatatccaggccatgtgttctcatcctctagtctagagtctagacgcaatgacaactcaatgaggaatgtgcccatggtgagcaggtgaggtccatctgtgcacaaccgatcaaactccatctgcttcctcctagaactttgctccttgcttcctcttccttcacctgtgctgttgctcttcacaccttgcggcagcagcaacagcttcatggtgtcggcgatggtaggatgtgcaggcagtgcccagccgggtggtgggaaaggtggcacaatgtgcaacagaaggaaagaaactctagcccaaagtgaaaaaattggttatgcccttgaacaaagtgaaaatttggtaactaaatctgtcccggtatacaatttactctatatttaattcagtaaggctggctgctaagatagtcctgtgatgcgtatgctggctccgcaatttttatttcttctgatgattgggtttaagtaaataattttgtgtaacaatcaagctctgtttgctatgattacgtgttacccttagcagtattgaccagagtgcacttgctggcagggaccgcgacaattcctcgtcatctctgaagcaaccgagggtgtgaagtgggcagggcagaagaggttcttctccatggaaaggaatgctaatggttttaagcttatggaatcagcaaggtgagttaaggatatatataggatgtaattaacaacacacttccttgtaacctatgcaatatttatgcacattgtgcttcatattgctcaacgaaccgtgcttctgctttatgcacttaggttgttgctagctagtcttaaaaccgatctgatcttcgtgcttgccccgctatgctaattactactactagtattttctttttacaagaacggatatgaggtctcaatgtcttcgatttagaatgcttagctcttttattctaccattgatacaattagcgtgatactaattagggtccctactacttaacatgcatggtaataaagctaaccatgcgatgcaattgcttttttctttttctaatcttgtgtaggctggcagtcaagaagatcaaggcattgggtaatgcaaggatcgagattgatccacggaatgagttctatgttgtagcagtagcaactgcgatatctctttggctgatgtcaagacaatatcgaagccttggcgaccccacatttcctggtggcagcatgaaaaagcttcaggcttggaagcgtgtttctaaacttaactctgggaaatctaataatgctgatgagtgatgtcgatggcactcttgatggagggtaatctttgctgcaatatgcgtggtagagttggtcgtatttattagttaagtcagtaaagaacatgtagtagagtgactggtattgtaattttatttatatgaatatttactgtgccttcttctcgtactagttgactagctaaactgaatgaagaacttatccagttggccccttgtccatgtgaaaaattccatacaatggcctgttaatggttgttttgccggatcagccaaagaaatataggctgaccaaattttattaggattgagaaattttacagattacaagttgagaaaaacatggacaagaagttgttcgtgctatgcagcaatatgtattatcttcgagaagtgagaattaatgccaacctgatctgtaatttccggccgcctcctcatgggatcctcggcagccgcatcatcggagttaaaatttaactcgcagatttactcagaagttaaaattttaatggagttaaattttaactcgtgatgacatggacgaatcttagccgttggatttgttttgcaggatcaagatctaccttatatcacattatgacatgtctaccctgtatcacccagtctgaatcttatgggttgttcctcggcagtgagggaaacggccggagcagatggatggaggcttgtacgatgagaccgagggccgacgagcactcgggcaagcggcgggtatgttcgtgcctgtgccagctgcggcacaataaatcaaaaaaaattacagattagtgattacacaacaggaaagagagagagaatgcaagataaatcaaaaaaaattacagattagtgattatgtatcagcaatcaaactgacaagccttatcgatccagaaaggacgagttacatctaaaaacaaaaccaatttttgacaactgctccgtttgaaccctcttgcagaacctactagtctatcaaacaaaatatcattacaagtcctggcttaaatcaatggatcgagttcttgaaaatgagatcaaacatgtaaaatagatcaaataggataagagcagttgcagaaaactcaaatgcacaagagaagaccatgcccaaccatgatctacctccttaattacctcacgggcacaaaccaccaatctgataagcataaaaaaatattatttttagataagcatcaagtagtaaacatgatgaacaaaaaaaattatattatatgggtaacgatagatggatacatgatccgctaatgaattgaaatcaaatcccccataaagaagacacttccggaactagtacaggtttcttatcttatctcaaaggtgcttatcaccattttctctcctcaatcaggaagagagaagaagctagagaaccaaacaaagggtcatcggcctgaagaagctcttccccgcactccgccatggccgcgccgatgtagacctgattggcttcctcgccgacggagcacatgccgccattttcgttgagattttcatcgaagaaactgaagaatgtcctgatgagaaattcaagaaatcgaaatcggagatggcagcgttgaacagagcaaatcttggcgtgttcatgatcgagctcaaatcggagcaggtgaagaaggtagcggagggtggtagattctacaccatcttcccatacatgagcttctgtacaccaggtatctcatcttgttctatataatcgcataagatactacccgtatttaaatatggcgctgttagcttttgaacatatgctttgcctatttattctattcaaaaattttatgcaaatacgtaagaatataggctatgtttaaaatacctttgatgataacacaaccaaataaacgatatttagaattttttttaataagacgaagctgtggtggagccaccgcccggctagcccaggcagccacccaggctcgcctgtgaaaactccacaaaattttaatattgatgagtaaattgacgatgaaatttgtacagtaaatactgttatattgaagtttgctcagactaaaaaaatctttctggctctgccaactgagacgaagaatatgtcataacaaaataaatgatatttagatatttttaataagacgaatgaccaaacacatgtttaaaagtcaataatgttatatatttagaaatgaatcctataaggctacaagtacaccaattttcagtttgctcgagaaaaatgtgcattgggtatatatgtatttggatcatgggatcggatggaattaatggtgtcatcgaagcacctgctgtttaatttgttaagacaacattctatggtcttctttattgcccattgtgagcgcacaccgaagtagctctagttaacctaggtacttattgatctgtctgtacatttatcttgagctatatcatcgttgtcctcctaagtttttactcgttgtgtgtatttgtagatcttgcaggaggtagcagacaaccatagccagctcttctcagtatcttctaacgagccacttaatgagagtggcttcacctggataattcatgattagtctgcaggagtttcttcttgcctagttgatgccattaaggtgttcagtcatcgtgttgaattgtgtttatttttaattcgttgtgatcttggcttcatattcaggtcatgcttaacgcaacatgcatggaacttaaattattctgaactttggtccattgttttatcctgaattgtgaatccatgggtgttcaatttttccctattgtctgttttattccttttatgacttacatggtccagtttcagtgagaagcttgcaacttctcattatatgaagctcttgttgctgcagatagttctatagatcgttagtgattgctcctactatgtaatttagttgtaaagaatcttttatttctgaactgaacatttgaatatggctcttctctacactggcaatatggtatgggagaagggattcacagaacaaagtcaaggagaaggagccatcagcgtcagttcagaaatcagaagctagcagaaactattcccctcttcagtgtagctagcagaaactattcccctctccagtgtcctttctaccaaaatttgcatcagttttgcccaagcgctcgctcgattcatgtgattgagtttgaaatagtatactgaatctataatggttttttttacccatgtagtaaggcacaatagttgctgctgatactgtcgtaaaaacatcactgaatagcataataatagattgatgcggcatcagaaacagagcactctgcaccattaagcctgaggccttgtccacaggctacaaactcaagagaaaaacactgacatatgatcaaagaatagcacatcagttttagctacaacaaacatatatccgaaatcgtaattctgaattctcatcttcactttcacctatagtagtagtagtatgacttattctactagacatataccaaacgacgaaggatggatcgaactatgcaactctgaatttcttcttcatcatcttcctcagtgtccaaggccggcagctctaccgcagagtatggcgttggtcgggatactgtactcattggagaagctctgctgcggcgtccacactctcatgtacagctgctggccgaggtattgccggtcccagttcgccgacctcaggttccacatcccctggttgtccaatgacaccaagattgccgaccatccattcgggtaaacctgatgaaacgaacatcgtcaatgttcagaattcagacttcagagttaactgttcttcaaatgcattggaatgttcagacttcagaattaactcttcttcaaattggttaggaatgttcagaattcagactaaggagttaattgttcttcaaattggttaggaatgttcagaattcagacttcagagctaagtgttcttcaaattgattaggaatgttcagattcagaattaattgttcttcaaattgattaggaatgttcagacttcagagttaattgttattcaaatccattaggaattttcagatttcagaatttctttttttttagataacagaccacccatgtggcccagcttttataacaaagccaaagcatgctttctgaattaactgttcttcagaagttcagattcattacgagtatgtcaacacatacctgaactgtatgcctcgcttgcgcatcaaccaagttgtaggttgtccgctgattctcagtccactgaccattgccatacctgaatccatttatcagagaaagaaatcatcaaaggtgaatgaacagatctttctcatgttgatgttcatctgagaattgatgcaactgaaaatctgaaagtttcagtggttgatgggaatgtagcttacccaacaacccagaagtcatatccatcgagatgccaagactgcagctcgttctccgtgttctggaacaccacctcgatgaactcgtgcaggttgagcctcaccaccggcgtccccgaccgcggcgccgcgccgtcgggcctcgccgggacgctgtcccagccgatgacattggcgatgttgtagttgtccacgagcttgagcggcgtgtcggggacgacgaacgacacgccgttgacggcgtaccggcgctgcccggcgagcaccggcgcggagttggcgagcaccagcgtcctcgacgtcgcgatggtgccgtagtggaacgacccctgcgggttgggcctcgccgcgctcgccgtcaggttccaccggaacgacctcgcctggttcatcgaccactccgcctgctccggcggcggcgccgggagcgggccgggcgccctggacacggcgctgctgtagtgcagcgtccccgtcgccatcagcggcgacgcgcccgggctgaaccgcgcggacgccacgacggcgtagtcctgcgccgccttgtcgagcgtgacgaggaacgccaccgactggccgacatggacgtcgagcgagtcgtacacgttctgcaccgggtgcgtcccctccacctccaccaacctcagcgagtgcccctggatcctgacattgacggacgtcttcaccccgacattggacaccctgaacaggtacgtcctcccctggtcgccgacgaacgccgccgccgacggcatgccattgatgagcagcgcgtcgggcggcgggagcgcgccaccgccgccggcgtcgagcgcctgcctcagctgcttatgcccggccttgtaccagtcgccgacgaggagcgtgaagtcgccggcgggcggcgggtacgggacggggatggccgggcgctggtagacgttgagcgcgccgaagccgccggcggcgcggtgcatggcgacggaggggaagtagacgaaggtgccgatctggtccttggcctggaacttgtaggtgtagttggcgccaggggggattgggcagttggtgcccagcacgccgtcctgccacgagttcttgcgctgcttgatgccattccatgtcaggaggaacggctcgtccaggttgttgaacacgttcacgatgatgttgtcgttcgtcacgcagtcgattcgcggcccaggaaactggccattgatcaagatgcccttcgattcgattcaaccaagcaaccaaatcaattatcagagagagagaatgacagaattcaagaactgcatctgcatttgcaagaagaagaagaagaacatctagtggcgttgtcagtcacctgctgcggggtggagccgagagggttgatgctgccgtaggtgacgttccaggtgaagaagcggtaggggtcgtcggcgccggcgagggtggcggcgacggcga

SEQ ID NO: 73958 - DNA, 3205 bp, Oryza sativa
aaaattacggaacaaatcacacgacaatatctcctaaactctcaagatgacattctctcgttgtttagaagtcaactaaatagttatgaaaatttttttaaaaaaaattaacaagactgattattatgataaatcactctacaaatatacaagttaaaatttaacttctacaagttccaacagaaaaaacaaattaaactatgactagttaacgtatattcgtaattaatttttttattgcagaagttaaatttgaccatgtttatgaagtggtttatcatatattaatctatcttgttgaatttttttaaaaaaaatcataactaattgggtaacatgcaaacaccgagagaaaatcctgtcaagagtttaaaatagttttgcaatctctatcctttctatacgcaagctatctttgcgacgaatattagccatttagcattatcaaattttagtagggcagagaaccggaagttcgagatattcgcacgtctgcttcagctggttgtggacaaagaggtgactccgtgactccccgtcgtccgcttgtcctattgaagtattgatgatagagcttgatgactgatgagtgaacgacatcggctgaactcgcagaagaattctctaacgccgacgatccagtcataatcagtgcggaaactttaagctttctgctcttataacccactgtcgatctggccatttgtacaaacgaagggacgggtgtgtaaagttttggcattgtcacatcaggtattatgtaggatgtcgcatgagatgtttgggcactaataaaaaaactactccctccgtattttaatgtatgacaccgttgactttataaccaagatttgaccactcgtcttattcataatttttatgcaaatataaaaatacttatgtcatgcttaaagaacatttaatgataaatcaagtcacaataaaataaattataattacataaatttttttaataagacgaaagatcaaacgtttgtcaaaaagtcaacggcgtcatacatataatatggagggagtaattacagaatccgccagtaaaccccgagacgaatttattaaggctaattaatctattattagtaaatgtttattgtagcactacattgtcaaatctagagcaattaggcttaaaagattcgtctcgcaaattagtcgcaatctgtgcaattaattattttttagccaagactacctctatcccatattacttgttgcttggacttttttcttacaacatttgaccattcattttatttgaaaaattagtgcaagcacaaaaataataagtcaaactcacagtgcttttgataatagagcaagtcgcactcaaaataaataatacttccaaaatttttttgaataagacgaatgatcaaacactacaaacaaaaactcaaagcagcaaataatatgggacggaggtagtatttaatacttcatgcaggtattcaaacattcaatgtgacagggtaaaaaacgttcgatgcgatggggtgaaaatttttgggatgggatctaaggtgtgtttaggctgtgtttagttcctgaaattggagaaaagtttggggaaagttgagagtttatgtgtgtagaaaagttttggatgtgatgtgatgtgatgaaaaattgagagttgggggaagtttggtgtgaactaaacagggccttagtttacgccaaaattaaaagtttgattgaattagaacaatgtgacggagaagttggaagtttgtgcgtagtaaaattttaatataatagaaaagttgaaaagtttaaaaaaaaaagttgggactaaacgaggccctaagcagccccgaaaaagagagaacatctctctttatgtcagaaccatggtgcattcagcagcaatcttcctgagggcatgtgcatcactgattcactgtcaccggctggcatgcgtggtggctgtttcgcttgtgaggctgttcgtgtgccaaactttttttaaatatacgaatacaagtaataaatatagactaataataaaataaattacagattccgcctgtaaactgcgagatgaatttattaagtttaattaatttatcattagcaaatgtttattgtaacatcacattattaaattatggcgtaattaggctcaaacgattcgtctcgtaatttacagttaaactgttcaattgatttttttgtctacatttaatacttaatacatgtgttcaaacattcggggctactttggtttgtgacctaaattggccttaccaatttttggcaatgccaaattttggcaagttttgatacgaaaaattttgagaaggcaaagttgtgtttggattgaagccaaaatagcctaagttaactattgaaatagcctattttcttaggcatgccaaaatttagcttcaaatcaaatagacactaaatactattaaaattgtcaaattttggggttaaaaaaggggccaaattaggccttagaccaaaccagtccttgattttacggaaaagttgtgtgtagctgcctgcagtgcaagtgattggtttgtcagaagtcatcaagtcaaagtcttctccaccaataatgtaattgtcattgtcactgtaactgtagttgcagtggcccacctagactattccacttctagaaggatttattttagtgcttaatacttttatcgtaaataaacaaattaaacacgaaaagtaacacatcatgctactgtaagtttggataggctaatatgtgttacagtacatctgtattacatctgtgtttagttccacgctaaaattaaaagtttaaaaaaattagaatgatgtgacagaaaagttgaaagtttatgtgtgtagaaaagttcgatttaacggaaaaattagaagtttgaagaaaaaaaagttaaaatctgaacagagcctatgtttgttcattttaaagagagggagtattaattattgtttgttcattttaaaacagagagagtattgattattgtagggtctacttggaatacatacagcattacttctacttctatgtacagcatgggcaactggcattggtcaccattgacctatttttatattaataaagcactaaaataactagaaaaaaggtgatgctgcaaaaagtattgcccaatggtacataacggtccatatagattattacgaagtactagtggcccggcgaaaaacgaag

SEQ ID NO: 73959 - DNA, 16459 bp, Oryza sativa
acctccccgttccaccccacggttgatctcacctccatccccgccaccaccgagttccccgccgccaccagcccttccccaaacccaccgccgcccatggagctcccttcgccttcctccccttcattgccggtgccgcaccgctgcgcctggctgcgccgctccctcctctctcgccggcagccggccaccgcgtgccgctgcctctccgtcgccgggagagaggagaggagagatagatgaagaggggagatgtggagagaggaggaagaagaggagggtgagttggactgacatgtggggcccacatggatcccactatttttttattattttatgtgtgagactgacatgtggggccacatgggtcccacaactttttttattattttgtatgtgagaccgacatgtgggtcccgaggattttattatttttccggctcgaattgccacgtaagcgccacgtcagtaccacgtcagatgaagaccgagtcaaattagccacgtaggcgccacgtcagccaaaaccgccctcaaaaccgtcgagggacctaatctgcactggttttgatagttgagggacttgttgtgtctggttttctggttgagggacgaaaatcggattcgttgataagttaagggacctcaaatgaacttattccttttcctggcagcatgctggcctgggcctgagtttgaatcctttgaatgtaggttttctcaccattttctagccttaaatttagagttgattttgagattttttcatcatactttatttttcagtctttacttttagatcgctaagaacacacatataaaagttttatttaccaattttttttcgtttgcaactatgtcgtttcgcttattccgtcaataaacgaaacgatggcctcgagacatttttttacttgaaggcacatgcacgaatctttaaataataacgaatctttaaataataacgctgtcagcaaatcgacttatttttaacgaaaatttcaacagatatatagcaattcaaatgtgacggttaggcaacgatatgttgcatatgcttgttcaaactcagcttgatccaagaaagtccaaaaactttgagaaggccagagaaagcctcaagaaacctaagggcatgttcaatacgtgcccctggagagtatccctagcccttcgtcgacggccgtttgctttttcgtccgcggcgtcccccgcaatggaacgtatccctctgctgggggacgagactctcttcgtgcctcgccagcttttcgtggggagtcacagccaggcgccgcgttgagcatgtgtggagctcgtgggcacggcgtcgttcccccaaattttcctttgcaccctcgcctcactctcgctctcccctcggtctcattgtgccgcgcctccttctctgcctcgccatccgccgtcactggggtcggagccagatgcatctcccccgctagatccatccgcaccgccaccaaccgatgcgcccaatgagcttgacgaggagctgcggggttgaggggtcggcgccgcgcccaccattgctggcaccgccatcgtctccatcccaatctggccgcgggaggaccaaatccgctagctttggcgctagatctgctgccctcggctggcgacggcgtgaggcggaggaggccgggaaggacaacgacaacagagagagggagagagagcggtggagctcgcccgccatcagtcaaccacgctcgccgtcggccaccccgcgcatcgcttgccgtccgccaccgcgctcggcaccggcgaggtggatggtgatgagcggcggggaagagagggggagatcgacgacgaatggtggcaggagagagagagaggcctaggagagactgacggatctggtgaggcaccggtgagacggacggcgacgagcggcggtgggctggcgacggcgtggagtagagagggagaaatcaacggagtggaggagaggagacgagaagagacgaggagaggggaggaagaaaagaggagcacgccggtgggctgatgggcaagcagggaggggtactttcagaacttttcacttaggactaccttgggccgggacacccattgtgggctaaagtatcttcatcaaatggcctcagattttgaagaactcattaggggtgtcctctattgagagatgagtttcctaaatagtgtctttagttagtgagggcactttaggagtggctttggttgtataaccttaataaagcctggcctagaccaagaaaggcaagcttttttatgtcaattcaaacctacattttctggttccctcatctcttggccttagccaaatagaatcaatttagtcctaaattcaggtatatcagctcctctaaatattaaaaccagtacaaaacgactctctcggtgtcaagctctccaccactagcccgcaattctgcatgggcatcgaactcggctcctcatggaaccctgccacggctccgtccgggcgtccccgccgggcggccgccgggacgaccccacgcccgcgcctaagctgctccgggagatgcagccggcgctcaagcccatcgaacggttccggtggtcgcgtgcgcctattgcggcggtgcacggcggtgcaggccggcggcgtcgagatcgtggccgcctgcgacatgcagtgctgctctccaaggacactacgtttgtgctcaaggtggtagacatggccatcgatcgtcgccgtcgtcggcctccaatggcgggaaagcttggctgtacaagacggccccgagctagccggctagtgcacggatatataacttctcccagttcttcacctgcttaaccatgtgttgcacaccatgtgctcgagcacgctggcgatcgatgctcctgaaccggatggatgtcaagtgaaaaaggattgcttcgtttggtcgcgtctccgtatagaaatggcaattttcggttcactcggtgtatgatgcgattgtgaactctagtgtgacggtccgcaagaggatctcttatataggaggttgaaggtgccactgaaaatcatagtatttatctagttgtttcatatcaaaataattctaacaaaggataaccttgcgaaaaagagttgcgaggtgataagcaatgttgttttttagtgtgcaagagacaaccaacccatattctttgaatataacatagcacgtttttctcggggatgtgtattctttgctttcaatattactagttgtggagattatggataccccatatcaacataacagttataatttagtcggatatacggtaccaaatatagatagaatatctttatgaggactcgggttagtttctaacttgtatgtcaaggaaatacccgagatcttagtcggttacgattgtattttatttgtaatcgcatattccgttagggatatggactgtattttgtaatacggatcccttcccctatataaggaggggtctgggttcctctcgggacgattctctttttcccaaatcatacgatcaataacatactcggcggaatcatccccggacaggagtagggtattacttcttgaataagaaggcctgaacctgtataaaattccttgtctccaaacccatccacttttctagcttgatagccacccccttttagtattgtcgaaatcttgtttcgacagttggcgcgccaggtaggggtagcatcaagttcttcgccgattagtgcgatgggttccctctccggcatcgacgacctcgtcttccccccgggcaggcgtttcggttcagcagcctcgacttcatcaccaacgacttcggcaagatctctctcctcgactcggatccaaaccagtcgggagagaaccaggtttcagccccattcggtattccgaactcggccaagatctgctccaagcttatctcgatcgagttggcttcaaaccactcgaacgagatccaatatacttcaacttcaccagatcaaaatgatggggcctacccgccaatcctgatgaaactccacgacgatttggctgccgtcttcactacaagggcgtcttctccccgtaggcctaggcggaagtcggcctcaacaccgatcccgcctagctccagggaagtcggcgtcatactccagccactcagcacgatttcgacggatcaactcgaagtctaccttagctcccccggcgtcgactcacgaccaatagagatcgtggaatacgacgaattcggctaccgctatgacaaccacaacctcgatgacttcgacgagagctttgaagacaattacacccctctctacttcggcgtcttcatggccgacaacgagacggaagaacaacgccaagcccgagaagcagaagcacgtgtacagtaggaagccgagcgacgccgactggaagaggagcgccaagcgcaagaacaagaacggctgcggtgagagcaacaagaacacgaacgggctgcaaaggaggccgaagaccgacgacaacgagccttggacgcagggcaacaagcacgagatcttatcgggcaacaagacgttgaggggacagcggtcttccgcaccccccaacagaacgccgtcgccgcgatcacccttctcgacaccctcctcaaggaagacgcactcaaccaagccgatcacgtcgtcaacattttgaaccagaccaagaccatgatcgccgcttcagttccggttaactccggcagcgttcgcacgccgactggtagccgggttccctatctccgatctcatgattatcatcagccaagcctcagcatcatcggcacaggatccaatcgcaggagcaggggccacgacgaacgatctgttcactcgcgtcccgaacgtcacagggaacgccgagtcgaacggcctcgctctccacctcgccagcgtcccgtcgatcttcgcgacatgatcaaccagcgccgtgcagcatgaggtcaccgccattcaccagatcgctacgacgacgacgtggatggagtagctgccttcactaatgacctgcgtcgagtggattggccagccggcttcaagccgactggaatcgagaagtatgatggcaccactaatccggagtcttggctcaccgtctatggactcgcaatccgcgcagcaggaggagacagcaaagccatggcaaactatctacctgtggccctagcggattccgcccgatcctggctccatggactaccccgtggcacgatcggatcatgggcggaacttcatgatcacttcatcgccaacttccagggcaccttcgaacgccccggcacacagtttgatctctacaacgtcattcagaagactggaaaatcccttcgagattacatccgatgcttctccgagcagcgcaacaagatctccgacatcaccgacgacgtcatcattgctgcctttactaaaggcattcaccacgaggacctagtcggcaagttcagacgcaaatctcccaagacggttaagcagatatttgaaaaagccaacgagtatgccaaagccgaagatgctattattgcgtccaaacagtcgggcaccacttggaaaccgaagaaagacatgccggccgcaggagagaggggaagtaacaatcgcaaggatcgcaagcgtaagcccgaagaacttgtggcgacaactactccatcttcccgacaacgttcccgcgtcaacaccttcgacaagataatgaactcccagtgtccgcatcatcccaactccaaccatgtggccaaagattgcttcgtctacaagcaatttgcggaacaatatgccaagaacgcacataagctttcagacggagatcaaggcacatcaaagaagaaagatgacgaagacgatgccccgactggttttcaggacttttgcaaggagcttaatcacatctttggcggacccctagcttacgaatctaagagaaagcagaaactaaccgaacgggagatcaacgcagttcagcccaacacgccccaataccttcgatggtcagagatagcaattaagttcgaccgctcggatcatcccgaccgagtggtccacccgggccggtaccccctggtactagacccagtggcttgcaacgtcaagctccgaagaaccctcatcgatggtggcagtgcgctcaacatccttttcgccaagaccctggacgatatgcagatccctcgtacggaattaaagccgagtaatgcaccctttcacggtgtcatcccaggattatctgctacaccactcggccagatcactcttccggttactttcagtactcgggagaattttcgcacagaaaacgtttgtttcgaagttgctgatttcgagacagcgtaacatgctatactcgaacgaccagccctagccaaattcatacctgtccacactacacctacatgatgatgaagatgcctggtccttgaggagtcatatccctacggagcgacatcaagcaagccgtcacatgtgataaagaaagttgcgagatggcccagacccgcgagatcacactcgcccaagaagagatccgactggctgcaaccatggcaagcgaaggagaagtgcccgcaaccaagatgcccaaaagcggagaaagcgatgccaagaccaaaaagattcctttagatccctctgatcctaataagattgctgtaataggcgctgagttagattgtaaataggaaagcgcgctcatcacctttcttcaaaataataaagatatctttgcatggaaaccatccgatatgcctggtattcctagagaggtgattgagcactctttacatgttaaggaagacgccaaactcatcaagcaacgactctgccgttttgcacaggacaggaaggatgcgatcatggaggaattaaccaagctgttagcagcgggcttcattaaagaagtcctttatcctgactggctggctaacccagtcctggttcggaaaaagacggggcaatgacgcatgtgtgtcgattataccgacctcaacaagtcttgtcccaaagatccttttgggttactcgcattgaccaggtagttgactcaacggccggctgcgagctactcagttttttggattgctactcgggatatcatcagatccgactaaaagaatccgactgcttgaagacctcatttattacgcctttcggggcctactgctacatcaccatgccctttggattgaagaacgcaggagcaacctaccaacgcatgattcagaggtgtttttcaactcagatcggccgcaatgttgaagcttatgttgatgatgtagtcgtcaagaccaggcagaaggatgatttgattacggatctcgaagaaactttcacgagcatccgcgctttcaggatgaaactaaaccctgacaaatgcgtcttcggagtaccgtcagggaagctgcttggatttatggtgtctcacagaggcatacaagccaacccggagaaagttaatgccatcctcaacatgaaactgccgagctctcagaaagatgtccagaagctgactggatgcatggcggcgctcagccggtttgtctcacgactcggtgagcgggggatgcctttctttaaactgttaaagaaaacagacaatttccagtggggacccgaagcacagaaagcctttgaagatttcaagaaacttctcactactccaccagttttggcctcgccacacccacaggagccgttgttactatatgtctcggccacccctcaggtcgtgagtgcggtcctggttgtcgagcgagaagaagaaggccatgttcagaaagtccagcgaccgatctacttcgttagtgaagttttggctgactccaagacaagatatcctcaagttcagaagctgttgtacggtgtcttgatcaccgtcaggaaattatcccactacttccaaggtcactcggtcacggtggttacatcgtttccactcggggatatacttcataaccgcgaggcaaatggacgaatcgcaaagtgggccttagaactgatgtcctttgatatatccttcaagccacgaacttcgatcaagtcccaagctttagccgactttgtcgccgagtagaccgagtgccaagaggacacgcccgaggaaaagatggagtattggactatgcactttgacgggtcgaagagactttcaggcactggagccggagttgttttaatttccccaactggagaaagactgagttatgtgctgtggatacatttttccgcatcacacaatgtggcggaatacgaggcgctccttcacggactacgaatcgcaatctctttgggcatctggcgactgatcgttcgtggagattcccagttggttgttaaccaagtcatgaaagagtggtcctgccttgacgataacatgactgcttatcgacaggaagtacgcaagttggaagacagattcgatggactcgaactcacccacgttcttcgacacaacaacgaggcagccgacagattggataatttcggttcaaagcgagaagcagctccttctgacgtattcgtcgaacatgtttatgagccgactgtaccaagtaaagaaataatcaaggctacggacacccaagatgtaagcatgattgaagccgactggagagagcccctcataagatttttaaccaaacaagaactccctccagataaagatgaagctgagcggatttccaggcgcagcagactttacattattcatgagactgagctgtacaagaaaagtccaacaggaatactgcagcgctgtgtgtctttggaggaagggagacaattgttgaaggatatacactctggtatttgtggtaatcatgctgccgcacggaccattgtcggcaaagcttaccggcaaggttttttttggcctacagctgtgtctgatgctgacaagattgtgcggacatgcgaaggttgtcaattttttgccagacaaattcatctgccagcccaagagttgcaaaccatcccgttgtcctagccgtttgcggtctaggggcttgacatggtcggcccgtttaaaagggcagtcggcggttacacgcatctctttgtggctatcgacaaattctccaagtggattgaagctaaaccggtcatcacgatcacagcagataaagctagagattttttcatcaacattgtgcatcggtttggggtacctaatcggattatcactgataatggcactcaattcactggaggagtgtttaaagatttttgtgaagattttggcatcaaaatttgctatgcctccgtagcgcaccctatgagtaatagacaggttgaacgagccaacggcatgctactccaaggaataaaggcatgagtttttgatcgattgaatccctatgccagcaaatgggtggaacagctgccatccatactctggtccttacgcaccactcccagtcgggctacaggccagtcgccgttcttcctggtttatggagcagaggcaatgttgcctagcaaggtagaatttgaatctttgcgtttccgcaactttcgtgaggagcgctatggagaagaccgagtagatgatctacaccgactggaagaggcccgtgaagcagccctaattcagtcggcccgatatttgcaagggttgcgtcgttatcataaccgtaacgtcttattacgagctttcttagtcggagacctggttttgaggaaaattcaaactacacaggatcgacacaagttatctcctttatgggaagggtcgtgtataatctctgaagtaacccggccaggttcttatcgactaaagcgtgaagacggtacacctgtcgacaattcttggaatatagaacatcttcgtcgtttttatgcctaagttcatttctctatttccctgttttgaccgacaacatcaagctttcccttgaagttatctgtcgggggctattatgataataatggagtgtgatttttatcaattcaatttgcttacttgatttatcattgccctgcttggtctttcaacttagtcaatgaggactgaaggtttttaatagcttttgcgggttttaggttcaataaggcttgacaaaggcttttaagaaatcagaagctaagtatggaataccaagcgtagcataaattcatcagtattgtacaaattgtgcctccatcatcattaatcatcaaaatcattgttatatcaaccagtatcagtcttttcatcatcagaattaccaggaccagtcggtcggagatcgatgtcctgaaatctttcaactacatcgattgctatcttatcggcagatttttgcgcaccactgatgaggtcaagagcagcttcttcgctcgtcccgtctgcaaagccatcaatggcatcaatgtcaactcttggataaagggatttggtcatcgccaacgccagacttgctcccatacttccagcttctttgatgttcttgaaatatgtatccggagcaactctcagcttgtcgaagatttcagaagcattaagtgtactcgagccattgttattgaagaacatcgcttgaacaagtggggtagcagcgttagcgacttcatcccgagctccttcaagttttttgatcttgccaaccaggacgtcgaattgagcccgcgacttgatcttgcggtctgcatcaacagattcacattaataagtcagcatatggaagataatggcttttgaggtattgattattggtaccttcaacctcctttaaagccaagtccctctgtcttgccagttctgccttgtcattttctagagtttgaatctacttctccagttgagatatcttggcagcttgcactacattaactctggttaatcaagattacaaagataacaacacaagttagttgggcagagcttgtgcgtaccttttgatgagccgctcagttcaaaattggattcctggagctcagcaatccgatccctcagatcatgttcattcttcctggcaagttcttttgtttcgtgcagttgattcctggtggcttcgagggttctgagatgagggactaacctctctaaggctgtcgttttagctttgttcctaagatgaatcctctacaagacagtttaattagcgcttgaactaaacaacagacgaaatggttgagatcaggcgccaaagagcttacatttacaatgcaggttgcctgaccaagtgcctttttcagtaggcataactcttcgtcctctttttgcttgtttattacgattccttgaggctgcatgttgtcatcctaccacttgactagaatgggagggcgcgaatcctcagctgctcgtatccggaggatttcttcttcctcaccaattattggccctagtgtatccatgaataaagatgaagcaatcaaataaagtctgttggatcgtaatgatttcagatagcgtgtttacctgtgatgattcccggtcggggacgagtagactcttgtgtcttcgcaggagatctgatttctgagtcattgccagcacccttcccgggaggactgtttgtttgagcttcaacctcgggaatcttttggcttggccctgtatccgattggtttccagtcgggggctcctggttaactccgactccagcttcggccgactggcttgcagtcgtgggttcgtcgctgggttctacattgtcgctggcttgcggattatcactcgggtgatcttttgcagacggcccggtttcttttgaggaatctgcttccaagttagttgggtcagagtctttctcagaaggatctatgtcagatggtttcctacaagttttgccatcagtgttattttcatgatgggagaatattgatacaaggaagattgttatatgatttgtacctggaagactttctgatttttgggaaaggacgactggaggttttcttcttcggattagttggcttcggaggttttccggtcgttcctttatctttgagctttccggtatcatcgccttcatcgtcacttggaaccagcttcctcttgcgagaatctgactggccgactggatcagaagcacttggttgggtttcagaccgaattcttggtcccccgcttccctgaccagtttggcggtgaggtgattggtgctgggcgattggaggatttgacttcatcaatgcgaactcctgagcataaatgtcgagcaattcaacaagagacgaaatcatgtttttgaggaaggttggaacgttagaatacataccggtggaggaggattgaatgcattgaacggtacgactggcagcaagtgtgaatagctgacaacgatagcatttgagaagatcttatacatcctttccttcatgaccttgaagtcaagagaatctggatcttcacggtttgggtcatgcttgccgtcaaattcgaaggctgtgcgagatctctctttgattggagctaaccgacacttgataaagtgctgggtgatctgttctccttgaaggccttgttcttttagctttatcatcctctccatcagttccactgcttgcgcagcttcatctcccattgccagtgagttccaagtatcccgataaactggaggaagacaggagtactcgggaagagcaggctcagggttttgaacataaaaccaatttgcgtgctagcctttgtttgaggttttgaagggcatagagaagtatttttggcttaaggttcccctgagttggaaaccagccccccccccccaacaacacatggtttgctcttgtttggctgaggcttaaggaaaaagatgcggtggaacaaggcgaaatgtggcctaatacctaaaaaggcttcacaggcatgaataaaattggcgatgtgaactatggagtttgggttcagatgatgcaggctaattccatagaaattcagaattccccgaaaaaatcttgaggttggaagggagaaaccgccatagaagaaatgagcaaataccacgacttcatgcgtatcgggggtcgggaatgcttcaccgaatgccggtcaccactcgatgatctccttcatcggaagaacgccatgcgccaccatctccttcagattatcttccgtcacatcggagggcgcccactgactctcgaagctttctctttcttccgccatgaatgtgaactggatggtttaatttggtccgagatatggctggaaagagatggagaatcggagcagtggacgtggggggaaatttcgtgaagtttttaaggatggattggagtggattgatgaaccctagttttgccggcacagttttgtactgtagcaggaaatggggaaaatggcgagagtctcggcggggaagacgaagagacgtttcattttacttcggtgttattagggtatcaggagtactaatgggcttgggcctaaacacagtatttcggcccaattttattttcagcatgacccgttgtgatccctagggatttaggcgctttttgctttggcaatttgtgctcacaatgatgtggcccaatgctgttaaaatccttttaatgcggtttgataattctttggaattaacacgatgcaaacaaaaggtgcccgacaggaaggtgttatactatttttgtaagccttatgaggttgcaaaagctgtttgggttgattcgagatgactaatttattaagggtcattctcttagcatgttatatgcttaatttggttatggtgagagtcatagcttaggctattagactcgttgattaccatgatttttatcatgtttgatggatcattttaagagtttcttactcggattcatatcaaatatgtctatttttggaccttttaagtgtttattactcggcccttttcctattttttatccttgatatgttcaagttgagaagaagtcggctgagtattttattgagtaccatgcatgcttcgttataaaaccactcggttcttgactacatgtttagtttttcaactaatcacatagtcaggggctacacctaagtaggtgcatctactcgatgcaccatgttttatttttgcccttcacagtcttttagcactcggcaagctagagcaagttaaattgaagcactcggattactgttttttgtttcgagaaggctattttgtcaactgcgaaggtctcgggggctactgtggagattatggataccccatatcaacatgacagttataatttagtcggatatacggtaccaaatatagatagaatatctttatgaggactcgggttagtttctaacttatatgtcaaggaaatacccgagatcttagtcggttacgattgtattttatctgtaatcgcatattccgttagggatatggactgtattttgtaatacggatcccttcccctatataaggaggggtccgggttcctctcgggatgattctctttttcccaaatcatacgatcaataacatactcggcggaatcatccccggacaggagtagggtattacttcttgaataagaaggcctggacctgtataaaattccttgtctccaaacccatccacttttctagcttgatagccaccccttttagtattgccgaaatcttgtttcgacactacttctcggagcgccaaaaatatatttggaaattggtttatgggagtgcccagcttaaacaaaatggttttatttgggggccagtagtctatgatcaatttggtattactgaaatgataatattttttataataaaggattggctaatctatacatattatcttcacatctaccagctagctccacatttgatctttgacgctatcataggagaagcagaatattatgcgcactagtgctactcttatatataattgataactagagtttttttttcatttttgatggcatagcccctataaaattacttgcaagaatatatactggaaaacacattttcacatacaacaaaaatgccttttctcatgcgggttcagtatgctccttgacctgagatatgggcgcgtgcacaacgactgccctctctgctgcttgtcgccaccttcgatcggtggccatcgccagcagatctgctgctaccgacagagacgtagccaggaaattttccttagtagtcctagttcgcacggtatgtcacgtggtaaaattttcttttgcaccataaaactgatatacaaatacaaatttagtgaaaatgtgatagaaataatatcttccaacatccataagcagcttacttaacaagcaagttcaaaatgtgcaaatattcacgtactcactaatctctagtcacaattcacaactcgatttaaccatttaggcagctattcgttaccttcacaactcgatttatccatttaggcagctattcgttacctgggctgagccacggaggggaggggacggcggcgcggtgcggcgtcagcgtggacggcggggaggccggagagaaggggactgtgcggacggcggcggtggcgccggcacggagacgcggagtggcggcctcgcggggaggggaggggacggcagtggcagcgctggcgtggagtcgcagaaggaggggaagggatggcgcaacgccggcgcggacagcgggggagccggccagccgagacggcgccggcgcggagtcgcggaggctagcagctggcggcatcgggctcgggcgaagtggcgctggtggctgagacgctgactcgctgagtggctggaagtccctcaaccctaatgtttctgggctatttgggccaagcaacctatttgggcctaatttttttttggggtctgtgggccaaatttggggttagtcccgaacccaccgggactacccctagctacgcccctggctaccgagatcatgtttatcattatttgaataacatgcatgcaaaaaatgaaggatatctatttttttgaacgcgtaaaagaattatgcgtcaatatattagaagataagagtttttgttatacaatacagtccgccaaatcgactatgtcagggaaagagagaaaaggcagaacaaaagctgtagaaatgaaggatatccatacaagggacaatgatgcatccatacgatgagaagctagcacaactgtatgaatgcatccattacctggacaatttgtacgtatcggcatatttcgcatccacaggatcgctatctctccacgtacaataattccgtttgcatgcatccatagtagtatttgtttggagcacactagtgtaccatcattcacacacctcccccacgtacgctgcaactgccaactacgaacagataatatgtttcttgctctcgtgatactcctcgccgtggcggccggctcgtggcaacctgcggcgacctccacgccggcgacggtgagtcctgctcctgccgtatcaccggtggcggcgccggcgggagaactcggcggcggcggcgctggcgcgcggcgagatcaggacagggagttcgtccgcggctgctgcgctcgcacgctctacccgcgcctctgcaccgcggcgct

SEQ ID NO: 73960 - DNA, 15133 bp, Oryza sativa
ccgtcacacacgccggtggcgtggcggtttttgggtgggatatgattcgcgggcggggtggaacacgggagagggtgggggtgggggcgtggagccgtgggtgttgcgttccgcgggtgagaggggtgggggaaagggatcgtgtgatcgtgtcgtggttggcagcagatcaagcggaaggaagcgtacgtgcgagctagctagcttgctgatggggacgggcgacgccacgacgatccctttgggggaatatatttagggctgccactatatacctatacctatttagggaatatgagtactccctccgtttcagtttacaagatgttttgactttattaaaattaaactattttaagttcaccaaatttgtagaaaaaaaagtagtagcatttttaacccaagacaaatttattatgaaaatatattcaattattgatttgatgaaactaatttagtattataaatattactaaatttgtctacaaagtcaatcaaacttgaaacagtttaactttgaccaaaatcaaaacgtcttgtaacctaaaacgagggagtagaaaggaattacacttacccatactatttgggggaggacataagtagaaaggaattacgcattttaattttgggtaggggaggataatgctcattattacccacctttctcatttccatgtatgtgtgtaaaactcggacacaaaatttaaaactcgttttcacattataaaacttatcaaatttgactgaatttcataggaatgaattattatatagagaagcaactttatataatttttgagccatttctatatgtgaggcccacgtataaattatccatatggataatctaattatgaaatgggtaaggatatggttacccataccctccccagttgcatgcctaaatataagcctatatgtggtagaattctctagctcaacctcttataaggatgtgtttggtacgataagttctcaacttctatttctttgtttttcacgtacacacttttcgaaaaattttatataataaagttgcttaaaaaagtcacatttagtcttttttttttagtttcttaagttaatactgtactaatgagccatcccgtttccgtttagaatttagaaattcatgactttctagtttgaacacaatctaatattgttagaagagaagtaaagcgggctgtcgggctaaaataatattagaaaaataaactagaaaggggtggagtaaggttcggattactccacacgccctatatcagactttattccggagttatttttaagagttgatcaattaacttcattaagaaaaagagacttgatcagttagagctctataataaacatattctagtagtatgagcgactctaggtgttcgttacgcgtggtatcatcggtatttgtgtgtaaaccggccggtgttatctggagcgttgagatacgtacggtgacgcgacaccgcgacagtatagtgatgctagtttttggccgtgtgtgcactacgtctacgtacacgcgaaggcaattcgccagtgacctgaatttgctcgatctcttgtgatcttaatttacggcgtttcgtccacgcggaggagttcgtaatactgatccttgggacgtacgggccgccgtgctcatcagcctcagccagcacgacgtgcgcgagtttctcagtttcttttgtttgctgcttctgctgctgctgctagagacacgtcgtgtgtgacagcataatatttggggcttattcgttttaaaaaagaagaatttctaaggattaatttctattaatatctgtttgtaggaatgagatataggaaaaccaaattaaggaaattttattttcctacaagttatagggagagaacgcaaaaaaaagtaattaaattatccatttaaaccttaaagaaaaattcctatggattgatatgtgcatttctttctatttctttaattttttatttttatgggttgaaattcctccaaacccaataaacaatcgacgtttgggacagcaaaatactgctacgtgtaagtcatttttgatgtttcaagcatcaaataattctgtctaagagataataatactactagtcgtaatagctaactgatataacaaaagagacaaatatgtataacaatatactactgatatctacataatggatgtatatatatagtcaaacgtactgtggagataggagatattatgtcatgcatgcatacacctgttgatagggacatgatggcgctgtaaaaacacgtagcataaggtcgcggttgcgctacacatcaggcaatgcgtgtctccacaaacccgccagctacgttgcttaattaagggaaaaacggcgagtgagtcttcgagtatgcgctgccgcatagaatttttttccgtgtgggtgtcccggactccaggtgatgtttgctgtttttgtcattagtgtagtattatatatttatatgtgcgcaaagtacacttgcaattgcatgattgcatctgttaattgttatcttcagtactggtaagattgcgtttgactactctgaggtcgtgttttattacgtacgggttgccgcctctcagattttcaatttggagcagtaggggcgttctttctgaagaatgaaactattccatttatcaacattgtgattctttttcaaaaaaatgcatacatattatttttatagaactgttttaaatcaaggtgaactaaactccatgatactccctttatgtcaaaatacaactatatttttttttataaaatagctatattttgaattgagcgagtagttttaaaaagagtgaagtatatagggagtctctaaacttgtgtaaatatgtcatccagatccctgaactatcaaaatatattctggatctatgaacttatcttgggtatcatacaagtctaaacggtttcaacctgctccgtgtgttgacatagtataccacggtagcacataaatattaaaaacatttttttctcctcttaggtagagaggagtacttttcaattttaaaggaaggcaggttaataagacgtgtttaatttttaatttttttatgtgactgacacataggtcctagctactaacatacatgcactatcatggcatgctatgtcaatgcatgaagcaggttatagcccgtttgtcgtgacttatatgtaagaaaaaattgcatctattaaaaagaatatggcaaccgaagagaaaggacacaatttaattaattatatacaagcttgactatgaataagttgcgctctggattttttttcaggaaaaaaaaacacttaatgcggtcttataggagaggtggtaatgggctcaaacttttgacatacaaaatatgagggttggataaaaaggttgagctaaactttagtagatttttttaaaaaaaaatatttaagatgagaggattgtgaaagggtccatgggtcctgacccattgtccggattctattcatgatcttagtttagtttcgcttggccggccaattgttgatgaaactgtacacttttcatttttgtttcgaaaatgacgagatctaggtgtcaaagggaaataaaatagcccagctttttttgttcatagaaagggaggaagagcatgatatcatagcacgatatgcatcacaggacagatgatttgtaaagagaggatggcaccgagaatttgttgagcgatctttatcagccaatcaagtgagatggttcactggaaagaatagaaaaaaaaatgtcagatggttaaggtgtgtaggcagaaggccccacccaccacattgaccagtttggccgtggacagcaatattgtaccgaagtggctgacaggttcattgacgaaaaccaagaaattttttgtgaaattaatctttagggcccatttgaaatagagaattgctataagaattttagaggatttaatttcctaagaaattacttaaacactttgattcgtaggaaaggattgaaaattttccatacgattgtatttctatggcttaatttcatacgaaataagtagaatgttgaaccttttagaagctttcatttgctttgtttgtttcatagaaacatgccgcttcaattactgtgttttttctatacatgtgttttttctatccttgtatgttttttatatgttttaaaggtgcttttagatgttgagagtctaaaagtctatttatatgagagtcagcttaaattataaaacttaattttaggagcaattctacggtccttgaagagctaccatgaggtaccaaaattttagtgcctcatagtacttaggtaccatgaagtaccaaatttataatagaaaaaatggtacttcatggtgcctccgcaaggaccataaaattgctctaattttagagttggagtaggtttttttagaaaaaaaaaagtacgaattacccactaaactatcgtgtggttgacccaattaccccctgaaccataaaaccggacaatttaaaccggacgaataacccccctggctcaatccggagcggttttagtcctatgtgaccgcacatgtggcactggccccacatgtcagcctccaccacatccttcctctattatgaagctagtgggcccccacatgtaagctgctctttcctcttcctttgtctacaaccatagagacgcccacgtcgccgtcaccctcatctcgaaccctgcctcctttagctagtcgttgtcgccattgcccccatccaaccgctggagagaggaaagagaggggagaggaaaaaagatatgacaagcggcagtggcggcgccctccagggcaaccgggaaagcgaccgactcctccactccgatcaaggattgccgctgcccgagtttcaccggtgtggccctatctccaccaccgtcgatgctggcatccagactccgctcccgccttgcttcgccgttgtcggaggatggatactgctccaccgcctcgatctactatgcatcgatttcctccgccgaccccgtcgtcaggaggccaccactgaccgtcgtccccttgtcgtgggctcccctgacggccggccccagcctctggctggcgtccgcagtcgaggccgtcggcatcgctccaggggaacccatctttgtggccgaatttcacggctccagtcggtgccttctcctgcgaccgcgccggtgccggtctccatcgccgctagggggagggctaccacttcaccataaccgccaccgctctgcctggctgccgtcgggctctcctctcccttgtgccacatctctgcctttctctctctgcgccacatcaccattgccgctctcgtcgtcgcctggagagcactcccagccatgcctcctagagcgccctcccatccgcgcccatcgtcgctcaccaccgaacggttcctcctcccagccgcgcccaccaccgctcccccagccgcgcccgtagccgctcacctccaatgctaacatcacacacacagacagaaggtattaatatgacatgtgggccctatattattttattctattttctgttgatgggatttccacgtcagtgcccatgtttatgacatgcaggaccaaaaccgctccggattgagctaagggggttattcgtgcggtataaattgttcagggtttaaaatatctggttttgtggttcagggggtaattcggtcaaccacgatagtttagaggagtattttttttctttttttatatcgtagtctattgtttatcattggcttttaaaccctaatagctttattaattatttttcatggctaatctttttgctgaaacgatcatagctataacaatattatagtccaaatggaaaaaaaaaagagattgggaaaaaacagctattactaaatttatgcaccacaatataaaatgtaacggaataattgaataatttcgtaaacgtgcatgcttggctagttaattggctgtttgcgtcaaggcaacgagactttcatatatcggtcttcaagttccagactcccagtaggtggcgggcctgtttagttgggggaaaaattttttggggttattttgggcgtttgaccagatgtcggaagggcttttcggacatgaacgagaaaactaatttcataactcgcctggaaaccgcgagacgattttgagcctaattaatctatcattagcgcatgtgggttattgtagcacttatggctaatcatggactaattaggctcaaaagattcgtctcgcgatttcctccctaactgcacaattggtttttgtttttatctatatttgatgctccatatatgtatctaaaaatttgatctatccaaaaattcgatgtgatgtttttaggaaaaaaaaattgtgaactaaactgggccgtagtactccagttgtgtgtcatttgctgtacggatttcatgacatctggatagtgcactagcaataaatgggctaccaatatccagtgcatggctttgaccaaccgagcccacaacttattcctgtaattaagtaccaataatatgtgaaactgaaaatgacaggggttgggagaaaaaatgtggaaatgcggcttcttttatgttagagaagattttcatccttgcaaactctcttggaccagaggaaattgttgggcttttatatagtcttttgggccgtaaagcaacaatctgagacggcctagcaaagatgttgagcagtgagatgcactcgtagagtaatggcaggggtgctggcatgcaccctatccgctcggattcgattctcttcgagcacgttcatctgaaatatttgcttcttgctccctctgaaaatatttgactccctctgtttctaaatatttgacgttgttaatttttttaaatatgtttgaccgttcgttttattcaaaaaatttaagtaactattaattattttcctatcattgattcattgttaaatatatttatatgtatacatatagttttacatatttcatcaaagttgttgaataagatgaatggtcaaatatgtactaaaaagttaacggtgttaaatatttagaaaaatatttagaaacggagagagttcttaaaatcatcaacaccaaatctttccttggtgtccaactttttaaagatgttgatcagtagcatcgcttcactttgaccagaaatgtatatcagcatggcactgtgtctatcatttcttttcttttcttttcttgagaagatgtctctcttttattaggagtatcatttagtaataataatagttggagtttcaaaacataacatatatcctcacaaaaaagagagagagagaaaacacaacatatatgggctattcaactcgctgcatactgcgccaaaatcaccatactcctcttggcgcaaagtgtgtctaccaaactcgacgccgatcgattttgcagcttttgctcgacggctaagttcagaggaagccgtctctgcatcttgtttgtcgctctcgatttcatccttagtttgtgagatggatgccaactcgtctctgctgctgctgctcctgctgctgaaatcaaaccgtggagcgcgcggctgcagggcggccgcagcctctggtctcccgggtgttgtaggagctgcatccggggcacttctgcgccaggacgtggaagttcacgttcgacgtcgcgccgcagtcgttgcagaggatccatatctgaatgaggaggaagaagaagaatcatcaaaggattgttcagagtcccagccatgttcactcaagaattggtagccaaagaacttttattccagtctggatggcgtagtacctacagaattttgtgatagaatctacatgattttagaaacattattttagtagatcatattattggtagaagttgagggtttgtcccatctcgtctttttttaagctcttttctattcacttctggactttttagttgtgtgcctacgagcagaggccggagatgtaatccatttccattatctaaaaaaatgttcactgaagaatggcacacgagattttggagaaatgtttggtgttttactgaccatcttcttctggtagaactccggcatcggcgtcgcggccacctcctcgtcgagcttcttccacgcgtccgacatgtcgcaggccgaccgtgagcacaccgggcaagcgaagctgggggatatcagaatcattgcattggtttggttaggagaaagttttatcaggtgaagttttttgtctgaagaacactcactgatgatgcgctctcatcacgttcaggcattccagatggatcgtgtgcccgcagtgcaagacgctgatgtccttcgtcgagtcaaataggtactgtgatttggaaaaggagagcaaatttttttatgtcagatctcaagaactggaaacaaattgagaatgttgtttttttttctctacctttctgaataccaaatgcatttgtggaaagcaaggctcacctcgaagcagacaggacagttgtgatgcattgctccttctacacagtgatgagaatccctcaagacattactgtagcaacaccctgtttagtgaggaatagcaaatgttagaccaatcttgtttatcagcgacatgtggcgagaatgtcaaaaaattttggggaatacgcatcactggctcattgcattaagatcatgcagaacataccgcatttgtcgcagtgaaagaacttatccacaccaccagttctggaaaaaaaatgggcatatccaaaattgatcaaactgaataaaatagtaaatgcagaaaataattcatagagatagatttaggacttgcctgcatatgccgcatccatcgcagtgatactggttctttgagacctggaacaaaccaaacaaatatgttagtcaggttgttaagcatcatcatacatttatgaaccatacttgccacattagaaacttagatgtaacgtagaatcatcatttgtaatccaaacatgcttacatcatcatcaaagaagttgcatttttcgcagaagtatttccccatgcatgccccacaaccagaacagtactgttgtacctgtcgatcaaagtgaacaattttcatgtgatcagtacagaaaaaaaaaagttagcacaatccagaaattctactgttgtacactcgagaaattctattgcacctttctataaactacttacatcctgttctttgtcgcagagagagcagataacctgtgatacaccataaagtaaaacagtttcagtaactccacaatctggttaagaaagttagtgataatgacaaaagcgtaacagccattgaaattcttatccactagattcccccaggaaattagtgctgtgataattgcacaatcagtttgactatttgaggcactgttagctatggacacctgttgggccacataaacgaatcaatcatgtgctgctactcaattattcaggaatcaatcagctgaccgcactcaagttaatcttggctgatggtgagacatgcctttgtcatttccctttcctcctctgccgtcatccttctagtgacattgtcacatggagataagcaagcaagcaagcaatcaatcatgtggaccagacaatggtcactagtagcagaaactaacctagtgtgcaagttgagttgtggaatggaaaatatcaagaagaatctgtccccatggagcactaagacaattagacaaccttatctgaagaagggggggagaaggaaaggaaaggaaaaaaaaaattcttgggatgggggcattcttggccacttcatggcaggggtcccaaacatcattgtccagggctccagaggcatgcatcagcatcagactgaaatggcaattactaatcggattttgaattttggactgaagaaattgataggtttgtgaaaactgaggtatgatctctccggcgacacgccatcaaatattgaccgcagatttttttcttttcttttttgtctatcaggcgttgtgtgtccaagcaaaattcagataaatttgacacggattatatcggatgaaattgggtatgacaagcatcaaagcttacacgaattgaaaacaaaagggaaagctgatgctaaaatcaaacagaagagtgagaacaaacaaacaccttcttgatttcgtggcgggggatctcgtgacggtcattgagatggatctcgagcgaattctgcagcaaataatcaaaagccaatatcagtaccgtttgaacgattttcctctcctcaataggagccaacaaaaaaagaaaaacagaatcaaaattcaaaagcgaaatggattggaagaagagagaagaatccatccaaccttggcctcgttgtggcaatgcctgcagccgaacacctcgccgcagcacggcgccctgatcctgcatcccctcgtgtaatgctcgcagcttcacccgccagaaaaaaaaaacaaaaaaaaaacaaaaaagcccaagcaaacaaacacaggtgagatgagatttccagaaccaaagctctcgaatcagagggtaataaaaatctcgcagccaaccacatgatcgattccctctttcttgcttacccgtgctgctccgactccaattccatcctctctctctctctctctccctctccgagctcaacaaccaacgcgctgtttggctctctaggtctcaccgacgacgagacggccgccggcggcgagggcgaggggggaggggaagggggtggttggcaacggcgggagggaaggagggaggggagcttgcgcgcgtgcggccgcgttttatagtggggaaacacgtttttttttctctctctagttttttttttcctccttcaaatatggcggtaacggctgtgtttcctctcctatcttttgtttgtgcttgtccccccaagatggcgtgaacgacatctctttggcacatgattcaaatgccgactgtctcaaacaaaataaataaattttatagatgaatttagataaatattgatccaaattcatccgtagaattggattcattttagatagagaaagtagtatagaacaattaatctcaacaatgtaacataagaattgtttcttggaatcatactttcaagaaaaagcttagagcaaatatgtggccaaaagcgtaatttgctctaaaaatactacctacatcccaaattagatgtcgttttgacttattacttataacgtttgacagttcatcttatttaaaagttagtgcaaatatagaaaatgataaaatcatatttaaagtacttctgataataaagtgtcatacataaaacaaataataattttataattttctaaaatgaagaaggatcaaacaaaaactcaaaacaactagtgttttgggatggaggtaattaacatttttatgatggaatagctaacttggttgaacgcacttgccgtgagctggaaaatatctgcctgcatagttcaatgcaatcatggaccagaccattcacagctaaatggaacctgtctttcatcgatctcgcctcataagaaacaacagaacaaagataaacaactactactagaatccactaacagtcagcggctggttgcccatagggtggcgcgagagcaaacggttttcgtatgagtcggcaatgcgagtgggccccacagagcacgaaaaggcacaccgggaggtggggccccggccgttactgggtgagggcgaggatgaggattacggtgtcaggcgtcaggtacacgttggatggggatagggatgtgtaggggttatacagtaagtcgcctggattacgtcgccaacgagacggtgacatacggatatgctatgccagatttccaatgagtgttgtcttgggcattgcccagtgattaggggctagtttaattccaatgtttttcttcaaacttttaatttttttatcatatcaaaacttttctacacacaaactttcaatttttccgtcacatcgttccaatttcaaccaaacttataattttagcgtgaactaagcacaagtgttatctcgacttgtcacatggaactacacgtgacaatttattagcacaaaatatacaagacgccacagtttagaaaagaatacttcctccgttttttaatagatgacaccgttgactttttctcatatgtttaaccattcgtcttattaattataatttattttgttatgagttgttttatcactcatagtacttcaagtataatttatatcatatacatttgcataaaatttttgaataagacgaatggtcaaacatgtgagaaaaaatcaacggcgtcatctattaaaaaacggagataatacttgggatggtaaagattttaagtgcctgacgtgacggcaggtaccaaataacgacagtactcttctcaaagttttgctgcaatcatcgcacaaaaagagggcagtgaccagtgggaatgaagaggaaatttctttccagacgctcatgagtcatgagtagtagctacaaaattgcttgcatttctcaaatgcagtttacaacgaaatgtggtatattttgtacacagctcaggccttggaacagttgttaacccaaagtgtgtaagcagctagaagcctaggggactcaaaattttggtagtattctatacacaaattacagtgatgggcgcgagggcattcttcctccggttactttgatgagcatccaaaagatcattcattagcgctctgcatgagctcaaaccactgcaacagagagaagacaagtccacatgtcagacagagagggaccagagaacagaaatgagtaaaccatccattagttcgtaaatagcaggagctaaggcagaggataatctgtacctgtctaagcaagtcagccaatgtacgaggaagtgcttcaatattcttcagcatgacatagtaagggaatggaaaggagtccatatatttccccatggttagtttggtaccttgataggatacttcctgcacgtcaatgccaaaaggattccaaactcagttaattagctaatcgtgaaaagtgataaccatgtcactgagatttgaggggtacgcaccagtgaatccatgatagattcctcgtgaccatctaggagcacatatgcgatcatcctctttctgttaaggacattcctgacgcaacgcttcaaattttcctaatgacgcgatgcgaacatcagaaccaaaaggtaggcactgtgagatatacaaaattatgtgatggaaaaactggtaccttttcgtggaacttcccgtcagatattattagtacgagttgctgaagtggattttgccctgacggtgtacgtgaccgtgccacggcagtatcaagcattgtgttcagatgcatcaagagatcagcaactggttcatcctcaagtttgttgtcttgctcaaaggacaaactagaaatcatctgtcatcagagaagaaagtgagcaacagctcgtgagtttcatttattggaaagcaaaagagcatgcaatcaatttcatgaaacctacattcgttcctgcttctccattgaagacctgatcgaaatcatgtagcactttgacatttccctttttccgaaacttgcaactgcaaactgtccaacctcaagttgtgacatggcccggcagactgtaactaatgcttcaatagccacttttccacacttgccctcggacatactccgtgagtcgtccacagcaataaccacttggtaattacgtttattaggtttagttcggcgcaaccatatcttatccctgcggaaatgacttgcaatatatggaataacctgaaaaaatagcaatgcaccatcatatgagtgaacaccttgaaaatggaaaaggctgttcttttagcattaaaacaagatcgtgagaaacagaagtacctttttcatgtttattctctttccagttctgtaatctccttgaagcttacttgcaagagttggttccatgacaaggcgcaattgctcagcaagttcttgggacaacttcatagttgtgagctcaacacttttccagtcaacaataggacctttcatatctacatcagtgatgttcatttccatcggagtagacaactccctctcattggctaaatcatcccgcataactgttttttcatctgctggaggttgtttgaacgaaacaaaatctccaaaagtctcgtctgtttcaccttgaactgaatcctgaacatatgtatcagtttgaatctctctatgctcaaggttgttggcattttcagatttgttggtacgtgattgtgaagcttgcagatgtggcacttcaagattatgatcatctccaggtgccctgtaagtattgtgttcctctttttgcacacggttttcatcctccatggaagactgtttgacttgcaggtcatcgttgatttgatcagctgttgcattacccagtgcctgagaggtgctctgctcactgtccggcacataacgaaattcggtagcactttcatcatcaatatggtgttcagcttctggttgatgatcctgcgtatcagctgagactttggcccgttctttccagtccgccattgcatctccaatgctcctaaaaggatttgtctgtttgatctgcgatggtggagtatcagtctgcaactctggcttagagttagacaataacctagagccatccccagagttgggcatagatatttccagactagggacttcattgcttgaaaaattaacagaaggagcagcagcactgttcatatcagtgctgttagccaagtttgattcagattctctgttatagtccatttcggcattatttggttgtatgccttgtgaaggatgctcaagtgactcaatattatgaagttctttctccatgttatttgtctccatctgtccatcttcagcatgctcctgctcaccatcaatctcattgtcaccatgttgagctgcatctacatcctccacatcgtctgaagcatctaaacacccatctgctgctagcttttcctcttctggactgagttcttcaccatcagcatccatttcatcaatatgttctgtcccatccatatccacatcctcagaatcatcctttggttcagggagttcaggtgctgttcgatcatcatgggctgcaggaa

SEQ ID NO: 73961 - DNA, 11031 bp, Oryza sativa
tgcattcatgttagcagtagaagaaacagcctgaatcaaagcggtagcagaagttctcctagaaaatgcaccagcaccaagtccagatcctgcactggcaccagcatcaccaagtccagaacctggactggcactagcaccaaatccagagacctggactggcaccagcaccaaatccagaacttggactggcactagcaccagcattaccagcaccaagtccagcaccaagactggaaccacaagcagcagcaccaaaaattttcccccaagctgtctttttcttaccagaagaagagcttggggttgccctttgtaatgtcacagcaccaaatttactttcatacttagcatacatgtcagacaatgcagccctaacctcatttaaatatgcagagtaatcaccactaataagttgtcccataatttggagaacattgctaaaacccctgatcttggccctaggatccaagataaaagcaaatgaatacagaaatggaatctcagaccagtatgacaagaacttatttttcatgggaacaacaacatttctaaggttccaatcattctcataagtatttagatgtccagcaatctcaagaatgtgatgcataattaatggagatgttggataataaacaccagacaaaataacagttgaatcataaaattgttcaaggaataaaagaacagtttcagcaattgtccagtgtaaatcagtcagtaatggctgaccatcagccattggatggtgagatgcaataaacactgaaaaaatgaccctatgtggcaagagatgcttaagcattagataagttgcattccatctaacatccatgtccaaaccaaatttacgaggacgaatacctttagcaatgcagaagtttttgtataaagcaatgcgctgattagatgcatttataaatgaaatagcagttctaaaatcttgaagcatgggtttgaagatttctagaccagccttaacaattaaattgatgatatgacatgcacaacgctgatgcaaatataaatcaccaatataaccagacagagcaggtttaagactatccattgcttttgaattagcagaggcattgtccagggtaatagagaagatcttattagtcaaaccatattcttgaacaacagaaagcacacgttcagaaatattttcagcattgtgtgacacatcaattagcaccagtcccaaaatcctcttctctaattgccaattagaattaacaaaatgggcaacaacactcaaataatcctccttagcattaccagaccatatatcagatgtcaaagcaacagagctaacagacttcaaagtatcaataagcatagcacgtctcttgtcgaagaccttaaaaacgtccctactgatagtttgcctagagacaacactaaatctagggttgtgagcattctgaatatactcctcaaaagcagcagattgaccaaaagtaagtggaagatcctctctagcaatcaacctaaccaactcagttctagccacatccggtttatattcccattgactaacagaaccatcagcattaaacctaagcatggactgagacaaagcaccaacatttctaggtttgcacgatttaatatgcctaagcaaatgtccagtaccaccagttgaacgagcagacaatgttttatgacagtaattgcatttagcagaaacgcgaacctgagcgccattgcgctcttcaaagagttcttcaaagtcgtcccatacctcagacctggacctcttgttgctagcacttgagccagacggagcaccgttgccatcggcaccggtaccatcatcgtgtggctccggctgcgacagatctctcagaggtgaagcagtgttgccaaacacctcgatgcgttcctcctccaagtcatcttcgtcatcaccctgcgtccccatcaccctcgcctcgtagttgcatgaggttggatcaccatccatcgcaggcactccggttcctcaacggtggctgccgcctgccgctcagcgacctgcaagaacaaatgaaacaacgacgagagcagagagtagttacggatctgatcgaatagagaaaataaactaaaaaaaaagcttgtacctgcgcatccggagcaccggagttgccgttgatgatagagatccacagatctacgagaagacaagaggagagactagatttggggggtggatgagtggatctgagtatctgacgaagagaaacgatgagggttgcaaaaaaaagtacagaatggagaggaaatcgacaatgcgaccgtcgatccggtgaccggagaggcggagacgaagagctcacggtcacagatcagccaaagagatgaaagaaaaggatagagaagagacgacccttaaagcccccagcgggagcccgctgacccttggtgctagatccggcgaggcattcataggagacgcctacaaagagggatggaggcgtggagggctgaggggtcggagcctgtaggtggaggcggagcggccgagcggctgatcggtcgagactccagactgatgtggctagggttagggtttgtcggtttgatgcggtttggggtatttatacccacccggcataacaggcctcggtcgggccgtgcctgccgttggaccgtgccgggccgtgccggcccaccgtgccgacctctttcgtgccgggccgtgccggcccaccgtgccgagggagcggcccaagcacggcccggctgttgggccgggccggcacgggcacgaccccagtcgggccgtgccgtgcctgggccgggccaatttgttgtgccttgggccgggccgtcgggccccgggccttatggccatctataagttcgaccacagaaccagattattcatgcatgacttgggaatgaaacaacgtgtataagtggtctagctggcttaattgttgagcatgtaatgaagcaagtagggagcctagtaaaacttacacttgcatgacttgggagcctagtgggcctttctagcctggcccatgtgcttgccaaaaccgccggttttgaggtgtccggttcgccggtttgaaaaccgcccggtttatctgatttttactggttcaattgtatatctagtccttgcagcaaaccgaaccggttgaggagctggtttcggtttttcttggtccaaccgccgggtcaggcccctttttttttactaggatggtcagtgtatttgctacatgataaaatttttaaacacgtggaggctgctgcaattttttgtggcacatggacacgatatgccgtgccacgaaaggacgcagttcacgcaagcatgaaaagattcctaccagtaagaagcaatatgtttctagtactgttggacggtggcaccagttgtatatgtacaacaaccaaacccagtgtgtatgtacagctattgccgccgtccaacagtacttccaaacatgaggttcgaaacttgtacaggcatccaggatgtttctgtgaggtgaatgtcgaattgtcgatggtgctttctctagtaggatgtaccgctgcaataattagggatgaaaatgggagcttctagcttgcaacggtagtctcgcatactaaaattccatgatgaagtgtcctgcaatggtgatgatgatagtagaaaatagggaggcatatgtgtagcacaaatagcaacaattaatgaaccaaataaatagtcaagcagaggtgacgacaatagagatctgaaacgaacctgaatcttgtacgttaacaccggccaccacagaaactataaccataatgaatgaacctgactttagcatcatgtgccttgacgctagagagaatccactcagtacaactgagttttccctacttctacaatctactactgattttatcaagttgaataatatgctatcgtgttttcttgaacctatactacatgccatcgtcatctacaagccgttagttgaacatctgttagagctttagttgaacatctgttagagctgaaaaaaggcctatttaccctaactcatgttttattgtgtgtcagatactacttccttttacttctccgcgctcgctacctttgttttcaaacttacaactgcgttgaaattccactgcctttttctttcgaacttactgctgcgctgaaattccactgctattttatttcaaacttgctactgcgctgaaaacctgaaattcaccacattttgaccccccataatacgcttaacaattccggcattattactacctgcatttttttttcgcagcagcatttcgttcaactgcatcaaaatgtacatggacggatatttgtataacactcagaaaaaaaaaatccattcccatgccactttactcgcgcctcgtgagatgactaatacagattacaaaatgagagatgactaacaaacgttgattaccattcactagcaaagcaggagcaacggcataagtcccatacagccaggttcagagtcaaaaaaaaaaatcacaagaacagtagtacagtcggccggccagccagcggcgcgtcgatgggatcccggcgaccggccgccgccacgcttcgatggggagcccagcgcccggccgcgcgtcgatggggagccgggcgcttggcagcgcgtcggggactggggtagtcagcggcgcgtcggggacttgggcggccggccttccatcgatgggagtcggcaccgcctcacactgggcagatcaatttggggcaggagcacggctacggttttcagccaactagtgctatagtgaaaggatattttagtcattaagaaaaaattcaatacatcaaacgggtgccaactaacggcttgtggacggcgatggcacacagtagaggttcaagaaaacacgatggcatattattcaaattgacaaagttagtggtagattatagaagtggggaaaactcagtggtactgagtggattctctcacgctagagacccaacatctcaatgtcatggttcttagcactaaatactggttataagccaatatctctgacgcttagccactactagaaaaactatttttttcagatgatagcactgtcgacgggggatacccgtagaccggatatagagagtattggggtccgttagtacgaggatctacatagtacgacaacaggcaaacaaaagaaaagaattatactggtttaggccccttgataggtaatagccctaatccagttgatatgggattatatgatggaaaccacaggttacaaagggaatagcggaactcaatgataccgatgagaccgtagtcgagttggttcaactagatctcctggcgacttggctcctgcacgctccggctccgtaggctgtggtggatgttttggcagtaatattcgatgccttaggtcctgccagggggtcccttatataccgcgggttagttgatcctcaagtaggactcggagatatcggacccctcacgatacagtaaagactcaatctcgaccgagtaggactcctcccatccgtagattatgtttctatcacgtgatagatttgcttaacgtatacggaaactatccgtatacgcgtgggtataccgtattagtatacagcgtacatccaagggtagagggtatatcttatccgtaacactgatagtagccccccgacttctgcttaaatgaactcatgttatcgatcgcaacttttgatgtcgaaattgttatcgttctcatctgatcgatctcggtgtaaaaaaccgtagagacaaagagccatcgacaacaccgcgtgaagttcaatggtcatgagtgaatttaaattgatgtctgaaaactaccgcgcgtaacagacctagaattttccggcggcaatctctctcctttccttgggatacgcaccatcgatagtgcgcttatttatagggatttcgggaatccattcgaagtccgtttgccagaaaactctcttgccttgtagcgctcttcgtcttctccgctccccgcaaagaaaaccctagcttatttccttcatcttattctccagcgatcctttggcggcgatggatcttgagtagtctaccttgaacaccgcattcctgaagaagctgtaggacgacggtgccctccctagtcgcgggactttgcaaagggaggctggaggtacagaacctgaactcatcttgggccccatgtttgtggtcgaggattatatttcttgcggttttctcccttcgccttccgaatttcttcttctagtcttgaatttctacggcctttctttgtttcacttgaaccccaattccttcgcatttcttagcatcttctctcatcttttagaggcctacattggggtagtgccctttcttgacctcttttgcttctattacgaattgcgtttgatggaatccaacagggtgtctggatgcatcggattccgacttcggaatggcctgaagtcgcgttatatccccttccagtgcccttcttattgtagcaagtggcggacgagatggttctatctctagatagaaaactcggaacccgtccttgttgtccctaaggatcagccagaagaaatcccagagtggaccgcaaaaccagccctgactccctccctccaatctttcatcgacatcattgatgatctccgaaaacggcggttgtcgggatacgaagtcgctgtcgacttcgtaggtcggtggattgagccgctgcaggcccgtgcccatccggcctttgaatactctgggccagaggacacgacccgggtctctcctcagggtattttttctcgcatttctaattttgttccgagtgcatctgtttctcctgacttatcgagttctcgttctcgatttataggtctggacagcgacactgtgggacgtcacgttggtcagataatgatcagcgcatcctcgaaggcggacgatatccccatcgcactctgcaacaaggacgcgaccgaacgcgccgccgcgattaatgtaagtgtattcgatgattcctttacatctctcttctcggggtcgcatcgtgacttcacgttgtgcaggctctccctctgacgtacgccatcggacctctcgtggatcaccaggcggcaacatcgttgaaggagggcgttgccaaggaggcatctgacgctgttgctggtggcagtgttccgaagaaagggaggatattctcgtccgtggtcaggacccgctggaaagcgacaagctccgcggtaagcctctctctcgttctttagtgcgtagtcggaatgacttgacctcacaccatttcatcttactcatgactcggacgcatctcctccacctcagcaaagccagaggttggtgacgatcagcaagaagtaagtaaacgttcttgaggtcttttcattctcgaagttttgattgtctaccgtcatgaagtaaaggaaaatcttcgcagaatggcgcaggcgaaggtggcgcaaggggggactgatgctgcttccagcgtgtaccctgtggcgacttcgactggagtcgtggtcgctactaaggaccaagaagcagcaccgagtagccctgccgtagcctcgtgcctacccggggtttgtccaccgatgccctcaccttggggggagctccaagcggagatggagcgcatcctctaggtcggtgctcgcggcgtaggccgcgagatcaaagaggtgaggccggcggcgtcctccgcgaatcagcgtaccgatcagctggcgcgcgatctggcggaggcccgcgaggacctcttaaagatgagggagttggtagccggaaatgagatgcagcggcacggacacgagcaccggatgtcggagctcgagggcgacatgatcgacatccgaggttcgctgtgaatgtcgttcactagcctgcaccaacttgccagggagtgcggcgccatgactaccatcccggcgaacctgatgagttctcactgacgtcatcactcacggaactggctacgacgatgggggaggtttgtaaggagctccgagttccccgtggagaacccgaggagtcagcgactggttacatctcgtggttgaatagggcctgcacacagctcgaagggattggcaagcgcatcgatgaggccctgaagcaggagtgccgtcgagcgagccgctatgccggaggacatgtgatggcctgtatccgagatcaccacccgcagctgcacctcgagttcctttgtgaagggttctcgcattctcggaggacgcccgcggagatcgacggtcttgtgtagtcgatggcgccgcttgccgagaaggttttctgctccatgcattggcgttggccgtcctggtagcttttgtatcctatagaaaaatatctcaaggaagcatgtaatatactttgaagtatttgtgacttgtaagaaatacttgtaaaatataaatggaatctatctaagttttcttactctgggtacgctgtgaacgagtgttttctcactttccgacttcagccagtcacttgagccatacactctccctagctttgtgaattgtcgcgaccgagaaaattgccttttcccgaacgctagtgtattaatccccatcccaggaaaagccggggtacaccacacaaacatgatacaaaaggccaacctttattatatcgataatatttacattattacaaagacacttcaggcctgacaaacaaaaataaacagcagcggactagcgggcctatggctccatcttcataggcgctcaactggggtataagccaggactccacctaggatttcttctccaaagcttctctttctgaaggggggagagatagagcaagaatgagtacaaccaccgtactcagcaagtcacaccgggagatgcatgattaatgcaagggagtacaaggggtaataatataggggttaagttttgcagtaaacaacatttaaaagtcacttagttgcccaaagctattttataaagacgattctagagctacacaatattattaatcaaggccgtggatctacacgaacctgccttaatccaaggcctacgatgattcagaccgaactggcaacccgccctgggtcccagctcgtcccaagccaacccaggccaaccttttcacattttagttgttaagcaaattttaagaattaaaccactaacttgggtacattgctaggattgcccatatccgagggcacggctattcgaatagatttactctgatcagaggtgtacatctttacccacaagacacatctttactccgcattccatggccttggaacccgtcgtaaacatgtgacataacccttcacccatcctagccgtgaacaaaagtaccgacccaaccctgcctacagccggtatcccgggacaggcaggccaggattgagccattagcaataggatatagaccgggtgcgccacacgcataggggtgagaccacccgcatactagtcaagtgccatggcatctcgactaacgggcatcgacccgtgtagtcttcatttgcctagacatctcgattaccgagtcatagctcgtgtagccttcatttgcctcagagatatccatcgtcgcaacgacttcatccatctctatccgtgtccttttgtttaggactagactgagcaccgagttaagccttacccattagacatgtggttagtacggtagtgctttgtaacagaggcccgaagaccggtccttatagtggccgaggtgttactggcaaaaccctgcacctcgagcccagcctaaaactattttgggagttttgaatagagggggaaggtgtgtgttcaattccaacataagccagccattccacagtgtccaaatgatatgagcattcccaaagtctaaagttataaaaccacctaatgttgcctaattaatcagcgaagcatctacctaaattcatactagtggaaccgttaatagagtacccactagttggggttttgtttatcctagggtgaacaaggtaataataaacaatagcaatgataaagctataacaaggattaataggaagtgctaaataaaatagtgataacgcaggaatttaaataaagcggtaatgcaataatttaaatcaaaataatttttaaactgggattcaatatgcttaagggtgatgtgacttgccttgctcagagagaacagccttccgaaccttcggcgacgaccgcaaaccacgcttcgagaacctccggaacgacagaagctacgcgaagcaaacaagcaaagctacaagcctataaagaagtaataacaatacataagaagaaagcacacggttctttaggttataacaaacattaggagacttgaacgggtcgattcgggattcgtatgataaagatatgatcatacgaagtttaatgctgttatatggagatttacggattattatgattaggttttgcaattataaaacatgtgcaagcgctagcctggaaaagacaggaaggctgcgctgctgacatgcggaccccacatgtcaacctaatggacgacggtagaccaagtacacagagacgatccacgggacgatggaagcagacgccgtgtgccaaccgaggcgagtggcagacaaacggactccactagacaccacgcgggctgcacacgtgcaaaccacgtggctaccgagtggacacacaaacacggtcaccacacgcacccacgaatgactaccgacaccggtacatgggtaccggggtcgacaaacacacaatgggcatggggagacaacgaaaggacgaggacggggcagtgagaggacggatccttactaccacgcgacgaggcgtgggaacgacgacgacaaacggcgcggcagagatggacaggaacgacggagacgaacggacgacacttctccggcgatccttggacgaaggcaggacgaggccaactcagggcttgacgatgtggagccgaggacgaagacaacgacgaggctgcagcagacttgacgaaacgcgggcgacgaacgaacgcggcttgacggagggacgaacgccacgacgatcgagaa

SEQ ID NO: 73962 - DNA, 1761 bp, Oryza sativa
cgagcgcgacgaagacggctcagggacgacgaaggcgaccgcgaagggaacgacttcggcggcgatccttgcacgaagccgagacgcggccagcacaaggcttgacgacacggagccgaggacgaagacaacgacggggctgcagcggcacacttgacggacgtggacgacagacgagaacggcttgatggagggacgaacgccacgacgaccgggaacgacgagaggacgacgactggaaccagcgaggaggcgatgagggcagccggcagcagctgcacggagacgaggacggcgcggaacacgccactgcgatgccgaaggtggttgaggtgcggccgaccggtgcacgggcgaggagggacgggcggctgaacaacttcgacgaggcggatggagaggttcgtggcgatgtgcggcggcttccgggcgaaaccgaggggtggacgaggtggagggctacgtcaccgtgccgagggaggggacggcagcgccggctgacgcacgggcatggcagaaggggctgccggaggagacgtcgacgaggaggaaggagaggccggtgcgggcaacggcgttctggcgaaattcgggcgacgccgtggcctggccaggaaagaggacggcgtttcggtgccgggagaggtggtggcgacgtcggccggcgcacaggggacgtggcagaagcggccggaggcggaacagtggcggcaacgccactgttgccggcagggatgcacttctggaggtctccgcgtgaaacagagggcaggccggcgaagaggaggcggctgcgacgctagaggaggccacggcacggccggccggcgtgctaacgcggcggcaggggcggctgaagatggccggcggcacgggagagaggggacgacggcgggaaggtggctagggacctcgggaagactcgggaggaggcaaaaacgagagaacgcaaggagggggttccaatttataggcgcgggtcgggagctggccacaagagagggtggaacggcggcggaaaaggcggccggcggccatggaaggtggccggggttggcgcgggcgttcccgacgattgggggcacgaatcaagggggaaattagggggaattgaagaggaaggaaaggggattaattccccctaatcaattttggaattcccggtttgaatcgcgtggattttggggaggaatggcgctagggttcacgggagagagaggaggaggccggcggctggaggtcggggacgcgcctgacaggcgggacccacgcgggaggcgtcatcagcgcacgcacgtgcgcggcacgggcgggagggcgccgctcggcttgggtggggcggcttgggctaggacgtggcccaggcgggaggggaggaaaagggagctgggccgagggggaaggggaggcccaagagaaggagggagagaaggagagggagtgaaagagagggaggaagagaggactttggccgcgggccgagagagagagaggactttgggccagacttggcccaaaggaggaaggaggattatttttaggcttttctttttaataaactttgatcatagttggtgttgcttaataaatatttccggtgctctgaaaatttaagtaaaatttgagggctctttttagaccaaggagaatttaacaaaaattctccgggccacattcgaatttttcttgaacgtattttagtggttgccaatttcttttcgaaatttaaataattcgattattctttttagaaaatgattt

SEQ ID NO: 73963 - DNA, 608 bp, Oryza sativa
cttgatgcttaccgaagggttcacggatcgtggcttagctgttctacaaaaggggaaaacaatcctacatgtgctacttctccgcaactgctttcggaccaggaggagtgcatccatcaacacgacccctatgactggggcgtatcctatatgttatatgtctacagccctacacagtcagattaaacgggggactctatacttgcattacactgggtggatttatcagaagccatgcgaactcatgcctactttcaaagtcgtgcattgctctatcgggtatgaagcatatccccgagtggaaacgattaatccaccattacctactgaactataaagactggatattattccactctccactataagtacacgtggctacaggtggtgaactacactatgactcgattgggactcaatgtgaacggcactcacaaggatacactgtcggtactgactctgaacatctcctcttgaccatcgctgatctaacattaccgatctatcgacctgctgcgcatactacacatacaggtacaacgggtaacataggtgtagctatgccaactcacatggagtccatagatctgtgttgaatcataccaggc

SEQ ID NO: 73964 - DNA, 9096 bp, Oryza sativa
gtttggaattttggataaaaattccgggcgtgacaaagaatcatccaatttggagttcatatgattgagataaactagtttatttttgcagacggctccttaaaatgctcgtatggaaaaattgattttttcatgtgggctcttaagtaagccgcatgcaaaaatgagctcatttttgcatgcggacctcttaagaggcccctatggaaatattaattttcccatacaggtgtcttaaagagtcgtatgtgaaaataaagatcaatttttgcagacgctgtcacttacggtccgtctgcaacctaaaggggtccttgtacagaaaattctttttttagtagtgagattattcaaaataacaacgaggataaactgtgttggaagcatacttctaatggcacatgcaacacaaaaagtgcatacaaggagatcattaaaaaggggagaaactgtgttggaagcatacttctaatggcatatgcaacacaaaaagtgcatacaaggtgcatacaaggagatcattaaaaagggggagaatcaaaatctgcagcaggtaagtgctcaaactacttacgtaatcaagaaaatttagaaggatgaactcacccttccaaaggtcaacgtctttgcttggagacttatcagagaggcccttccaacagctcaatggctaaatctcttagaatttctgatattttggctgctgcttgttgtagacgtggtcaacctgaaactgatttccaccttctctttggttgtccctgtagtaaattaacctggagaatttctgaagctaatctatctgttggcaactttttgtgacaagtcgaagcacgatcgcagcaccaaaacgccttgtggtgatatggagtcgccaactacctcgatctagccaaacggccaaatcaagatgggttttgtagaaaaatagctaaaccggcaagcggagccgatttagatatcaaaatcagcctctaggccgatttagatctatatgatgagaactatccgtctcgtgggcaaaacagaaggttttcaggacaaacctacaaataggtgtcgcactctcgcagcggcagcggacgatttacggcgcaaatcgacaaaaatggactacaactagagtaaagtagaaaacgtgattcaagtagattgtgtgttcggggtattacaattgaaccggccttgtcccttaaataggggttggtcttgccctctataggcccttctccacgtccaactcgggatagaaaccaaaggaatcccgaaacatgctttcccgagcaaggaaacccgagacccgacgaaaacagactcagactcggaccctgacagtctgaccggccatatacctacagtcagaccggagttcaggccgcggtcagaccgcctacatacttgcggtctgaccggctctgtgaaggaaacccggcactttccaaactttggcaattttcccctattttgtcgatagatgccaaatttggatgtaaacactatctactgacatctttactgataatttccctctggctcatattattgcttatattgcctctaatagctcacatcagttgggtttaaatagaactctcatcttaatgtggcagatgtggaaagccaggaatgacttgaaatttcagggaaagctgaaagagccaactaaagtttgttttgtatctgaagctatggcaaatacatacaccattttctctgctcataagtctttgcaggatgatcatcaggatatggagcaagaaagaagaataaaaaacattcccaatggaaacagatgctatgtggatgctgcatgggaaaatggcttcaccggcacaggaatcttgtttcacatgttgtcttcacataatgctcttttcatgctttgtggctcattcatctttgcaagccgaactggtgggtttgcaactgacaatgcactactacaatagctatttttccgtgcggttgttttgattttggcgtgcggttgttttgcccgtctggaacattgcgtctgggaaaatcgtgattttcttgtgcaggtggcgcaaccgcacgtgaaaaatccgattttcgcgtgcggctgcttatgcgaaaataaaaatccaaaaaaaaataaattttcaaaaaaacaaaccctaaccctagatctagatccggcaccccaccgccgtgccggccaccaccgccgccggatccgggcgggggactgccgccgccgccagatccgggcggggggcagtcgccgccaccggatctgggcgcggggagggcggcgctgctcccagccctgccgggcaccgcctcctcccgctcccggacacgtcgtcggcccgctcccggccgccgccttgccgccggtgtcgtcgcgcgcacgccaattcaggccaccacctcgtcgtcgtcgtcggccgcgtgcacgctgctccgagccgccgcctcgccgtcgtcgtcatcgtcgtcggccgtgtgcacgctgctcccggccgctacctcgccattgtcgtcgtcgtcggccgcgcgcacgctgctcccagccgcctccccacgtccgcccgccgctgccgtgagcccgccgcgagccctctgcgcccgctagccaccgtcgacccctccgccgagagccgcccggaggagaggaggagaaggtgagagagagagaggaaaatgagagaagaggaaactgagaagataagggggagggagagaggagagaggtgggcggggggagagagaagaaaagtccaattttttttgaataggatgggagggaagtgctattttcctatgcggttagattagaaggcccgcatgtgaaaatagagctttttttgtgtgcggccgtgttaagtgacccacacacgaaaatcaatgtgggcgacgctccccctatttttccgtacggtccaacgaccgtatggaaacaaaatagggtggcgtccagaaaagtcaatcatgtagtagtgatggaggtggccaattttctaaactttacagggattacctttctcacaaacgatgcaacaattactgacagtgccaaggatgattttgatacaggtcattggagtcttaggggctgtttggatgcttgcttcagtttaccaaagttctatagctaaggtgtggcatgccacaatttatgtggctaagaaattcttgaccacaagttaggtaaatgttggcaaaggtatgtgcctatgacaagtagggtcacaaaattaaaaagtgtggcatgataaagatgtggcaatcaagcaaacactaggctaaattggtcaaagtagcttgccaaagttgtggcaaagtatggtcaccatccaatcaaccccttagacttctttgaagccaaattaagagtgtgatcccagaaaatcctatgcatgtggtttggatctcaagaaaaatcaacagtgtagctgataaaatggcctaataagctacttcctccgtttcatatcataagactttctagcatcgccaatatttatatatatgttaatgaatctagatatatgtgtgtctaaattcattaacatctatatgaatgtaggcaatgctagaaagtcttataatatgaattggagggagtagaactcagcataacactgatccttctcaactgtaacatctcgcacattgcatctcgcacattgcttatcctaatagagattgtcatgctagaaatcttcaaaatgatttcgtttcggtgaactatactattaactatgtactacctctgaaattactattaactatgtactacctccatttcaggttataagattttctagcattgcccatattcatatatatgttaatgaatctagaaatatatatatgtgcctagattcattaacatttatatgaatgtgggcaatactagaaaatcttataatatgaaacggaggaagtactatgtttcttaaaaaaaaaggggagagacgtgagaggtggttgaacatagcttatagctatgttcccaacccctctcccgcattttccgcgcgcacgcttttcaaactgctaaacggtgtgttttttgtagcaaaaaaaagtttctatacgaaatttgcttaaaaaatcaaattaatctatttttgaaaaataatttagctaatatcgctccgttttccgtgtgggagggtaaggttcccaaccatgcccagcaaacacaggcatagacctctagagcgcggcggacgaccccatccacgtggtaggttccatatattgccttaacaccctcagaatgttgggattcaaaagattaaaaagaggtgccgccacacatgattttttatctaacaaggagaacttttacctctaagaacttttatctaataccggcctaattacggtgtaaaagcacaagagaacttttgaagaccgcattttcgccattgtagatatatcacctctatatttttaccacgtgtcatttaaccattgggagccatttaaactgcctgcaaacaacttttgcctcttgtatacaatgatatgggaccatactgcaaacagcaaccgtctactatgtacatgccacccctaacaacttatccctaaaccgaacagaatcctatcatataactacaagaatttatttaatctatgacgaaaaaattcgtcatggatcactgaaaattcgtcacaggaattttcccatgacaattatacttatcgtcatctattgagcgtcaaagattaaatttgctgacgttttctccgaaatcgtcacagatcagcacaatctatgatgttttttaaccgtcataaaatgcttatgggctcgtgtagtccagcccaggcccaacctttgtgacgaaattaaacgtcatggatggttgccatgtggcggctaacatggcagttgacgtggtcgtttggacacgtgtgcgatgacatgtcactgatgacgtggcagctgacgtggttgttttgacacatgtgcgataacgtgtcactgatgacgtggcagctgacatcagcaattgttttatacggcccgttatttttttgacggcccattaatttttaaacagcccattaatttttttaactggcctattttaaaataggcccatttcagaactagcctattttgtcaaccaactatcagatcaaagcccactaaacagacccattaaatttgagcccaccaaattcaatccaatttatcatacaatctcagattcaaaccaacacatctcaacaaacatccaatacaacacaaaatttacaacacagttaacagccaaatctagtcacaatccaaatacaatcacagtaaccaaaatttcaccggatgtcgcatgaccaagatcttccaagtgagcttagcagcactgcatatgcacaagataaaacatcaataactgccatatcatcctagtttcttctactgttcaagcacttaatagatgaataaaaaatattcatgcagttactgatgtcacggacatgctgcaatgtcaggatcgggaggagctgtctccctctgtatgttatctccacctgcacttcgcacatttctgaaattttcagttcatctcagttcagcattttgtaacaaagaaactaagcatgctcagagatcaggcaaaacaatatatatatatttaccccttttcactgtggaaataatggttttcacgcatgagggagaggcaccctcaaatttccttactaaagtaacagttataggtgaaaaaaacaaccctacttccgatcctgctaccaaataaatagcccagttctttcgtgaactctgaaaagatattgaaatgcttttgcacttgtacagtggaaaaattggtaaacaaaaagaactgccagccctggtttcttcctattatcccttaatttaaaaggaaaagactgacatcatgctcacaaatttccaaaaattgggtataaactgaggcatcttaaactgcaatgcaactgcttagcatagtataacatgagaaagcccagccaaaagtttgctagatagccaaaaaaaccacttcacatgttaggaagaaacatgccactacagttttgacattcctgagcaccacatatggtggcaaccaatcctttttacatgaataagataaaaggagtcatcagatttgacattcataataggatttcacttattactttctaaaaaaaggtgaccataggactcataggaactcaccaaaagtgaccatgggaaggatgaaagttgaagcaaactcagcaattcgcacaggaaaaacagcctcatttcaatttggagcacatccaaaacctctacacagcacaccaatacatctctagttgcatctgtagcccatctaccgcagcaagaacagcaacaatcacgagggggaaggaagattagggaagcgagtagggtggatataccttgatgtagatgttctctgtttactgatagtttgctattactgtttgttaaaaggaaaaggaaagatggctagtcctgtttttgtagaatatttttgcagcatgcacatgtttaattgctaattgcaaattgcagtacataaaaaagtggtaatcttttatttcaggtggatatgatccagatatatatggactattggagattagtacttttgatttcatcttactgttaacatttatatatttcatattttctgaaagtacgttgaagtagagtttaccattcgatatataggaattgtgaaaactgctcaagtgatggataaataaaacactacataatgcaagtctcttgttcaaaagatcatgtcttacagctatatgatattatattggtttctcattctgcttgcaggtcagatgataattcattgaggttgattgccatagattgataattctacaggttaggagtagtacttataacgtatagatgcaattcagtttcaacagtcatgaagtgttgatgaattatgaagagctcaagcaatacatctctagttgcatctgtagcccatctatcgcagcaagaacagcaacaatcacgagggggaaggaagattagggaagcgagtagggtggatataccttgatgtagatgttctcggcagccttttcctcctcgccgagcaccttgccgccggaggagaggagccgccacagtgtgagccacgccggcagcctcgcctgaaccccctcgcattgactcccttgcctgaaccccctcgcattgactcccttccgccgccgtaccaggtcaccgtcacctccaccgaccccattcacgccggcccgcctccgcggctccgccaccgcctcgctgccggcctgcccgacgggccctccgtctctggcgcgccgctgtcctccgcctctgcgacggcgccaccagatccgccggagcaggctgtcactgtgcccgccgcccgccgccgagagccgagctccttcctagggcggcggatccggccttccctaggacggcgccgccaaatccaccgccgcaggtcgttgccgccgcgcctccttgctgccaccgccgctcccgctagagttgggacgccggcgagattgccgaagaggggggggacggaggagcggcgagaggagcggagggggaggcggaaggggcggcgagatccgagggggctgtggatggtgggcgaagggaggaggacgatgacgacggcgtggtagccggcggtgtgagggtggggaaagagaaggtgaagaatggatggctagggtttggatatatgtataagaagctatgttgatgcgattttaccagaataaccctggtatctggaaacctattatacaagttacttggacaaaatggtcatttaacgtggaaatttcaaaattttgaaacttcaaatcgaattttatcataataaatgaacttatgtgaaaaagttgtttgaaacaaagttgtataacttactgagatctaccaattttattttggttatttctccatctgagtttcattggcctatataaaatttgaatttcaaattatgacaacttcaaacaatattttcaaaaactaaatgatctcaaatgaaaagttcatcaacaacaaaattgtataactcatcaatatctataacttttattttggtcatttttctatatgactttgtttcaacggtttgaatttgaatttcaaattatgacaacttcaaacaaaatttacaaatactaaatgatttcaactcaaaaagtcatcaataacaaagttgtataactcatcaatatatataacttttattttgatcatttcttcatccgacgaagtaatttgtaacattgttcacaaaatctacatatctctcttattttttataaacgtataagagatatgtacattttgtgaacaatgttacaaatcacttcgacgaatgaagaaatgacccaaataaaagttatagatcctgatgagttatacaacattgttgttgatgactttttcagttaaaatcatctagtacttgtaaatgttgtttgaagctgtcataatttgaaattcaaatttaaactgtttaaacaaagtcgtatagaaaaatagccaaaacaaaagttatagatattgatgagtactacaactttgttgttgatgactttttcagttgaaatcatctagtacttgtaaatattgtttgaagctgtcataatttgaaattcaaattcaaactatttaaacaaagtcatatagaaaaatggccaaaacaaaagttgtatatattggtgagttatacaactttgttgatgacctttttagttaaaatcatttagtatttaaaaatgttatttaaagttgtcataatttaaaattcaaattttatataggtcaatcaaactcagatggagaaataaccaaaataaaataggaagatctcaataagttatacaactttgtttttgacaacttttttacataagttcatttagtatgataaaattcgattcgaaggtttaatgttttgaaattaattgaaggacggagacaaaatagacttattggcgagggaggagcaaaaggcctgttacgggccagcccttttgctcatcccttgccgagaagtccattttaccttcctcctttcatttaaattcaaaatattaaacctt

SEQ ID NO: 73965 - DNA, 9311 bp, Oryza sativa
  unsure (1)..(9311): unsure at all n locations
attcctgcagcccctgtactcgtacacaaaattacaactggaaagcaaagcaaagaaaagcaaaatctacgcgtagatggatggatggatggatggagaagaagaatgctagtggtggtggagaagatggacagatggggcgctttaaattggaagagaattctccgcgtttcgcagcagcggcggccattggaggagtaaattaaggtcgcgaggaacatggcggcccagcctgtctcctcctctcctccatggctaccatctttctctctggccatctctctctccagtacagtgatcagtgacgcagtgatgctgctgctgacttgcttgttgaatccggcattacgctgtcgtacatctcaatgtgctagatactgtacagctattgaagaatttaaaggaggaggatttgttttctgccaagaattttcatgaacatggtaacaacaattcctacggttgaggaattaacaaaaaggggtttcttttgtttctgcaaaaaaagttcatgaacatgaaaattgtaacaattcctacggttcaagaatgaacaaaagacggcttttttttttggttgtgccaaaattattcaagaatatgttacccattttctgtactgcaattacagtttcagggcgcattatgtgctcgaccgtatcatcatttcatcacggaccatgaacatttcgtatttaccagggaaattaatcgacgagaacaaaatctgaaggtgaatcgggaggaaatgcacttgccacgtgtgtacgtcgcagtacagagtgaatttttttgtccaaaagaacctccattcttggcctcgtatcaatcaactcctccatccgtattccgtagtaattgtaccaagtaatcttaactaagggtgtgtttagttcatgctaaaattgaaaatttgattgaaattagaataatgtaatgaaaaagttgaaagtttacatatgtaggaaagttttgatgtgatgaaaaaattgaaagtttgaagaaaaagtttgaaactaaacaaggcctaagcaaatggcatgaacaatgcatggatgaatggtacggtttggaaaaagttttttttaaaaaaaagggagggcaaaagttttgcctcatatatattgatagagcaggtttttcaaaaacgttttaacttggagtaaagaaaggtgcattcggcagcgcaaattttcaatttctacctcctcatttttcacacatacattttctgaacccgctaaacaatgtatttttttataaaaaatataagaggttgtttttaaaaattatattaatcttttttaaaaaaactagctaatacttaattaatcatatactaatgaatcacttcattttacgtgtgcgggaggagaagttttcaaccatgttcgaacacgagacctagtgtaattaactgcctgcaatttcatcgaccctctttctttctttatttcttttgtttatttctttatttcttcttctttcttttcttttcattttgttcggcttttgcttctacgagtgggcgatagttctagatgatcctatgtaggagtggctcttgtgtactctacaataattaaattctttcacaggacccttagcttggaagacaaccaaaatgaaaaggtgcttacaagtatgcacaacagtcaaaagagggaaaatttaaaggcaagaagataaagaaaagaagggaacaagttaacatgcatatgtgtaactcttttgatgggcacatgtataatgatccaccactaccttgccttgaggccctgttctttttttttaattctggtattttaaaacaattcttaacttactacacggtgtgtttcgtaaaaattaaaagtatataaaatttccttgaaacacttttctaaagcaacattttaatttttctaataattaattgatttgtttgtaccctccaataactataaaagaattagattgtgcataaattttagctatctcaaacaggttctaatagaaaatggtgtgtcacgctaactgcatttgcatcgaagtttctcattggtgttggcactagttttgcatttggctcgcttaaaacacatgaatctttcttcttttttgtacacaaaataaatcattttaatttatgtgaaattcatgtaaagctaatgtagaattcgtggctttacaaaggagtgtgtggtccctccctcacggaggtatagacggccgtgaaaacccacttgtttaaaagaaaaatgacaagaatattctggttttaaagatctgaactttggtcatccaacaaccagcccctgatacacatgcttttttttcttttctaaaaggaatgtgtgtctcttatataatgatagtatcttttacactttacagatatgaactaattgcccaattagttatccacaaagacataccctgatactcctttcttttttctaagaaggaatgtgccatgtgtggtgcttattaatactaggagtatgttacatttatttgcaggtatcctatgaaagcatccatgtaattaatattgcagtaactaattaattgtctagttgacaagagaatgtaatacagaaaaatagccaaccaattggtcaccttgcatgggagaagagcagaaaataagaaaataagcttgcacatggtcgccagtttgttaatttgtcacaggcatgcatgactacaactagtacgtactacacttttgcagacaaaggctagaatggaggacaattagtattgtcttatggctttaattaatatacgcgtggtgattagtggagcaggattagttataagtggaaatcctaatcctttgaccatgctgtcatgcaggcatgtggccgttgaaccgtgtcgaagtagtacaggagtagcaggcaggcagcttgcttttttttgcttaattaccctagaataattaatggataaccctaccatggcattatctggcctgccctggcctgatgatgatgcttaaattactttttacaaatgttttgctgggtgagttcaaaagaagccgtaatttgtgccgcttaattagatggaggaggacaatagagttaatgaatgctacagagacttgcgtttttttgggtgaaggtaccgacatttttttgcgagaggacgcaagtggggagctgcttgttgccagctttcttggtttcaaacgatgtacggttttactacaaaatcttgatcaactgatgagttacaaaagaagttggtgaaaattttgacgttcccgagcttggtaatgcaagaccgtattaatttaagcatatgcaagcctatccaaacgatggttctgtactgagtaaactttggctctgtttgggagattctaggagctgtaattttttcaagaatttccagctcttaaaatagtctatattctcacttagactctgagaatatatagctataggatccagaaaaagaacttgattttttcagattgtcagaaactacctaccagtcgactgctaatattaaactctcccaaatagaactttaaatgcgtttgtaaggattaatcatattattaaaacaaatcatttgtttcatgcttcaaaaaacatgttttcttaaaaaaaatcttcaactgttgtgttgcttttatttcttaaaatatttaatttatacttataataaaatcaataatatgtgataataatatgcttaccctaagactatgtgcttatagattttctttaaatactcccaaacatttgaaattctcatccagagaatatataacgatatactaattcagaaaacaaagtaaaagttgataaacctaacccttttttttcatactcttactagctctttctaatcttaatatcctcaaacagtgtgactaaaccacgtactcccggtggtactagcagtatagtaatttaatggagaaaagttccatttctataatttatatattattatgcgcaaattaaggagccctgaaagttgagacagcggcattgcgtatttgcgtgcttgctcatcagaaaccgcgggagaaatcaggggcacgaattgcgtttccgcgtggacggcagcacaaacagctggagtttgcttgttctgcgtgcacgaatcacgaggcaggcagcacctctcttcctttctttttgagtaaaccctcacatgcagccattttgcctcgtgatccataccaatatactccatccgtgatccatcctgccctcgtaaacccaagttaccaacctcaaatccacaaaagaaatgtgtctagtttactgcaacttactcatagattataatacttcaacttagtttgatgatgattagtgttggagcaagcaaagcatgcctctgcatcattttgccttgtagagaccgttggtgaggactgcatctgacggcactctgcatgcttacttttccatcatttctaggaactcatcgctgcctgcccaaactcatactggcaagttcagtacaacggcagaaactcataccagaagaaactagtggcaacctagccagcatttgaaactccttcaagattcagatttcaatcacctggtaaggaattcaagttttcagtctgaacttgctgagatatcaagattttataagcctgaaacttcctgggagtttccttcagttttccgaatttctagcagtcaagcccaatatccaataataggctttagagttggaataagttcacctgccgtccctcaactttacaccgagtttgtttgacataccttatcctaaatactagaaatctttgcctcttaaatgttcagaaccgtgcaaattaggtcctataaaatcggtggagtttcatgatttgggcataatagcttacctggtcgtgcaggtttgggttttcttttcggcccaatgctggcctgggcgcctggcccaacaactcaagcgttcatgtgaaaagcttgcttgcagcttgtatcagttggttgcaaggacaagataaggaaggcctcctttgaaactaaggaaaagcaataggaattcttgaggattttatcctacaaaaaaataatccaatgaagccatttgaaacaaaggattgtttttctttgaaattcctatgaaatgaatcattctagagcaagtttttctcttcaagtgtatagaattcctgtattttctctgtatgctaatcaaacaatgtttcgaaacattcttgtgttttaaaatccctaggaatccaatgagtatgaacattattatattcataagttttccctattcccgtgttttctcaatcccacatttcaaagtggcccaaggcccatctcacatatttgtgtatttggccttcacgcaaaagccgggcctctggccttctctctaaaaatctcacatatttgtgtcacatttttttccctttttataaattctgtactttgatctactactgtgaactcagtttgtttcatgtttccagttttcaaaatgaacgcaaacaagtgtacgagatactctgcaactctgctgattgacattgactaattctactcccagcaatgactaaacttttaaaatttatttgaaaagtacatgtaaagtcagcctgaagatttgaacgcgagagacaaattgaaccagaattatattcatgtggcacaactgcagcatcatcatcaagataaggaataaaatggtagagggtgttgaaaagttcagctaatgcagtgcaggtggtctacatcaaaccaaaaaaaaaacaaaatttaatttctgcagaagaagaacatccccattagtgagtcagcaccaacaagaatataccgattgattgatgaaactagcttctggttgttgaacattgggctgtctccactctgcagagagtgacagacagaaagatccacgaatattcaccagcacatccaagaacaatcccattttcaacattggatacaccagcaaccaactgatttatatgctccagttaattcatatctgtacatttgcatgaattttctccttttcaacacacaagatgaaaccccaaagtagcacacactttacagcattcatctgcaggaagatgatggaactgttaactgaacattacctgaaacacactaatttcatttcagctcctctgaagaagtcacaaaactgatgaaaactgtcactgtcagtaaaatatcgatcttgatacacttgtatgttacacacaagacacgaccagagaccaacataaggatgaagatcataaataaaaatgcaagtgaagccatgcttgcacaggtcaaggctggggacaagttcaaagcaagcatcaggaatgctaataatgcctcagaatacaatagattccggataagaatgggtgatcatcctgccctnnnnnnnnnnnnnnnnnnnnnnncgaacaaatttatagtaatatttagcagtgcaaactttggcttgattgcatgcagaggcatgcataaacgagaggtgaagatgagttcagatgtgtcatgtgtgacgcgacttctcggaactgaaaaacctcacggcaataactaaaatcacaagaatgttactactagcgaagaaacctgcagacttgcatgccaagaatgctcacagtttcgtcgagaaataatcggagtcagaaagatgcagtctcgcggttttacagctcatgagagattcttggtgtgtgatcctctccgtcgcctcctcttccggcgccgcatcagattcttggtgtctgctaatctttttctctctctctttccttttcccttttgtttactctgatcgcatactttttttttgcagcaggtatatttatactatcttgatgtaattgtctaaattcaataaaaacttcaattatcttaaaagaatgtacgtgtgtaattgtttaaattcaatgaaaacttaaattatcttaaaaaaaatgtacgtgtgtaattgtttagattcaatgaaaacttcagttatctttaaaaaatgtacattttcagatatatgtggtgaaaagaaaaggattgggatatatgtggaagacagaggtgttgttggtgtcatggcttggctggtcagttggatgaaacgactctgctgcggttctggacaagaaacttattatgatcaggattcattcaggggtaaggaccacctcaagtcccaagaaaaaggatgaggatccaaagttttttttttccccttttcaattcaagaatccaaagatttttattattcttccttgttctggctcttgatgccgctggaatgttgatggccatcagaagccagaaacatgccctcttggctcttgctaaaataggcctaaaaccactgtccatttcatatacttcaatcagcaagaacagcaatgtcaagcttatcagaactatagtaatatgcttgattgaaatggaagatatcaagaaaatcactcaagagaggttggaaacacgatatgggtaaaattctcagggcgaaaactgtagctctgcccgaatcctttaaccggcaaaactcgccgcaaaactgtagctagtatcatctctttcgatatacatgacaacaaccaactcaccatcagtttcatctcaagcactcaaggctcgatctcactgtatacaaacacctacactagtctctcctctcaaactcctccctgaagatctggtattatttttcatcgccgcgccgcaattaacctaacccaccaaagctgtgatgaaaatttctgatgcaacatcatcttggatcatttccagccatagctctcagacctgccatcctcctcctcgcagctgaccgtcgccgccgatgagccgccaccggccatgcctgagcctgagaaatggagaggaccctcaggggatccagactgggagctgctttgctcttgaggaatgtaacagagcccttgcatgagcacaatcggttggttcacaattgttgagcttggcactctcggccggttgtgcaggcggtacttctgcgcaatcagaatcgcaaaaatcgacatcagtatcatcgcaaatccgtcgcgagaagtcatgattgttactgaacattgatgaagaaaatcttgtggtaaacaaaaaaaacagtggtgaattttcctcacctgaagatggcttttgacctcgtcatttgtcagtccatccaccttcatcagctccctgatttgctttggagtggcaactgcacaatcaatcaatcaatcaattcaggaatcaatcaccatgagcaactaattactaattccaaagtaattaatcaccacatgcagatgcaggtgctcttagctctagaaatggcaattaattaatgaattaattaagtgtaccttgagggccaccgagttgctgcaaggcggcgacgaacttgcggtggaggtccggcgaccagcaccgcctcgtcttcctcgcctgctgctgctgctgcgccgccgccggctgaggctggggctggaggctgagagcggggccagacgccgccatggcggcagccctcgccgcggcctgggagaagcccacgacctgacggcggctttcgtcggcggcggcggcggaagcaggcggcgagagcagcgacagatccggcatcctgacgtcgtacgccatgtcctccttcctcatcaagctctgcttcggccgcgcgaaagccggcgcgccagagcccacaaacgcgccgccgttggacttcgcctccgacgagatcctcaccttgtcctgcttctgcgacgatcgtccaaatttcagccaccgaaatccacgcaaccaaacaaaaaagcatccattgaagaatcaaacgaaacgaagtctcacctctggatcagcggcggcggcgtctgggccgccggaattcccagtccagagctgcgcggtgctcatccagttgctcttgtcgccggcggcgtcctcctcatcctccttacgatcaccacccttcttctccacctcctccttcatcacatcaatcactgcacgcaagccatgcccaaatcaacaactcgccaccacaaaacaaaacaaaaaagaaagaggcttttttttttgtttaatagttattaccgtcggcgaggaggcggacgcagagggggagctcgcggcggaagacctcgatcttgcccatctcctcctcgagcctccggatgcagtcacccatggcggtggtggtggtgtccttgcccctgacgcggccgaagctcttggcggcgaacatcttgagatccaggctcaggtccgccgcgccgacgccgatttcccccacatccagccccatcgcgcatacaccacccctccacctcgatcgagaattcttcgagaagcttgttg

SEQ ID NO: 73966 - DNA, 647 bp, Oryza sativa
cactgcagcgccacgtccaccaccgttggcatatatatatgacaagagagaagtgtcacaaggaaaggtgacggggtgcggtccgcggggcagctagggaattagtgacatcatggccacatgtgatcagctctcctatacttgggcatatcgaaggaagcttaagaggttgcggaccttctatttaccctagaaccattgatgatcacttgccctaagatgtcgctgccctccaccggaacaacctgagcccgagatccatgtcagcgccgcatgagccagatctcccttgcagtcgccgttgttgttcccgatcggtacagccccaccgtcatgcctgacatgatgggcctttgtcgtgctcaactagtacaaccagctgttgaacgagttgtagtgctacgttgactaggtcaacgtgttacgtagaccccacatagaatgaaaccatccaaggaggtaaaacgaactagtttttttttacgggaaccagcaggagagactccaactgaaatgcattgcaaaaatcggagagtatttataaaagactgtaccgcggtggtgttaggggggagataaattacatgttgtcactacatgattgccatagagggcagtcctgaacttttacctatacaaaaataggg

SEQ ID NO: 73967 - DNA, 7051 bp, Oryza sativa
tgtaacaggataacttaaagccataaaactacaagaaatggcaaaaccgtgtgtggtaggaaagatatgcttacgcggcacctatgttgacctgaagtatcaatccagacgactcgaacaaagagcacatcttgttcagataatggtatgccgttgtcagctattgctgttatctgaccgactgacccgttggcaacattcaacttgtatagatacaatgcatttcgtctaaatatgtcctcaactgcttcaatagcttcttgaatgctaaggtcaccatcttcacatgcagctgagagtacacgataaacaacatcacgtgccctccttgcacctgtaaatcaaactccatagttttgcacatttttttaagagctttactatataatgacttttcacttaacttatggaacaattatggctaaggaatgtacctaggtaatatgtctctggaaaagcataaccatctgtgctgaacatgacctagaaatgataaaattagaaatgtaaagcatggcatatcttcaaaatgggcaaaaactagttgcagatatataagtgaaaatattacactcgtccaggttcttgcaaaatagatcagaatgaaattcttttacaaggcaccttgagtgaatactacaatgagaactaacataatgaaaattagatgcacttcaagcatgtaggagggaaagaaattcccagacctctactgcaaaatattgcagtaatcctacaaagcaacaattgttaatgggattctgtatttatcagttctattattcattatcaataatttacatggtatggaaaacagggggggcaatatgatattgagttgccagaaaataaaacacagttcagctttccataaatcagtggaacatacaggtaaaatgtggactgtttcaataacctcaaaaaaaaaaaggaagcaattatccagaagacagagattttaccttctttatgggagctagctcaaggacctctttaattgatgatgtcattccttgaacactaagttttggaattgccaagccaaaatcaaggtatacctgtttgttttaaacaattaaaacataaagtccatcaaaggcaatgcataagtcatcaatcatataaggatcccacctgggagtacactgatgctagatatgatgcttcctttgaaaatggataagaggcatgtaaaagaacaatttggcacttagagaatcttgtgtcctcaagaacagcacgcagatggagagggttgcactttcgcaagtccaggtccttatctccaaatctgaaaaagggtggaaattaattgaaatattgaaagtttaaaacagaataatcatattttaggattaaaatgttgtcatcaccctgtgtgaatctgcattggcaggtgatatgatacagcaatttcaagactgcaagtaaatagatagtcaatcaggttcttatttgtaatccgaagaggcctctgacctgaaaaggataaaatagtccaggtgtataaaatattgatggatccaacaatgtgttctcactctctcctctctctctccgcaaaaaaatacattacctgataactccttacgtagtccatcctctgcatctgtcttgctaatatttggatcaatctctaagccacttctatatgcagctatacttttcaatccaacaattttgttggcaactgtgataaattagttaaggaaatcaatacattctaaaacagtatacaacaagaactatccactgcgcctgaaaacaaatactggggaggatatgatttcagcttagtgacaaaaatttcagtaaaagagtcaagtgtccagcttgatgcgctgaatgattcctgaaaaaagtttattactcatagatgctaacagaattatgaaagctgacaaactttgtaaaatggagaaaaggtacaactttggagaaaatagacaggtcagaacgataaaaaaaatgcactcacatcattaataattgtttctgccagcttttcaatcctcagaattctgccaactgtaggagcaaacgccttgtgtgcctccagttcaagcatcttgtcaaagtctatgccatcatctataagaattgcagataagttggcagccttgaagcactttgagcttatagacgacaacccttcagcccttctgaactcctccaccttctcaagtgaagcttcacagttgtacaatgcagcgatgtccctcaggcttctctgcatttcacgacgttccaaacgatctaatgagcttctaaaaaccatactcttagttgcaacgaaacaactacgaatacagcattacgaaagcaagaatgtactagcaacatttgcaggttggaacaaacagagagctacgactcatatacagcatcctaacactgcacagagtacagacaaaagtggtccacatgaccacatcacatgcatgcatgccggcatggacacctgctgaaacgcacataatttctcagacagaagtagaacagtgaagcagtgaaccatgccgaaatggcccagtaactcctctcatgtgtcatggaccctagcaacgtttccattccattgctcgcatcgcacgcctcggtgcccacatccaccaccactgagctctccttgacagggcaaagagacgagacaaaaaaaaggcgtgtactactcaacagtgctgctactatgggaaattggcaaagccgacataaagcctgtggcctctgccatgccaccagttaaaagagaaggacggattccgcatattccactataaaccacatcgccaatctcggtaataaaatggatcatggagacgataaagttcgcattccgttttcatttctgccctgaaactactctccgaaatccaccagtggtggcggtggtggtggactggtggttgcagttctgaacctgagttgaacacaaatttctctcggaaaaaattcattggattaagacagaattactgttgactcggctttcggagtaaccaaatccagtgaaatacagtgattcatttttttttcagatgacaacagtaaattttcactgcaaaaattatctgcatcactcaacagtgtatatattttttattttgcaaatgaaaactctgcagccgactcaatctagcacacactgttacgcgaactagtctgacgaacagagtaggggaagcgcacaagtcgtagccgtcgcgatctcgagcagcacacggaagtaagcggcgtaggcgacccaacggggccgtgcggataaacggagctgagaactgcatgtgtaccttgaaggagagggtgtggggagcgagggcgagggcgtcggcggcgtcggcctcggagaagcagcggaggaaggggaacgcggagccgtcggcgacgaggttgtgcgcgtgcgcgtccaccgccgccgcctcctccgccgcgcgccgcagcgccgcgtacttggactccatctccatctccgccgggctccggctccggcggtcgtcgtcggtggccgcctcgccgccgctcgctcactcgctcggtgtctcgaggatttttttttttttgttttgtttttaagaaatttttttttctctcgcttcgtttgaccgcgcggaatttgcaacgcggccacacggggcgtggggtttttataagcggggcggcacgagagtggaggaggggcgctgcctgcggggcacgtgcaccgcaactgtccgcttcggctagtgggttagtggtgaccggtcaccggtgagcgtcgcagtttgattggctggctgcctggcatgtgggtccggtttgtcagttgtcactcgggggttgcgtggggttataatctaaagtaatgaaaaaactaaaggtgttcatcacctagatgtgccacgtcatgggaaaattagaaccgttggatgcagccagatattgaacaacagccgtttattctcaaaataaccaaaagaaaaagcatggtcaagggacttcggaagtcaactggaagactcgtgaatccaccacggcaatatccgaaggtccgccaatattaaaagcccatgtgtccagcgcgatatatagggcatcacggatatagcccaaaataaaagaaaaagtcgaatttcatggatatctcttttaatgaacgaaaaatgtttattccttccatcattgagccacgtatacttatatagcatgaacctttgaatttggtgtgaacggttggattaataatgaagatcgttggaagagtcaggagacttccatcggagagatgaaacagaaaagacaaaagtaataaaaatccattcatggggtaccgttaagtaagagaaataaagaaacaccacagttaaacttaattaaaataaaagctactaaataatagtaaaaagagcactataataactcaaaataaatcatcgtattctttgcccacctaacaacatttaaatatcttccactaacaacatggtactctaactcctaatattatcacagcgtatatctttagtatataatacctgtaaatctcactctttggcaaaacttaaatatagtagttccaatagctgtaattacctaattaaattctaacatatataattattacaaacgatatgcatttaaaaatgcaagtcatagtcccaattattatagatctaattacctaattaaattttaacatatataaatgatcggatttgttagaaaacttccacaaattttttgcccctaaaactttcagatttgtcaccatcggatcgcctcgagatttgtgtatgaagaaaaaaaattgttacaactaatttttcacacatgtcacgtctaaccaaatcatagttgaatacaagttttatataagttatatcgtagttactaatacaattacagtgtagttacaatgtaattatacttcaattatactatagttacatatcaaagtttttgactcaaaaaatttacgataattttttaggtattcccatgaatgatacttaccgttaccgttacatataaaagtgcaagtcatagtcgtatgaatgtacgacttaattggctagtatgaagaatgtacgacttaattggctagtatgaaacggaggaaatatatgagagtaaataggtagatcgttcttaaacaactttcgaagataggagcaactataaccgaagatttaaaggcttgagatttgcccgcaactatcactatcacttgtggtagcaacagtgatgatgaatctctacgattagtgacagactgactgagcactgcggtttgttgtggcggttgggttggtctgctgttatgtactccctccgtccaaaaaaaccaacctcgtactaacatgtgacatgttatggggttcttttcttctaaagatgaaatgtggatgaagattaatttttttacataaaacgaggtggtattaacgtatgattgattgaattttaattattacaaacttgaaaagtagattaatataatattttagagcaactttcatatagaaaattttcacatgaaacacaccgtttaacagtttgaaaagcgtgccacggaaattattcttggagaaaagaacggtaacgaggttagcttcttttatgagggagggagtaggtccaagatagcatttgggattgagtggatgaagagaaccattgccatgagatagatagtttgcatgaattattctgttttcttttttacaagtttatagttagtcactgtagcttttaattactcaatcgaaatcacaccccaagtaaaaaaaaacagctgacgtgacattatgacgacgtgagagttatgcattactatggaaagaagagggttcaggctaaattatgccacatcatatttctgaccaaatggaacagggccaggttaggtacgtactccctccgtcccataatatatgaaattttaagtttttacttacaacatttgaccactcgtcttatttaaatttttttgaaattattatttattttatttgtgacttactttattatctacagtattttaagcacaactttttatttttaatattttttaaaaaattgaataacacgaatggtcaaacgttacaaacaaaaacttaaaatccctaatactgtgggacggagggagtaaatgcaaaatgcattatccccaggccgttggctaacgaaaccgacgcgtatggttcttgtcggtgataataaggttgattgcagcatgtacctgcttttgatcgagttactgatttggaactaacgatcgatcaagctcagatattttgggactggacggcactccaaacccatttaaggaagcttgtttgcgcgtcacactccatagctgccaagatgtctgcactcggagtctggactctggacgtactacaccatccgctctttaaaaaaaatagatgtgatccctcgtaatataacgaatctacgaatctggatattgtctaaattcattgtattagaagagatcacaatcctatttagattaagtttttttagggagagagtaagtctcaaatctcaacaggggaataggttagcccaatcatttcgcttataccgatctttttgatagttcaaaggcaacgaacaattttatattataattgatgatcacagtgttgaaaaaaaaacacaattcagatatgtataatgtactttaggcttttaacacctaaacttttgtgtgtagatcattatgacaaattaaagaaaaacagactaatttgattttgacctttaatccagcctcagcgatggtgattgcctgattggtggtgagagtgtataaatgaactggtgaaatattagcttttgtactaattctgttgcgccagatctcagagataagtgcaatgcatcatgcactttgcaagttattagtattttctccgttttatattataagattttctagcattatcacattcatatatatgtaaataaatctagacacacacacacacacacatatatatatatatatatatatatatatatatatatatatatatatatatatatatatatatatatatatatatat

SEQ ID NO: 73968 - DNA, 1784 bp, Oryza sativa
tcgcttcaagcattttgcctgctgggtagtgggcggcactggtcagagagctgaaagctgatggagatatgccgcggaaacgcgagacagcaaaatgttgagttgggctaagccttcggaatttgcgagaacttctgaactccggttttttgggctctagttggactatcgcctactgggcctgtgggccatggcaaggcaattctataccgatgcaatattccatttgcacattatccggacctttctcttcctggaacaagtataccgaaggtccctcaacttgccatcgagttacaaaatagtcccctaaccgcaaaaccgcgcatcccccaacttacaaaaccagtgcaaactaggtccctcagcggttttgaccccagttttggctgacatggcggctgagtcagcgtgggacccacgtgggccctggtactccttgagtttttttttttttgacgaagtgagtaggagtatgtctgattgatgttggcggatcggggatctgcagaggatgttagggccttgggcactgctcttctaatcgtctttgcctggcagatactgctcgtacagtagccccacacagaggacttgggcgagtaattggtttgttttggaccgtgttgctctcttgctttattttccttttgattttttgcctttaagcttcccactatgtttttctccctctgaaagcttcacggttactgttcttttacactcttttttaaaagcttcgaaagctttataattgagagaacgatctaatgaatccgaaccagttgaattgaaaaacagaaaaaactactaaacggtgttccgtggcgacggaatagtactactaccttatctccttctcttcccctccactcgctcgctctctctctctctctgtctcttcccctccactcgctctctctctctctctgactacccaccatgagcacgaaggcgacgatgacaatggcgacgacgacgacgacggtggcgacagcgacgacgacaacggtgccatcaccaccagcccccgcggacgacctggacgacagccggcggggctcccgaccgccacaggcgacggccgccgtcgagaagcctccccctcaagctcctcaagccgctcctcctcttcgttgttcttgccgctagcttcctcgccgctactgccctcctcctcggcggcgctggcgcctcctacggccggggagcggtggacgcggccatcggggcgagtgctttggcacaacatgagcgatgaggagctgctctaggcggcgtcaatggagccacgggtttggcggtttggagcgaggcacgtcaatgaacgacggaatggcacaaggtaggcaccagatctgtcacttcctcttcctcttcctccgtcgccgccccgctgctcgacctccccgacccgcgactcctcctccttctctctcttggggtatcacactgatacccaggtaccaaggcctgatacctaggtaccagctcgatacctagggtaccaggtggcctgatacctaggtaccagctcgatacccagggtatcaggtatcagtcgataccagggtaccaggtaccagccgataccaatgtactaggtaccacctcggtaccttacccaaggtaccatgaggatatggcggtgaggtagctgctactctgggtgctcaggagcgacgacgccggcgaggtatggcgcgtgaggtagcttctactctaggtgctcaagggcggcgatgacgccggcgaggtaaggtagccgctgctccggcaacaat

SEQ ID NO: 73969 - DNA, 950 bp, Oryza sativa
tatgtaattttagtacttacatatgtaattttgagacttacattgtaaatacactaaaattacatatgtaattagggacttacaatgtaaatacatgtcgactattttttttgatggaaaatatggcgccataaatatagcatctcctctcttgcttctgatcaccattatttttcaggtctcgaatacccagacttcgagagatggcaacaactaccgtcaccacaccaattctctgcaacctcagcgccaagccacgcgacaccctgcgcctgccgacgacgcgttcgccgaacgacggcacgaggcgaacgacgctccacctgagctcgtcaagagcccgcggcgacttgatccgcgccgccgccgccgtctacacggtgaagctcatcgggccggaggggcaggagagcgtgatcaaggtgccggaggacacctacatcctggacgcggccgaggaagccggcgtcgacctgccctactcgtgccgcgccggcgcgtgctccacctgcgccggcaaggtcgtcgagggcggcgtcgaccagtcggaccagtcgttcctcgacgacgcccaggtcggcgccggctacgtgctcacctgcgtcgcgtacccgaccgccaacagcgtcatccagacgcacaaggaggcagacctgtattagttagctagctgcgttgcacttgatgatttgatccatcactttcgatgcaatcttgacactgtggtttgcacatgcacttgccgttgaaactagccagaatttatcgtcatcttccacttggattgagttaagtgtacgttcttgtctctgcattgttctcaatggatatctcggaatctgtcaagcctgtcgtgaagtcgatggccggggatgctgcattatcagcaatcggtttcagttctcgccgccgttctcgcggcgtccatgagaaagaatcaaaaagggatg

SEQ ID NO: 73970 - DNA, 7621 bp, Oryza sativa
aagtgaactgaaatcatttgtcaactagtatttattaacaatcaagatatctcttgtcaggtgctccctccatccacaaaagttacacctatttcacatttgagttttttccaaataagttgtttctatttgtagtctttatgcattcaagacttaaatgaagagataaattaaatgttttattagaacccaaggagtcatctaaatactcattggttgcatgtttacattcactctttgatcttgtaacatccaaggtgatttaatttcttcttggtcttggtgagggagtacttgcaggatgctttcaaggtgccgcaggtgatacagctaactgacgatgaaaagtttatgtggaagaacttgactattgccgaatgtaaaaggcttgcccatgaaaatgccaaagacattatcacctgtggatttgacattgaaaaaactttcatttttacagatttcagttatgttggagggtaagattactagtactccctccgtttcacgatgtaagtcattctaccatttttcacattcatattgttaatgaatatatatatatatatatatgtatatatatatatatatgtgaacatatatatatatatatatatatacacatatatatatatatatatatgtatagaatcgttaatatcgatatgaatatggggaatgctggaatgactttattgtgaaatggaggaagtacttcctaactgtcgattaaaatataaatgtctggctggtcttttttttttcactcagctagcttctattctatgataaagtagtaaccctctatctttttttacagggcattttatgaaaggggcaattgtgtttttgcccttgctttacgattcaattgtgattttacccctgttttttagggtttgtgattttgcccctgtttttttaaatgaaggagccgtctgccccagttttgacagaagtttggtgggtccggaatttcagaattaaacaaagatagaaaatgttattatcatttatgaatgaccattctacccttggttcaataaaagagccaaatccccaatcccttactgtcccgattttcactccaaaaccctagctgggttgcaagcggcggcggcgacgcgcggccagcgggcggcatggaggagtggcggtggggccagctgccgcggaacagcgcgcggcggagtcggggcgcgggcagggaggcgctgcggcagcgcatggaggcgcggcgtggcggcctcgcgggtgcacgcgcagggaggcgcggcggccggcggccccgtggccagcgcggcggcggagaggagcggcggctccgtcggccagcgagccagcgagcagcgagcaggtagcttggcggcgggatggcgctgttaaaggatgtaggcaggcacggcggcgtcctcggtctggagcgcaggctggggaatcagggaggcgcgacttgccgccggcgggctggcgctcctaacctcttgccggcgcagggacggaggcctaacgctattgcaaatacaggattaggagacataatggagtaaatcttgtgcatggtggaaatctgctgcaaatcccctgttttctttcccattttcatgtcttgtatctgcgacagatttgtttggtgaatggtgatttcttcctggtaaatgtgatgaatctttttggtgaatttttgcacccgatgcaagttctttgaaaatgctgcagaaatgatgttaaattcttccaaaatttgtcaaagtttggtcaaattcgaaatatatgcacattatatcaagaaaggagaggcaaatgtgtaaagggtatacaagtccttctactgctaagttgacgctgttaagtgatgctaacagaataggggcaaaacagggacagaacagagcttcgtttcaaaaaagtgagggaaaaatcacaaaccctaaaaagttagggtaaaatcacaattgcaactcaaagtgaggacaagaacataattgcccctactaaatatgcttgaagtttccaaccgtgtgacatataacaatgtgagaactattctattaagattgttctctgctcttggtgttcttgcttaaatatttgtgaacaccatggagattcattacttatctttaagcgtcatgttttctaatactcttactcttggatgacagcttaaagggatatttggaattagtccggaagatcaaattggcaaggtcagctttcctcctgtgcaggctgctcaatcattctcatcatcgtttccacatctctttcatgacaatgatgaccatctgccgtgccttatcccatgtgctatagaccaggtatgatatctctggtctgattatctcgacagtacaacataattgcttttgtatctacttgctagtatactgataatatatagatttttcagcacaaaatttggacttagtttgtttcttcttgttcttttccatctctaaatttgaatttgacccactcccatacgcaaaagccaagtttagagccttgacttgtaaacatttgcatttaaagataccaaaatgttctacatgtttgtatatagccgtatcatccatgcatcgaatatgactgtcaacattcggaaatatcaatcattaatgttggaaataacccaactagcgttataccacatgtaataaaccagtaaaaagaacttccacgcaaggtggtgtctgagaaagggaatttctaggcagcctgcccttatctgacataattggttgtatatcttcttattggcattaaaatatgtagagagatttatctggcagctctaaatttgtactgagtgcttgtcaagtaaatatttttccaatacttgatttagtgatctactatcatgaaagcatatccgatatttctcattaaaggtactggagtgttggtacatatatgtatttagtttggcatattttgagttgcctatttaatcttaatttatatttatgcaggatccttattttaggatgacttgtgatgttgctcccaaacttggttttcagaaaccttcactgattgagtcaagatttttccctgcacttcaggtatttcttttagggagagcttggatgtaggactgaacattagagctggtgcaatttgacgacttgtaattaacttgctcagaattttttttggttttacttcgaataatcataatttcacgtgcattactttatgtcgattgcttgatttccttttaacagggggagagcactaaaatgtcggccagtgacccaaactctgcaatatatgtgacagataattctaaacaaataaaggcaaaggtttcatctggaatatttactcaatcacacgctttagttcggccatttaaattatggtatcttgtagttctattatttcataggcttataaaagctatttccattattttccaggtgaataaatatgctttctcaggtggccaggacaccgtggagctccatagggaacttggtgctaatcttgatgtaagctctttcccaagtattgaccactactgaacaccaaactactatgctagaattatgcactgtattctgagttttgcttagaaaacagaagttagatttaagaatcaacacgatactcgaatttgaatgatcagcagaagctaccaattctaatgcatgtagttagaagccctttgtgtttcttgaagaagccttctatgtccacatttcagtgctaatatgctgaatattgtgatcttcatttctataatctgcctgtaatattccagttaattcctgtatttctaaagaaacaccaaagtgatctgtgaattcttgtgttgttcaggtggatgtctcaatcaagtacctaaacttcttcctacaagacgatgatgagcttgagcacataaagaaggtgcatttcttattgtggaaaactaagttgcactaccattatatatgaaactcattatccattataaaatttatttcccaataccaggagtacaaggcaggaaggatgttaactggcgaagtgaagcaacgactcatcgaagttctatctgagctggttgctagacatcagagggctagagctcaagtgactgaggaggtaatgaaaataattcatgttttgtttgatcttgtcatgctttacaattgggttggttgcaagttctaattcttgtttctattgtacacacacatacatccgtatgcaaagattataaccaagtattctgaacgggacacatacaaatttccttgtttgtgtagatggttgatgctttcatggcaataaggcctcttcccaacatgtttggctgagcatcaagacaagaagagcatgacattttcgttgatcagcacatgtgtgtccccctggtttacttgttgctggactcttgtgaacataatgacaaaaagacaagaagtccttaggtttagttttggaggtatcactacaagaatctatttaatcagtgacgaaatttgacgaaattttcgtgatgttttcagagatcgtcacggatatgcaactatggatacaaggcccataatccgtgacagtttatcgatttcgtcataaaccggcccaaaacctgtaacgttatagcaatttcgtcgcgatttaaatacttcaaaaccatataagagatatgcaaattttgcaaattttgtgaagaatgttactatcactttatcggatgaagaaatgaccaaaataaaagttatagatattgatgagttatacaactttgatgttgatgactttttcaggtgaaataatttagtatttgaaaatgttgtttgcagttgtcataatttgaaattcaaattcaaattattgaaacagagtcatataccaaaatgaccaaaacaaaagttgtagatattgatgatttatataactttgttgttgatgacttttacttgtaaatgttatttgaaattgttataatttgaaattcaaattcaaattattgaaccagagtcatatagcaaaatgaaaaaaacaaaagttgtagatattgatgatttatataactttgttgttgatgactttttcagttgaaattatttagtatttaaaaatattatttgaagttgtcataatttgaaattcaaattttatatagttcaatcaaactcggatggagaaatgaccaaacgaaaaatggtagactaaatgatttctacaactttgttttttataattttttcatacgagttcatttagtatgacttttgtgtgttacttcacaatggtataataaaaaaaagaaaaaaaatgttaaacagagaaggaatgaaaaaaaggcctgttatgggccagtccttttgctcctcccaagccgagaagtccattttgcctccctcctttccattaattttaaaatattaaacctttgaatcgaattttatcatactaaatgaacatatgtgaaaaagttgtcaaaaacaaagttgtataacttattgagatctaccaattttattttgggtatttctccatctgagtttaattgacctatataaaatttgaatttcaaattatgacaaatttcaaacaacattttcaaatactaaataattttaactaaaaaagtcatcaacaacaaagttgtatgaataataaatatatacaacttttgttttggtcattttgctatatgactctgtttcaataatttgaattgaaccttgctatacacacgaagaaatctatacgaaattcgcacgaaaactacctgcttacgtgatttccatggctagaacactagaagcccacacaagatcacaggcctacaacactctagattattcaataagaaaagcccatatcaaattgacaggttcaatatcatgctactcattcagacttcagagcttcgtttgagtggagatgcagaaagcaaggatagaataaattcaatcagttctaaaaaaaatcaattcaatcaagcatatgagctaggtggcggctatatgtctaggccttaccgcctcagctgccgccacaatcagggtttacgattccgacaggcccttctatttcgggcactggcggaatttggaatttcgcgaaatccggtggaaaaccggtaaattccgaacaaatttcataaaccaaaatttgaatgcaaattccctgagtttgttgacaagttctcgaaaacctgtcggttttagcgaaattctgatcaaaatttcgatctgtaacctgtaatttggaccaactactaactgggcctagtacatgcaattcgggccatgtaagtgttttcttttttttaattctttattcttttctttcctggtgtaagttttagtaaatacacacaatacatcattttttttagaatatttatatcccaatatgttctatgaatatcatagtatttataagattttatttgtttttttcttttttttatcaattcaaatttgaatttggatgaaactcctcgaaatctcatacggtttctactttcgagcctcgtcggaatgtcgaaatttcgcgaaatccgaccggactttgttggaatcgtaaaccctggccacaatacgagcagtattgctttgcttcctgcataataggtacgatctaccatgcccacactaataataaaggcaaattttgtctacaggacactgtaatttcgtggttttagccgtaggacactgcccgaactcacttttggaggaaaacactctataaacatggtaatttggcaatagacatcgtgctgattaaaataataatttttggttgaagaggagagagaaatggcatgaaagttctaaaatacccttgggcccatatgtcatatcttccatctcttatctctatccccgctgcgccgccgcctcgatcgaggacctcagcgctgacgtcttccaggaacagcttgggcatcaccgcgctgcccaccctgaacgacgacgacccatcctccttcctgacgtcggcaaagctcaccatgaccatgagcttggtcgcccggccatggccgagcaggagcagcacggggtagaggctgtacagcagcagcagcagaagtccgcggaagagtcccccgacctccagcgcgacgagtatgaagtacgggaaggtcgacggcaacatgagctgaccgccctccaccttgcacaccgtcacgtccgccgccgccgccggcagctcgtaaacgacgacggccgcctgacgacgcgtggcggcggagacggaagatgagcatggaggcccgctgctcgccgacgacacacggctgccgctgctcgcagactacgcgctgctgcagggcgccgtcatcgactatgcggcagcgccggcgacgatggcctcctgactacgtgttgtgcggtggagaagaatgtgcatgcaggaccgctgctcgccgacgacacgtggctgccgctactcgccaactacgcgctgctgcagggcgccgtcatcaacgccgccgcggcgccggcgatgacgacagcctgacaacgtgtggtggtggcctgccgacggagaagtatgggcatggaggaccgctgctcgccgacgacacacggatgccgctgctcgtcgcgctgctgcagggcgccgtagtggacgctgctgcagcgctagtgtccgcggagtggag

SEQ ID NO: 73971 - DNA, 4239 bp, Oryza sativa
ctgttttaaaatatgaaacggacgaatttagtagttagttccactgttaattcacttactccctctgtctcataacatagcaacctatgaccggatgtgatatttcatagtacaacgaatctggacatgtatctgtccagattcgttgtcctataaaatatctcgtccgattcttgattgctatattatgagacggagggagtaacatgcatcttactatcttagggcatgttcactttgataccattttcaaccatactaataaatcctggtaaaattttggcaatattgacatgttgccaaaattttggtattgccaggtttattttggctacagtctgaatatgcccttgattatgcaataatgctgtacacgtacgctagttagtactttagtagtgctggaaccagcacgtacgtgcgctcccgtggcccgtcgacgtccctcccagcaaagcatgggaaaacgatcgagctagcatagatcaatgcatcaactatcgatcagcaagtatacatgaacacatgacattatgttgcaagttgcaaccacctaaatagaccaaattaaatggaaaatttaatttccttgtgctctttaattacagttgcattgcgcagcatcaacgatcgatcgatgcctagacggattggctgttgtattttttttagataatggaatataacatctcggtctttactcaagagagttacagccaattattatagagaagcacctaaacaagaatgtagttcaacaaatcattgaaaacacccaatgaacaaaataagtaacgaatctaaaataaggagaacacattattgaagtctatttgtgaatctccaaccataattgataaaaagttgcataattatcgtctcaagtttgcaacatgcaacttgtttatacccaaatttggcacctatggacgaaataggggaaaattgccaaagtttagaaagtgacgggtttccttcacagggccgatcagaccacaggtgtgtgggcggtctgaccggccagtagggccggtctgaccgcaggtatgtgggcggtcagaccgtcagggtccgagtccgagtatgttttcgtcgggtctcgggtttccttgctcggaaaggcatgtttcgagtttcctttaatttctatcccgagttggacgtggagaagggcctgtagagggcaagaccaacccctatttaagggacaaggccggttcattgtaaaacccccgaatataatctatttgaatcgttcttttactatgttttctattttaccctagtttagtccatctttgtcggtttgcgccgtaaaccatccgccgctgctgcgagagtgcgacacctctttgtaggtttgtcttggaaaccttccgttttgcccacgagatgggtagttatcctcatatcgatttaaatcggcctaggggctgattttgatctctaaatcggctccgctagccggtttagctgtttttctccaaaacccatcttaatttggccctttagctagatcgaggtggttggcgactctaggatcaccgcaaggcgtttaggtgctacgatcgtgcttgtcgacttgtcacaaaaagttgccaacataacttttataaactctcggttttcttcaaacttttgtggttgccccggtatcggagatggattggctattgtatacgtactatgtgtacttataccaaaagccgaattgccaatcgagctgcatgccacgcactgtgtgtgtgttggcaacacctgaccgaccgatccatgttccgtgatcgatcggtgtgcgtgcagtgtgcagtgcagtccagggcagccggtggggcaaaaagggcgtgaaataatagggatgagatcgtgcgtttgcacgcacgcacggtaggaggagtacgtactgttggtgaatccgcatcgcactaacagttcgcgcgcgcggcggaggagattcctacgcactacgcagccttttttatatcgtaaaggttgagcatcaccaacagaacgtgaataattcaccttcaaaattttgttattgggttttctaaattaaaaataagaagtgaaaatatatctctctccaagagaaagtctcaatttaatttcaaaaactaaaagtaagcactactgttgaactaccaaccgaaataactatttttccattgacccggcgcggaaaaagatcgttcctccacccagcccacgcgcgggaagaaaaagaagctaatgggtatgagagattagaattgggagatgtggcgtcgttcctcctcaaacgaagagagtgatggatgtggtgatgaggtttccaaaatatcataataggatttgttggaggtattatttttcactaaaatccaaaaaatcaggattggggatggaataaaagcactgttggtgatgctaagggcgttgccatgcaccgaccattaccagggaggcgcgcgcgttgtgttgcggcagttgcacacgccccgctgtacgtgcgtgcgagagagatcgactgaaatcacgagtgtttcgctaactcgtaccgtcgtgcggcgtcgcgtggagagatcactctcttatatccaaaatgatttaaaggaggagatatgacttatagggtatgtcacattttatacgaagatgaattattttgagacggagagagtagacagccgagactggattgtaatttgctgagacgacaaccggcatggcggcagcaaattacagagtcttacctatgtgcggcgcgcatgcacgttcattgtacggtgggccgtggaggtgcacgtacgggcttctaaagtcgtgcgatgatataattgactttgtatgatctttttccaaagtcgttggttttaaggatttttttccctgcgagttgtataaccgtccgtgcaatcataatccatttccaggtaattgcaatcgtaatccatttccaaaaaaaaccaattttggaggagtggggatattacatctcctatatagaacaaaaggttcagtcttttttaaatggagtgagtatgtactgtgctactttacaaaaagaattcagtatattcatttggcaaaattcagtgttatcttcatttcggtcaattaagcaggccaatactgggccatatgatggctgaaaaatatatacttactccatttcatattataagttatttgatcttttcttagtcaaagtttttttaagatttaatcaaatttatgaaaaaagataacatctacaacactaaataagttttactaaatttaacattgaatatattttgataatatgtttcttttatttatattgaaaatgttactctatgtttctacaaatttagttaaatttaaagaagtttaactaaaaaagtcaaatgacttataatatgataaaacggagggagtacatgttttgcttcgacaataacaatccttgatgccctgcaaacatgttaacaccaaaacatttcccttcccatggcacacaagtcacaagtctccgttttcgtttcaaaaagatcttacttcctccgtttcacattgtaagtcattttagcattttccacattcatattcatttaatgaatctagataaatatataagtctagattcattaacatcaatatgaatgtaggaaatactagaatgacttacattgtgaaacagagggagtagataagtatccagaaacaagatctggtccactaaccggacgcggtctgggccattatattatgggcccattataggcctatataatggcatatattaggaataagttcacttagactcccttaattagcgaccgaatctaatttacatctcgacctccaactattaaaacttccttgatggttttggaggacggtttcgctgatgtggcacccacgtggcaatgttggccttgtctgtggtgtgcacgtggcactcaggtgacattagaattaaaaactttcaactcattctaaaacttttaatttaaaatttaagaaattttaactcaaaattcaaaaactttcacctcaaagtttaaaacctccaacccaaattttaaaactttgagtttgatttttttaatttcaactcaaatttaaaactttcaatttaactttttaaaacttttaactcaattgtttatatatcattttattataaaaatgctaaacatggattagtaatgttattaatacctagaaggaattagcggcgggaggtgaggcgtgccgcgcgctaggatcgtg

SEQ ID NO: 73972 - DNA, 3643 bp, Oryza sativa
agttttcacgtcacctcttcattgcagacttgcagtggaggagggatacttttgtcaaaacacccctcatttcttcgtctatttctctttagccccattccatttgtttatgtgtcaatgaagttattgttatgtattgtacataaataatgtatatgtcaagaaaaatgatactgatttataaagttagttttttttatgtagatgttgtaattctgatggttttatggggttgtgacatggaaactgaaatatctccgtggtgagggtcggctactcggctggtgtaattaatctgtgggcgagaaattgattgaagatattcagatttgggacggattaattgctagaggtaaagatatgcgtaggatagaacggacggatatgatgctattaaaaaccgatatctagaagatatcggtttttaattcttgcgcttttcgattgcttctctttgaagcgatgagttgttcgtatatgcgtacaaaataacataattattatttttttctttttggcttgcttcgaatgattcggtaacagcacacgcctttaattcgtcgagcacctgcagtgacatttgtgcacttctcctttgatttgtcgcttgtttaacttcttgtctatctttttgtcgcatttgctatagcattttgtgctttctggaattcaaaattgtgtgatgcgcacattggtttagttgtgtgcatatattgctatgcttgtttacaccttatagcaccaaacatcctaacaaacatcagcttcaacatacaagtatgtgataaaggtcagcttttgatgttgtgtgatttgcccggtgtgtgtgattgcataattcaccactaaaccccatcacaaagtacttcttgaaattttgattaccgtaacatttttaccccttgcgatatactactgtgtaaaactcctttgatttgtcacttgtttttttttctttttgtcgcatttgtcatcttcattgaaatttgtatgcttctcctatttttctttttgttgcacttgctagatcatttttgtgctttctagaactcataaatgtgtgccacacacattggtttagtcatgtacatttgttagtatgcatgtttacaacttatagcaccaaacatcctaacaaacatcggcttcaacatacaactaatgtgatacaagaagtactttcaagaggctagccttttcatgttgtgtgcttcgcctagtgtgcatgattgcataattaaacactgagccccattgtacttctcgaaatttcgattagtgtaacatttttaccccttgtggtatactactgtgtaaaacttctttgatttgtcacttgtttgtctttttgtcgcattttccatatgtagtaaaatttgtatgcttctcctttgatttgttgcctatttttcattttgtcacatttctagactattttgtgctttttgcaactcacaaatgtgtgtcgcacacatttgattagttgtgtacattaattagtattcatgtctagaacttagagaacgataccaagaggtactttccagtagaggctagcttcaatgatgtgtgccttgtttggtatgtaatcacacaattcaccaccgagcgccatcacgaagcatgccttaaaattccgaataatgtaactttataccgttttcaatatagtactataataacacacatgtgttaacgaccaaatttggtgatatcagcatcgaaaaagaagattagatcaaagtggagtcgaaggcagagatcgatttgggaacagaacaggaatcggttggagtccagatcggctacgattaggatcggctgagtctgagtcggactaggtaagccaatgcagccgattccgacaatacaacttggtgtatgacatcgggttgaattgaggtgtttcaagatgattgccgcacatggatagagtcctgagaaggcaatggtatctattaattaggatattttatgtaatctccttagagatatgcttgggcaaaagtctgccgtaaagacttttggtatcttagagtttgttagagataagagtcgtttccgatatgaacattgtttgtaattttcgggtataaatagatcccgaaccccatgtaatcaagtaacacacacgttcaatacaatttcggcgcatcgccacccttttgctttagttttatttcgacgagttcttgctttcgggttgagctacatcggtttcgatcttcaacaagaggtaaaacttgttatgacggcttgcgttctcgggattagtgcttccatctttataacactctaatcttgtttatgtaattcatcgggttatcatatatcttacataatctctggcaatatcgctatctaacctacaaccggctaacatctctcgaagaaggcagccaattaggttagattttgacgttgactcagattatataagatatctaccactctatgaaacttccagcagcttgattgtctagatattgttcttcttttcatacttaatgctgcatcagttgagtttgatctattaagtcgtgcttagaatatcaatctctagcctgccttctggttgccgattagggtagcatcggagtttcagccgatcttatctgatttaactatatttgctctatatgcttcattgacatgttaaatctgcccttgtgtcaagatattattgcatttatgtatattaagcttctgtttggtttattatacctgttttaatatcctgatatagagtagcatcgaagtattagccgatacatgctagatctatctgatcggctatgctataaacatatatagtcctgttattaatatatatttcgatctaagtgatttatactgtctcgcatggtggccaatctatcccaatcacttgatttaagtatatatcgatataagaactatatattggtaatatctacagccgatcgagtagatttagttctttattatctatttatattcgccgatcgattcacgtatgacatcggctcaaagatgaatgatatgtcatcggcacttagccgatcggctatcatttatggatttaaccgcggtttctttctctatttcttgttgattacaggatcaaatcaattggcacgctaacacacccgaaggcgagctttggacctgcactagagttaagcagatctcccaggcctcgtgtttttcatcaacaacatgaaaagtacatatccccatggttgtaaatatttatcataaactaccacacacttcatcaaagaaagtgtattctcagaacattcagtagaatataccaattatacatcaattgcaaagaagatgccatgccaccttgatgattaaagaaattcgagtcacgaacaacaaaccatgaatgagatttttgggtgccgctttgaagataagaattggccatttgatatttgtcttattgggaacagtgacatcatttcaacatggcatatacacggggtttcgaatatccatctagaagatatatttgtcttttaaaatttagtcacttgcaaagttgtgtccatctgtagaatagctatatggtatggtggtgtcatccccactacttatttgtgctaccatttaaaaatgcaaaatgaccatttatgttacactctataaaatt

SEQ ID NO: 73973 - DNA, 6010 bp, Oryza sativa
catgtgagttgagtttggaccttagatttttatggagttatataaatatgttgtatgagtgttgtcaaatttttccagaatttttcataaccgtttggatagtttttaagcaaacgaggggacatttccttgagggatcaaaatagttccccaggctcatcagcgggtgcgtagtagaattttaatgttattacaaaaaataaataaaatttttacagcaaatatatatttaacgtagttagatatatatgctggggctcttaaaattctggctctaccattgagttgaatacctgaatccaagacgaaattaattaagaggaaatgcgtggtagcaaatgtcaattaatgaataatatttccttgctttgaccgtgacaacggttgcaaaggtacggtgagtgtttctgatagtcgacacaagtctagctcactactgttaacacaataattgaccacctgttgttgttcagatttcagaaattcagatggaggcatgcagcatcaagctgtaccagtgtacctaacgcaagcaggcccaggaatattcagcagcatggatcacaaccacaattacaagggatcgatccaaaaaatccaatcaacagaagagggtagctgcatgtaggcaaagctaggtggtagttggcactatgcaaaggatgcattgcatgcaccgctatagcttgacgaattaatgatgattagcatcacctacaagagatgtttaatccttagcaatcaagcggctcctcgtcgtctccaggaggcagagctagtatatcaccctctttctctctcatctagcttctctctaatccttgtattgcatgccatatctgtcgtgttcgaggaaagaaccattcattcttccaatgagattgatcccagagaagagaagagaagagaagcttctcattgacagctactcctcctcctccagctttgattaattatcttatttactgtaccatactacttgatttgatactagcatcttctctagttcttaccattttctaagactcttgatagtctatgtggtactagcttatagacaagaattccatgtgtatatataaattaaccctgaagagattagcatgaactctaggtggagtagattggtttaagcttaattaagcaagagctgaaaggtactggaagcttgccagtggtttctgattggcaggtgccagtttgcatcatatcagacagaattgggacctaattaataaaccttggatacatgtgcaaaccggaggatctaaagaaagaaaaatgcctcttcaattccatgatagtttaatcactaaaccagattagagcttactatcagttggcccttacaatccattggagtcgttcttccatttcttggtttgtgttgaccctgatggatcatggatggatgctattattgttaatagatgatctcgatgcgagattcttctacagcgacaagatgataatgtattctaccacatattggtggtctagaaatctagaatcttgagaatatcttggcatgattcgatcgccagcgagtaattaactgtttggaagatcgatgatcacaagtatagtatagctagctggagttgctcttgatcgacagatcgaagaaagtctggccctttgaccgattaacaacaaccacattgccacatttttctttcctgatatatataaattaatatgcatgctttcagttcaataatggttcagtaaacgtcaacctcagaaaattatattagctatttaaggttctcttgttaattgcactgatccttccatgtgtgtgatttctatgctgtgtttacgcttttgtatttctatttctttttttgcttgattgtttgtcatgacagatatccatatatttttggaaaatgaaactctcttgatgctgaactaatgaaagtaattggggattttttttactaattcttgtctcaccttttaaaaattgttgtttacaccctttctcttttttaggccttaattaatttcataactgtaaatagtgcagtcttactaatattgcaaacgaatggattaattagaataagcaaaactctcagtataagatgtacaactgccggaactaggctgcattcaccgtgtacataacaacaatgtacatagttcagttaaggggagaatgaaattctccatttcttgttcagattcaactgaatatcgatctatctgctcctctgtcaacatctagttgtataagctatgccaaagcttctaattggattagcataaaaattaagtctttaaggcatatatagtatacttgagcaattctatagaagcacattcctgatgcatttagccctcatcacatccatgtacatagctcattctctccattacaagatcctaccgttatcgtacctaaactaattaaacaatgttttgacctaactaactggtttgtacaattagtaatactctataagtcgtttttgactttggtcaaatttaaactacttcaagttttacaaagtttgtagagacaaatatagtaatatttacaacatcaaattagttttattaaatctataattgaatatattttcataatatattattttgcctatttgttttggggccttgtttagttcccaatttttttcccaaaaacgtcacattgaatctttggacacatgcatagagcaatagataaaaaaaactaattgcacagtttacatggaaattgcgagatgaatcttttgagcttaattagtccatgattagccataagtgctaagtaacccacatgtgctaatgatggattaattaggctcaaaagattcgtcttgcggtttccaggcgagttatgaaattagttttttcattcgtgtccgaaaaccccttccgatatccggtcaaacgtccgatgtcacacacaaaaaatttcttttcgcgaactaaacaaggcctgggttaaaattgttatacttttttctacaaatttgatcaaatttgaagcagtttgaattcgaccaaagtcaaaacgacttataatacgaaacggaaggagtacaagacaacaacgatctaatctaaatggtgcccaaccggccaacacacataaaagtatcaattccattgacttttttttactaattcttgtctcacttaaaaaaaatgtttttttacacccattctcctttttaggccttaattaatttcattaactgtaaatagtgcagtcttactaatatagcaaacgaatggattgattagaataagcaaaacactctcagtataaggtgtacaactgccggaactagctaggctgcattcatcgtgtatgtaaccatcataacaaccatgtacatagctcagttaaggggataatgcaattctccatttcttgttcagattcaactgaatattcctttgtcaacatttagttgaataagctatgccaaagcttctaattgggtagcataaaagttgccccgctatggtgttttctattgatagtagaaagcaatctaaaccattgttttcatttgatcgaagggttcaaatttatttatactatcaccacaattagcggtagtagaaatatggagggacgttattgtcaaaaaaaaagagggtgcagagaggtataatttttatttagcagtaactaaaccattttttctcacttttttggctttttttatgaaatatgagcgatgctagcacaaagaatgatcatagatcgatttagccagaaaaaacataaatgagaaagtaactcctaattattatattagtaaattactaatttacccctaataatatcggtagtataatgttaccaataaatagcaccggagcatcgctctcaaagagcaatctttaaggcatacatagtactatacttgaccaattctatagaggcagattcctgatgcatttagccctcatcacatccatgtacatagctcattctctccattacaagatcctaccgttatcatacctaaactaattaaacaatgttgacctaattaactggtttatacaattagtactacaagagcaacaatgatataatttaaatggtgcccaacccaacacataaaagtatcaattccattgacttttgcacaatgtcaccatgaacagacaaaagtacaggggtactactgcccctgcccctgacctcaaggaaataaagagccattctttcttgatcgctttctttcttcaatttatttattttttacatgcaaagaggcaactacaagtgggcagaaaggggttactgtttgagatttctttttcttcatcttttgacaaaaaatatgattgactttttcttggcaggccggcaaacgccatcagatctccacggcacacaccaacatgtacaaacacaatgaatgccaatgcactttattcagtttatcctcctcttatctgtctgcaaaattgcagatatttacctactttgaccttgaatgctttctgaaatctcatctaattggtcccaaatgtttctgttctgcactgcccttgcacaaactttgtcatctgcaatgtgtcaatgtgtcatagagaaatgagcccatggaagatagagttccagccagtagtagcatatgcatttttctttcaagaaaaagaaaagttgaagtagcagaatttcacaaaggttactactgtagtagtagtgcagaactacatatggatgaggtgattgagtgaaagagtggcagacagagtcatggcttgtgctgttcatggtaaaggttgttgttgttgttgataagtcagaaggaagaaaaggtcttctttttatgatcatgacaaatggagtagattgttgagcattttgcattgactgagtgattcaaactgttactgaactctgaaatgccaagctaacaaacagttgagacggctctagaacagtctcagatgctcaactggtagttctagttaacctgataatgcttttattccttactgaaagatggtttggttcggtcatccagcatcttatatattcttattcagaccaatttgacagattgaacttattctacgagccatctcattttcagcagaaaaagaaagggacatctgaaagtaaattctctgctgctaagaacagaagaagtcacaaattgatccaataatatcgcagacatttttatgcacacttgccattaacacatcccagaaaattgcatttctgcttttatttaaagacttaatagtatcctagctgaaaagccattaacggccacagttgcaggacacctgtacggcaggagaagctacacaggtcaggacacacttgcaagttgcaacaaacaactttgtgaagtgatttgatttaattctcttttctgcatatatgtgtacaaaaaataaaatctcttttgatgttttcttctattgattgtgatgatagagccagtagatggagtgatcgatcgatcgatcgatcggaatctcgcgaatgatctttggcgacatggacgccaactagaatccacccactcatcgatcacagagaccctgaaggcgacgccactgacgttaacagatgcatcctcatcgcctcaaaacctcatgttcatgttcatgttcatggacagacctctcccaagtaaaaggaaaggactgtcgcattgcattgtgtctactgttagctgtgaacagatacaagcttttcgtcttcgtcgacagtgtcagttaagttcttcagaatggagatggaatatattttgcattcagatgctgagatgcagaagaagaaagtatatataccccactacttcacatggaagacagcaccatttcttgagctttcacagtccaacaatggccatgtatgcatgcataccggaacacgccattgcaagttgcatttttttttttgaggagatgatcagtgtgcagcatcaaatttgggggcagaaaactgtctgcagtctgatcctgacgaacagatggatggatatgcaatttgcatcgacaggggcac

SEQ ID NO: 73974 - DNA, 1180 bp, Oryza sativa
caaccactaggaaaatggagccaacatggtaaaacacaatcatgacaggcacaatccaaaatagagagaaaaaacgtggttcaccagaaattactattacctccgttgttccgccctaaaatataacaacatttagctatgtgtttaaatttatagctaaaaatacttatattttaggacggagggagcagtaagcagccgatcaaacatagtactagtagaaagcatactctttctcggtgttttgaaatttgaactggtactcgagaaaagcaaacctgaaccgtgtgcctcatgcctcatgcctgcactgggctatcgataaatgggccgtaagacaagtctatgggccactgtttaggcccatatcttcgttggagaaagcccacaagcggcaggagttggggaaacctgagccgtaaaccctctctcctcctccggtctccttcctccccttcacctccgcggcgcgccgtcggtcgccgctcgccgccgccttctggttcttctccggtctatttccccgcgggattcgtcgcggacactccggttggttggtgtatctgtatgtgattcgtcccacgctgctccccgtcgcctcccctaagacgaatcgaagctgacattttctggtgtttttttttccatgattgttggctgcaagaagtcggttcgagttgccaaaatctgattgttctccggaggtgaaggtttactaggcaatcatggatggtacgcacgcgctggctctgttgcccattcccatttcgttaagctttgtttattttgtgtcagttggggaagtaaatcttaacaaaacttggtcatcctctcttgcccaaaccgcctaaaaagtttggaggatcaaattgtgttttagcacataggttgtgcagttggttgttaatgcaagcttagtggcgattgtagttgcctgggcttgagttaattttgaagttcgtaatggcaactgtgaggaaataactctcttttttttctctcgatcataaaaaactgatgacttttgctgatcatgcaagaaccagacctatgctatcagcaattcagcattaataaaccactgtggcacagtcaggaactaactctctagtcagtatcatgcaggataaccagcatgccagagaacctgatcttactttccaagttcgtgcatttcaag

SEQ ID NO: 73975 - DNA, 950 bp, Oryza sativa
aagattaatttagtagcgtctcaggtaatatttacatgttcagaccaaaagatccaaatccaatcatacagcgcattttcctacaaatggcgttcgctagatagttcactcctatgttatcgacaaattttgaagaagtgtcatcaaaatccatcgaattccatcaaaaacctgttactgatggcattattcagaagatttttcctcctgttctttttgcgtttcaatactctgctcgaaaaaaatttgtcctcctattttttgcatttcaactgatatccccatcatcctgatgtgataatcagagcaatgtacaaaattctctcaaacattaatgaggttcagaaaatttctccttttgcatttcaaaatcagtaaacagcaatgattcattcactatgcatcctgggaagaaaagaaaagaggaggcagcggccatgggaccagtgtccacggagcaaactctggacgctgcattcgggcgtcacgccggtgttggctatgctgctgctacccgttcgctggagggacgagacgagctgcctcgacgacccaccgagccggagcccaaggaggaggctcccctgcgcgttcgcgggttcggcagtgacgatgaccgcggaggacggcgtgcgttggccgagtggctaagtcgatggtggcggcgggacgctggtccgctcgaacatcggctggtcatgtaggcgtatggcctcctatgcacatatagcaaaggaggaaaatgagcagctaaccattcatagtacgcaagaaaaaatggttgccagatttgctaggtccgcgtaacgtagaatacctgtcaggcaaatgggagcaacactgctattagagcatcaaattcaccggctcgacggcgatcgccacggccgcgacagtcacccggcgagcccggaggagcatgaggccgtggcggctgccctgaccgcgag

SEQ ID NO: 73976 - DNA, 6372 bp, Oryza sativa
cttggccatttgaactcggaattggaccgttcaagtctctaatttttccttaagaagtcaagcccccatttttgtgctttgtttctgcttgttatatggagtttagtagagtaaaagccttttcttttccgttggtcgtgtagacgctgcagcttcggaagatccgctcttcgtggaagttgaagccggcgtttgggaaagcgagcaaggcaagtcacatcatccttgagcatattgaatcccagtttataaaattattttgatttaaattaatgcattaccgctttatttaaattcccgcgttatcactgttttatttagccatgcctatttacctttgttaagacattattattgctattgttattattaccttgttcaccctaggataaataaaaccccaactagtgggtactctattcatggttccactagtatgaatttaggtagatgcttcgctgattaattaggcaacattaggtggttttataactttagactttgggaatattcatatcacttggatactttggaatggttggcttttgttggaattggacacacacctccccctctattcaaaaaccccaaaatggttttaggctgggctcgaggtgcgtggttgggttttgctagtcgtacctcgggtactataaggattaagctcgggcctctgttgcaaagcactaccgtacttccacatgtctagtgggtaaggcttagtttgtggctcagtctggttataaacaaaagtacacggattggagatggatgaagtcgggggtcgatggacattctccagggcaaatgaaggctacacgagctgcggcccggtagtcgagatgtcatggcacagggctggtgtcctgctgctagggggctcaatcctgcctgcctgtcccgggggttccggccgtaggtggggttgggtcggtactcttgtttatggctaggatgggttgggaactatgtcacgtcttccgtccgtataccgtggtggtatgtggcacgtggttacacgtgagggagatgtgtcttgtgggtaaagatgtacacctctgatcagagtataatctattcgaatagccgcgccctcggttatgggcaagctgagcaatgtacccaagtcagtgttttaattcttaaaatttgctcaacaactaaaatgtcgaatggttggcctgggttggcttgggacgagctgggacccagggtcgggttgccagtttggtctgaatcatcgtaggccttgggttaaggcaggttcgtgagggttcacggccttgtttaataacattgtgtagctctaggatcgtccttataaaatggctttgggcaactaagtgacttttaaatgctgtttactgcaaaacttaaccccaatattattatccccttgtacccccttgcattaatcatgcatccgccggtgtggcttgctgagtactgtggttgtactcattcttgctcaatctttcccctcttcagtaagagaagctttggagaagatgtcttaggtggagtcctggcttataccccagttgagcgcctgtgaagatggagccgtaggcccgctagtccgctgctgtttatttttgattgccaggcctgaagcgcctttgtaataatgtaaatattatcgatataataaagatgtgtcttttatatcatgtttgtgtggtgtaccccggcttttcctgggacggggattaatacactagcgttcgggaaaaggcaattttctcggtcgcgacaagctggtatcagagccatctcaactgtaggataagccaagtggataaaacctaaggacatattttataaataaaactatttccgaaagtccctttttcctcctttcccctgtgctatttgcaaaaggtttactcccttcttccttcttcagatttcaactagtactagttggttagttttgcgaagaagaagatgtcgccaattgttcgccgaaggtccggaagaccgcagggtccgctagcgaagtggaggaagcagtgaagccagctgtgaaggagtgaggatcttgggaacccgtcgcagaacctaagccaccctctagtgtttcgtttgttgtgtgtttccttgcttgtgtgtgtagtgtgtggtttgcatcggtgggttgtgatgtgaccatgctaggttgtttgcttaatcaacttgcagaataagtgaaacaaataacacatcagcaagaagagttagttcctttaaggtcctgtctctagttctggtctattctttcctggcttgtttcctctctcacctcaatccctgtaacagatgtttaacagagaaaaaggaaagaatgtcagcgggtatgcctcaagtaacccaagttttcaactcaatccaccactggcctcaagagagttaaccagggcatacccttggtccattccaagcatgctgcttagttcacagctaccattagttggaagtcaagaccaaaatcagtatgtgtttgatcgagcatttgccacccaggtcaatgagcttccaatgctagaagaggatgtccccttttgtcacgattgtagagagcaaggacactatgccctgaattgtccatgggtatatgccaaagaagccccttcctttggtttagcagggcagacatcgctaaaccagcctcctcgcaccaagtcaagcttgcagcctagtgtacaaaggagagagcctaatggagagaatccattgaatcccgggaattgctttcctcctagcccttcgtaccacgtggggtcacgtgctaagcaagccaaaggcaagaagagtaagaatcagaagagaaaagcaccgatgcgaactgaagaagaagtacgtaagatgactattaccagcaccgaatggcctccagcagggataactattcctagacgtcaaagaggaaataccttccgaggtgcacgacagttgacccagcacctcctaagccatggtggcagagtatctgatagtgaagggtcagatcaagtctcctcggattatgaagatgagtctctccgacatctcggcgaggaagagatggaatcaaaagcatgcccccgttgtggagaaattggacacgttgctagcctgtgtttcacactctgcccttattgtgaggaagaccatccaccaggtaaatgtcccacccgcaaggtcacatgttttctgtgcgaaggtaccaaccatgtgcccaaggattgccaactcagtgtgttgttgaccaagaccgcagaaatccaacgaacaaccctacgattgtctcatcagctagtcagctccaacatcaacatcgacgatatcatccccagcaccaatgctcctcctgctgcacctgactctgcagtaaatcatagcaataataccttcaacaccaaccattctctgcaccgacggcctcagcaaagaattgtcgtcgatggaagaagttgtgtctctccccgacctactccaggccgagcgaagggcaatcaatctcaggagtgcgataccaagcagaagaccgttattcgcctcaatcagcaatcagaaggaaacttctcttgtgaatgatagcaatatgcagtcctatcacatcatcacagaaccaatcaaggatgcagtcactagaacaatgccagctatgtatccatgtttgtgattttcagttcgctacttatcactgtaatcgggagtttgcagcaatcatgtaataaataaatatattcatgattataaacaatgagtttgttatgtttatggaagattcatgttgaggatgcaaggtaccgatgttaagcaccttccctttttgtttaaggcagtgccttgtattcatgtaataagggagaaatgtgtaataaaaacaagttctatgagggttattttggaagatgctgatatggaattatgtgtataattgtttactgtcaaaggagacctagggtctcatttcagaggaactatgttctaacctcgagttaaaaaccaacctgatgatagaaaagaaaatgccgagtccgggaagatatctgttgcttcaattgtcaaggaatgggtcatttcgccgacaagtgcccaaaaccgagaaacatagctgccagcacgtcagtccacgcaactccttgcaatcagaagcttgctcctcagcgaattgtcatccatgcatcccgaagcagtcctatagcccgcattgcaacagctccaactccagcgagtgcattaccacaaggtgtcaatgctcaatttcagccccagccatcagttgacaagacagaggccagtatcggcattgtacctttggatgttccagcacagcagccaagaaatcaagtacaagatgaagaacccgaacgtaagaaagttattgtctgttacaactgtagtaccggttaaggaagcagacatgccaatcgccaagtggtcactggagcaaatgcagtacctgataagcctaacgttagtcagaagcaaccataatactcttatatcagtgttcaaatacttttgttttatagttgttccccgtcaatcatgtaataacagagaaacatgagataatgaatgagcttgataagcttatgaaggacccatgttaagattgcaagtgctgtgagttgtgcacgttttgttgttgattagggagacctagggtctcattttcgtaaacccatgatctattaggaatcaaatagcctagcgattgatggcgaagaaaatcaagtgatcaaccaaagagacatttgtttggactaagagtttcagatgtgtctcttcggatcaaaggcaacaatcgtcagtctagcttttgacgaactacttcaaggtttctctgagagacagcacgcccaaggacctcattgccccagaagcatcctcaacacccggagcgaagagtacctggttgagaaaggtcgaaaggtgattaatggaagagatcggaaaagatgtttggttactgggaaaagaagtaggtcgaaaggtgattgataaaggataacgagaaccatgatttgtgtcactcgaggaagactcccgatagcaaaacaaccctacaacagttgcccggtcattaaagtaggtgaattcacgagtaagagagatgaccacaggtagaagtacttctatggggacaaggatggaaacttttgtgacatgaccaagaagtcaagaagtaaaacctgaacagtggaatctaaagctcggttcaaccttgggctttgtatcagatgctactagaataaaagcacttgcactagcatcgttcaacgcactttcctagcaatcgatccatcgagaaagaacacatcaaggctgaaggtgcaaaggaatacgttgaatgctaaatgatgacaacatgaagagaatagtggaaagtaaactgaacataaagaaagtgaatccgagttgcttgttcgtgagagctattcccagttatgaatcaagtgatatgttcgaagataatctacagaggtcagattaaaatcacatctaacaacgaagcctcagatttggcaggataatgattagacaataacaaatccagcagtaaagccatttgggaagacgtcaaagtatgtcaagtgggataagttggttctctggtgaagcataattcaaaggcaaagttatcgacccttgcatcaaatagcagaagtagctatcacccggagaccaggaaagctaatatgaggcagttggtggcaagttagaagtaaatgacaagcatgatattcttatgatgacaaacatggtatcctagtaatgacaaagctgatgtcgacgcatgtcacgaaggtggtaacttgtatgaggttgacgccaaagatatgaatgataagaagttctagaactgaagccccatcctcaaccaccgcagcctagtctgagtcagttaaaggtgcaaccagggacaagtcgggtgaagagaagattccatctgcaacaggagatcgagccaagcagtccagagtggagaagtttagttagacaagtttgttatagaagacagagcggaagaagtcagacaagaagagaagaccgcccaacctatcttcttgctagcctcctcgaatctcggggacgagattcttgtaaggggggtggatttgtcacgtcctgataaattcatcccgaattaaaaatcattcgctaaaaggaataatagaattaattaaaattcgaaaagaaattggcgaacactaaaatacgtacaagaaaaattcaaatgtggcccggagaatttttgtaaattctccttggtctaaaaggagccctcaaattttagtggattttcagagcacaaatattattaagaagaaataaataaagttaaaaaggttttgttaaaagaaaaaccctaaaagtcttctttccccccctttccttctt

SEQ ID NO: 73977 - DNA, 9377 bp, Oryza sativa
attaatgagatacaggcgtgccagtcagtttaatcctgcaactgataagatttgtaaataatagatcaaacagccgatcggctgacaagccgatggagtagttccagccgatagtcgataatagccgatgccaataccagccgatagcgatagggtttaagcaatcggctatatgtccaatgtagataatgatataaaggcaatcggctgatgatgatgtaataaaataacaatataatccaatataaactaatcggctagcaatgatatgataaataagcatcgatacgaaggttaaagcacacatcggctagaggtccgatgtcatgaaatccacaagattagattaaacaatgaaacctttgttgtcatcggctaaatccaacttatatgtatatgcaatcctcatgagccgatgcaacgtccagataactcaccggctgaaaccccgataaaacccttattggcaatcaataagcaggctagagattatggttctaagcacgacttagtagatcaaaattaactgatgcagcactaagtataaaaagaaacataatatctagacaatcaagccgatgactgattttcagggtggtagatgcctaggctaatctaatctagcaacgcgatttagccgataccggcagaaaccctaaaacgagaagcagccgatagagctaaattgatatgctaagactagattaacagagacatatgataaataggtaggcaagtatatcatctaaaccagagcaatccaagaggtcgaatgtactgatgcagccttgaacgacgccgatgtagacgatacaattgcctgggccgacggaacattggacttatcccttcgccggagatcgaagacgatgcagccccgcgtcgggtgccaagtcctgccggaacgtaaaaacaaaagtagaaataaaaatggtggcgatgcgccgaattgtattgatcgtagagatcgattacatagaccccgggtgtacatatttatacccatgggttgatacaagtccttgtcggacaagaaagaaactacctaaagataaaaggaaaatatagagtccttatcggacactaaacaaacttttctaaagataaaagaaaactaacaaactattcctaattaatagataaactgccatgccgcatcctctttaaactcggtcacttaggaataagcttcctttagtagattgatttccttaaccgaatatagcaggaatccgactattggtgacttgataactcacatcggctgattccgagatgctgcagccgataatgattctaagccgatgacatctttgccgattaccaaatttcactgttaacacgaggccagcgagcatggcgcagacggcgatgcagccagggaggcgtgacggctggtcggatcggtgtcggtacgccggcgaccaacgttcgtcggcgtcttcttcccccttttcttttttccatttcttctcttctttgtttcttgttgctccggcaattcgctcgtcatggcgcaaccgtgcggcggcggcgcgtccaggccgagcggctagcgtcatgggcagccggtgctgcagtgcatcggcgtgtggagcggatgcatgaccggtttccatggcgccgatgctgccgcttttcctttctttcattttgcttttcttctttgtttcttgtcctctccggccgggcgttgtggcggagcgacggcgccgccaagatgcggacgcgaggtcgccgctgggcgtacaggcgcggggttcgctgccggtatgcaggtgcaggctcgctgctaggacggccacggcacgaccactccccgccgccgatgcccagctcctctccgtcagtctactccccgttcgtcgctagcgagcaccgctgctgcccatcgccggccgcgcccctaccccaccaaagtgaagagaaaggccgggggagagagagataagcgagagagagctacacactgacatgtgggtcccaccacgctgagtcagcctgtcaacgggtcaacaacgccacgtcagacgaagtcgccagcaaaaccaccaagggaggtgatttgctctggttttcagaaatgaaggaggcgttatacccggtttttcggttgagggatgttattcacgcaaacgcaagagatgagggaggcaaaatggacttattcctataagttttgggctttttcacagtcccactccgtgtctgagctctgaacttgtgggcttacactatctcttgctccttccagcccatctttttgagtttacccttcgattaacctactgaagttgcaggagtaatctgtacgacatttttaaccataccattatttaacaaattaataattatgtggttatatttagtttgttatcaaatattggcaatgtgtatagaattttggcaacattattaagccaatcctaccaaaattttagcaatgttgttaatttgtcaaatttttgatattgacaaattttagtaaggttaattttgacattaatcagaacagaccctaagactaaagagtctgtgatcgactgaagttgtgacttgtcgtgcttgttggcaggctggtggccttctctgcatccacgggaaagcctgccgcgaagaagagcctaaggatgaaagggaaaaggtgtaatgtctgcaactactgctactagctgaaacctgaatgttaaaattttgtgtacaaaatcatatacgagtaaacatctgaaaactgagggctgatttggtttgaagccaaaacttgccataccaaaatattggtattttgaacagtaattttggtaatgtttgttttgctaccaatacttaccaataccacacaaatgttgctaaaatattggcattggcaaaatcttgcccatgatttggcattgccaatagtttggcatggttgcaaaccaaacaatccctgaaatcgtcgtggtgtcgttacttcgtcagtggaccgcatgagattcggcgcgtgaagcgcaacttcctacgagagacgctggagaacgagctgccggagggcaccatcaggttctcttccaagatcgtctcgactggggaagatagcaacgtcaagctcctacatttggccgatggttcaacgataggtgtgtgagatcaacaatggctagcagatcacttgtacctctcttcttctcactaagagcagccatggcctgatgcattgatgtgcttttgttgaaggtgctgatcggatgcgacggcgtgaactcggtggtggcgaagtggcttggcctgccaaagccaatcctctcagggcgctcggccaccaggggcctcgccgagtacccggtacccctcccctgatggtgcgcaccgttgctagttacttctccttgacgagcagcaacaatggcggattaattcgctgatcaatctgtcacgtgtggtgtgcacagacggcgacgcggaggagagcgtggccaagatgcggagctacgtgctggcgaaggcggcgaggatcccggcgccgctgaggttccggtcgccgctcgcgctcgtccgcggcagcatcagcaggggcaacgtctgcgtcgccggcgacgccttccacccgacgacccccgagctcggccagggcggctgcgcggcgctcgaggacggcgtcgtcctcgcccggtgcctcagcgaggccttcctcgccgacggcgccgagcacgacccggggtacgaggccgtcacggtggcgctggagaagtacgccgaggagaggcggtggcgcggcatccggctgatcacggcggcctacgtcgtcggcttcatccagcagagcaccaacccggtgatcaagttcctcagggagaagttcttgtcaggattgctggcaaaaactatgatcgccatggctgattacgattgcggaaagctatgattctgttcacgagaaatcaagaacccaagaagagaagaaagaaattggcggtgagcgggaacagtcttaattagcacatggaacaatcttgtgatgttgttaaccaagcacgagggggcgagcttaaagtccaccgtacaatgtactagtaccacgtacacactcaccatggcagatgctcaaggcaaagtcttatgtacggttttctatgcctctgtatcaaagttgagttcagcatttgacttgtgggtatgtgtccgagacaagttttgttctagaaatttcgtggacaaaataagttcttggagtacaaggtaaacccaaccttggcataatttagacacaataacaaaattgattaaaaaaaaggtttatttagagtgcaaatagcacaaacagagttttttttaaccaaaacaagtagtcttgagatatttttttttcttttgattatatgattacatgaaaatacatttaccctcatttagcacattattaagacattgaggctagaaataattccacgaaactaactaaattaaccacattaggatttcaaacacagtgggtaaagtaatatgcccataaacttagcgtcaccgtttttcgctcacggtcaccagaatgtttagaatccgatactcaattcgcaagcctcataatatttgacacccaattcgtatatgtcttccagaaattaccaatttgtttggtgacattatctcccatttttctctttttccttcttttactctacgtttttttttcccttctcacatgattggagtagtggacagttttttgcactataacaggggtcaggccagttagcagttatcgagctaaaatcgtcattcccggtttcccaccgccaaaacccactggcgggtggcggctgcctgctggcccatcgttgagtgactcaaagaagccgatcaatctcagtggcgcagaggtagcaacagatcaagctgccataatcacatggcgtggttaatcgcccgaacatatgctgcaaatgggtaaaatattaacaaaccggtttgaccaagtggcttcatccgcatccaagaatcttatatggaacccatgatttaattaggagcaatttgcagtactgccaagtgtgaggaatccctgtctagtttgttatagtgcttatcatatagccgaccataagccagtgtacatgcatggttctgtggcatctttaatatgcgaaaaaaggttgtatactagctagataagcttgtagcccaaaaaatgaatcttgaagcatctgtagaaatcggaagcaaagtgtaacgtcccgccgccttcccccaggccgggcccgcttacatctgatagctttcataggtcacacatcttttctgcacactttgtcctcactcgtgtgcacccggaaagaatttcccggtcggtcccccatcccaaattgctccaggccaagcacgcttaaccctggaattctttggagattggcttccagaaaagaagttgcaacttgttgatatgagtattctattaatcctattaagccctagaccgggatgttacaccctcacccccttaagagagatcgacgcccccgtcgatcaaccctaggccaggaacgtcatctcttggccacgtccatgtgtgataccattttgtaacgtcccgccttcccccaggccgggcccgcttacaggccaagcacgcttaaccctggaattctttggagattggcttccagaaaagaagttgcaacttgttgatatgagtattaccctcacccccttaagagagatcgacgcccccgtcgatcaaccctaggccaggaacgtcatctcttggccacgtccatgtgtgataccattttgtaacgtcccgccttcccccaggccgggcccgcttacatctgatagctttcataggtcatagactgccctcacagaccaacacatatcttttctgcacactttgtcctcactcgtgtgcacccgggaagaatttcccggtcggtcacccatcccaaattgctccaggccaagcacgcttaaccctagagttctttggagattggcttccggaaaagaagttgcaacttgttgatatgagtattctattaatcctattaagctctagaccgggatgttacacaaagggctagcatcaaccctttaaacagaccaggttgccaatcatgtaagactgtgtattacgcacaccatagcctcagcaaaagaaaaggcttctcacggagtggattctaatctctcgagaggatatcctctcatgtatctttttctttcaaatttgatacaaatagttgtgaaaaattctaaaaaaatatttggcaatgtagagtatagtgatatctactaatccaaaaaaatcaaattcaaattcgatttacacattgagaaaccaaaagaaaaggcttctatcatcactgtcagtcaagtaacttaaccagaataaaacagagggaaatatgaatttgtcagctatttctgtcactgcagctctcaccattcaaatctagaggtttgaccatatgatctatcatggccaccaatagataaagtgaggtcttacaaactaattaaaaaatgcagtacatcactacatccacaaccagttgccctaatagtccaatggagggcctcggtgacagttgacttacaagcaagcaatagtttcttttcgtagatccccatcaaccaaacaaaaaacaacaaatctgagcactgggagagctccactacccccatcatctgaaacaaaaattaatcacctatttgcactgctaaattccctagcttccagacctagctaactgatacctaccagtggggaccacctgcaattccaagaatcaaactgtcatgggcgcaactagtggtggtgatttgtctgaggggagccgggggttggattaacgcgcgtcaaccgcctaaatccaagggggtgcaacatgattaccgacgcttctcgatccaatgaccctaggtaatcacgcgacctccccggccgtaatcccatgtgctccaggcagccgagtctcgtgacctcacgtgacgcttccgcctctagctctcgatcgatcgatcccaccactaattatccactcccaaatgattgtttagtggcccgtatcataagaccggccacgtcgtgcagctagtgtgacttgggagagacagtgtaccggccatttgccagatttgcttcctcagaaaaatagcagagtcggccgggtttgcagacttgcagagatcggaagaatctttctctttcgaaatgttgaggatttttggaaggaaaacaaaagggaaatggagatataggaatcgtggcatttaaggcggcacggtgcagcgtcgtctgtgggttgcaacatgcatcggcatgtgagtctgcctcgggaggcgcgcgctcgtcgatctcgtggccgccgcacttcctatttaagcaccgccgcgggtgacaccgtcccctcctcctcagtactcagatacattacccgcaccgcctaattaagcgctcgcatctgaagccatttcgagggacgtcatggcgcggagtgccttcttcttccactgcgtcgccgccgtcgcggcgtgcatcgccgcgacggccgcggcgctcagtggcacggccacgttctacggcgggagcgacgcctccggcacaatgggtatagtttagacatttgctaattaagcctgatcagttttacacacaccaatggactggtgctgacaatggcgtttgttgttgatcgacaggcggcgcgtgcgggtacggcaacctgtactcgacggggtacgggacgaacacggcggcgctgagctcggcgctgttcaacgacggcgcggcgtgcggcgagtgctaccagatcacgtgcgaccagtccaactcgaagtggtgcaaggcgggcacgtcggtgaccatcaccgcgaccaacctctgcccaccggactactccaagccgagcaacgacggcggctggtgcaacccgccgcgccagcacttcgacatggcgcaacccgcctgggaacagatcggcgtctaccgcggcggtatcgtccccgtcaatttccagaggtacgcacatactccggtcaccgtcgtttcgccggccggcggcgcacagaatcaagtagtgatcacgtacgtatacgtatgtgtgcagggtgtcgtgcacgaggaaaggaggggtgaggttcaccatcaacgggaacagctacttcgagctggtgctgatcaccaacgtgggcgggccggggtcgatcaagtcggtgcagatcaagggaacaaagacggggtgggtgaccatgtcccggaactggggcgccaactggcaagccaacaactacctcaacaaccaggccatctccttctcggtcacctccaccgccggcaagacgctcgtcttcgaggacgtcgcgccgtccaactggcagttcggccagacattcaccagcggcgtgcagttctactagctagcggctcgcgcgcgcgcgcggcggcgcatgagccgccgccgccgtcgcgcgcttgcccaacggcgagcggcgcatgccacctgccgccatttccgttcaatttttgcatttggaaaacttgtcaaaaagaccagcttatttagcatcattctgattggggaaaaaaatgtattcttagctaggggaacgccactgtggtttgcatggctgaggcgggttccaacggtgttcgtctggccgggcggcctgatcgatagcccgccatgcctaaccgcttttacgatgattgctgggaaggaaaactatttagacgactttgcttggacacgaggtaaggagtgcaggcactgatcgatccgtgtaatgctgaaatatggcgctcattggaaggcgcaaaccacatgcgagtttactgtttgacccgatgatgatctcaatgaaatgaattggccattggccctgtaaattgactgcagtatctttgtgctttcactgtgtattttgcgttgaaatttagctcatcctgcatgtggtgaaaccacgccgactcgtgtgcacgtcccgcgagtggaggtagagtacgggatgggggtgctaagaatcccgtcaaaaaaaattagttgtatctggatgttgattttcattcctcgaggggatattccctcattgtttgtatgtcatctaaatagttattaaatttttttaaaaaaaactgataacatagactaatatgaaatatatcacttcacaaacatgcaaaattaaattcaacttctacaagttgcaatgaaaataacaaattaaactgaaaatagttatcgcacattcacaactatagttgtctcaatacaaatttagacacccccaccaacttaagcttgatctaaagtagagtaaattaagcaagaagcaccctcctttattttgttcttattccgcccttgcgtgaggagcgttatggctatgaaagacctgct

SEQ ID NO: 73978 - DNA, 2049 bp, Oryza sativa
ttattttagttacaacttttagaaatcgaatttgaacttgcatatttctaaagtgatatattacatattaatctatcttgtaattttttatgaaattttttcataatcatttagttgacatacaagaaacgagtggatgtccatccgagatattagaatccatcacagtggagtaactaatggttgtgcatccctcggttacttaattgttgtgctacaggggatggaatgtttgtagtcgttaattccacaatcgttgcatcaacattttttttagactaagggcattaagcccccatttccattactagaaatgacagattacaaaagcaagtcttacaaactgaaacaataataataaaaaaaaggaggccaacacactggctgttttttccagactagaactgtccagaagacatagaagaacacatccccatcctcaaacttgcataagagcaagtttagggcctgtttggcacagctccagctccagctctgtcgacggaggatactcgtagaccagatatagagggtattggggtacactggtacgaggatctacgtagtacgacatcaaggaaacggaaaacatggattatactggttcagtccccttgataggtaatagccctaatgcagttgatatgagattatatagtggaaaccacagattacaaagggaatagcagaactcgatgataccgacgagaccatagtcaagttgattcgactagatcacccggcgatttggctcctgtaggttccggcttcgtaaggctgtggtggttgtcttggctatgagatttgatgccttaggtcctaccagggggtcccttttataccgcaggtcagttggtctccaagtagaactcggagacatcggatcctacacaatacaatgacgacccagttctattcgagtaggactccttccgtctgtggactccgtgatggatttccttaacgtgtacataaagcgtccgtatacgtgcaggtataccatatcaatacacgacatatatccaagggtagagggtataccttatccgtaaccctgacaagctccacccctcctggagctggagctcagcaaacagtttcagctccaccaaaactgggagtgaagttgggtggagctctctcacaaaatgaactaaagttgtggagctgggtttagacagctccacaattccactcagacccaactcctggagttaaattgaggagttggagctgtaccaaataagcccttaatagtatatcccactactagcaccaaatcatctatagccaatgtaatagccaattcatacaatagttatttactatactattaatacctggtcccacctgtcatacacacattacgtcttggagtccgtgctgcagctggctactgatctgtagcccgctgctcttctctctcttcatttatctctttaaaatatgtttatagctggcttatagcctgctattgtacctgctctaacaagacttcagggactaacaaggaccgaaaacccaacagcaaaagatcagcactgcagcctccccaccggcctccatccaaatctggagttgtacacttcacttgcaatttgtcttatgagcttggccccaagagcagccttctttgatctgcctccagcttctacaaaagagcccatgattccatccagtggcaaaccaagaaaactacatcagtgggatcattaggcaaatttttatcaaagcagactttattcctggtcttctaaacagtccagattacagcagcaataccaatgacaatcagatttttggttttatttgagaaagcagaaagccaagtcccaaaaagatgttggcaatctttagccgttttgaggtcaaaagcacactatatatgatgttccaaattaatctgacaagagagcaacaatcgttgcatcaacatgtttccgttttgtcccaagtgaaatgcagctgtgatgaatggcaccgtctgacgctaaatatgtgaggtacaataactgcatgcctctccgaagtccaagtgaacaagtgacc

SEQ ID NO: 73979 - DNA, 2426 bp, Oryza sativa
ctgagtactgagggtgtactcattcttgctcaatctttcccctcttcagtaagagaagctttggagaacatgtcttaggtggagtcctggcttataccccagttgagcgcctgtgaagatggagccgtaggcccgctagtccgctgctgtttatttttgattgccaggcctgaagcgcctttgtaataatgtaaatattatcgatataataaagatgtgtcttttatatcatgtttgtgtggtgtaccccggcttttcctgggacggggattaatacactagcgttcgggaaaaggcaattttctcggtcgcgacactccgcgactgcccaacacatgagcctcgtcccgacacatgagacgcgtcacggcaaagcttttcgataacctcgcattggcagtacccgctccatgaacataaatcctcatgaactctaggcgtccatgtttctagcagtgagaggagttctggcgctcccgggaaagagaaatctcacatacatattatattagggttcaagttaagttctctctcacacacactcatggcagtcctaccaatggcgacaccgatgtagggctcgcctctcggccctacctcaacggctgttccaccgtagcgcacctgcctcactctggggtgaaccatctatgcagggatactgcctccgctcggctatctagtccgctaggtctatacccatacgagaagtgtggttgtacgggggtcgtttcatgcttaacttcatggctcagtccttaattgaccggggacggtactagccttttccagataccacccaaatcctccgtccgccccagtcgaaaacagttgttcccactttattttcctttcacaaatcatgtcatcaatttcatggcaatgtggcgctcatgtcttcacatgccgcatctcaattaccttcccaaaggtaattgcccaagcatttagcatttgataaatatgagtctgcatgatcctagaatagcatttctaagcaattgtcataattgactggggactcatacgtaaacatggttacgaaggaataagggataaacaataatcaaggcatggcataatcacaagtaggatgttcatcattgcatgcaattttatttataaacaaaataatttcgcaattaggatcaacatgttcaaggaatagtgatgacttgcctgctcatgataatccttattctcgatataatcttgatcaaccttcacctcctggaagttgctgacattgcctcacgactaaccgatacataaattctataatacgcaagaaaaaccaatattcaaacaacaaccaaatatgcacaacaaaatatactattcgtgtctgcttaatggattccaatcacgctaggggctaaggtttcttaatctttctattgtcaacgtggcctatttaggagttaaccaacatagcatttatgggatacatatatttttggctaatcggtggtttagtctatcaaatggctatggaaggattatggctatgtatgcatctatctaaataggacggttatatactagaggttctgttgttagatggatttaggatcaatcaaataattacagtgaatcatttgtattattattttattgatggaagctttactttaattatgaacatattttacttgtcacaataaattataaaaggttaataattatccatgctttgtatgttagatttgtttaggttaatcatattatggttacagattatcccatcacaaaattttacaatgaataatcctaatttacagttgaactataattataattatatgaggtgaagatttataactagtatttatctaatatacatgtttgtcatacactccctctaaattaatatatgcaacacgcaaattaatactataccgtacaactataatgggatgtatagtatatgtgtaagcaacaatattttattattagatcatatatttgagtatttgctttttactgtaagctatacaatacatgttgattttaagatggctctgtttggttaactaatagatatcaaccgactatatatatatattctacttcacatgacattgtatcaactaatttttaagtagtccaaatacaactagctctgtgattactctcctaaacaggttaaagattcatctatgtgtgtttatattttagttacaaaatatgaggctaaactttatgtaagtaatttataagtcatggatttagttatatttggacataggctagtgaatggcactaatattttcctttacacccattaatttgaaggattgattataactaatttatttggttgctacagtgacaagacatattaaagataattatgctactgtacaatatccatttttatttattggcacactatttaggttaactattatctaatcatttgatat

SEQ ID NO: 73980 - DNA, 1169 bp, Oryza sativa
acaagagatgagggaggttaaatggacttattcctataaagtataccgccatttcgatgtctggtccctgaaggccctggacggctgcacgcgccgatgctgctgcccaatagccgctcgcccgtggcccagtggcccgtcttgctgctgcagtgtcagaccagcccacattttcctcccccatacaatgggcccaaccacccccgcccacagggtggctttgccttgctctcacgcactcacgctggcctccccgtagccgtcaccgtcgcatgcgtcctttgcctgcctgcctcgtgcctgccacctccgctggacactgtggcagttagcgaggtagctagtgagccacggttcaagaccgaaccctctgcatcgctgtgcaactgtgcatgccgtctctctctctgtctctcactctaatccgaaacacaaccacccgtgagtccgtcaccgctcctgctcccagtagtccagtactctcgctccactctcctcgccgagtcgccgtcgccgcctcggccagcttcggattgggttccagcaccggggcggataatctgctgctgctgctgctgctgcaaggtcagtctcgcgcgcgctcccttccccgggttgatcaccgcgtgcggcgccttggtgacgtgaaagcgatcccgcgcagcattacgtagttttaattaattctcttgtgtacttcacgctagcttcttgcgggtagtctcgatttctgtttccgtttctgcttccgttcttttctccttttggacgaatgcgctgcttcctgtggtgagagcaaaaggctctggttgcatgacttgcatccaaatctgagtaatttagacaatgtatgcagatcttctagcagcctggaccctagagggggatactatatacagtgcagttgtttgtctgtgagactgtgaaactgttttttgaagggagttatctgtgtaaatgtataatcatttcattctgaactggtcatgacatctgttgaacatcgcaaatgtggagtaagaccagttgggtgaacttgtaagtttagtaaccaactgaagcctatagattaggtagcctcatgtatgctcttctccatatgattcatacgggtggccctcgtagctccagcttcgttcttctgtaggtgtccaaatccgaaaaaagaa

SEQ ID NO: 73981 - DNA, 9338 bp, Oryza sativa
tatgctatgtcacccaatctgaatcccaattttattgggttgcagtgtttgccactaacacgtgggccgctttgattgggctggaacatgataacggattgatggtggtgagaaatcacccattcaagatggtttgtgttagagggcgcggtccagcctgaaggttatattatacttgctttaccataggtctaatcgtagttataacttttggtaatacacctatacaactaaaaaaaatagtctaatggatgaggatcaactctatctttaagtcgtgcccctggtaacaattactatgtaggacttaggggctgtttggttgctagtcaaaatttgcctcaatttaccacaagtatggcaaataggtttgaccaagttagtatagtgtttggttctagccacaagttagtcatgccaaactttcctttaacttgaccccacatttcatagatacaataatgtgtggtaaggaggctaagatgtggcttcaattttcttggccacaactttggcaacttagccacaaatgtttggctggcttaggtagtgttacacaaccaatcaaacagcccctaaacccaacagtttcattcttcaaatcaaacagcatgaacgttcctttgtcagactttcgatgagtttgaatcttatacaacaatgctgatttcatgtatgaaaaaagagcgacggcccgctcttcttcccccaactatatacatagccaacatggagaggtcatgcgtcatggccggtcgcagagtgcgccatagcagtgtgtgtcgatgtcatgcgccaacgaggtgtcattggagaggcagctcaacgaccggcagtccggcacagggcatctttggaagggtaagtgcaggcagccgtcaatgggtgcgttcaacggtgcccattgccaataagcacgcccgtgggagttctatgttactagactagtcgagcgcttctcttcataatattgagtgcagatcggctatcatcgtactgtcgtcgccaccaccacctattactagttactggccaccaacagagccaaccgtactaaaaattttgggagatcaaggatagagaaagagaagaaaaatgtacgaagatgaaggataatgttatcatttcgatgcctttttttttttactaaatatgcccatttaacgtggtgatgaaaatggcataaaaaataatgaaaattttatcaagtagcatataagggaatagctactttttgacatcacagaatgaaaccattcaagttccatgctatctcgtgaacaatgcctcttttaagttccaagctatctcgtgatctctaaactagcgagttgctttggtgcgagtttttctgtgtagatttgggctgaaagcctgcctgagtgtctggcccgtgagagaagcccaaggctggaaatctgcagcataaccatgggccataaatcacatgtagcccatatgacactgcatgttaacaatagcacatgttaacatgcaaaaacgcccgttcaaaaaaaaaaaaacatgcaaaaacgtggtacatatgtacacgcagcataggtagcactacttgctaaacttggatatggacggcacaaacccaacgtcccaacctgccacatttccctagtggcgacgggtctatttttttcgagacaacatgcacaaaatataaaatagtacgacgtttttattgatatagcataaaaaatataagttagaaaacagaaaaggacagtcacactaagcgtttacgtctgatcctgatgctgaaaaataaaaacaagcactcaacatccggaatgggtattctaaatgacgccaagactatcgctgtttgcctatcctaaaatccacgatgtagttttcacttttttctaatatattgacgtgcaatcttttttgcgcgttcgaaaagaaaaatgtgattttcatccgaagaaaccattgggagaatagagaaaaacaaaacctcgctctaggcggaaagcggcgtccgcaggcgtcgtagttgccgggccgaagacgacgggtgtctactgtcctgtacacatacgcaacgacagtttgccggtgccggtgccggtgcggctgccgtatcgcgtggctgcctctggcaccggcgcggccatcgaccgttcaattcaagccgcgatgaggcccgtgagcaggtctcgtgtgtttctctcccaagttgggcaaaatttctcagaatcgcgtggtcaactgctgatagcctgataaccgacagagtgattaatagcaccctgtacgtaacagcagtcctctcctcttgtagtcttgtagagtagaagtatagagtaacagtacaggagaaatactccgatccatatataacttctagcatgttcacatttcttcagatttgtattagctgttgggtagccatgcatgttagctgctaatcaagagtcaagacactgctgagttcaaataattaatatatttgacgaattcaagatgtacatacatgtacaattaatccaaaaaaagtactaacaaattaatttcccagcttgagatcatgcagacgaacaaattcctctccctgctaataactgaactgctggttgctggtgaatgtcatgccgaagctccaccagctgggcacgacgttgtagatgtagagcgtctggccgccggtggatgtgacggcgaaggagagcgcctggccgacgagccccgagttgcactgccagttggcgccccagttccggttcagcgtgatccaccccgtgcttccccccttcaccgacaccgacctcaccgacccgctccccgccacgttcgacaccagcaccagctcgaagaagttgaaccctcccatcgtgaacctgatccctccctgcctccagcacttcaccctacacatcaattaggtataggtgtttaagatcgacgaagataaagttagtgcacacaaaatgagaaagttattagcgtatgattaattgattttttattattacaaactttagaaatagatttatttgatattttaaagcaaccgttcatccgtttgaaattaacatgttagaatgtacttaagagcagtaattacggattactactagttgtaatacactgtaagtacttactgttggtagaggacggggatgatgccggccttgtagatgccgatctggagccaggcgggctcggccatgtcgaagtgagggcggggcgggttgcaccagccgccgctgttgctggggagagcccagttgggcgggcacaggttggtggccgtgatggtcaccgcggcgcccgccctgcaccactgcggcgtcgcggcggcgtcgcacatgatcaggtagcactgcccgcacgaccacccgtcgttgaacagcaccgagctcagcgccgccgtgttcgtcccgtaccccgccgtgtacaggttcccgtacccgcacgcgccacctgaacacacagagtcacacagcagcaggtctccgtgagaaacactgacaacgcaatgacagattcgtagcactccgtagttgatagagcaccaaaggttttcttacgtacccatcgtgccggaggcgtcggcgccgccgtagaacgtcgccgtccctttgttccagccatgcgccggcgcgaagccggatgctgctagcacggtgatcaccaacgacgtggcgaataagatcgcgtactccatctccgtcgagacgatagagcagagaatcgaacactgatcaggaggttaccgaggttctgaattttctgatggttttgcagtgaacgtggagggggttatataagagcaggaatgagaattatggtcagatcagagcagggaattgcagagaacatgccggcgatatctcagtcagcagtgcaagctaggctcacatgcatgcaaggaaaatgtaagccgaaccctggagatggaattgcgcgttcaatcaggtgattgatacgctgtaaacctgcaagctgggcatcatcatcagcacggcttagcattttctcctgataatcatgacctggaaaataatacatttcatgcatgtaccttgcatgttcagtaatccgtacttgccggcataaaatggatctacttagatattagtctgataatctatggacaaaaatataatttggaatgaactgtgcatgcatgccatggcttatcagcatctatgtggaatttgcaaattcttggtaggaaagaaactctgagccacatgaggccatgagggggccagcactgtcagcacatggaagatagctaggaggtggataaacaactgatcagattgattattaactcagcgcctacttagatgtctaatcatttggaaaaagctgactaaaagagtcagcagatttaattagccaccggtaccgcgcgcggtacggcgttgaaattgattacatttttaagcaggaaaaatgctgtcaagttgtgcactattatactgacttctatttgctctccctttgaattaaaccatcaggcgtacgaaaaatgtttttctttctttgggcaaagacgcatcatatgctacgatagatgcctctgcaggaactagttgcaaacttgcatacggggtacttgtgtgtagttgtgttggcatgcatgagcttgtctgtgttcgtaggatttatcattcatatccagtaaattccactgccagttctcttagtggtagagtccttagactttccttcttcccttccccactgcaaaccactaaatgattcttaatgttccctgtttttgaattattgaaatgattcctcaaaaagtttttggtggcaggttgccggtcttgatgtcaagatcgtcagaaagagggttacaaggacatacaccgagttcagctagattacagaaaggcgctggagctagaagaaatcagcaccttttgctttggacactggcaattagcggatcaaagcattttgtggcatccaagtagacaataacagtgtcagtgtaagacaaagtggtgaggactaatcgccatttggtgtagccatgatcgtgtcttccgtgtaaacataaaagtttctcaggagtcagcaggaaaatttccgcattccaaatgagaccctgatttatatcacggtagaaatgactggtagccgccagtaagtagtaactcatgaaactcagcatataatttcatttcccggtgggaacaatgtacatcaagaatgtagttttaacatcatctacgtacagaacgaatgatagatcggtcacaaacctcgagtgagattactagttcgacctgccttgccatgaatggacctgcgtagtactactactactatacacattacataggctactagtcttcactagctctctcctggtgcatgctctttccccactatgtaagcttcttcaatctgcagccttattatactgatcttgctctgcatgccgttgtagtgtgcctgttagtaggaaaactggaggttggaggagaatgactggccgaacttccaccacgccggcacgatgttctggaagacgagggtctggccgccggtggaggtgacgccgaaggtgagcgtctggccgacgaggccggcgtgcgactgccagttcgcgccccagttcctgctcaggggcatcctgtcggtgttcggccccttcacccacaccgactggatcgacccgctcccggccacgttcgagatcagcaccagctcgaagtagttgaaccctcccatggtgaaccgaacccctccctgcttcacgcacggcaccctacatacgtccacaaagaatcacagatcgtacgtagtaatgatgattaattagtgaatagttaatggcattggtttgacttaattatcatggacatggagagtcaaaccgtccaatattattgtagtatacgtacctctggtacagcaccggcacgataccggccttgtagatgccgatctggagccaggcgggctcggccatgtcgaagtgcgtgcgaggcgggttgcaccagccgccgtcgttgctggagagggcgtagttgggcgggcacaggttggtcccggtgatggtcaccgtcctcccctgcaggcaccaccgcggctcggcctggtggtcgcacgcgatctggtagcactgcccgcacgacgcgccgtcgttgaacagcgccgagctcagcgccgccgtgttcgtcccgtaccccgaccagtacaggttcccgtacccacacgccccacctgtgcgtggtcacctcacctggcctctgttagctaacgacgactctgaaactgtacctacttactggtgcgccaatgcgtatacgtacccatcgtcccggaggcgtcgctgccgccgtagaacgtggccgtgccactggaccagcctgccgtcgtcggcgcgatgagcgacgccgcggcgatgacaacgacgagcggcagaatgctcggtgtcttcttcttcttccacatcgccatgaatcttgcaggtggactagctcgccgagttgctgcaatgtagttagtgacagtggtagtagtaactatgaagaaatgcgagtgatcttaaataggagcgggatcaccggcatggaatttttgcctgcgctgcagcgcgaatggcgcatgtacgtacactgcacacactcagctccaattaattgcgtcgtcagatcggtgatctccttgtttcttcgtagcttctttgcaggcacactaacatgcaaacgaagaagaagattctctcatttctctccaccagatcgatctgcagctacgcgtcttatattcgatccgtaattaagctgatcacgctgccacttccgcatgttctctgctgctgcatgctcagctcacccaagggcaaggggaatgattagctggaactatttacgcttcttaaaccggctatcttgtgaattgtttagttgacagagttgacacgccatggaaggatttggtgagatatgagaggcaagcaagcggcagctatggtacttgctcacatgagggagagcggcaagccgggcgcaggaagaatccaagtgcgctgtcacacggatatggcgagaagatggtgaattatcaattatcaactcaccggatttgcagaagtcgccggcagcgttcacatacagtaaccagattgatgtcatttttaactatactattttttgataaagttgctaaaaaaatggtacgtttagtttgttgccgaatttagtaaatacataagaaatcctaccaaaattttggtaatattgctatcttgccaaaatttggtaagatttattttggctataatctgaataggccgcagattttctatttactttttcctaactttttaacttttaattttaaaattatccatttcaaaaacttaaatatatatcgtttaattagctaacgacattgacacatggcaacatttgtcttgccaagtctccttaatcggtgtggcaggataaaactgtcacgttcgttatgggtgatgtgacagtgttgttttgtcatatcatgtgaattaccatggctaagagatttagatcttaaaataagtttctgatgatttatttttgaaattaaaaagttttaaaaaaaataataaaaagggtaaaatatctccgtcctcgccgggttaggcagccgaaaggcccagatgattacatcggccgtcacgtgaagcccaattcacatgggtcgcagtgtcttcccgtcccaactaatacggctcgttcgaacactgaaattccgttctgaccgaactgggccgtacgttggtgacagtcccgctcaggcccaacttcaacgggccgcagattggcagcaatcccgttcgggcccagtaagaacatggctcgggcctcaggggttcggagttgggaaaagtacactgaaggtcgctcaacttgtcatcgagttacaaaatcgtcctccaaccgtaaaaccggatatagcgcatcccccaacttacaaaaccagtacaaactaggtcactcagtggttttgacttcggttttgttcgatgtggctacacgtgtagtacctcaaggttctgagtttatatctccataggagcgaatttaagagattgggttatttgcggggcaaagttttctatttcaatggccgtatatatccagttggatgtagaggctggataaaaaatatcgttctctaaaaaaagaaaagagaaatggaagatttaggtggggaacctctctcctatgattattcaaaaaaaaaagcctcgacaaacatttctttttttttctctctgttttagtctccttaagtctatggtttacttgttatctgacttgactatcacaagctcagaacggttgtttgacggaggcctagtttagttcccaactttttctttaaatttttaacttttctatcacatcaaaactttcctacacacacaaatttttaacttttctgtcacatagttctaatttcaaagcaaacttccaattttagtgtgaactaaacacaccctgaaactgcacatcatcacctgtgtactgaattctatttgtctcaaaaaaagaaaaagagaaacgaactgtcagtcacctgcagttgctgtccaccactgacaagcatttcacttttagttcgtgtgccaaaattttgaaaaatgaaatggcatattggactcaaaaagctacttcagcctgccgctgacagaaaactctccaatccgacccatagggcgcgcttgccttttgtctcagattacaggaatagtgatgtccccttctgcagagcaatgtgaagcatgagtgcatgttcagtggagtgttaatagatggaactcaaggagggaggagactggagcaggagtgcaggacacgggcatgctatgccgtacctccggcacggccaatggcacaggtgccggcacgctttgctgctgacattagccgtcctcgccgcggctgttcatcgggccgttttgttttgatactaaaaatatgcactaccaatttataggcaaattgcaaattgaatagtatgcgttagttttgattgagccaaatatttaacagtgccccctatcttatttggtcatattttagaagcttcttccttatacaataagaatttggctttatatcggtaacaatctaaatgattgctaaataattttatcctaccaatattttggtagtgccaaagtttacctagactttgacactaccaatgaattagtagggtaatgaatcaaacaagcccatcatctgtcacccagctgcagtcactctgggcatatggagacgagctaaggcctatggtctatggcggtggctaagacaccatcagcagcgatgagggggacgaggatgctgaccgactca

SEQ ID NO: 73982 - DNA, 1210 bp, Oryza sativa
gagggccaccgccggccgccgcgcgcctctggttctccccgccagtcgccggaatacacctctatattaggagcagatattccgccaccgccgccgctccctaccgccgccgacgctgctccagccaaggttcagagaaaaggccgagggagagagagagagataagggagagagaggggaaggaggaagaagggaaggagagtttgcactgacatgtgggtcccactacgctgagtcagcttgtcaaccgggtcaacaacgccacgtcggacgaaaccgccagctaaaccaccgagggagatgatttgctctggttttcagagaaggaggaggcgttatacccagttttccatttgaggggtgttattcacgcaagcgcaagagatgagggaggcaaaatggacttattcctactttatacaaggaaaaaaactatacaacatttattttttaatatcggctagttcgattggtttagtcactaattcagtttgcttcgagcatttatccgctgagaaatatctcacaattgtttgggtgacgatctctgggtcaaagtcaagagtacatattaccttttttttttttgcttggaacgacatttaataatatagtttttaacaaaatatatttcttcttctttgcaggttatctttttatcatgcattgactttggtctcgggctatcatccataagcctagtttgtaggggtttactactgcgactaatttgtatttaaagtaggtggccagagagtttttctacctcgtacacggatggcgatctagtcttcgaatagagatccttgatcaagttataatttagttttcttccgtgggtatctgtatgtaggcagtgtgaactatcacgatacaaaagtcgagtgtccttagaaccagtggtgtggatgatgaaagaaaatataggtattgccatgaacttaatataaacataagcgataaaactctaagcaaacggcaaggttcaacgtgatcccatagtaggccgggcagtaatagaacgtgacgcctattcactaatacatgtgatatgcttaggcatcgggttgccatcaatgccaatacacccatccgttgtatgcctcttacattcagtaatagaaatccctagccaagttagcaccaagcatatacatgggcattagatttactagctagtttaagcaagtctcgatccatacaggttac

SEQ ID NO: 73983 - DNA, 3812 bp, Oryza sativa
aagaagtcctgggtgaagtcatggcttataccccagttgagcgcctgtgaagatgaagccgtaggcccgctagtccgctgctgcttatttttgtttgtcaggcctgaagtgcctttgtaataatgtaaatattatcgatataataaagatgtgccttttgtatcctgtttgtgtggtgtaccccggcttttcctgggatggggattaatacacttgtgttttggaaaaggtatttttccgggcacgacaagctaatatcagagacatctcgactgtaggataagccaagtggataaaacctaaggacatattttataaacaagactatttgcaaaagttcctttttcctcctttccctaatgctatttgcaaaatgtttactctcttcttcctccttcggattttcaactagtactagatggtcagctttgcgaagaagaagatgtcgctagtggtctgccgaagttctagaaggctgcaggatccactagcgaagcaaaggaagcagtgaagccagatgtgaagcaggagtgaagatcttggagaacccgtcgcagaacctataccaccctttagggttttgttagtcgtgtgtttccttgattgtgtgtgtagcacatggtttgcatcagtggggtgtgatgtaaccatgctaggttgtttgcgttatcaacctgcagaataagcctaacatatatcataacaggaaaagattagatctgttaaggtcctatccttagtttctgatctctttctttcctccaattttctctttccccctctctaaaccttgtaacagatggctgacaatgagaaaggaagtaggtcagaaatcaaaacaagggtgccccaagctccgagtgaatgaagcaccagacaccagttgtgtgacagtggtctaacacctgattaactagaacgaattgcttatagagctaccacagcagcatcagatgccaattctagacccgagtcagatgcaacctcaagtgcaggtggaggcagtccaatcactcacaccacaagttagcgcaccgccagcatcccaacaagcccatcgtgccatgccacatgtggactcaaaagaagcaagaatcatttgttttatctatgttgaacaagggcactatgcaaggaactgtccttagcagaaaaaaaaagcaccaatgcgaaccgaagatgaggtccgtaagatgaccattaccggcacagaatggcctccaccaggaatgacaaaacgtcaaagaagaaatttcttccgaggtgcaccatagttgacggaacatcttttagctaatggaggtagagtgtctgatagcgaagattcagatcaagtctcctcacgggttgaagatgagaagtctctccaaggtttcaaccagaataaaaaggaacatatggcatgctctcgttgtggagaaatcggtcactttgccagctcatgtgtcaccacttgcgttcattgtgaggaagaccatccacccgacgagtgtccaacaagcaggattacttatttcttgtgcgaatgagctgatcatgtacgaaaagattgtcaattcagttttctgctgatgaagaagatggccaaccaacccgccagttacaacagacagaagcatcaaggcaacccaaatcctcgacaagactacagtttcagcctaactccaatgccaggacagaggaatcaaaatgggaaaagaaaatgccgagtctggaaagatatctgttgtttcaattgtcaagaagtgggtcatttcgccgacaagtgctcgaaaccgagaaacatatttaccaacacgtcagtccatgcaactccgcgcaatcagaagcttgctccttagcaaattggcatccatgcatcctgaagcagccctatagcccaagttgcaatagctcccactccaatgagtgcactaccacaaggtgtcaatgctcaatttcagccccagccaccagttgacaagacagaggccagtatagggttggacctttggatggtccaggacaacagccaagaaatcaagtcaagatgaagaacctgagagtaagaaagttattggtttgttacaactggaaagaaccagggcataactccaggacttgtccctaaccaaggaaaaaaaatcggcctccacattttcgccaatttacaagaaacagacatgccaatcgccaagtggtcactgagaaaaaaaattttttttgggccccccccaaaaaagggggtttttaaaaaccccccccctttgggggtttccccaaaaaagggccccctagtgcttagtcagaagcaaccataacactcttgtatcgatgttcaagtacttttgttttatagttgttctctaccacccgtgtaataagaaagaaacgggaaataatcaatgagtttggcaaatgtatgaaggatccatattgagactgcaagtgttgtgagttgtgtacattttgttgatgattaaggagacctagggtcttatttccgtaagctcataatctgttatgaatcaaataacctagcgattgatggcgaagaaaatcaagtgatcaaccaaagagacatttgtttggactaagagtttccgatgtgtcctttttcggatcaaaggcaacgacagtcagtatagcttttgacgaactacttcaaggtttctctgaaaggcagcaggcccaaggactgcattgccccagaagcacccacaacacccggagtgaagagtacctggttgagaaaggtcaaaaggtgattgatggaagagatcggaaaagatgtttggttgctaggaaaatgtcacgtcccaaaacgactctaaaatatatcctttaaattatgcctagaataattaaaatccgtgtgaaagcctctaacaattaaaatgtgcaaagttaaaagtcaaataaggcttagaagatttttgtatatttcctaaaagcctaaaatgtgtaaataaattttagtggaattttcatagcacaaataataattgttaagaaataaacaaagttgaaaaagttttataaaaagaaaaacccttaaagtcccccttcccttccttgggccggcccggcccatctctccttccccccctctctctctcctctccccgcggcccactcgggctctccccgcgcgcgcgccgctgacgggccggcccgcccaccaccctcgctgacgggtagggcccacccgtcatccccgacctcccgccgctcccgccgctccgcccgcgccctagcgccgccgccgccgcgaatcccgccgcctcccgtcgtccccacgtgcaataaagtgggaggaatcactcaacgtgatcccctctccctttccccccattttttccctctctctcttgcgttcaaacgggcggatttgcccccgcaaatctcgccggcgccattgatggcggccgacctcccgcgccggtttccttcctccccagtcgctctctcccccttccaaccctatttaaaccctccccgcacctcctccgtccatttccgccgtcgccgcccttcctcctcgccggattcgagctcgcgacgtcgctctctctctccgccatcgccgccgagctccggtccgccgccgtcgtcgccccggaccgcctcccacctcggcgccgcctccttcggcttcgccgcatcctcgccgacctcgtccacccctccgtttcggtcgccgaccgccggagcgccgccgtccccgtcgacccgagccacgccaccgcctccttccgctccggccgcctactccgtcaccgccgtcgcctcggggtgagccgtggaccgtcgcctcctttcccccttccctc

SEQ ID NO: 73984 - DNA, 1260 bp, Oryza sativa
catatactactcctcactgcgcagctaaactctagcggtagcagcaaccagtgcgtaggcgtagctagctatagctactcgcgcgctgcgcgccgaatcttctttgagcacgcacggatgacgcatgttctctctgatgtgacgcccccgtgtcagggccgatcgatcgatggatcgtgtcggcaagacgccaaaaggacacgttcttttttttcaactttgctgtacatgcacggcgtagatatggctggagtctggagagcaacccggtcgtgtcaaagccgcactcgatcggcagagccaggagtcggatcgacccggccgcttgtgctcatgcctacccataggtgacatcgctgctactgtagtagtagcagtagcagcgcctaggtcgttcaattgttcaaagttgcacgagctgatcaggaagtatggtaggagtacgtacacagtgatcagtagtactccgtagtagcttagcctgctgcctgccatcgtgacatgatgcacctgagagaaaaaaaggggccaaaatgattggatacgcctttcgctttggtaggggagggaattaattgccggcgacacgtctggtgggtcgcgtcgctcgcacagccggaccgccgatgatggcgcggttgaatataccgctccccgctcgcgcgttgccgacgacgcgcaacgtgcgtgcaaggccggtgtgagacccgatcgcgaccgatctgccgccgctactgatgatgcccgctgctgctgccctgctgcctaattaacatatgcttctcctcccgcgatcgatcgatcgatcgacgccaggacggcgacgacgaaagctggggacaaaacggagcccgggggaaacatccgaacatggcagcacacgtgcatgggcagaggcgaagcgaacggtgcgccgcgcgatcgatcgccatcggacggcccggaccgtgtgcggggaaagtagaggaccgaggttagctggcgatcgagcggcgactgctacctgctccgtttgcagccggccgcagtgcaggacgacgcagcggcagccttcggtttcgcaggatgcatcgccaaagcggggagaaaaaaggcaaaggttttgcagctgcagatcgaacagatggaatgatgatggagagacgaccaaaaactcggaattaagatggccaggagaaaaaggcattgcgactcatgcatatgcatgttcactgtccaggcaggcaggtcaccaatctgatctgatctctgatccgagtc

SEQ ID NO: 73985 - DNA, 4823 bp, Oryza sativa
caatgcctgcgggcttatgatgtaataattagcactagactcttgtgtatgtgcttttggtatttcagctatgaactcgtgtgtagcagaccacttgatccagggaaatggtactgtttacacgaatgattcatgttataaaaacgggggtccacagagctggtatcagagccatacgactgtaggaaaagaccaaaaggcgccccaccccttttctaagttggccaagggaaaaattcccatttagtaatactttcgaaaataaaaacgctatgtttacaaaactcggtatgattttcatcttactcttaactattttctttacaaaataggttttactctcaactgactttgggtttttcttaaaattagatggcagatccggattcacccgctacctgggagttgagcttacctcaataagaggggtatgtcattgagctgcatcggatgttgaggcgtctgcgatactctaggttcccgttatactgagtgagacagtgtggctcagtttgggaggctcgggtcgaggttcacccccgagtcccttccgagttggactacagctttcagacacgtcaccaccgagacctgctgtcacgcccggaatttctatccaaaattctaaacgcttacatgtgtgtgaaccctcatccaggaatcagccgaggcacacaataacaaattgataatagagtacaattattactctaattaataagcgaataaaatgtcattacagaggtagatagttcctctcaatcaataaagatctaagcagcggaaaataagataaacggcgcagacgactccactccacaggcagcttgaccagggctacacctaatcctcctcaccaacagcatcactgtagaactcttcctctgatgaatgattgcaaggtgagtatatgacatactcagcaagccacgcagcaaatatgcaagtgcacaggataaacaaagaatggcatagtagggtttcatttgcataaatagcatttaataaacatttcagaatttaataaaacagttaagtaataattaaaccatattaaaccaacactatacaacataccctgttgcataggcccaaccattctgaacaaccatcccggctgcacagttctatctccaaaccaagaatataccattccaaaccaggagctaaacaaattattaccagttatagcatcttttattatgatgaggagtgtgagactaatcacgaaagacattgttagacccgcccataaccgcgggaacggctattcgaatagttttactctggccagaggtgtaccactgtacccacaagacacagccccacaacatgtcaccatgtgcctcaataccaccacggtacctcggaaaggagctgtgacagtacccctcgcacaacacaatcgaccacagcgcaccattcctggatcataatcacccccttataaacaaggcattgactccccagcgacccccgtgggcttatctccgctacttctcagtctggtgctccgcaatgaaccatgctgtacaaaaggtaaagccgttgcccacgctggcttgtggttggcacggttaatgtttcacaaccgaaactcgtgaaccggtccttaattgtcatgagcacgactctcaaaaccatgtgctcacaacccaccattatcaaattttagttggcaaataattaattaaccaatcacgattgaccatcgtgaactatcattaaaccatcattaaataatagtgagtcataagttatcccaataatgtgctaatgtttctaagcatggctaagcagtcatatctaatatctagctgaaccaatatatataaagctcaactagtcaagttataataacccaagatatcaaggaataaagtaatcaagaacaaaagggctataacaaataataggttaattccacccaatgacattcgaaaataaatgcaatagttgaatagaaacaatagctttaaacgggatcaacatgctcaaagggttgtttgggatctgtgtgacttgccttgctggccttggaactcttcaaattcttcccctgcaaaaacggactctccggaaacgtcggaatctaaacagaaaagagcaaaatcaccaaaacagcacataaacaagcatgaacagtacatgtggatatttttaacatgtagatctcaattttagaaaaaaattagagacttgaaccaactaaatccgagctaaggtgaattagttatgaatttttaaagattaaatcggattaaaacacttatattgattttaattgaattatgacgcaataatgaattatttttgaaaaggaaaaaggaaattattgcgttagcggctagggtttgcggtggaccgggcgcacggcggcggttcacgagatctaacggtcgagatcgatccatccaaaacggacggccgagatcgatcgggtctacggcggctcacggcagacggaccctgatgacatcagcggtgacgtcatctccggcgacggctcggcggctcgggcgcgcaagctcgccggcgaacgacggcgcttcggcacgaacggagggcaccaggacgatagagagcgacgcggcgaactcaccggtgaccaaagaagcggcggaggagcagcggacggcgacggcgtcgagaaaaaggcggcggcactcttcggcttgacgacggcgacggtgctccgacggttgacagcgaatgcgaaggggcggacgaggatggcgacgcgacggcgaccacgatggcgagctccccgagcgacggcgatgactggagcgacggcggcgcgcggctggagcgacggcggcgctaggctgcacgtggctagggcgctacagacgtcggcgagcgaaggcgagggtggcggcgggtagaggagacaccggggtccttttctaggggctagggcgcggcggcaaaggcccacggcggccggcgacggaaaggaaagattggggaaaaacgaatccgaatcaaactcgaatccgcctatttccaaaggaaattagacaaagtttctatagaggaaaagatagagtagatcaaggggattctttcccctctaccaatttcaccggaaacggaaaggatcggccgaattggaaagcggcggcggcggcacagcactagggtttcggccggcggcggctggaggttgacgacgaccccgacaggtgggccccacctgtcagcgaggggaacgcgcgtgcgggcgctcggcttgggccgacctgggccgagagagagaaggttttgggccgactttcggcccaaagccaaaagagacttttaaaaacctttttcaatttaaattattcatgaaatgcaattccatttattaaaattacttccttagctcaaataaatcccagaaaaaatctaggaattatagaattaagcaaagtatttaatgaaattttatctggccccattttatattggaatttattaattaaaattaaatcttctcttctaagcttttaaaataaattctaaaaattccaattaaacaacaatttatatatttggaatttttagggtgtgacacctgccagagaccgcgatgcaggatgcagcccaggaggccttcctccgactcagctctatccaccgagctgagttagcgagtaccgagtttgctcatcacccgttccgggaggagagcaactcagtttgcacagttcaggacacgccctgctgctacaacccgatggtgactcggttgtcacgatgggctgaggcagtagatgactactacgaggaggctctgttggagattgacgatcaccagagacgtgtgggagagctggagactgagttgactgacctctcagtgcagcagcttcagttggaggaggagcactaggcttggggcagtgagatagactcactgaaggcacagctccaggttcacggcgaccagttccagcagttatctgactagtacaacgatcgccgcgggatgatggatactcttgaggaccagctgagagagagtcaggagcacgtcagccagctggaggagcagcttcgagcagccacgatcagcaccacaggggcttctacttccatagcagtaggccgtgaccgctacttcttcctcaccccgccgtacccaccagcgttccacgctcttctgggagaggctagtatgctagctaccgagtcagcaccttacctactggacccgacagcgacacaaccacctgtcccggagatggtgcgcactccactgatccctacaccttctccgcagctaggttccagtttggagactccgatccaggtcgactccgagacagaggggaccgacaccgagccagagatcgagccagacatcactgatccttcagaggatgagacccctgttccccgcatcaccttccttggaggtcctcgcaccctcagcactgctcgcaagagcacacgacctccgggcaagaggcccaagccagatccagaggccactacttctgagccgtggggactcaggtttgcgtgtgccaacgaccaccctctacctgccccaggatcctgcggatggctggaggactagactgacagactccttgcagcttcgatctcgtatcagatggtttttggatagcatgcgagacacaccccccctcttacctagattgacgagtagattgatgattagtttgatgtatcttttggatgaaccttattcgactgcgtatgtacgcagtcgattgcatcatgatttatgtaccatttgtgaaactctgtgatgttatttatgatatctattgttgttgtgttataaatgagtttattccaccatgctt

SEQ ID NO: 73986 - DNA, 7619 bp, Oryza sativa
gtcgagaggttccaggacaccgatctttgaccgactggtcctgataactccgatgatgaaaaaactgatactgattgatgtaatgtgataacaatgattttgatgatgatgatggaggcacaatttgtacaatactgatgaatttatgctgtgctcggtgtttcaaacttagcttctgatttcttaaaagcttttgtcaaaccttattgagcctaaaacccgcaaaagttattaaaaagcttttagtcctcatggactaagccaaaaaatcaagcaaggcaatgataaatcaagtaagcaaattgaattgataaaaatcacactccattattattataatagtccccgactgataacttcaaggagacgcttgatgttgtcagtcaaaatagggaaatacagaagcaaaacttaagcataaaaacgacgaagatgttcgatattccaagagttgtcgataggtgtaccgtcttcacgcttgagtcgataggaacctagccgagtgacttatgagattataaatggcccttcccataaaggggataacttgtgccgatctcgtgtagtttgaacttttctcaaaaccaggtcgccgacttagaaggctcgtgatcggacgttacgattatgataacgacgcaacccttgcaggtatcgggccgtctgaattaaggctacttcgcgggcctcttccagtcgatgtagatcatccactcggtcttctccgtagcgctcctcgcgaaagttgcgaaaacgcaaagattcaaattctacctcactaggcaacattgcttctgctccataaactaggaagaatggtgactggctcgtagccgactgggggtggtgcgcaaggaccaaagtatggatggcagctgttccacccatttgccggcataaggattcagtcggtcaaaaactcgtgactttattccttggagtaccatgccgttggctcgttcaacttgcccattgctcataggatgcgctacggaagcataacaaattttgatgccgaagtcatcacaaaaatctttaaatactccaccagtgaattgagtgccattatcagtaatgatccgattaggtaccccaaaccgatacacaatgttgatgaaaaaatctctagctttatctgccgtgattgtgatgaccggtttagcttcaatccacttggagaatttgtcaatagccacaaagagatgtgtgtaaccgctgactgcctttttaaacgggccgaccatgtcaagcccccaaaccgcaaacggccaggacagcgggatggtttgcaactcttgggctggtagatgagtttgtctggcgaaaaattgacaaccttcacatgtccgcacaatcttgtcaacatcagacacagccgtaggccagaaaaaaccttgccggtaagccttgccgacaatggtgcgtgcagcagcgtgattgccacagataccagaatgtatatcctttagcaattgtctcccttcctctaaggacacacagcgttgcaggattcctgatggacttttcttgtacagctcggtctcatggataatataaagcctgctgcacctggaaatccgctcggcttcatctttatcttgagggagttcttggttggtcagaaatcgtataaggggctctctccagtcggcttcaaccatagctatgtcttgagtgtccgcggcctcaactgtttctctccttggtacggttggttcgtaaagatgttcgacgaacacgtcagaaggagccgcttcgcgtttggatccaaaatttgctagtctgtcggctgcttcgtcattgtgccgaagaacatgggtgagatcgattccatcgaacttatgctccaacttgcgtacctcttgtcgataagcgatcatattgtcgtcaaggcaggaccactctttcataacttggttaacaactaactgtgaatctccgcaaactatcaaacgccttgattcccaaagagattgtgatccgtagtccgtgaaggagcgcctcgtattctgccatgttgtgagttgcagagaaacgtatccataacacgtagctcagtctctctccagtcagggaaattaaaacaaccccggccctagtgcttgaaaatctctttgacccgttaaaatgcatagtccaatactccatcttctcctcgggcgtgtcctcttggcactcggtccactcggcgacgaagtcggctaaagcttgggacttgatcgaagttcgtggcttgaacgatatgtccaaggacatcagctctaaggcccattttgcgatccacccgtttgcttcacgattatggagtatattgccgagtggaaacgatgtaaccaccgtgaccgagtgaccttggaagtagtgagataatttcctgacggtaattagaacaccatataacagcttctgaacttggggatatctcatcttggagtcggccaaaacctcgctaatgaagtagattggtcgctggactttctgaacgtggccttcttcttcacgctcgacaaccaggaccgtgctcacaacctgagaagtcgccgatacgtacaataatagcggctcttgcgagtgtggtgaggccagaactggtggagtagtgaaaagtttcttgaagtcttcaaaggctttttgtgattcgagtccccactagaaattgtctgttttctttaaaagcttgaagaagggcatcccccactcgccgagtagcgaaacgaaccggctgagcgccgccatgcatccagtcagcttttgaacatctttctgggaactcggcggtttcatgttgaggatggcgttgactttctccgggttggcctgtatgcttctatgagacaccataaatccaagcagcttccctgacggtactccgaaggtgcatttttcagggtttagtttcatcctgaaagcgcggatgctcgcaaaggtttcttccaggtccgtgatcaaatcatccttttgcttggtcttgatgactacatcatccacataggcttcaacgttgcgaccgatttgagttgagaaacatctctgtatcatgcgttgataatttgctcccgcgtcctttaatccgaaaggcatggtgatgtagcagtaggccccaaagggcgtgatgaacaaagtcttcaagcagtcggattccttcaatcggatctgatatcccgagtagcaatccaaaaaactgagcagctcgcagcaggcggtcgagtcgactacctggtcaatgcgaggcaacccgaaaggatcattggggcaagacttgttgatgtcggtgtaatcgacacacatgcgccattgccggtcttcttccgaactaggactgggttagccagccagtcgggatgaaggacttctttgatgaagcccgtgtcgcgtcccaaaacgactctaaaatacatcctcaaaattgtgcatagaataagtaaaatccatgtgaaagcctccaacaattaaaatgtgcaaagttaaaagtcgaataaggcttggaggatttttgtatatttcctaaaagcctaaaatgcgtaaataaatttttagtggaattttcagagcacaaataataattaagaagaaataaacaaagttaaaaaggttttataaaaagaaaaaccctaaaaagtttcttttccctccccctctccctcttgggccggctcggcccacctccctccctctctctcctctcccccgtggcccaatcggccccctccccgcgcgcgcgtgccgctgacgggcaggcccgcccgccaccctcgctgacgggtggggcccacccgtcatcccctacctcccgccgctcccgccgcctcgcccgtgccctagcgccgccgccgccgcgaatcccgccgcctcccgccgtccccgcgcgcaataaagagggggaaattattccccgtgattccctccctctttccccccacttttccctctctctctccctcggattcgttcggaaagtttccccctaacttcgccggcgcatcaatggcggccggatcttccgcggccgattccccctcatccggccgctctctccccctcccaacactatataaacgctccccgtgcctcccttcaccgtttccgccactcgccgctctctctccctgtcggaatcgagctcgcgccgtcgttctctctctccgccgtcgccgccgagctccggtccgccgccgtcgtcgccccggaccctctcccgtttcggcgtcgccttcttcgggttcgccgcaacctcgccgacctcgtccacccctccgtttcgcccgccgaccgccggaacgccgccgtcctcgtcgacccgagccgcgccgccgccttcctccgctccggtcgccgttcccgtcgtcgccgtcgacccggggtgagccgtggaccgccgtttcacttcccccttccctcccctctctcgggcgccgctccgccgcgccggtggtcgccggcagcgaccatcggggcgcgggtgcgccgcctcccgtcggctgtgccggcgtggccgccttcgggcgcgccccgcggctgccatgtggggcccggccgtcagccgcccgcgccctcgggtgcggctgacacgtgggaaccacggcgccggccggcgtaagccgcgtgcacccggtccaccgtggaccgtgaggctgccgcgtgggccccactcccgtggaccctgtccgtgcgcccctcccctcggctgacgcaataaatccgattttaaattaaaatttaaatgaagaaattcgcaaatatccatttaaagagcatataaacttcaaatggccataacatggccattcgaactcggaattggaccgttcaagtctctaatttctccttaagaagtcaagaacccatttttgtgctttgtttctgcttgttatatggagtttagtagagtaaaagccgtttcttttccattggtcgtgtagacgctgcagcttcggaagatccgctcttcgtggaagttgaagccgacgtttgggaaagcgagcaaggcaagtcacatcatctttgaacatattgaatcccagtttgtaaaattatgttgatttaacttattgcattatcgctttatttaaattcccgcgttatcactgttttatttagccatgcctatttacctttgttatgaccttattattattgttattgttattatttccttgttcaccctagaataaacaaaaccccaactagtggacactctactcatgctatcactagtatgattttaggtagatgcttcgcttttaattaggtaacattaggcggttttacaactctagactttgggaatattcatatcacctggacactatggaatggtttggttattgtggaattggcttcacaccgctccttctattcaaaatccccaaaaatggttttaggctgggctcggggtgcatggttttgatagtagcacctcggccatataaggaccggtcttcgggcctctgttgcaaagcactaccgtacttccacatgtctagtgggtaaggcttagtttgtggctcagtctagttataaacaaaagtacacggatggagatggaagaagtcgggggtcgatggacatctccagggcaaatgaaggctacacgagctgcggcccggtagtcgagatgtcatggcacagggccggtgtcctgctgctaggggctcagtcctgcctgcctgtcccgggggttctggccgtaggtgggattgggtcggtactcttgtctatggctaggatgggttggaaactatgtcacgtcttccgtctgtataccgtggtggtatgtggcacgtggttacacgtgaggaagatgtgtcttgtgggtaaagatgtacacctctgatcagagtataatctattcgaatagccgcgccctcggttatgggcaagccgagcaatgtacccaagttagtgttttaattcttaaaacctgcttaacaactaaaatgtggaatggttggcctgggttggcttgggacgagctgggacccagggtcgggttgccagttcggtctgaatcatcgtaggccttgggttaaggcaggttcgtgtgggttcacggccttgataaataatattgcatagtactagaatcgtgtttgcaaaatagccctgagcaactaatgtctttaaatgctgtttactgcaaccctaaccctttatagtataactcctttgtactcccttgcatttattctgcacttgtgggtgtgtcttgttgagtacggtggttgtactcagtcttgctcaatttttcccaaacccagaagaggagttcctggaggatgaaggcttcggtgtctagctcgtgcctgccgtcaagtgcctgtggtcgtcgccctagtcttccgttgtttctcgtttgtctttgtgtgtgctgggccttcgcttcccatgtaataaattaactatttacgcttccgcttgttaaactctgaattgtatcaacttttggtgtaccttgcctcctgggacaaggattaatgcacgcacgtaaggaacgcccgttgggttatttccggtcgtgacaagttggtatagagcccccttgaccctaggacgagccgtagatcccaagccttagcagtattttcgaaataaaaatcctctgttatttgtgaaaaccctttagtctttctctgtcttgctgcttcatttatcgccaaaatctgatttttttttaaatgttgcttttctttttgtttttgtttgtagatggccggcagcgtcacccgtcgtggtttggacatgactggtttcgtcttggagctgcggggcatgtgcgttgtcctggggtatccacatggagtggactaccagggcaggccgcttccggagcaggagggtgacgatgcagagccccacgctgcttgggaggtcactgcagtgatcctcgttggctctcccgagcggacttcgctggcagtcaccgcgggtggagattctttccccgccgcttgccagagcgccgctctcctcgccatcggcactcttcaccagcgctacccggacgagttgcagcactcgccctaccgctaccaccctcgccgcggtggagcccgcgactacgccaccttccgggatgctagctcggaggatgatgctaccatcgtgcacctggcgcgcatggtggaggcatacgacgcggctcgtatcgacttccatcagatggtgcgccgtgggatggtcgagaacaacatgaagatcctggagctgcgtcaagagaacctgcagctcaagaaggacctagacgcggtggaggcgcagctgcatcagctcaagatcgcccagggagaggtctgccgccccaagcgtcgccgcgtctgccgcagcccgaagatcaccgcccgcaagagcacctccaggccctagctcgttcgtcagtccctggcgtggacttgcttcgtcgagacccctcgtgccgagcccgcgcccgtggttccccaggagggggaagcctccagcgttggtagcacggaggatgcgctgttgctcaccttccgtcctggcccgtcgcagcggtagacgagcagttagtaggcttgcgcgtgtgttctttctcgtttgtcttcttgttggagttgtgtggggcatggttataccggtgtgtggcataactgtgtcggagc

SEQ ID NO: 73987 - DNA, 1552 bp, Oryza sativa
aaaccgggagggagagggagaaggaaaaagaaaagaaaagggagagagagaaggaaaaagaaaagaaaagagagagagaaagaaaaaaaaagaaaaagaaaggaaggaaaaagaaaaagaagggaagaaaaagaaaagggaaatagataggaaattagagggagattagggaagtttagaaaatttaaaataattagcatttagttatagactagttatagacgtagaattgcgaaatttaatataaattatggattattcttggtaatttctacaagaaatcaattcgcggtagtagtttaaatgtaattaagaactaaacgattagatgaattcttatagactattatagattattttgggtaatctctataagtaattgattcacggtagaaattcggatttaatcactaggaattttagacgtatattatatttagtcgtttagtactagactaaaattaaatcgtataatattataagataattttaggattccgtccgatatttagcttgcgatagaaatttccaacctattatatggatataatgctcgggtagattaaattaaaaacttatgataacaaaatatctatacccacaaaatagtttagaatataaaaatcgaaattgggtttgccctagttcgcgaatagtaaagttaatataaaagaatcgacttacgcgttcgacttctatttggatttatttggatttttatttgaattctaaccgaattcaaatcaattttcgaacgtaactataaagcccgagggagttgcggatccaagtgagggccaagacccgcaagactttgagcaaggcaagtcatcactattcttgaacatattgatcccaattgcgaaattgttttgtttacaaataaaattgcatgcaatgatgaacatcctacttgcgattatgccatgccttgattattgtataccccttattccttcgtaaccatgtctacgtatgagtccctagtcaactatgacaaatgcttagaaatgctattctagaatcatgcatactcatatttgtcaaatgctatattcttgggtaattacctttgggaaggtaattgagatgcgacatgtggagacatgagcgccacattgccatgatattgaggacatgatttgtgaaaggagaaataaactaaataactgttttcgactagggcggacggaggatttgggtggtatctggaaaaggctagtaccttccccggtcaattaaggaccgagccatgaagttaagcatgaaacgaccctcgtacaaccgcacttctcgtatgggtatagacctagtggagtagatagccgagcagaggcagtatccctgcatagatggttcacccctgagtgaggcaggtgtgctacggtaggacagccgttgaggtagggccgagaggcgtgccctacatcggtgtcgccattggtaggactgccatgagtgtgtgagagagagaacttaacttgaaccataatttaatttaatatgtgtgtgagacttctctttcccgggagcgccagaactcctctcactg

SEQ ID NO: 73988 - DNA, 3188 bp, Oryza sativa
gtttcagacaaaagggaagctcgcacctcggtatgtgggtcctttccgtatcattgctcgacgcggagaagtcgcttaccagttggagctgcccgcctccttgggcaacatgcatgatgtgttccatgtgtcgcaactcaagaaatgtcttcgagtgccatcccgagcaggccgacttagagcaaattgaagttcgcgaagacttgacctacgtggagaggccagtgaaaatcctggacaccatggagcgcaggaccaggaaccgggtaatccgtttttgcaaggtccaatggagcatccacgccgaagaagaagctacttgggagcgtgaagacgagctgaaggcagcccatcccgatctcttcgccagttcttccgaatctcggggtcgagattccgtttaaggggggtaggtttgtcgcgtcccaaaacgaccctaaaatatatcctttaaattatgcctagaataattaaaatccgtgtgaaagcctccaacaattaaaatgtgcaaagttaaaagtcaaataaggcttggaggatttttgtatatttcctaaaagcctaaaatgcgtaaataaatttcagtggaattttcagagcacaaataataattattaagaagtaaacaaagttaaaatggttttataaaaagaaaagctctaaaaagtccttttttccccctccccctcttgggccggctcggcccatctctcttcccctctctcctctccccccccgcggcccattcggcctcctccccgcacgcgtgccgctgacgggcgggcccgcctgccaccctcgctgacgggtggggcccacccgtcatccccttcctcccgccgctcccgccggcttgcccgcgccctagcgccgtcggcgacgcgaataccgccggccccgtcctccccacgtgcaatcaataggggggaaattttccctgggaaccccctcccctttccccccatttttccctctctctctccctcggattcgtttggaaactcctcccctaacctctccggcgccattaatggcggccgagtctcccgcgcccgtttccccctcctccggccggcccctctcacccccaaccctatataaaccctccccgtgcctccctccaccgttgccgccactcaccggcctctctccccgccggaatcgagctcgcgccgtcgctctctctctccgccgtcgtcgtcgagctccggtccgccgccgtcgtagccccggaccacctcccacctcggcgccgcctacttcggctttgccgcatcctcgccgacctcgtccacctcttcgtttcggtcgccgaccgccggagcaccgtcgaccccatccacccgagccgcgccgccgtcttcctacgctccggtcgccgtttccgtcgtcgccgtcgacccggggtgagccgtggaccgccgtttcgtttccccccttccctcccctctctcggccgccgctccaccgtgcctatggccgccgccggcgaccataggggcgcgggcgcaccgcctcctgccgctgcgccggcgtggtcgccttcgggcgcaccgagcggctgccgcgtggggcccggctgtcaccgcccgcgcccttaggtgcggctgacgcgtgggacccacggcgccggccggtgtgagcccgggtgcgcccggtccaccatggaccgtggggctgccgcgtgggccccactcctgtggacccggtccgcgcgcccctcccctcggctgacgcaataaatccatttttaaattaaaatttaaatgaagaaattcgcaaatattcatttaaagagcatataaacttcaaatggccataacttggccatttgaattcggaattggaccgttcaagtctctaatttttccttaagaagtcaagaacccatttttatgctttgtttcatcttgttatatggagtttattagagtaaaagccttttcttttccgttggtcgtgtagacgctgcagcttcgaaagatccgcttttcgtggaagttgaagccgacgtttgggaaagcgagcaaggcaagtaacatcattcttgaacatattgaatcccagtttatgaaattattttaatttaagattattgcattaccgctttatttaaattcccacgttatcactgttttatttagccatgcctatttacctttgtgatgaccttattattattgttattgttattaataccttgttcaccctagatcgaaacaaaaccccaactagtggatactctactcatagtatcactagtatgattttaggtagatgctacgttgtttaattaggtaacattaggtggttttacaactttagatcattgatgcaatgatctttgtgctattaaaactatttctcgagctccgaaaattcacggaaaattccggagagtgcattagggcacagaatattacaaaatattcttggccaatgatttttaaaggaaatttttaattccctcaataattcacttgatcatggcaggaccatgatcatcaccagttcagaatttactcctgaagacgcagcaaggatacccaagcgtcagagaggaagaaataccttccgtggagcacgccagctaacccgacatctcataaagtacggtccgcccagacccgaagatgatgaatcaggagaacggttttctactgatgacgatgatgatacgacccttaacagtttcaaggaaagagagttgaagttcaaagcatgtgctagatgtgggatagtcggacacactgctagtttatgcctccccacatgccgctgtggtgaatatacccattactcagatgcatgccctttaaggaaggtcacatgtttcttgtgtgaaggaatagatcatgtgcctaaggagtgaggacaaagtgtgtagaaaggatgcctgtggagtggtgttcccgctgcagttctagtcaaggcttagctcctgttgtctttctttctttccgctgcatttatgtaagacttttgtgatgtttgtaagacatggatctgaatgtcgatattgtcgtttgtgtaccccggccggttctggacggggattttaatgcacattctgcttggaattctattcgggaatttctgggcgtgacagttgcccacccaagctcttacaccagcaccagcgtcgctccgggggtttggcggagaggcagttcaagttcttggccaag

SEQ ID NO: 73989 - DNA, 5701 bp, Oryza sativa
tgagttcaggctaaaagagttaaatacttacattagggccaggtaggccaacaactatcagagaacaacagcggaagacaaaatattataagggcccggttaacatgccacaggcagtcgacaaggacttaaaacaaaaccgcaatccgatcatcttcttggatacgcaagcgtaccgacaagggcttctcttcaacactctcctaaaagatatataaatagcaagggtgagtaccaaccgtactcagcaagccaccacaacaacaatgcatatgatagaggtatttcaaggaatggcttcaggttcctttgcgcaaagcaagttttgcaaatcttttcacaagcctaagacctagcatagactgattaagttttaataccagtgtttacattaaacaacgatggttctgtccaccatccattgtgatcccaaggatagcttcccgccattgagtcgtcatggttttctgaggacgtccaccttccctcctctcaggaagtggctccatcagcataaaattcatcatgcaatatcccatcccacacatgttaagaatttagagtctagccaagtgtaatacacgtcccggtgctcaataaccgcgagcacggctattcgaatagatttggtttactcacactgcagtggatgtacactttacccgcactccgtgtcacgtcctgataaattcatcccgaattaaaaatcattcgctaaaaggaataatagaattaattaaaattcgaaaagaaattggcaaacactaaaatatgtacaagaaaaattcaaatgtggcccggagaatttttgttaaattctccttggtctaaaaggagccctcaaattttagtggaattttcagagcacaaataataattaagaagaaataaacaaagttaaaagggttttgtaaaaagaaaaaccctaaaagtcttctttcccccccttcccttcttgggccggctcggcccaactccctccctctctctcctctcccccgcggtccatcgggccctccccgcgcgcgcgccgatgacaggcgggcccgcccgccaccctcgctgacaggtggggcccacctgtcataccctacctcgcgccgagcccgccgtccgcccgtgccctagcgccagccgcgccgacgaatccgtcgcatgccgccgtacgcgcgcgccataaagagggggaaatcactgcccgcgattccctctccctttaccccacgttttgcctctatctctcccttggattcgctcggatttactcccgcaatcctcgccggcgcaatcaatggcggccgagatttccgcggccgattccttcctctccggccgccctctctccctcccgacgctatataaacgttccccgtgcttccctcctccgtttccgacactcgccgctcactctccccgtcggattcgtgcccgcgccgtcttcctctctctccgccgtcgccgccgagctccggttcgccgccgtcgtcgccccggacctcctcccgactcggcatcgcttgcttcggcatcgccgtgtcctcgtcgatctcgtccactcctccgtttcggccgccgactgccggagcgccgccgtcctcgtcgacccgaaccgcgccgccacctctttccactccggtcgccgttttcgtcgtcatcgtcgacccggggtgagccgaggaccgttgtttcacttcccccttccctcccctctctcggccgccgctccgtcgcgccggaggtcgccgccggcgaccatcggggcgcgggcgcgccgcctcccgtcgaccgtgccggcgaggccgccttcgggcgcgccccgcggctgccaggtggggcccggccgtcagccgcccgcgccctcgggtgcggctgacacgtgggacccacggcgccggccggcgtcaggccgcgtgcgcccggtccaccgtggaccgtgaggctgccgcgtgggccccggtccgcgcgccccctccccctcggctgacgcaataaatcctttttaaattaaaatttaaatgaagaaattcgcaaatattcatttaaagagcatataaacttcaaatggccataacttggccatttcaactcggaattggaccgttcaagtctctaatttttccttaagaagtcaagaacccatttttgtgctttgttcctgcttgttatatggagtttattagagtaaaagccttttcttttccgttggtcgtggagacgctgcagcttcggaagatccgctcttcgtggaggttaaagccgacgtttgggaaagcgagcaaggcaagtcacatcatccttgaacatattggatcccattttacaaaattcttttgatttaaattattgcattatcgctttacttaaattcccgcgttatcactgttttatttagccatgcctatttacctttgttatgaccttattattattgtcattgatattattaccttgttcaccctagattaaacaaaaccccaactagtggacactctactcatggtaccactagtatgaatttaggtagatgcttcactgattaattaggcaacattagggggttttataactctagactttgggatattcatatcacctggacactatggaatggttggattattgtggaattggattcacacctccccctctattcaaaatcctcaaaatggttttcggacgggctcggggtgcattgttttgatagtagcacctcggccatataaggaccggtcttcgggcctctgttgcaaagcactaccgtacttccacatgtctagtgggtaaggcttagtttgtggctcagtctggtcataaacaaaagtacacggattggagatggatgaagtcgggggtcgatggacattctccagggcaaatgaaggctacacgagctgcggcccggtagtcgagatgtcatggcacagggctggtgtcctgctgctaggggctcagtcctgcctgcctgtcccggtggttccggccgtaggcggggttgggtcggtactcttgtctaaggctaggatgggttggaaactatgtcacgtcttccgtctgtataccgtggtggtatgtggcacgtggttacacgtgagaaagatgtgtcttgtgggtaaagatgtacacctctgatcagagtataatctattcgaatagccgcgccctcggttatgggcaagccgagcaatgtacccaagttagtgttttaaattcttaaaacctgcttaacaactaaaatgtggaatggttggcctgggttggcttaggacgagctgggacccagggtcgggttgccagttcggtctgaatcatcgtaggccttgggttaaggcaggttcgtgtgggttcacggccttgattaataatattgtatagttctaggatcgcgtttacaaaatagctttgagcaactaaatgtctttaaatgctgtttactgcaaccctaacccttatattataacccccttgtactcccttgcatttattctgcatttatgggtgtgtcttgttgagtacggtggttgtactcagtcttgctcaattttttcccaagcccagaagaggagttccttgaagatgaaggctttggtgtctagctcgtgcctgccgtcaagcgcctgtggtcgtcgccctagtcttccgctgtttctcgtttgtctttgtgtgtgctgggccttcgctgcccatgtaataaattaactatttacgcttccgcttgttaaactctgaattgtatcaacttttggtgtaccttgcctcctgggacaaggaataatacacgcacgtaaggaacgcccgttgggttatttctggtcgtgacagaaaagaattaggtcgaaaggtgattgataaaggataacgaggaacatgatttgtgtcactcgaggaagactcccgatagcaattaaccctacaactgtcaccatgtcatttaagcagaagaattcgcgagtaagcaagatgaccataggtagaagtgattctatgaggacaaggatggaaacttttgtgacatgaccaagaagtcaagaagttaacctgaacagctagaaactaaagctcggttcaaccttgggctgtgtatcagatgctaccagagtaaaagcaattgcactagtatcgttcaacgcactttcctagcgattgatccatctggaaagaacacatcaaggatgaaggtgtaaaggaatatgttgaatgctaaatgacgacaatatgaagagaatagtggaaagtaacccgattgtaaagaaagtgaatccgagatgtctgttcgtgggagctattcccagttatgaaccaagtgatatgttcaaggataatctacagaggtcagattaaaatcacatccaataaagaagcttcagatttggcaggataacgatcagacaataacaagtctagcagtaaagttatttgggaagacgtcaaagcatgtcaagtgggataagttggttctcgtgggaagcataattcaaagttagagtgatcgaccctcgcattgaatagcgttagtatctagcacccggagactaggaaagctaatatgaggcagttagtggcaagttgtcaatcatggtatccttggtaagcgggatatcatagtctaaagcatttggtggtaagttggaaggaaacgccaagcatggtattctcatgatgacaagctggtaatgacaagcatggtatcccagtaatgacaagttggtatcgacgcataacgtgaagttggtaacttgtatgagattgacaccaagggtatgaattatgagaagtcccggaactgaagccccgtcttcaagtgccgcatcccagtcgaagtcagctcaaggtgcaaccagggacaagccaggtgaaacgaagattccatctgcaacaggagatcaagccaagcagttcagagtggggaagttttgctgggcaagtttgttaaagaaaacgcaatggaagaagtcggaccagaagagaagaccgcccaacctatcttcttgctagccttctcgaatctcgggggcgagattcctgtaagggggtggatttgtcacgtcctgataaattcatcccgaaataaaaatcattttctaaaaggaataatataattaattaaaattcgaatagaaattggcaaacattaaaatgcgtacaagaaaaattcgaatgtggcccggagaatttttgttaaattccccttggtctaaaatgatccctcaaattttacttgaatttccagagcaccggatataattattacgcaacaacaacaattaagaaagtttattaaaaaggaaactaaaaataatcctccttttcctttgggccaagtccagcccaaagttcctttcctctctccctcggcccgcggccgaagtatcacttccctccctctctttttcctcccctctctctccctggcctcccctcctcctcccgggccacctcttccctcctcttccgcttgggccgcccctgccctatcccggcctagccgaccagccgcctccctcctttccctcgcgcccctctgcacgcgcggcgcatgtgcgcgcctcacgcctgaccggtgggtccacccaccctgtcgtcttcaacctccagccggccgctcctctctatcactctcccgaaccctagcgccaccatccttcgatcccgctccactgcgcaagttccggccaaataaattgcaaaaacggaatccccatcc

SEQ ID NO: 73990 - DNA, 3997 bp, Oryza sativa
tatcagttcacccagttaattaatttcaagtttctgtaaaaaaaaactgtatggttaaacttgtaaattcagctgctatacttttaatagatctcctcttagttgtactctctcttaataattcgctggaaacggctggaaactaacctgttcggtctaaaaataacttgcacaaaataaactaatggagtctgttgcgtattcttaaatttttttaaaaaaatcaaatgaggtcaggacaaagtcgatagtgcctggagctaatcgttctgttccaggaatatgtgctcaacttccatatgaaaacgaactaaaatcgagatcgagaggaattgctgttatgcacatctgtccggaaaaacttgtactataatcgtctgagagaacataaacggtttgtcgttgcatgattatagttaattagagtagattcttcagttgatgataataaaaaacgacatggttacctactactacttgataatacttgtcattttggatgagactaatatcaaactttatttttttttaactaattctaaaatatgtcttttttttcacgaatgcgcaaaataattatatgtcaatatatcagaaaaaaaagtgtttatttacacagtgcaatcaaccagaccggcttatgccaagcgaagggagaaaagacaaaataaaaaaaaccaaggaaaaaggaagatactactacgatagtaaacacaactctaatcaacggaaagggggtagagccacactacctgtcacaccccaatctggcaccgccgtacaacggcacctgataggagcgtgtcgtaggaaaaacggcgcgaaccgctccctacgaaaccgcgatctcagtaccagtcccaggacatagcgctggtacccacggtgacaaatatgaatcattacaatccttaaaataaatagaggacttatttaccttaacttaggttgcagctcagacagcccgagaatgcaaccgacgacacggacgaggcaaacaccaacaacaacagcagcagcggaaccaacggtctaacacccaacaccacaggcgacggctgggaaccaggacaaaacccttaatcttcactttacttcatcttcaacttcaggacggaggaactatatatatttatatagagcaagggtgagtactttcgtacttagcaagtcacgggaatttaggtgtttaatgcaagcttggaagagaggcgaggttgttttgcaaatcctttgtttgaaatcattttgaaatcactaagtgatttacttcttgttaagtttgggctgaaaagagacttgcgtctcaaatcgacttaagagatgcttttcaacaactcaattggtaatgtaccgacctcccgggttagatcattacctctcggctcccagagccatttcacttgattaatcggctcccagagcctttctcattttctcggactcccagagtccagctgcccagcagcaccacattccgcttccactcgggaagcctagtctatgatgcccgtagacatcccgaatcacacagattcgtttctgaccactcaggtcatccatctgccacataggctgattctggttacgattcccatcccacaacttttcacaaagcacaggcaaacaaatctacgcaacggaaaccacctcacatccgcccatgaccgtgggcacggctgttcgaacagttagttaacctccgcagaggggtacactttacccacaagatacgaccttattccgaacacccgtcggtgtcggaggttcgcaacaaggcctttcctaagccggcccagggttacctcatgccacatagaaggatcaaatcctcacataaatataggccattttagttttcacaaatcaaactccaaccacctcgatcggtaattcagcaagcttctcttccttgcttaccaggaacccggtttggctccaaccgaccccgccccggcgttccccaactattggcatgcgaggtttccctgaaccgactaattacttagccagggtgtcccattccaccttgtggttgcactttgattatgctcgatgagtttcccacaggaatcggtccttatatgcgaatacaggacagtgccacgcaggcacaacccccgcatcgtgagttttcacaattcattttatgtttaaacacaccgacaccacatgtcgggttttcaaggcttctcaaacccatttcccaagttttcgacaatcaacggtgcatgtgagatatttggtatacgcgctcagagagcacgaataccaaagtaccacaagggtggagcgacaaggaatcatgatagtacagcctacaggaattagtgcgactactgggtaggtccgtcggtttggcacgcaaaccgaggccaagtaagttatgtgtgtgactctaataatgcaagttgtaaacaaaataataatgattttctaattataggagcaattgatcaaagggtgacttgccttgctcaaggtcttcacggagcttcacgaatcttcgagaaaacccgcgatcggcgaaaatccgataaccgcaactatacgcaaacaaacaaaaaccaaaacaaaagaccaagaaaaagaccctatttagactaaataatagtgcgattaaatagatctcaattttatggaaatactggaagttgaacggaatcaatcagagctacggattgagagatatgaattttggaagtttaattggaatttttgggcaaaggaagatatttgtggaacaaggggaaattgatttatgaaatttatagaaataatattctcaagaatattattgtcaatttatagaaataatattctcaagaatattattgacagtcacggacgtgcgggaccaagggaaatgattcatggaattttggaataaggaattgatttatggaaaaggaaatggacgagggatgtatattagactttttcgggcggcaagggcgcggcctaagggttgaaggaggctcggccgagccatttaggccggcgcgggcgcgggaaaggcggtccattagggcgcgcggaagggagagggagcggtccggtggactgagtgcacctcgcgggttccaggtggggcccgcttgtcggtgacatggcccacggtgggatgggcgcacgcgaggtgcggcgctagggtttcgggtgcgagtggcttaggagcggtgcaccgggtggatggatggcggcgggcccacgtgcagccacacggcttgccgtggaccgcgcgcacgggagggaagacggagggagggggcggctgactggcttggcccggtcaaagccgaggtggcgccgacgtggcgcctacgtggcagccacgcgggccggcgggaggaggaagaaggggaggccgagatggacggcggacggcggccaagttcaccggagctcgtcgcgacgattcgagagagagggagtacaccggaacaatgggaaggacgagagggagtgagccaccggatcggatttgccgaaggggattcgatggcgacggatttcgacggtggcggccggcggcgatcaagagggggaatcgcggcggggcgacgataggtcgattcaaggaggagggagcatctccggggcgcggggaactcatttccggcaccggatggggcggaggactgccgaggagggctggcgatggcggcggcctccgggagcgggcggcaacggcggcaagcctatggcgggcggcggcgagacctggggcggtgtccatgcgtgttcgggggggctggccgagctaccacgcgagctagggagggagagggcgagcgaaaagagagaacggagggtggcactaccaagccgggacgggcgcagttgtagcgcccgttccgtcgtggcgcctagcgggaaaatgtaatttctaaaaaccttaattgcgaaaattgtttcttcgcttgcagtcagtctccgtgccattccggatctcaaatccccgacctatcgtcacgttcaaatggggcgcaggaat

SEQ ID NO: 73991 - DNA, 3764 bp, Oryza sativa
ctgtactagacattccaagagtatgtccttgcgcctgttttcttgtggtaatacgtaaggccatatattttgatgagatcaaacgaaaatggccatttagactgcataaagaaaggcgacgtaaataatttatatatactatactgaatttcagattgagattcctagatggttattgtatagtgcttaacctaatgctctgtgtaacacttataattgcctgcatctgctctggggatttagtggcatatgagagaactacgtggttcctgcctgatagactacaggcaggatcttcctaggcctcacaatccacacgcggttgtctgttccgatgagttgtacttgttcttgtgcttgacagacctatgagtctatgagtatcaccaggaataaggccaaacacttgtaagagtaccttgtaaccataattcagcaccatacaaaatgaatcattggattttctgaattttctaatgatttatccacacgatttcatcagttttgcttgtatgtgctttcatatttctattataggcgcatgattcttgctagtggacttgagggcatggaaggatttcgccaaagatggagcttacatggacagcttggagacacaaggtattaaactttgtattggtcatgcgttgtgatcatctatgtcatagttgaaactcgaaagagctcacttgtaatttgtaaatgtggaatttgaatattaagaagctagtgggcctatggtgattaaccatgtttttaactattcgtatgcatttgaataatttattaattcaaatccagatggtggattaaaattgcaatatatacatataaaaaacaaggcttgtcattttttttccttccgtgcagttgagattaaatttacatctgaagtatcattaatgcattatgtttttggtgatgtggaggatctgcttcagatgaaatgaagctgttacaaccctagtctcccatgtgtaggcatgggtgtccttttatgtggttgtctgtgctgagccttgtgaagggttgtttttcaagcactgtgccatccttcatcctttttatttctgggatgtcttccagtcatgatttccccattataagcataaagtactgaacaaattatatacaaaggaattgcattcaaaatttctggtcactccagttgaacttttgaattatttgagttcagaaatgaacttaattcttcatattgcatgccaagctgttttttctctgttattccattttgcatgccaagttgttttttctctgttattctattttgcatgccaatttgtgtttttgctgttccattttacattgtttttttttgcaggaaaaggttggaagcgctgaacagtggaatcgtaaaaagagggagccaaagttctccagtgcaagagacaactcctgcagtcaggaagaggtggttcctttggtaggttagttttcgttttctgatttgcaaaccagtgtagcatatggtatattattggccatgggcatgcactcgttcctttccacagtatgctgtctccaaaccaacaatcgcacctgctaaccagtacaatttgcatttatacataggctccacccccaacttccaactttccatcacatcacatcacatccaaaactttcctacacacataaactcctaacttttttttttccaaactaccaactttccccaaactttcaacttttttcagtaactaaacacagtcatagctgcgagtctaatgtgagatccaggaagtcaaaaccgtggagccattgctcctaatacactcatacatcttgctgtgccttgtgaacttaccatagccaaccaaatgatctgtaatttttccactattgcctggattgttttcgttgtcagtagagtaattactaattagctggtacactcaatccagtacggtattgttgaagtacattgatccagatatccggaatagcctattagatttcttggagcaacatcctgaagcaagatagcaacttgagatctagtgtgttttcatggacaataacacgtgcgtcccaggtcatgctttacgcctcacgatgaagattacaccgtactcgtgtcttcatcagttattccactcaaaaccgcattcctgaagattcgttgaacctttgtggccatgctcacttgggttaggacatattctcggcgtttaagtctagtgtggaaagattgttcaggtacccccccccccccaacccaacccccccccaaaaaaaaaaatggatgtgagtattggaagaatgggagtattggatttacgtttttgcgttagaatcaagatggacaagcagataaacactttatttttcgttagggaggaaaggaaaatataaataactatggaacaggctgataagggtgagttagggagaaaaggaaaatataaataactttggaacaggctgataagggtggatcctgcggttgccataacgtagagaagattgtactcgaaaccaagatcaagaacaagcaaccgcattccgttggccgggatgtcaagcgtggaatcgtttcatgtggagctcgccgcgcgagtgagagagaagttgacttccccagacttgattggcgaaaaagccatgcttaattccaacgacacacgcttggtcagagctcaatatgccaccaatagaccccgcctataaaaaagcgcgcgagcctgttccatcgtatcacaaccactaacgtgcgttcacccccctaacaactatctcacccccctaacaactatctcaccggctcgatcaatctctcaccggagatggtgcccgtccggccgtccgcggcggcgctgctgctcccgccaccgctttcctcgtcgtcgcggtgggcgcccagccgctgagcccggacagccccatcctgagggaccccaacgtgatccccatctacatgacccccggctcgtcgcccaccgtggcgagctgctacaaccagaacaacacggcgtcgggccccgactgcacggtcgagccgcgcgcgtgcccgcgcggctgccgcgacatgtgctacgttcactgccccacctgcaagctcgtctgccgtaagaaaacgcatcaaaaagttcaaaacagaatgcatatcatgcatggtaatagtaggtaggcgcgttacgtttggggtggtttttgatgatcggttttgcatgtcgggttttggactgtgactggtgcatgcagtgtgtgagctgaccggcacggagtgctacgacccgggttcgtcggcggcgacggcaacaagttcctgttccacgggcgcaaggacgccgacttctgcctgctctccgacgccaacctgcacatcaacgcgcacttcatcggcaagcgcaacgcggcggcggcacgggacttcacctgggtgcaggccctcggcatccgcttcggcggccaccgcctctacctcggcgtcaggaggaccgtcaggtgggacgccgccgtcgaccgcctcgtgatcaccttcgacggcgcgcccgtcgagctggacgccgtccccgccgccagctggagcccagcctccgttccggcgctctcggtcttccgcaccggcccggccaacggcgtggtggtgcgcctcgacggccggttccgcatcgtcgccaacgcggtgcccgtcacggaggaggactcgaggatccacggctacggcctcaccgccgacgacagcctcgcccacctcaatgtggcgttcaagttctactccatcagcgccgacgtgcacg

SEQ ID NO: 73992 - DNA, 6601 bp, Oryza sativa
tccggccaaataaattgcaaaaacggaatccccatcccttcctcattatttcccccaactttccccctttaatcccgcccccaatcaccgggatttaatccctcttctttgaccgccattgatgccgccggccacgttctccggcgtcgttcctgtcccctcctgtggtcggcactcccctccattgcctaaaaaacggagccctagtccccctctccttcggttttcccccttcccgagctccctagccacaccgtcgctgacctcctctctctcctacgctgccggccaactccagccgccctgccgccgcgtcagcacgccggccggccgtgccgtcgcctcccccggtgtcgcagtcgcctccccttccccggcatgctctccgtttcccgcggagacctccagaagtgcatccccgccggcaacaatggcgttgccgccactgttccgccttcggccgcctctgtcgcgtctcttgtgcgccggccgacgtcgccaccacctctcccagcaccgaaacgccgtcctcttccccgtccaggccatggcgtcgcccgtatttcgccggaacaccgccgtgccgcgccggcctctccatccgccttgccggaatttccccggtcggcccttcctcctcccatgcgctgtcggccacgccaccaccacctccagcatcgcagcggcgaaccggcgacgtcatcctcggcatcgcctcccctccatccgaaccccaccgctggtgtccgtcatcgtcttcaccgttcatcctcgccggctcgtcgtcccgcggtgccgcctccatcgtcatcatcacagcggcgtgttccgcaccgtcctcgcattcgtgcagctgctgccgactgccctcatcgcctcctcgccggttccggttgtcgtcctcccgtcgttctcggtcgtcgtggcgttcgtccctctgtcaagccgcgttcgttcgtcgcccgtgtttcgtcaagtctgttgcagcctcgtcgttgtcttcgtcctcggctccgcatcgtcaagcccttgagtcagcctcgtcctgccttcgtccaaggatcgccgctgaagtgtcgtccgttcgtctccgtcgttctcgtccgtctccaccgcgccgttcgtcgtcgccgttcccacgcctcgtcgcgtggtggtaaggatccgtcctctcactgccccgtcctcgtcctttcggagtcgccccatgcccgttgtgtgtttgtcgaccccggtacccgtgtaccagtgtcggtagtcgttcgtgggtgcgtgtggtgaccgtgtttgtgtgtccgctcggtagctgtcacgcccagaaattcacaagtaatttctgaactaatttgtgcattaaaaaccctcatccaggaattagccgagatacagaaactgacaatttaatatacagattcatcaaaataactaaagcgataaatacttacataagaggcacttagtcctcaccatgaagaaaattgcagcggaaaataaaatctagagaagcttcagctcccacaggcagctcaactgggatataagccaaaggtcttctccttctggatcatttttcttcaactgaagtttgatgattattgcaaggtgagtacatgcaatactccgcaagccacacaggaattatgcaagtgcacaaggataccaaaggatggcataatatagggtttatttgtgaaagcaacatttagcaaagatttaagagtagtaaaatagtagagtaattaatcatcaatattaatcaacactgaacaacacacccatgctgcacaggcccaaccaaacctgaacaaccaaccctggttgtacagatcaaacctccaaaccaggaattatccattccaaactgggagtcaaattaattatcacattgttatcattaatgagtagtgtggaactaatcacgaaaaatattgttagacccgcccataaccgtgggcatggctattcgaatagttttactctggccagaggtgtaccactatacccacaagacacgattccacacatgttgccatgccccgaagtaccaccacggcactgcaaagggggaaatcgtgacaatacccttcgcacaacacaactcaccacagtgcaccattcctggatcataatcaccccctcaaaaacaagaggcatggactccccagtgacccccacagacttctcgccgcttctcagtctggcaccctgtaatgaaccatgctatacaaaagataaagtcgttgcccacgttggcttgtggttagcacggttaatgtttcacaacagtagctcacgaaccggtccttaattgtcatgagcacgaccttcaaaaccatgtactcacaaccaaccattaatcatattttaattatcaattaattatcataacacgattgaccatcgtgagctaccattaactataaccataagtaatagtgaagcatgatttatcccattaatgagctaatgtttctaagcatgactaagcaactgtcataagcatctagctgaaccaaaccaatatataaggttcaagctaatcaatttattacccataggaaaataaagtcatattcggccataattaattgggaaaggctcactacccgatgacattcgaaaacaatgcataagttaaaataaaacaatagctttaaacaggttcaacatgctcaaagggttgtgtgggatctgtgtgacttgccttgcgaacaagcgtcttcgattcgtcttcaggaacttctccaacgaacgaacgatcctccgaaacaacggaaaactaaatctagaacgcaaaacgagaaaaaacactaataagaccaaatgaacagtacaattaaagttcataaaaaggtagagcttgaatttacatgaattatgagacttgaacgaccttattccgagttcgtatgaattagttatgaattttacaagacttaatataatttagccttatacagaaaaggaattacgatttatttggaaaggaataacagccgctgacgtcagcgatgacatcatcgccggcaacacactggaccacaaggttgcaggcactaggaagctcggccgggctatccgagaacaccaacgcggagaggacgacgagacgccctcaccgaggtcggcacgaccacggacgacgatgggagatggccggcgacgagattgaggcggcggcgtggctgtgtccacggtgactgtggcgtttcggcgaggggaggcagcaaccgaggggcggacggtcttcacctcgctcctgcgatcccgagggtagcgaccgcgagcgaaggcggcgatggacggcgacgagcggcacggctgaaaacgagtcgacggaagattgcctcgggttgacagcgacgacgaagctccgatggtttgcaccggtggcgaaggggtggacaggcttcggcttggcgttgcaatgccgacgacagcctcggggaggtccggctaccacgggagaagcggaaagcttcgccggagatcaaaacatggcgatggttcggccttcacagtgacggcgaattccggcggggttcggcgcaaaagaacgggtggccggggtagctctcacccttgcgaagccgatggaagtggcggcgcaagtcggcgacgaccagagaagcggaagacggcggctggaattggtggcggcggtggagagagaaggtaagcgtggcggcggctctagggctagggaaaaaaatcgggaaaaaggaggaaacggaagaggaggccgaggggctgctatttatagccaaaggaggaggagatcggctcggatacaggaagaatcggcgacggattagttagggttcgccggaaaaatggagctcgaaaccgcgtcgaattcacgcgatatacaacggtattcaaaggggtttcttagggataaggtagaggagatcgaggggactccgtttttacaaccaattttggaaacttgctctgtccggaggtagaagatggtactgtagcgaggggacgtaaaacagacttcttgccgggcttttttttctcggcttgattagaagagggaccaaaactggacttccgctaaataagagaaagaggaagagagggctgctgcgggctaaggaagagagagaggagaggagtgggctgaattcggcccagactgaggaagagaatttaattaactttttataatttaaataattgctgaaatgatgtttcatttattaaaaatacttccaatgctcaaataaatccaagaaaaatcccgaaaatacttgggcacataaagtatttaatgaaattttatctagctcaagtttaagttcaaatttcttatagattttattcccacacttactttgattattaagtaatttctaaaaattcctttttcacaacgatttataatttagcgattttcagggtgtgacagtagccgcgtggtttccacgtgtgcagcccgcgtggtgtccagtggagtccgtttgtcggctactcggctcggttggcacacggggtctgcttccgtcgacccgtggaccgtctctgtatacttggtctaccgtggtccattaggttgacatgcggggtccgcatgtcaacagcgcagccttcctgtattttccaggctagcgcttgcacatgttttataattgcaaaacctaatcataataatccgtaaatctccatataacagcattaaacttcggatgatcatatcttgatcatacgaaccccgaatcgacccgttcaagtctcctaatgtttgttataacctaaagaaccgtgttctttctttttatgtattattattgcttctttatagggttgtagctttgcttgtgtgtttcgcgtagcttctgtcgttccggaggtttcggaagcgtagttcgtggtcgtcgccgaaggttcggaaggccgttctctctgagcaaggcaagtcacatcatccttgagcatattgaatcccagtttttaaaattattttaatttaaattattgcattaccgttttatttaaattaccgcgttatcactgttttatttagcacttcctactaatccttgttacagccttatcattgcaattgttattatcacctcgttcaccctaggaaaacaaaaccccaactggtgggtactctattcatggttccactagtatgaatttaggtagatgcttcgctgattaattaggcaacattaggtggttttataactttagactttgggagttctcatgtcatttagacattatggaatggttggcttgtgatggaattgaacacacacctcccccactattcaaaactcccaaaatggttttaggttgggctcgaggtgcatggttctgctagcagcaccttggccactataaggaccggtcttcgggcctctattgcaaagcactaccatctaaccacatgtctaatgggtaaggcttaactcggtgctcagtctagtcctggcaagagtacacggatggagatggacaaagtcggggctcaatggacatctctagggcaaatgaaggctacacgggctacggcgtggtagtcgagatgtcatggcacagggccagtgttctgctgctaggggctcaatcctgcctacctgtctcgggggttccggccgtagtcggggttgggtcggtgcttttgtcatggctaggataggtaaaggggttaagtcacatcctttatgacgggttccacggccgtggaatacggagtaaagatgtgtcttgtaggtaaagatgtacacctctgatcagagtataatctattgaatagccgcgccctcggatatgggtaagcctagcaatgtacccaagttggtggtttaatttttaaaacttgcttaacaactaaaatgtggaatggttggcatgggttggcttgggacgagttgggacctgggtctggttgccagttcggtctgaatcatcgtaggccttgggttaaggcatgttcgcgtgggttcacggccttgattaataatattgtgtagctctaggatcgtgtttacaaaatagctttgggcaactatgtgacttttaaatgctgtttactgcaaaacctaacccctattattatccccttgtacccccttgcattaatcatgcatctcccggtgtggcttgctgagtactatggttgtactcattcttgctatatctttcccccccttcagtaatagaagctttggagaagaagtcctaggtggagtcctggcttataccccagttgagcacctgtgaagatggagccgtaggcccgcttgtccgctgctgcttatttttgtttgtcaggcctgaagtgcctttgtaataatgtaaatattatcgatataataaagatgtgccttttgtatcctgtttgtgtggtgtaccccggcttttcatgggacggggattaatacacttgcgttttggaaaaggtatttttccgggcgcgatagtcacttctctccccgagcaaaaccctagccgtgcgcgggtgctagcacatctgcgcgtggcgttccgtccatgtacgtgtggataccggtagaggcggcgctggtttgcggtgctgattggcttgggagtacggcgaggagaacgcacgaggaggaga

SEQ ID NO: 73993 - DNA, 685 bp, Oryza sativa
tttttttaaaaaaaagggtcattgtgaccctttatatctgtacaatagtttgattaaataaaatattaatgagttaggggcgtttccagaatataatgctttgtgctcgaaggaatatatgtttggcaacacgctaagcacaacatcacttttttttttgaattacacggaagaagcacatgcttacatatcaccacgcatatacatcagtacatcacatacccgctagagtattccttttaacaaagagatgaaagccctatgataaataatttagaaatttcactaaatttctagtgaaacatactcatcacttatgtcctcccgtgtgcgtaattgtaactgttgggatttaatccccggtgtttacaatcatgtagccatgacttcaccaccacatctctaatacttcccggacaccacctttgtttggagcttgtgctcctgtcctatgccatgcacttaatttggtgttttcgctttgtaggcacgcgtgctaactttgaagattgttcacttgttcctagaatggaaaaggcttgatggaattaccagaaaaaacaagaataattcctcaaatagattagcccaaatagtcaaatataatatattattttagttgtgaagaaatgaagctaaaagtgcagttgccactagtcagtttgtatttttggcaaaaattcat

SEQ ID NO: 73994 - DNA, 846 bp, Oryza sativa
gaaaaagggatttattgcgtcatcaaaggcggttcccccggtaaaccgggttcaaagagacggtctacgaaaccaacggccgagatctaatctaagccgaacggacgggcgagatcgatccggtccaccacgggctatggatgacgtcagcaatgacatcagcgatgatgtcatcgccggcggcggctcgagaccacgggctcgacggcgaacggcagcgaggcggcgcaaacggaggacaccaacgggtagagctcgactcggcgaactcaccagcggcttggatgatggcaaacgacgacggatgacgacgttggcgaggttgaagcggcggcggtcttcgggtcggcggtgacggcggcgctccgaagggaaatggcagcaacggaggggtggacgaggtgctgctcctcctcgcgatcctgatggtagcaacggcgaccgaaggcggcggctgcaatagcagtgcggcgcggctgcaacagcggccggaggttgaagacgactgacaggtggaccccacctgtccgtggctgagagagaggagggagggcgcggcggattgggccagctgagccggacgcaagcaggccgaggagagggagggagaaacttgggccgactttcggcccaaagccaaaaggggacttttaaaacctttttcaatttaaattattcatgaaatgatattccattgattaaaaatacttccttggctcaaatagatcccagaaaaatctaggaactatagaaacaagagaagtatttaacaaaattttatctagcccacttttatgttgagatttaacaaattaaaattagatcttctcttttaggcttttaaga

SEQ ID NO: 73995 - DNA, 1957 bp, Oryza sativa
atctctatccccctcccccctgtgtctctctctccgtccctctctcccccggtaagcccgcgcgccgcgagagcgtgcgcgtgatccgcaccgagccgagcaccattcgcccgcgctgcccgttgcttcccgcgcgcgcaatccgtggtggccgaccgcctggttgccgccgctgtcagcctctgccacgcctgccgcccgagtcgccgctccgctccacactgcccccgccgtcatcgccgtcgtcacaacccggccccgccactccgcgcgctagcctccaagggacggaggcagagctcctcctcctccctctgccgcgtcgccccctctccctcctccttttctcaaagtggcaaggggcaagccccctttccctcctcctttttcccttttctctcccgccggcgtcatcccccccctgtcgccgttttggccgcgaccgccgagcgctagccctctcccttgaccgccctaggtcggttcccaaaccgacatcgccatcctataaagcccaggcgccctccctcccttctcctcttgtttgtcccatcgcctccactccattgtcgccgcctcccgtgctctgttcgccgccgcctttcgttgccacgcgtgccggaggagccggcgcgttcgtggacgcggaaggggactccgggagctcgtcttcttcctcttccccggcccgaggccggagagatcactcccgtgccgtcggcctcttgtcacagcgccccgcctcgtctcggtagtgcatccctccgttctccctcctcgctccatctcttccccttagctttgagtagccgctcgagtagtaccccagtagctagttggcgccgccccagcccgcgccgccgctcgcagtaggctcgccgctgtcgccgcccgagctcggaagcgcctctcgtcgccggcctccctcggtgcgtttcctcctaatccggcgcaagggacggattcccggagtcgcgtagatgctctagctcgcccgaatcgatctcccgtcgcgccgtcgccgtttcccccttccctcgccgccggttgccgccgccgcaatccaccgccgtcgagccccgtccgacgaatccgagccattggcttgtctctcctcgtctcgtgcaaccacccggtgtgctcgctttcgcctgtatcgccgtggttcgctccgtcgctcgccgctgtcgaccgccgtccgttccggccggcgtcgtcgtctacctcccgccggcccgcgtggcagccacgtaggcgccacgtcggcgccagctcagcctagaccgggtcgagccgaccccggtcagtccctccccgtgcgcgcgttccaccgcgagctgtgaggctgcgcgtggacccgccgcacccacgtccaccgcgaaccgcgcgcgtgcatcacgtccatcctccaccctagcgccgcgccgcgtgcttcctccgcacggtgagccgagccgctgacaagcgggtcccacccgggaccgcgcgaggtgagcccggcccaccggctctctctctccttcctccgcgcgcgcgcatcttgggccgctctgggccgccttcttgggccggccggcccgttaagctcggccgagccgctctttctctcgggccgcgccctagccgcccaagaaaagtctgttttctctccctcctttcttttcttttcttttcttttccaaaaaggatttaattaaatccttttcctttagaccaaaaatccaataatcttagaaattcaatatcttcccaaccgtaaatccgattgactccgttcaactcccaaaattcctcaaatcccgagatctatctaatggcacgcttagaggtcatcaatagggctttattttcgccgtttgttgagttgtcccgtttgcgtgtagtttcggagcccgaagacccgcagtgcgaggatttcgaggatcaagctccagatctcgagcaaggcaagccacct

SEQ ID NO: 73996 - DNA, 5694 bp, Oryza sativa
cccaagaaggaaggggggggaaaagaagacttttagggtttttctttttataaacctttttaactttgtttatttcttcccaattattatttgtgctctgaaaattccactaaaatttatttacgcattttaggcttttaggaaatatacaaaaatcctccaagccttatttgacttttaaatttgcacattttaattgttggaggctttcacatgaattttaattattctcggcacaatttcgaggatgtattttagggtcgttttgggacgtgacaaacctaccccccttaaacggaatctcgaccccgagattcgaaagaactgtcgaaaagaccgggatgggctgccttcagctcgtcttcacgctcccaggtagcttcttattcggcatggttgctccactggaccttgcaaaaacggattacccggttcctggtcctgcgctccatggtgtccaggattttcactggcctctccacgtaggtcaaatcttcgcgaacttcaatttgctctgagtcggcctgctcggatggcactcgaagacatttcttgagttgtgacacatgaaacacatcatgcacgttgcccaaggaggcgggcagctccaactggtaagcgacttctccgcgtcgggcaatgatacggaaaggacccacataccgaggtgcgagcttcccttttgtctgaaacctgtgtacacctcgcaatggcgtgacccgaagatatacaaaatcgtccactgcgaattccaggtcacggcgacggttatctgcataacttttctgccgggactgtgccacctttagattatcccgaatggttctgactttaccttcagcttctctcaggatatcagtcccgaacacttggcttttccccaacttgatcccacattagcggtgtccggcatttgcgcccatacaacgcttcgtaaggtgccatttgtatgctggtttgatagctgttgttgtaggagaactcggcataggggagactcttatcccaggtcttcccgaaatctaatacaatgcgcggagcatatcttctaggatctgatttagacgctcggtctgtccatctgtctgcgggtgataggcggtgctgaaattcaatcgagtacccagctcttcttggagcttcttccaaaagtgagaggtgaattggcttcccctatcagatatgattttcttgggaacgccatggagactcacgatcctagcgaagtagagctcggctagcttgttccctccataggtggtcttcacaggaataaatcgagctaccttggttaatcgatccacaactacccatatagaatcatatccaccttgggtttttggaagtccggtgatgaaatccatcccaatttcatcccatttccattctggtacttggagaggttggagaagtccggccggtcgttggtgctctgccttgacacgctggcacacatcacaaagggccacgaactctgcaatttcccgcttcatactgacccaccagtatttctccttcaagtctaagtacatcttcgtactgccagggtggatggaataaggactttcgtgagcttcctgaagtatcagctgtttaagttctcggttatctggaacgcatacccgatttccgttccatagggttccgtgttcatcctctgtgaaaccagcggctttaccctgtttcatattcttgaggagtccatgcatgtccgggtcgttcttctgagccttgcggatttgatcgagcaaggtgggcttggcttccaacgcagtcaagaatccacgactaactatgcttaggttcagggcttccatctgttgattaagttcgagtggaatgccacggacgttaagagtgttgcagtggcttttccgacttagagcgtcggcaaccacgttggccttaccaggatgatagtgaatccccacatcataatccttgatgagttctaaccatctcctttgccgaagattcaggtccgactgagtgaagatgtatttcaaactcttatgatcagtatatatttcacagcgattcccaatgagatagtgccgccagatttttagagcatgaaccactgcggctaactccaagtcatgggtagggtagctgccttcatgaggccgtagctgacgtgaggcataggccaccacatgaccgtcctgcatgagcacgcaccccaatccttggcgcgaagcgtcacaatacaccatgaagtccttgcgagtatccggcaagattaacactggcgaggaaaccagcttttctttgagagtttgaaacgccttctcgcattgtgggctccacacaaatttctcttctttcttcaataactgggtcatgggtcgagcgattttggagaagttctcgataaacctccggtagtatcctgccaaacctaagaaactgcggacttgagtaactgtcttgggttgcttccaatcggggacggcggtcactgttttagggtccacagcaactcctttagcagaaatcacgtgccctaagaatttgacttcggacaaccagaactcacacttgctaagtttggcatacaattgatgttcccgcaactttcccaataccagacggagatggtgctgatggtcttcctctgattgtgagtatattagaatgtcatcaatgaaaaccacaacaaacttatccaagtattccatgaacactttgttcattaagttcatgaagaaggcaggtgcattggtcaaaccgaacgacatcaccgtgaattcatacaatccgtatcgcgtggtgaatgcggtcttaggaatatcttcttcacggatacgtaattggtgatatccggaacgaagatcgatcttggagaatacagtggcacctttaagctgatcgaacagatcatcgatccggggaagagggtacttgtttttgatggtgacttcattgagagctctgtagtcaacgcatatcctcttcgtcttgtctttcttctctacaaaaatcacaggagcgccccatggggaagtactcggacgtatgtaccccttttctttcaactcttccaactgtttcttgacttcggccagttcatttgctgccatacggtagggtcgcttgtacagaggagtggttcctggagcaagatctatccggaactcaatctctcgcttaggcggcataccgggtagctcttccggaaacacgtctccgaactctctgactatggggatttcggatagtcctatctgatgaagttctgaacttctgacagaggttgggggtgcaaagaaaacaaccggttgttccggcccttggtacagagtgacagtgcgtctcgcgcaatccactactccttggaattgagccaaccaattcattccaaggatcacatccaagttcttggtgtctagcagaatcagatccgagggaaagggaatcccttgaatttctatagggacggcagggctataatactttgctgtcataacccctccaggggtggtgatgagtagagggtttctaagcctttctactcccaactgatttctccccacgaatagcacagatataaacgagtgggaggctccagagtcgaacaaaatggtagcagggatggaatgaatgaggaacgtaccaacgatgacgtctggagttgtcagcacgtcctcggccatcacgtggttcacacgaccccgaatgacatccttcccaccgttgttggggcggggaggcgcttggccttgctgacgccttggcttcgggcatttatccgcaaagtgcccgggctcgaagcagttgaagcacagacgctgctgaccttgagcgtccctgcggccttgaccaggctgcacagtttgcgtaggaggacggggcgcacgagtcccttgttgattctgctgttgctgcggctgtgggacgcgcaccacgaattgaggtcgaggcgcggagcgaggttgctgctgctgctgttgctgctgcgaggaggatccccctggatagggattggtgtagcggaccctttggttagcaccctgttggttgcggaaattcgccaagcggcgcttgtgcgactccagttccttgtgcttggcttccaagcggatgctcttgtccaccagacgttggaaatccggataatccccagagactagacggacggacagctcggggtccattcctgccaggaacttctcttgcttctcctcatcttcccgcacatcctccggagcgtaacgggccaggttgttgaactcatgcaaatactccatcacggagcggttgccttgcttcaactctcggaattcccttttcttaagggccacgactccagcgggcacatgggtcctccgaaaagcggcggtgaagcgagcccaagtaataggctgtccctctggctgcgtagcctggaaatggtcccaccatagagatgcgggtccctgcagctgatgggcggcgaagatgactttctcctcatcgctgcactgcacagtgtctagctttttccccacggcatgcaaccaatccaacgcatccacggggttgttggagctagagaaggtaggtgggcggatgcggaggaactcggcgagtttagagtgttggggaggtggtggtggggcattctgttgtggcggattttggaggtggtggaggaaagcagtcatcatgttggcctgctgggcgaggatttgggtgagaatggcgttggtgtctggtggtggtggtggaggaggaggagaaggtgaaggtgggttgccttggtggttgtggttgctgccttcgggttggttgccatcaccggtaaccgcatttctcctggtcgtcaccatctgaaaaccccacacggaaccagcaaacagagaaagagctaacaattaaaactaaccacccacgactaccataatttttgaatttattactgctattaaattggttcattaatgttcaagttgcttaggcgaataaaataagacaggctccgacacagttatgccacacaccggcataaccatgccccacacgactcaaaaagacaaacgagaaagaacacacgcgcaagcctactaactgctcgtctactgctgcgacgggccaggacggaaggtgagcaacagcgcatcctccgtgctaccgacgccggaggcttccccctcctggggaaccacgggcgcgggctcggcacgaggggtctcgatgaagcaagtccacgccagggactgacgaacaagctcgggcctggaggtgctcttgcgggcggtgatcttctggctgcggcagacgcggcgacgcttggggcgacagacctttccctgggcgatcttgagctgatgcagctgcgcctccaccgcgtctaggtccttcttgagctgcaggttctcctggcgcagttccaggatcttcatgttgttctcgaccatcccgcgacgtaccatctggtggaagtcgatacgagccgcgttgtacgcctccaccatccgcgccaggtgcacgatggtagcgtcatcctctgagctagcatcccggaaggtggcgtagtcgcgggctcctccgcgacgagggtggtagcggtagggcgagtgttgcaactcgtacgggtagcgctggtgaagagtgcccatggcgaggagagcggggttctggcaagcggtggggaaggaatttccacccgcggtgactgccagtgaagtccgattgggagagccagagaggatc

SEQ ID NO: 73997 - DNA, 3468 bp, Oryza sativa
gtagctgatgggatcagctaggcccgggtggccgtttgaaaagttgttggcccgggtggccgttgaaaagctgttggccgggtgccaaccttgtttcaattctaaagactgatacattgcacatactccgaccggacgagacgcactgtctcatccgtgtcgtttgagaagcactcacttagttgtttcagaaaagagttcgaataaaatcaattgcaaaaacaccagcctttctttgaagcctgcattaaacacttatttcccctggcttgctgagtactcccgtactcacccttgctctatataaataatctccccccccccctcagttgctgaagaagatgaagcggatcccgctgatgaggagttcttccaggagcaagccggcttcgatgagttttagggtttcggcctagttcccaagtcgcgcctgtgatgtttggtccaagtcctggcttccgtttcccttttgtaatgcagttgtgagctcgggatctgtccgcagcccaacatgactgtacttctactctataataaagagacctctgttgttgtgatattctgtctccctatgataccagcactgtttcctgggactggtatcgattaacaggttaatttggagcgtcacgggctagttccggtcggtactagttcggggcgtgacacagtactaactcctttgtcagaaatgatatgtcctaagtattccagttgagtgcaagcaaaagagcatttagacctcttagcaaataactggtgttgcctcaaaatagcaaaaacttgctgaagatgatgcaaatgactatcaaggtcagggctataaactaagatatcatccataaacaccaacacaaacttcctgataaatggtgcaaagactgagttcataaggcactgaaaggtggagggtgcattcgtgagaccaaatggcataaccctaaactgaaattgcccatgatgtgtcttaaaggttgtcttggcttcatcagtttccaccattcgaatttgatgatacccagctttcaagtccagtttagagaagaatttagtgcctgagagctcatccaataattcatcaacaaccggcataggaaacttacttttaatggtgagagcatttaatcttctgtaatccacacaaaaacgccaactaccatcctttttcttgacaagtaaaacaggtgatgcatagggactcatactaggtgtaattaaaccagcatcaatcatttctttcacctgtttctcaatctcgtctttttgtaacggagaatagcgataaggtctgtagttgacaggagtagcatcaggtactagagaaatagcatgatcaaaaaccctatgtgggggaagacacttaggatcgtgaaagacatcgtcaaagtcagttaacaattgttgcaccgaagaaggaatcacatgctggacatcatcctgggaatgttccaacaaagcagcagcccatatttcacaacccttatgccatttcaaaagttgtggcagagtgacagcagcaatttcagaagggactgcagcatcttgtactccttgaagagaaatccaagacccttgatactgaaacttgagtgttttattagcccaatgacaagacatttccccccattgctcaagccagtccatacccaagatggcatcgtgaccccccaaagtgaccaccctcatgtcataagtaaatgtgtgcccctgaatccaccaaaaaaaaccaggaaccacatactgacaaggtaagcaatcaccattagcaactttcaccagagtagaaggaattggttttagaggtaaacccagcatctgtgcaaagttgtaatcaataaagttgtgagagctgccagaatccaccaaaagtaacaagactttactatgaaccaatgctctcaaacgaatagcagtaagaaggtaagctcctgtcaatgcattcagagaaatatgacagtcctcctcatcatcagattgttctgcagcaataacaacatccaatatgtcatcagtgagcacctcttccaactgcatagctttgatttggcctccaacagcacaacgatgttcaggagtatatttgtcaccacacttaaaacaaagaccctgagcacgtcgatagtctttcaactgcttagccttccatagatcccctttatctactcgacctggagtagtatcagaactgacatcactcttgtactgaggaagtttcacaaatttccctttgagagctttggtagctctactagccaagacagattcctacataagagcaatagcagatgcttgctgtacagtgtcaggcaattgaacaacaacagcagctcgaatttcttcagtaagaccattcataaaacgagtcactaacattttaccccccacagatggatcaaacactctgatctgatagacaagagaatcaaattgttgtttatactcagtcactgtactagtttgagtcagagtatctagtgcagacattttcttacgttccacaacaccctcaaattctgttgcgactgccattctaaattgatcccaagagttaacctcattcactaacttataagaatgataccattgagccgcatttcccgacatatgcaacacagcagcagagactttgaaattttgagtgatttggtacatgtcaaaataagtctcacacatatccaaccaaatccgcatatcagaaccatcgaaacgaggaaaatccattttaggaagtggctgatgacgccaataaatcccatcaccaaaaccacgacccaaatcaaccccatccaacataggaggaacaggtggattcaacggcggaggagtcgcagaaccacttgtactaacctgcgagatcccggaaggcgaacccaaaatcccggcctgatcagagcagctggccacccgcttcatcgaacgggccaactcagcacactcttgctgcaccttgccgacggaatccatggcgagatccaccttggtagtcaccttctcaagactgccaccttgggaatccagccgctgatcaatctcgtgcatccactttgtgatgccttccaacttctccaagagtttggactccatggagtccatagcttgcttcaaaggggctgaaagttttgcgggcgccgtggcgaatcaggaagaatccaacgcacggcgacacccacaacctgtctctgataccactgtaacactacgccaccgcgaaactcgccgccgacgagagagagagatatttagacgagatcggagttggggacgaagagaaacagagctgaggcagaggagagacagagtttggagagagatagatttgatttctttttgccaggttggccacagccattctctctctcgagtatttatctcctgattacatggaccgtttgcccaaacgatttaaagcacgcaggccgcattctatttgataaagtctagcccaaaacacacacactatcattcaca

SEQ ID NO: 73998 - DNA, 1319 bp, Oryza sativa
attcagaccgaactggcaacccgaccctgggtcccagctcgtcccaagccaacccaggccaaccattccacattttagttgttgagcaaattttaagaattaaaacactgacttgggtacattgctcagcttgcccataaccgagggcgcggctattcgaatagattatactctgatcagaggtgtacatctttacccacaagacacatctttctcacgtgtaaccacgtgccacataccaccacggtatacggacggaagacgtgacatagttcccaacccatcctagccataaacaagagtaccgacccaatcccacctacggccggaacccccgggacaggcaggcaggactgagccccctagcagcaggacaccaaccctgtgccatgacatctcgactaccgggccgcagctcgtgtagccttcatttgccctggagaatgtccatcgacccccgacttcatccatctccaatccgtgtacttttgtttatgactagactaagccacaaactaagccttacccactagacatgtggaagtacggtagtgctttgcaacagaggcccgaagaccggtccttatatggccgaggtgctaccatcaaaaccatgcaccccgagcccagcctaaaaccatttttggggattttgaatagagggggaggtgtgaatccaattccacaatagaccaacaattccaaagtgtccaggtgatgagaatatcccaaagtcttgagttgtaaaaccacctaatgttacctaattaaaagcgaagcatctacctaaaatcatactagtggtaccatgagtagagtgtccactagttggggttttgtttattctagggtgaacaaggtaataataacaataacaataataatatggtcataacaaaggtaaataggcatggctaaataaaacagtgataacgcggggatttaaataaagcgataatgcaataatttaaatcaacataattttataaactgggattcaatatgctcaaagatgatgtgacttgccttgctcgctttcccaaacgtcggcttcaacttccacgaagagtggatcttccgaagctgtagcgtctacacgaccaacggaaaagaaaaggcttttactctaataaactccacataacagcagaaacaaagcacaaaaatgggttcttgacttcttaaggaaaagttagagacttgaacggtccaattccgagttcaaatggccaagttatggccatttgaagtttatatgctctttaaatggatatttgcgaattgcttcatttaaattttaattaaaaactcatttattg

SEQ ID NO: 73999 - DNA, 6460 bp, Oryza sativa
gccccctttttctgcatctgaagtttggacgcaactcgggatcggcgcccgatgggattcagcttgggtgactttgtgttggcatgtcacaacgtgacattgtgaggatctctgccatcaaaaacacatccaacggctcgtttggttgggcccgcctgcaggtcggaaatttagccgccgatccatccgtcccgcgggagatggcgcccgccgatccaacccatcccgtttcgcctcgcccgagtccagccgtcgccatcgccgtgagccagctgggaggcttgctgtcaccgcgcgaggccgtcgggctcgccgcgagtggggaggggaccgggcggccgccgcgcaaggccggggtcggggccctgccctgctgccacgaccgaggagagaagccaagccgccgcgcgaggccaactccatgccctgtcggcctgtcctgccgtgacctgtggagaggcgccagggcgtcgaggccctaccctgccgccgcgaccgggggaccgggaaagctaccaacagtacgatagaacatttttctctgaaactcagtcagtcaacacaagggagatagctatatccaattcactcacaaatgcagtgaaatcattgcatttccctccatttgaatggcacaaccatacatctcctttgaagtcatatatatcaagcatcagcgcgcgaacaccattctgcaaaaaaaaaaagaagctatttctatgagaatcaattgtggctagatgtatcgtcagacatgtagaacaatggctagaacagatgatgcatatagcaggtgcgacatttaattgatcagtgactgtatcctcttggttgtcaaaggtgatgcgtggaactccagtgtgcgatggctccccaacaattgcaaatgaattgtgtgtcgtgagataggcatactagttgaatggcagcgagttgttttgaagaacaaatcaaaagcaaactccagtcaggatgcagcaaacagaagctgtttgatgtccataggctgatgcttgtgcaggtagccggcaggggcagcgcggcctccaggacgtcccctcctccacgcgccgagctgcagattacagaagaaaaatgaggccggttcaccacggctgcagatcaccacgactgcctggactggctcggcggcctccaaccgcaaccaccaccgcacgagggcaggcctggtggccgaccgctgctcgcgccggcagggccaccgcggcgatctcgacgctcgcgcgcggcggccccaccggagtcccgcggcgacaacccccttccgagcggtggcaccggcccccttccaagtggcggcggtggtggttctgggggattcgcgagcagcgtgctccggcaggaaacggagcaatgcggggtgaaagctgaggcctgcaggtgggccagcgcagtggacccttggatttattttcaacggcccagatcgctgcaatgtcacaccgtgccataccatggcaatgtcacagaatctgagtcccgcccgatgggagggggaaaatcggaagctgacatcagtataacacatgcgcgcaaaatcactttaaactattttttctcttaaattatttatccaagtcattgaaaaccgcatgtcgtaatattgagtcgatggttatgcagttgttcgctaactttggatggagattcataaataggattcaataatttttgtgatctttttatgctgtgagttttcattaatctgtatgcttttgtttattcaggtgtgagtttttattgagttggagtaataattggctatagctttttgagcaaaggcaaggattatattccattatctaaaaaattagatctatacatagtaaaacattatgagtacactaacatttttttttaaaaaaaatgaaacgaatttccttaacagaggatttccaaaatacgcgggcaatttgttgcaacggagtatgtggtggggccacgtggctggtgggggcaggaacatgtggtgggcccacagagcacgtgcgcgtatcgtgggggggagagcgaccgatttttcccctcctcgagcgacgatcagcagcaattctgctgaagttctaaacgtatgagaaacttttggtgacagctcaaacaacgttggctagatgtaagttagtaaaatttattgttagaacttttgatttttttaatcctaatttgtttttagcttggcttttaaattttaagattgttttacctggaatagctctaatttacaccacctttagaataggacatgactatatagcgcacgatcgctggtttgattaaggccctgtttagatctcaccctaaaattttttgacctgtcaaatataatgtttgaacacctgtatgaaatattaaatgattatacactgtaattataattgttaaatttttagaaaaaaaattgtcgacagatatgtagccaaaagtgaactggcaataccaacgccgaacgcatacgcaacggcgtcatagcacgagtagcaccttttctcatggccctatgtatcgtggagtctgtgtgatatttgttgtaagtattgggaagtggaggaccagactttgcctaagctgtgcgtcgtcaagtttcaaccaggtcaggtgtgtgcctctcgctgtagtagtctctaccattcccagcgcatgaaaccgaccgtaatgaagaaagcccacgacgcaccccaactacccaagtgacactcgtcactcgtgccgtcggtcatgtgcatgcaccacgcacgcatggaatccacggcaacagcggcgacgcacgcccaccacctctagactctagtagttgtagtacaccccaatgccacatgcaaaagcgaggggttgtttggttggcatactcacattactaaaacgtgccatactttatttagctaaagctgtttggatgctatattaagtttgccaccattcaccatactttttatgctacacttgtctaagttgtgacttacaaaaagtgagccacaccttagctagcaaaattgaattatgccacactttattgagttgatgatatgtgggacccaaatagataagaagtaatactgccacaagtgtggctataaaccaaacaatatactaacttggtcaaacttatctaacataagttgtgataacctttggcaaactttgggagcaaaccaaacaacccctaacatgcctaacatgtggctaacaaaattgaagccacacttcaactataggagagcaaacttgccacacttttatgtgtcaatgatatgtgggacccacgtcatggtgaagaaatcttatcataagtgtggcacgaaccaaacgaatgcctaacttaattaaacctggctaatttgagttgtgtcacagtgaagcaaattgtggcattgagcctcacagcccctcaattctgctgcgggtcgcgactttgcgaattgcgagtagttggcgcacgtactactcctactacacgtccactgcgtgtgtctgcgttcccggacaaaattgccagccagtgcacaagtgcaggcgtgcggccacttcccaaagaaacccaagtagtggaatttccggaaattaaaacagcataaagtgctcctaccactcctactagtagtactactacttctacccaacaatcattccaaccagtctccaaacaaaaataaaactattgcaaccagcctccaaaaaaaaaaaaaaaccttaccccaaccgccaactcacgggctttggcccctggcacggcagccttaacaccctgtttaattccatctccatgcctcatacctacccactaggctagcacccacgacacacataaaccgagcaacctgtgagcagatggccccatttgtcactggcaaatcgtggaggcgacaccggtgtgaaacaacaagccgcacgaccccccagaaatctcctcctttgcctcggcccctcccacggcgagagagcgtccacccgacgctcagcaactggagcaagcacgggcaacgagtcgcagtaaaacagcagtgcggactcggagacagtacggggaaaacgcacatcgagcggtggagagtggagtggagtcgaatgcagcgcgagtgagtccaaaacgactcgtctcgtaacaccgaagcgaccgagagcgcctactgccgcctactgcgcctgcgctgccgccgcgcaagcccaagcgcaacgcatccgcctctgcctcatcctctcctccacttgctggtcgctgccattgcctgcgcctccactccacttctcgcggctcgagaggctgacggcggggcgcctcgaatttcgccctctccgacgagcggaggcggaggagggagcccaggaagaggatgcgaaagcagtgaagtttgtagaattttcagttgcattttgctgtttctgcttgggagttgctttggggcgataagaattctcttgttgatttgttcctcgcaggagaggaggagaagaggggggaacggaaatctcagctgctgcgtcagtctcgcagatctgctccgttgagctgctgtttcacggaatcaccatgggtggaaatcatcgccatgggtggtaggattggttgggtgtcgccgatcttctcgcttcacgccaactaatcgagtgaattgtgggaagaagaagaagaagaagaagccgagtagacgacggcaatggcgtcgtgggagaacctcggggatgtggcgaccgtcgtgcagctgacggggctcgacgcggtgcggctcatctccatgatcgtgaaggcggcgtcgacggcgcggctgcacaagcgcaactgccgccggttcgcgcagcatctgaagctcatcggcggcctgctggagcagctgcgggtgtcggagctcaagaagtacccggagacgcgggagccgctggagcagctcgaggacgcgctccgccgcgcctacctgctcgtccactcctgccaggaccgctcctacctctacctcctcgccatgggctggaacatcgtgtaccagttccgcaaggcgcagaacgagatcgacaactacctccgcctcgtcccgctcatcaccctcgtcgacaacgcccgcgtcagggtcggtaaaaccatatccctttcagcttctctcatcagtgttcatttgtttaatcgtgtagttgagtgttagactagtagcctgggcatgtaggcttttaagaaatgttggttgcatcattctttgattctaaagtatggtatatggaatgtttgcttttgaaattggatggaaaatgatttgtcttggattcttggtggttttcctgtatggtctcatgggttctttgttttctgttggttggtgtgacccaaaggattctattttagaatctatcttctgaatataaccgacgctgcaaccttttggtgctccatcattttcatcgtctatataatctgatttttttgttggtgtgaatgtgacccaaaggattgtgaaggtatatgtatatgctaggaaactgattttttttttagctccagcacagtgagctcaatcactaatcatgccacttgggactagtgatctgcatcggatatcatgtttatttactcctatacttgtcatctttgcttcacaatccttttttttcaggagcggatggaatacattgaaagggatcaatgtgaatattcttttgatgatgaagacaaggaggttcaagatgctctgttaaaccctgatccaagtacaaatcctacggtagtgctcaagaagactctgtcatgctcttatccaaacttgccatttaacgaagcgcttcgaaaggaaagtgagaagctccaagtagaacttcaaagatcacaaagcaacatggatatgggccaatgtgaggttattcaacacctcctaggagtgactaaaactgtggcaagttcgattccagagaaatgtgccactcctaaggtttctgaaaaagctgactctaatcacacaaaagtcagtgaagatagtgcaaaaacatatcatgatgactctccaaagaagcaaaaggatgcctgcactgcaccacggttagtaagtttaactagtttctttcggtgactatcttcttatgatgtgggttgcagtggtaaaaaaggcagtgtataaaaccttttctcattaagtaacattaacctgaacaattactatggccatttctgggtaaatcatgaaaaatgtgcgcattcttccttattttagaggtgtaagtcttgtatactcaactgtgtgatccaacaaaagagaacttcactatgttctgttctagacttgaaatagaaattttgttatgtgcttatgcccctcaaaatgcgtatgcacattataaaaattttgatagttcctatggtgcatatctttctcagaagttctccgccatcttcttatggccatgatctggtctcaagcagaggatcatacagcgacgagtggcatgcagatttgcttggttg

SEQ ID NO: 74000 - DNA, 2109 bp, Oryza sativa
aaggaagggggggaaaagaagactttagggtttttctttttataaacctttttaactttgtttatttcttctcaataattatttgtgctctgaaaattccactaaaatttatttacgcattttaggcttttaggaaatatacaaaaatcttccaagccttatttgacttttaaatttgcacattttaattgttggaggctttcacatgaattttaattattctcggcacaatttcgaggatgtattttagggtcgttttgggacgtgacaggttgcttccaatttagcactgactcgacattgcttggatccacagcaactcctccagctgagatgacatgaccaaggaacttcacttcgggcaaccaaaattcacaattactaaacttggcatagagctgatgctcacgtagtttctctaaagcaagacgaagatgctcttcatgcttttcttttgtcttggagtagatatggatgtcatcaataaacaccatgacaaacttatccagatattccataaacactttattcatcaagttcatgaaaaaggacggggcattagtgagtccgaacgacataacggtacactcgaacaaaccatactgtgtggtaaaagcggtcttaggtatatcctcctcacggatttgaagttggtgatatccggaacgaagatctatcttggagaaaactgtagcaccggaatcaaaaagcacagttgcgggtatagagttaacaggaaacgtacccaaaaccacatcaggtgcattctgggcttctgcagctacaacatgattaacacgagccttcggtgctggagcattggagtcattctggacaggagcattcttcacacgtcgaggatttggacacttatcagcataatgtcctggatcaccacaattgatgcacacccctggcttgcttccttgttccttcctgacagactgattctgtgttggagctgctacaggacgagtgaccacattacgattgttgttgctgcgattaccagtgttgttgttgtagaactggcgttgagggcgaacaactgaagaggatcctccctgtgggtatggtgcagcttgaggtcccataccaatgtgcggcctctggctactaccctgttgagccttgaattgagcagccctacgcttcttctgttccatcctattgtacttgtcttcttggcgactcgccttgtccaccaactgctggaaatcccggtactccatagccatcaatgcataagacaactcatcattcaatccctctaaaaacttctcctgacgctcttcatcagtgcgaacatcttctggggcataacgagctaagcgattaaagtcatgaaggtactctgtgacagaacgggatccccgattgaatgctctgaactctctcttcttaagtgccacaacacctgatggtatgtgtgtcttcttgaaagcagcagtaaactcccgccaagtgataggctctcccgcggctctgtttagacgaaagtgatcccaccactcagcaacaggaccatgcaactgatgcgaagcaaaggaaaccttctcctgctcggtgcactgaatcaaatctaacttcttttccacagcatgcagccaatcacctgcctctactgggttagtggtgcttgagaaggtaggtggtctcacacgtagaaaatctgccaacttgttttgtggaggtggtggttgattgttgttatttgcctgctggttctgcgcttgctgcactaatagattaatcaactaagtttgttgagccaagacttgggcaagtgtgggatctccttcattgtgaccacttccacttccacttccagtgcgggtgttcaccatctgaagaaaagcatgggcaaaaggaaagaacgacagagagataccattagaacggagaactttaattaatttcaattctatattgctcttaactgtgtatgattacatttaaattgaattaacactatctcaccagctaacttactctctgacaagcaaaagaagtaaactcatgtagttacataccaccaatgatgtaagcaacacgctaaacccacacacacacaagcaaacttaagcaagcaaactaacacagggaact

SEQ ID NO: 74001 - DNA, 5885 bp, Oryza sativa
ttcttgtcacatcataaaagatatattgacatgacaccctatttagtgagaatggaactcttattaggaatggtctaacggtgattggtgaatcttctattaggctagacatgcaatcttctaaaatactcactctgtttattaataattggcacgatacactattctctttcaaacactcatctttctaaaaaatatttataaacactaaaaaccatgtcatgtattaaagtgggttatgctttaaatataagtataaaacttttgttcactccggtctaccctctccatcttaaaataactcaacctaatatatggtgagatccatcctagtgtacaatgaatctcaacaaaagcttattcggatttcttgtattagaatggattacagcatattctaggctaagttattttaggatggagggagtaacaatttaagagtaatcaatggtcaaagctttaactgaaatattaaaattgtaaccccgattaacaaattgtattaagatggatcacatcacattctaggttaaattattttaagatgaagggagtaacaatttaagagtaactaatggtcaaagcttcaaccgaaaaattaaaattgtaacccttattaacaaataatcctttctaccacctataaaagatatcctttcaaccaccgagagaattaaatgatgcttcaggagaggataactttgcaatgacaacgttgattttatcatgattccagaaactagtcgaagcagacatatctcatcatatccatgtaatgatcaataatacttctccccgtcccaaaatacttcctattctaaatagtttagcataaattaagatttaagaaaaaaactataatgtctcttatttaataatgtacggttagaagtgaaataataattgaggggtataatcagaagaaatttgaactgacaacaagtattttaggacaaaatgtgaatttagtaaagacaactatttcgaaagcaatgtagtataaagttaagagtacatcattcatgttatcattatttagtaattactccattactccctctgtttcatattataagtagttcgactattttcctagtaaaagttatttagattcgaccaagtttatagaaaaaattaaaaaaaatctacaatataaatatattttgatgatatgtttgttttatgttgaaaatattactatattttctaccaacttgtttcagacttaaagaattttgacgaggacaaaaatcaaacgacttataatattaaacggagagaatactccctccgtaaaaaaaaacccaacctaggacagatgcgacattttatagtacaatgcagggtgtatttagttcacgccaaaaatagaagttttattgaaattgaaacgatgcgactgaaaagttagaagtttgtatgtgtatgaaagttttgatgtgatggaaaaattggaagtttgaagaaaaagttgggaactaaactcggccgcatattcattgtactataaaacatcacatctcatctaggttagtttttatgggatcgagggagtaagcaataaggtccgtatccttttcaatttaagacctactaccataagacgtactctcttcgttccataaaaaaccgatatagtactagatgttaacacattgtagtactacgaatatggatatgcctatatctagtactaggttaagttttttgaaacggagaaagtatatgttaagggcccctttgaatcgcaggagtgaaaaaaacagaggaataaaaaaacacatgattctgataggaatgcaagtgtaaaacagatgattgtaaaacacatgaatgaccgtttaattggaccgcggaaaaaacgtgggaatcaaatgagagagatagacttaaaggaaatttttcaagaggttaaaatggatgttaatttttttacatttttcctctaaaatagtaggaataggaaagtttcctatgttttttcttttctcattcctacgaattaaaggtatggatagtgtaggatttcagttttttttcctccaatttaaaggggctaagctttggtggaaagatggctatttcccaggcacaaaataatgataccgaccactatagcgaaaaggcaaataaaaagatagtaataataatgccaaacaattccagctccggaagaaggaagaacgcggcggtgctcttgctcacaaatcactctcaaggccccggcttaaacgccgtcaaaccatgccgtgacgatctttcccaccggagcgtgggccccgccgcctcctggccccacacccaatcctcggcccaaccagccccacaaaggcccagtccgcagcgacccagcaaaggacgcggccacgtggacggaggcgatctccgctgcgggggtggatcccgggccaactgcgggagcgcgcggctttagatttcgtcggatctcgggcggagcgggccccacccccacaccctccccacctccacttgctccacgtcacctccccccgtctcctcccccgttatctaccgcctcctctcaccaccaccgcctcctcctcctcctccgccttccgcctctcaccaccacggcttccagctctggccgtagcagcagcagcgcgcgcgcgggtgcctgtgcccgccgctgctcacggctcctcgccgccggcttgtgcctccgatacgtgagctccccacggtgcggcgccccgccgtacgtcgccgcgtgcgcgacaagagctcggtcgcgttggggtttggggatcgattgatttataggcttttttgtttttgtgcggcagggggtgcgagggggtctggaaaccggcggatctcggccgctcgccgccggagtccggcacgggtggaggagtacggcgacccgcttttttcttagcgattttctttcctcttctctcaggctgaggcatgcttcgagcgcttcgtccgttctgattttttttttagcccgactgtttgagaatcgtctgactgacctgataaagcctaattttactgccattttagctccccaagcgccgtgaattggtaggacttttgtgggaggcgctggtttctgctctactcacagcaagtttctaaagtaggtgaatcctcacggctccggatctcctcttttgaggatttcccccgaattttgatcagatgttcgatgcttttcaggactcggaagcaattgattgtgaagtattcctttcagttcggcttgaagtagtcctctcagaccattgccgcatataagagtagcttattaccttgtataggaaaaagtagaaagcttattccgagcatgtcttgttcataatagactggactctttgattcctgtgtgtttctggcagatccaagtagctgactgggtgcagcatatgctttttctaacgttgggcgtatgatgcaccccacaatctgtgaactatccctagtcactcagatcaacggcgcattatctctcttccaatctggttgatgggtagcgcctgcgaagctggtacggacgagccttcccgagacgatgttaaggggacagggaatggcatcctggagaatggtcatagtcacaagccagaggaggaggaatggaggaatggcatgggagaggacttacccaatgggcacagtacaccaccagagccccagcaaacagatgaacagaaggagcaccaagtgcagattgtccggtgggagaggttcctccctgtgaagacactgagggtcttgctggtggagaatgatgactctacccgtcaggtggtcagcgcactgcttcgtaagtgttgttatgaaggtatgcactgcaaattgcaataccaatttattgttaataagtttttctattttccgagggaagttaaattacttttatgatcacatattcgtattggagaatggagattaagatgaagattttacctcggttttccttagcatgcttttcaaactactaatgttgttttatgtgaaaactttgtatataaaagttattttaaaatatcaaataaatccattttcaaatttgaaataattaaaactcaattaatcatgcgctaatgactttctcgttttacgtgtacatatttaatcttcatgtttagcatgttcaaacggggactaaaggtttcctaactacatatttatttctcaattccagttttatgttgcattcagttgtgattttttctatacaagggaaaatttgctctctccactatataaaaaatatgtattgtgcattgtaaaaaagaaagtgcggttgagtcacatttttgaacttagacgcggtaaaaattcaccatgctatgaagctatatttagaaaaaggcattttttgtctaattatctcgcttaacaattagttgacttgcccttttttccttaagaagaaaggttccaaatattgaatatcactatctttatgcatcagctgattggtctcattggcatggtcattcttggtaaccagaggggtatagcgcataggcctgcttccaatacgcacggcaggcactatagttagcatagacagcagacgagtgcatattccaacacatggcagttgaagatagactagtgggccagatgtggactggggatattctggtgattttttctatatagtcttgaatttagttttaagtactcatccacattcctctcccaatgaagaaaaaaaaatggaacatagtgcctctacattttactacaggctgcccgcaggaccaatctcttcagtatcctggatcaagtaactgacatgaaaagacctgctataggcatcggtgttattttctgttagcaccacgttcccccaattttcaaatttgccataccatcaagtcatctcagcatcactactccctcctccctcttctcttgttaatatgctcaactaccttattattggcgctggatccagggtaaaatgccactagggtcactctacttacatgatggtagcattgactatttacaagagcaatttaccataccgaaggagcattgactatggacctgatgcttgcatgctggacctgaccctgctgattgtgaatgcttgcattacatgatttttcttctgcaatttgattgggcagattcaagagggttctgcgcttccagatttccaagtgcaggtgctgatgcaccaactgccattttcagataagagtgtgatctggtcacataggtgtgacactggattcctgtatttgccatgcaatgcaccatggctttgccctggattttatcattagataactctaacaatagtgctattcctacagtttcatttttggtttgttcttttgtcaatcttgcttccactctcttcttttaaaattttttacaagacctgaaccaagcccagacattcatgtgctaaaggcctgctcgacattaagatggtttatgaatttatgataacctcagggttgtcgataataatagttccatgacaggattccctatgattctgtcctctccatgaaattaatcataatattacacatatttgaattaaaaacagcatacatagataatatactcctagatttctgttttctttaagattcctaaacctgtttaaacttcaagaatggggagtactggatgcaacacctactactactacctgctagacaattagattgccaatcttggtggcaattgtcaaaatatcgaattatgctgaaggaagcattttggaagttacatgatcaaggccagtagatccaattgtttctctcttttttttcatgttgaactcaaccacatctattatttagttaaccttattacactaggtagaagaagatttgaataaggtgcactgactgatttgaacaactcgattatggtca

SEQ ID NO: 74002 - DNA, 5326 bp, Oryza sativa
ttcctcatcacttaagacatggatgacaggttcagcatgatcaggcacagcatctcccaccacatgagtctttgaagctaactggagacgaggtggtggacgggttctcttccttgcggtgaggcgaagcttgggtgctggcggtggtgcttctcccttaagctcagctagttccttctgcagacggtacaccttgctctccaacttgcaaatcctggcacagttccagttttccctatcatgagctgctttctcccgctccacgcctactgcatccatggcgctaagcatatacacagcatgtatcagagtggcactaccttcgccttcaggacagttgtaagttccatagtcttgaccatgaggcttgtgtggatgatactggaaagctaatgactctaactcctcatcaaagcgatgacatagctctccaatggccaccaaggctgcttcctgataagcatggctgtactttcttcccccagcttcaaactttatcgacggaaggtcttcatgatcactagccaacgtcacgcgaacacgacacttctccttgttggggtcatggggaatctggcgatactcgggggcaacctcatagcctacttcaaatgccatcaatctcagctccctgacgaatcctagcacatcgatcaagcttttcggtggatggggcggcatctaaaggaacatagaaaggaggaatttatgcatatatttaagttagctgcacatactagacttaattaatttgacccaaaaagaaaaagaaaagaaaaggaggaaacagaactaattaaatttcgaatttttcttttctgaccgaaacataaattttcagaaaccaatttgtttttctgaattttttttcgaaaatttttatttatacaggagcacagacttcggaagtaaacaaaaagaagcaaatatattttcttcctgtacagtactcgtggaaacggaactaaacaaagtttttgtttggaaaatgaaatcaactttggacagagacaaattgctttagacaaatgaataaaacaaaactaaaatacttaggatctaccataagcacggtatagtgtcaccattaacagggatgagtagtgctggtgctatcttgattgaatcgataccataatagatgtacagtgccgactaaccaatgaaattcagaaaattaaactatttaataccctgaacagtaaagtttttttttaaataaaagaacatgtttctgttttggtaaagtaggatttagtaaatttggtacataaccttgcatgtgctgccaacttaattaatttgtaagagaatagagaagagcagtcctatttttcaaaatattttgaaggctacttaaggtttaccatttggcttatcgtaaggtcaaggtagctctgataccaacttgtcgcgcccggaatttctatccaaaattccaaatgcttacacgtgcgttaaatcctcgtctaggaatcagccgaggcacacaataacaaattgataatagagtactatcaaacatctaattaatactcgcgaaataaataattattacagaggtggatagttcctctcaaaagaataaaattctacgcagcggaaataaaaacaaaagatggaacagctatggcgactccactccacaagcaacttgaccagaacaaagcctaatcctccagatcatcaccttcaccgaagtactcctctgatgaatgaatattgcaagattgagcatatgacatactcaacaagccacacagcaaatatgcaagtgcacaggataacaaaggatggcataatacagctcaattgcataaacaagatttaataaacatttgagagaatagtaaaacagttaagtaattaagcaatattaaataaacactatacaacacccccgtgttgcataggcccaaccccatctgaacaaccaaccctggttgtacaaattaaacctccataccaggaatatatcattccaaaccaggagtcaatttaattatcacagtattatcattaataatgagtagtgtgagactaatcatgaaaaacattgttagacccacccataaccgcggacacggctattcggatagttttactctgatcagagatgtaccactgttcccacaagacacagctccacaagatgtcaccatgcgcctcgataccaccacggtaccttggaaaggagctgtgacaatacctctcacacaacacaactcaccacagtgcaccgttcctggatcgtactctccccttcaaaaccagaggtaatggactccccagcgacccccacggacttctcgccgcttctcagtctggcaccccataatgaatcacgctatacaaaaggtaaagtcgttgcccacgctggcttgtggttggcacggtaaatgtttcacaacagtagctcgtgaaccggtccttaattgtcatgagcacgaccatcaaaaccatatgctcgcaacccacctttatgcaggttttaattatcaattaattatcataacacgattaaccatcatgagctagcactaaatataaccataattaataatgtagtatgattcatcccattaatgagctaatgtttctaagcatggctaagcaattatacctatatagcacttagctaaaccaaaccgatatataaggtccaagctaaacaatttattacccataggaaaataaagtcatcttcggccattaattaattgggaaaggctgaccacccaatgacattcaaaaataatgcataagttgaaataaaacattaggtctaaacgggtttaacatgctcaaagggttgtttgggatctgtgtgacttgccttgagcttcttcaaccactcctgaaccttcctcgacgtaaacgctctcctctggaatgtcagaaactaaagcaaataaacaaaatcaacaaaacagtacaaaaacaagcataaaaagtacatgtggatatttttaacatgtagatcttgattttagatgaatttagcagcttgaaccactcgaatccgagttacgatgatttagttatgaatttccgaagtttaatcaattttcatctaatacagaaaattattacgaattaaataaaagatttatgatgtcacgatgacatcatcgccggccatggcacgggacgacgcgaccaccggcgatagagggctcggttgggctatccgagaacacccacgcgaagaggacgacgacgtgaactcaccggcgcaagaaactacgacggacgacgacgaacgacggccggcgacgaggtccgacggcggctcggctcgggtcaacgtcgacgacagcgctctgacggtcttcagcggctgcgaaggggcggacggggtgctcctcttcctcacgaacccggtggtggcgacggaaggcggcggtgacggctatagcggcggcgcggcgcggctggaacggcgtcggcggcggcggcgctagggcaacgtggcggcggcgctacgagcaacggtggagcttgggacttgaggagaaacgtagaggacgactaggggatgctttatataggcttggattagagagatcggactccaaacgagaggatttgagccggaaaaatctagggttagtttggagagataaactcaaaacgaattcgattcggtttatccgggcaaaattgatctccgaaacattaggggaaagggagaggataaggatgagatgatttcccctcaagcaatcgaactcggagatggctggctagggcggaatcgaaggggaggcggcggcgcttgggctcggctcggccggccagaggtggaagatgaccccgacatgtgggccccacatgtcggcggcttgagaggagagggtggggcggcggctcggcttgggccgcacggccgcgcgcgaagagaagagttgggccggaaacggcccaacggcctaggggatggttttaaagactttttcaattaaaataatttgtgaaatgatgtttcatttatgccttattaaaaatactttccttgctcaaataattaccagaaaaatctagaaaatagataaacaagcaaagtatttaatggaattttatctagctcaattttatgttgaaatttttcctagattattagagtttaacttgtaggcttttaaaaataatttctaaaaatgcattaaaaattgaattattaaattaggcgattttcagggcgtgacaaacctaccccccttaaatggaatctcgtcctcgagattcagaagaactggcaaaaagatgaggatgagctgacttcaattcatcctctcgctcccaagtggtttcttcttctgaatgattgctccactgaaccttacagaacagtatgactcgattccgggtgtttctctcactcacctcacaaattctgactggcttctcaacataagttaaatcttcttgaatctctatacgctcaggatctgcttcctccgtaggaacacgcaaacatttcttcaactgcgacacatggaacacgtcatgtattcccgccattgacggaggcaactctagttgataagctacttcacctctccgactcacaatcttaaaaggtcccacaaaacgtggtgccaatttccctttggtctggaaacgatgaactccccgcagcggcgtaacctgtaggtatacataatccccttcttcgaaagtcaaatccctatgacgattgtctgcatagctcttctgacgcgactgggcaatacacgacctttcttggataatcttcactttttcttctgcctctcgcaatacatctatcccaaaaacttgacgctcaccagtttgatcccaaaggagcggtgtacgacacttccgaccatacaatgcttcgtatggagccatttgaagactagcttgataactgttgttataagagaattcagcgtacggcagattcttatcccaacttccaccgaaatctagaacacaggctctcaacatgtcttctaaaatttgatttactctttctgtctgaccatcagtttgagggtgataggcagtactgaaattcaaatgagtacccatctcttcttgtaacttctgccaaaacttcgaagtaaactgactacctctgtctgacactattttcttgggaacgccatgtaaacatacaactcttgccatatatagctctgcgagcttatttcccgtgtaggttgttttgacaggtatgaaatgagcaactttagtaagcctgtcaaccactacccaaatagaatcatgcccttctgatgttctgggtagatcggtgataaaatccattcctatttcctcccatttccactctggtatc

SEQ ID NO: 74003 - DNA, 1387 bp, Oryza sativa
cccgttccattgctgcgcgccgtcgccgttcggcctttgcgtcgccgctgccgcgccatcgccatcgcgcgtcgcatcacctgccgcgccgcgcccccgggccccgagtcgccgctgctaccgcgccggtgccgctcctcgcgccccgcgccctgctgcgacgcgtcgtcatcccatcgccgcgtcgagccccgcgccacgccaccccgccgacgccatgaggccgccgcccctctcccctcttccccattatctctctccccccttcccttatataagcccccctactcccactcttccccttcatcctcacctcctctcctctacccacgccaccacgccgccgcctccacgccgctgcgccgccgcctccacgccgccgcgctgtcgcatagagccgccgcgccgccgccacgaagctgccgcgccgcgccgcaccttgcgccgacgtcgccaccgtcgccgtcgctgccgtcgccgcgaccgccgtcggtaagccgccgcctcctccacttgctcggccaccgtcgccgccctgggtagcagagagccgagaaagagagagagagagggagaaaccaagggagagaaagaagaaggaaggaggagagaaaccgggagggagagggagaaggaaaaagaaaagaaaagggagagagagaaggaaaaagaaaagaaaagagagagagaaagaaaaaaaagaaaaagaaaggaaggaaaaagaaaaagaagggaagaaaaagaaaagggaaatagataggaaattagagggagattagggaagtttagaaaatttaaaataattagcatttagttatagactagttattgacgtagaattgcgaaatttaatataaattatggattattcttggtaatttctacaagaaatcaattcgcggtagtagtttaaatgtaattaagaactaaacgattagatgaatttttatagactattatagattattttgggtaatctctataagtaattgattcacggtagaaattcggatttaatcactaggaattttagacgtatattatatttagtcgtttagtcctagactaaaattaaatcgtataatattataagataattttaggattccgtccgatatttagcttgcgatagaaatttccaacctattatatggatataatgctcgggtagattaaattaaaaacttatgataacaaaatatctatacccacaaaatagtttagaatataaaaatcgaaattgggtttgccctaggtcgcgaatagtaaagttaatataaaagaatcgacttacgcgttcgacttctatttggatttatttggatttttatttgattctaaccgaattcaaatcaattttcgaacgtaactataaagcccgagggag

SEQ ID NO: 74004 - DNA, 5592 bp, Oryza sativa
cattcttctcggcttttgcacgttgctcctcctgctccctcgcaatacgggcctgctcgtcttcaggggccccgaccatgaaaacttcaaagaagagtggagagtagtcgttggtgaactcggagttgttgatgctttcggtgtcgaagttgctatagccgtccgagaagctgacgctgttgataatctatgtagtcctataggatccaattgttgaatcataacgctcacctcccgagatccgatcttggactcgttgaaattgtgcataggtcaggacctagggggagggagactggtctagatccgaacgtcacagcgaggggcgacggaagtagcatggtgatctgaggatatattgctgaagtggtgcagtttctccctaattggttcgaatctgactcgaggagagcgatcttactgaagtagtcggagatgaagtcgaggtcaccgaacctgttggcttgtcctagggggaatacgaagtcgtcggctcctgaagttgatcccattgcacttgtcagtggaaaactcaacgcaacccctatctggcgcgccaaccgttgattctagaaatcgacaatgagaaaagggggtagaacatgagatctaaagtggatgagtaaagggacaagatatagacatgtttaggccttttcaatgagaagtaataccctacttctgttttggggattgtatccactgggtgttgtattgatttgacaatcaagttgtgcttattccattgagaggctccctgccctccttatataggttcggaggtcgggttacaaggagaaaaacccaaccaaatacagtataaatttccttgctggcaactttttgtgacaagtcgacaaacacgatcgcatcacctaaacgccttgcggtgatatggagtcgccaaccacctcgacctagccaaaaggccaagtcaagatggttttttgtagaaaaaaagctaaacaggctagcggagctgatttagagatcaaaatcagcctttaggccgatttagatctatatgaggataacgacccgtctcgtgggcaaatggaaggttttcgggacaaacctacaaagaggtgttgcactctcgcagcggcggcggacgattcattgcgcaaatcaacaaagatggactaaaactagggtaaagtaaaaaacatggctaaaagtaaagataaaagaaaaaaacgatacaagtagattgtgtgttcgggggttacaattgaaccggcattgtcccttgaataggggttggtcttaccctctacaggccctcctccatgtccaactcgggatagaaactaaagaaaaacccgaaacatgccttcccaaataaggaaacccaagacccgacgaaaacagactcgggctcggaccctgacggtctgactagccacatacctgcggtcagaccggagttcaggccgcggtcagaccgcccacatacctgcggtctgaccggtcttgtgaaggaaacccgtcactttccaaactttggcaatattcccctatttcgtccataggtgccaaatttgggtgtaaacattccttatacatttagataagtgtgtatgactaaaacttatggaatatgccttggagtacaagacaacacaacttgcaaagcctaatcttttacataatatacggatccggcccatcacctatctctagtcgaataagctgttcgtctaggcaatggtctatgtttacatgggaaaagtcaaaattgttaagtgtatgcaagattgttgatttgaacctagaaactcatggtgagagtagaatcccctcgtcaccatgctatcaagtagagtatgcacaaatgtttgtgctaaatctcatatgacatggtaaaattggtcacctcaaaatctgagaaggcagcgccaatgaaattatggcttagagccattgagcatgacgatgagctaaaagtccatttatgtaattagttttttatttataaaataagtttttgaaattggacgtaattgtgacatcctggcccaattaggatttggcctgtgtggctcatatgagctgtgtgcgcatgtttagtttcacctggctagtttagtaagggtggaaccaaattatagggacttgtccatccaaccatgcactcccaggttaacccttttacaagaagcgagaacagaagtgtagatggagtggtatgtgtaagtaggccctcccgttggatgggctggctacacggtcctggagggagggatgttatagtaatgtcaaaaatcgtgggtatgatttgttggatttttagctacccacttgccgaataatttggttttgctcacggattgaaatttcggaccccttggcatgcacctatctcgctcgaaatttactggtttttttaatttgtttatattgataaaaagttattcaaattcattcaaaatttgtttaattctaaatattttgatccaaaatctctgaaatatcgatgccccatagaaatgtatgaaataaaattggaaaaaaccctcgttttgccaacacgcatccctcattttttcaactatcatgtcttgagccttcaacattacatgatattgttgaaataactatcaaatgggatatcccaagaaccctattatttgatgtgcatataaacgaagatagtaatatttgagagaatattcgcaaaaagactaccatagaggagtatgtacaataatagattatggttggaagacattttcaaagaatatatcaaggtccagggaaaagtaaaagaaaaagtcagcggatcaagcaattctaaggaaatgacttgacatgttaagaagtgcctgaacggattgtgagaaagaataaagaagtgcctgaatggaatgtgagaaagaaaatttggaatatgatggacaaaacagtcaaagtcgtagcaacaagtttacagaactaaactcctttcagcggaatctcggggacgggattctctttaagggggtggatctgtaacagactcaaaatttcatggaattttttttttgcgaaatgtcttaagtcatgctcttcccgattcttctgttgaagtgatcttgccttctcttaatttcttttaacttggatttaaaactttatttgcaaagttaatcgctttcttttaaattttacaaaactttgttatttattttctttaatctttaactttggctctaaattatatttcctttgaatccattcccaaatatctctagagtacatgaattgttgatacctttcgtttggatctccacctaaatatcccccgagtccataaaatatccttttcaatccccctttgagtcaacgtacccatccttaatttaaagtttatcaatctaccaccaattctgttcctgtagaaattcccatccacatatacttccgagcccatatctatactcccaccaatatttcccctttgaaatcccgttcctccaaattatccactcaagatttcaaagtctattgtttagcttgggccaatatatccccgattgacctgactctctgttatatcccattaaccatttttgtctttggggctaaaccagtataactccctttccgttggaatttattttggatcaaccccaatctaaacctatccgtgaaaacctttgtctccttttaatcgatccaaaatattatgtggtcaagttcctattttgatcaatccaccaatttgattcctatgacttgatcacattcttgacacaagaataatattatcacaaatattggaatgattgctcttgtgctaagaaacttatttccaatcccttctattcaaaatttaacttcttttagccacaaataattcaccgagaatccataccacatattttggaggctaaaatcttagttatttaccttcatctatttttgccaccatcccaaatttatccaaagttagaagttaaattattacctttcccgtttgatttttaaatctttcgtgacaagttttacatttggtccttatttgaattcttttaaaattggagcatctttatttttatccttttcaaaatttatatctcaaaataaatatatttgattttattataaaaatattttaaactcctttttgctttaaaaaactttatattcttcttataaagttcaaaagaccctccagcgtttctcttttaaattttatctccattaaaatttatttaaaaccctccattcaaaattccttggattcaattccttgaccaagattcaaaaagtccacatccatccatccttttgttttcaactcctttaaattccattccaaatcctctatacaaaattatcaaaacttcctatttattttgggccaatttccctttcttttggcccattccctttttcttttcctccctccttcttgggctgccgacccaactgagccgaagcccagccgagccggcccacagccgagccgacttttccttctctctctctgtgggcgccaccgccgccgtcgcttgcaacaccacggcgccgccgccgcttcgccattcccaacacgccgtcgcccagccaatccgccgccgccgccttgcccagccaatccgccgccgccacctcacgccgttgacgtcatcctgcaaagcaaaccgacgtggccagccaatcaccgaacgaggccggcgtcgtttcttcctcctgcccgccaccgtcgttgtggccaagtcgccgaccgcctttgcaagcgaagttctccaccgcctctcgctgcctataaaaaggacaacgaggttccctattcctccccataaaccgagctcctagagcttggtctccctttctctcctcatgaccggccaccactacccactggccgatctcctcccccgtagcctctcttccaattcccttgcgccatcgggcttgcctcgccgaggtgaactcatttttccagtttctcctctctttccccatccgaaaccaaccaccacagccaccttcttttgttgccggagctgtgctcttgttgccgccgttccggtcatcctcctctctccctctgccttcctccaccctccccgggtgcgtgatgctccggaacacgcttagacgccgccgtcgaggccgttcaaccaccggagcaccggcgccctactccctccctctcctctgtgcccggctggaaggagaagagaagaagaagaacgggaggaagaagaagagacatatgacaagtgggccccctgcacagtaacctttttcttttatttgattttaattcaatttcaatctttagacacccatatctttccaaccacaaatccaatcccagtaagactttaacctaaattcatataatttcaaactcttcgttttgatatcaaatttcttatttttaaaattttatttaaaattctttatttaaaaaaaacctttccttatttatttatttactttctaattttaaattattttaattaacctttaaaaattattttaaatttatttgatttactttatatccctttaattttaaatttatcgtttaaaaacttttttaaaatttaattatcctttaatttctttaaatgcccttttctttattttaaaata

SEQ ID NO: 74005 - DNA, 10370 bp, Oryza sativa
ttccttcgtaaccatgtttacgtatgagtccctaatctactatgacaaatgcttagaaatgctattctagaatcatgcatactcatatttgtcaaatgctatatgctttggcaattacctttgggaaggtaattgagatgcggcatgtggagacatgagcgccacattgccatgatattgagaacatgatttgtgaaaggagaaataaactaaataactgttttcgactgggacggacggaggatttgggtggtatctggaaaaggctagtaccgtccctggtcaattaaggaccgagccatgaagttaagcatgaaacgaccctcgtacaaccgcacttctcgtatgggtatagacctagcggagtagatagccgagtggaggcagtatccctgcatagatggttcacccctgagtgaggcaggtgcgctacggtgggacagccgttgaggtagggccgagaggcgtgccctacatcggtgtcgccattggtaggactgccatgagtgtgtgagagagagaacttaacttgaaccataatttaatttaatatgtgtgtgagacttctctttcccgggagcgccagaactcctctcactgctagaaacatggacgcctagagtgcatgaggatttaagttcatggagcgggtactgccaatgcgaggttatcgaaaggctttgccgtgacgcgtctcatgtgttgggacgaggctcatgtgttgggcagttacggagtgcgggtaaagtgtacatccactgcagtgtgagtaaacccaatctattcgaatagccgtgctcgcggttattgagcaccgggacatgtattacacttggctagtctctaaattcttaacttgtgtgtgatgggttgttgcatgacgaatttttatgctgttggagccacttcctgagaagggggaaggtgggcgtcctcagaaaaccataacgattcaatggcgggaagctatccttgggatcacaatggatggtggacagaaccgtcgttgtttaaatacaaacactggtactaaaatttgatcagtcaatgctaggtcttaggtttgtgaaaagaattacaaaactggcttagcgcaaaagagccatagccatcctttgaaatgcccctttcatatgcattgttgctgtggtgacttgctgagtacggttggtactcacccttgcaaatataaaattaatcagaagcgggagatgaagcttcggaggatccctatgcctactactaggagggagatgaagatgatggcgctcagtaggtcttagtacggttgttgcctgtggcaatggcatgccgctgcctgaattccgctgccttatctattactacttttggatgtattccggaccgctcggtccgatgatttaagacaatgcctgcgggcttatgatgtaataattagcactagactcttgtgtatgtgcttttggtatttcagctatgaactcgtgtgtagcagactacttgatccagggaaatagtactgtttacacgaatgattcatgttataaaaacggtggtccacaagctggatggagctctctcacaaaattaactagagttgtggagctgggttaggcagctgcacaactacactgtagagccaactcctgtagttaaatttaggagttggagctgcaccaaacgggccctcagtatgtctgaattgctttctctaccccaattcattgttgcaacctagtagaaaatatctcagtgcttttgaagatctaaattcaattgaaaaattggactggagtaatcttgtatttgaatgattgatgaagcatatagaaaaacttgacaagtcgaaaagttttggtggctgtctaccaataggtatgtttttcaatttttttctttgtactctcatttaaactcttataacaaactgaagaaatcttctaacttgacattttataatcttgacattttgatttttagaagaccaataggtatcttctaccatgattttataagctttaaatttttaatttcatttacatgtttttagtacttaaattatagtttttttcaatgtaattcttatacaaatttactgtaatttgatttatattatttatttcaaatcttaattttttgatattaggattttacctaaacagaatatatttgatgtcacataaattccttacttttataacttttcagttcaaccaatattaaattttctgacttaaaactatgtacaaaatgggaacattctaaattcataacttattcataacagtagacagtttgtaatgttttcttgtttctttataattttcaaattatttttttgtagaattgattgtggaatctttactctaaagtttatggagacttggtgtccgagagttctacttccaaatcttttttcccaaagagatattcctcgtatcagaattcaacttttgaacaaaatgttgttccgcccaaataactcaaaccttagctcagaactttatcaactcctgaatgatcatttttgaaggtcattttttaaaagctatttatatcatttttgtactttcatgctatgttttgaaaatttttctttatttttctatagattttggatttatatcttgaagaaatggttcaagtggagattacagattcatattctctagaaggacaattgactatactagtcttactacttacatacatattactttgtaattacaaacttttgctacttgtgtaactacaattttgtgtaatctcagtttgacttgtttcatcacaaacaattgttgataaagtataattattgaacttgaaatatgatactgcagtaatagaacttattattacaactatgaatgtccatttttgtctctgaaatatacttaagtatgaattctaattcagatgatcatatgaaatttgatatgaatacaaaacatatttgattacagatctaaataccgaaattcttcagttctttttcatcttcttgcttgaattttgtacttcatcattgcagcttttgcctcccattgtcttgtccttctgagattttcttttacttggagcaacatttttcttttgttcttgtccatcctgcaattgttttgaaaatattatatttttattttgattcaatttttttaaaaaatatatattaatctaccctataattcaccaactaactcttacatccttcatacttcattcatcaaatctaacggatgaaaataatcgaatccaaccgctcctgtaaccccacgtctcccctgcctccccttctcacacggtcgcaccccctcgtctcccccgcctccccttctcacacggtcgcaccccctcgctccgagatttttgacaataagccactaaatacgcgcgcctttgcaaacttaccacccaatccgcatgccttctctaatacaccactaggaatgaaaatttcttaatttcataccactttctctccttcccgtcactttttctttttctttttcgttttctatttttctcttcttttctgggacagttttaccctggtcccacctgtcaggtaaaagagataggggaatcgagagaaggggatcgggaacggggaggcagagcgcttgcgctcctgtcctgtcgcgcgccggctgccgtgagtctgtatgctgctgccttgctgttcctcctctgctgctgtaagcaaaattttgtcgccggagagaacaaaatggcatcctgctgccctgctgttcctcttctctgagcaggatagtggcatataactgttgcatttattgctgcatgtattgtatatatgtgtatacataaactgttgctccggatgccaaaattttgacagcttgtaagcaaaattttgacagcatgtaccctaaattttggcaacattatgtaccttgcaatttgtacagcatttgacaagtcaagaaagtacccataatttggtcacagataaaaaaatggcagcatgtacccataatgcatatataaccatttgagaacaaacaagttcaataacaaacttaagaacatcatccagattacataaccatttgacaagttcagagaacaaaatgaaaccaaccagttgtgtcccatgtttcacattacaaaagcatccacaacactaaatattatatttagaaaagcattcattttttccctttctttggagtgatcttccttgcagctctagtaggcctcggaggggttgccatttgactcgatccttctccaacaacattagtcaatgccaattggcttcaatgaactgagtgttagtaaaattttaagaatcaatcataccattgaactaaagaaaaatcataccttctagtgacaggcccaggactcgcattgctggaatcattgattgcaactttttgtcttttaggtgtgctagaacccgctgcatcactagttgaacctagtggtcttccttgtttagcacgacttttcctaaaaaaatgtaaaacaagttaaatgattcataaagattaatgtacaatatgctagaagaagtaaatgtatgtggctaccttttttttcttggtaccatttaatggacattttgaggatgtttgtctatggcccatgttaagacacttcttacattgaacctgccactttcctttggtcctaggcttgcttcctttctcaaggcacccaactatcctattctttctttgcctccctacatccctcttagtgagaggcaacaacttgaaaccaatattgacttttggccattgggacttatctggaagtggatgaataacacctgcatatgccagcttatacttttccactgaatagcaaggatccaggtaatcagccattcttgggtttctagctgatattatgagagctaatgcatgtgggcatggtttgccagaaacttgccactctctacaagtgcatgtatgttctgtaagattgacagcatgcctactaatatcatgttcaggagtaatctcagtcacttctgctaggtccttattaccttgcactaccttcaagtgacccaaatctctagtcattgcattcagttgacgaactacaatagggagcataacaccatctagtttctcacctatcttcctccgtctcgcaaatagatccattgtctttgctctgatgccatctgcgagatctgcaataggatgatccttcatatccttgatctatttgttccatgactctgctagattgttggtgatgaagtcacattttatcttttctaagaacttactcctcatccaaagtaggccgtgataagtttctagatatggcttcacatctgattttgcctcatgaattttattcatgtaatactcatatctatctgtcatgtaagacctagctgcagggtacatgttcccaaacactgaaccatgaaatttcttgatgaaattctgcatcaagtgccaaaagcattctctatgctctgctgtactaaatacacttttcacaacattctccagtcccttacaagcatccgagctgattgctaagtgtggctgttttccaatggccttatgaagttgttgcataaaccaagtccaattgccagtggtctcactttgaaaaaaaccaaatgcaaccggaaacatccagttgtgtccatctatggatgtagcagaacctagctgaccattccaactcccattaagggctgtggagtctatactcaagtatggccggcaactcatacaaaacaaaaagggaataaccatgagacaactcatacagacaaaccaatatttgaaatatgacacattgtttagttagttgttaggaccctcacggatttttcattatgcatcagcctggccacgatagcccatgggcattcatcagctgtgcaaaagcccctaaacctttctttatcagacttctctgtcccaacctgaaattgtccctttatagcgtgttgcctcacagctgacctaaattcattcatgcttacatatgagcttccaacttccatcggaggatcatctctgtcatagaaaatttcagattcaccaggtattacatcattaacagcatattacaatctctgcctcgttaaggttcaaatccccttcagtatgagctgaacctggtgtaggcactgaattcctttgcctcttagcctcaagtctagcttgctcggctctcccatcctcagctctaagtccaacaaatgtatgcatttcatcttcctccatcgaaggcatagaagaaccaagttgatgttgtggaattggttctatctccaatgcatcccaatcaatagcaagttgaggaacttggttatgtggaattggagctatctctagactatcccaatcaatacaactgctgcattcttgaacatcaccttgcctgtctgtcacaacttcacccattgctacctcattgacctctgaaactaccgagttagtcatcaactgaataggcttgtcctccacatcaacaaacaaaatcaactttctatcactcttcctaacaaacaatgcatgggctacatccatattatccttaaacggtgtttcctcaccagtgcccatgtcgtagccacttatcacagcatgttggttgctgccccattttacccttactgcaagatccttttccaaactctccaatgtgcactgatgatagtccacaacccattcaagccatttacgcgccacttcaacacaagtaccatcatcaagtttagctgtaaaatgaccgaactaaacgcacacgctaaactccgcatcacatacgaacaagaaaaacgagagtaaaaaaaaattagttcgcccgctaaccaaatccgtcctaattttgttcttcagcccgttaatgcaaataatggagatgtggagagttatagcattacctagaagggagctcagatggaatcgaggagcttgccgcttgcgccatgatctcttgaaccgtgaccccctgtcccatctctatcttcaaaaccctaggtccccgagggaccggaggccggccggcggcggggcaaggaggcctgccgacggcgagccaagtaggctggccggcggcggtgggtggctgggcgatctggaggctggtggcggcgcccggtgaggaggcggcgcggcgacgggacgggagcgcacgcgctctgcctccccgttcccgatccccttctctcgatctccctatctcttttacctgacagatgggaccagtggtaaaactgtcccagaaaagaagagaaaaacagaaaacgaaaaagaaaaagaaaaagtgatgggaaggagagaaagtggtatgaaataagaaatgtgcactcctagtgatgtattagagaaggcatgcgaattgggtggtaagtttgcaaaggcgcgcgtatttagtggcttattatcaaaaatctccctcgctcccgaaatcacgccgcatcctctcttcagccaacgtcgcccacccgctcgtcaccgattccccatccacgatttctctcctctcccgcgccgcccctccgtcgtcgtcgcgtgaagtcctggccgatcccctccgtcgtcgtcgcgtgaagtcctggccgatcccctccgtcgtcgtcgcgtgaactcctcgccgatccccttcctccgtcgcgccgtcacgccgccgattcccccctcctcgtcgggcgcgccgcggggttcagtcggcgccgatccccatcccccaggtcgccgtcgccgatcctgcatctcctctgtcccgtcctcgccgatcccccgcctccctcgcgccgtcacgccgccgattctcgcctctccaagaccggtattcttgcctttttgtacaatgcaactgtgtatagacatatcctagcagggatagaagtttcagtttttttaattaatgtgtcttgtgtgagaccagtgcaaggggatccacattgttcttgattttgttttggtttcaagtttgctggtgcatgtgcatgtatatgataactattgctcctcgatgactgggtcgctgttgaaggctcagttttggcaagttttgaattcgagctcgatggccgggtccctgttgaaggctttcagttttggcaagttctgaattcgagcgaggttagtgtaattttaattattttaggtcatttcagtggtgcaagtaattcatatgtcatgggtgcaattgatttacttaatcattttagaattctgtctgcagccatagcggcctgtacttaaagaaacttgagcatgtgtaaaaaaggttaaagaggcagatgcagtgtactccttcagtgaaatagcagagtacattagagaagtgtaattttacttgatttagtgcctcgcacttaggaagtgatcaatatttcagtgctgggcatatggcacttgcttgtccttaccaccttgaccaaatctgcaaaatagagtaggaaacaaaacatacaacaaagatataaaaaaaatgcagctaagatattttacttcgtttagctgaatcaaatcaaacaaaccactcatctaatttcttctttttatctttgtttaatgcaaatactatggtaggaacccaattgtttgtttgacataagaaatcagtcatctaatttcttctttttatcttttttatgcaaatatggtatttagtaagaaatgctagagtactaatagtccctctgctcaaattgatcaaatagaactgtcaaataaattcaatatgttgttttggcgtcgttaaatggcatggttgttttataacacacagtaaatacaatgttagacacagtaaatacaatgtgtagaaattaattcgagaagctcaccatcaatgttagatacacctctgaaattagagcaataatggcagatattagatcaatgcacactataggggtcttggggtcttggggagatcgacggccccggtgtcttggggtcttgggtttggttcctaactgaatattgttgtttcaacagctttcatttttgcatcttccccagatcactgctggtcaacaggtcaacaaaaggtaacgccagttgtaaatcctgccatgactctgaatctaggactctaaaagctcccaagctttaagatttgagaaccccgtgcagaggcagtggagactgaggaggtcgccatccacaaccgacaacgacaacgcgacgccgctgccgcctcaagagccaccgctgcctatccatactcacgccaccgttcctcctgcgccgaaaggtacaggacacccttcgccacccctaccccatccctaatatgtctcctctctcccgataagtatccctgatgttgatcttatgtaaaagcatgatttatgctcaatatatatcatatgtaatttgtgctggaaattgggaatcatggatgacattttctgtatatctacatccaaagccaactgtgaacagttgtattttcctctgataagcactttcaaattcatgaatatgtaccatactgctgatttcagtatggtggggaattgatgtggctggaataagaaaaaacattctcacaccctgtgtttcttccaaaaggactatatgttcactattctaagggtgatttgtctacatgtgtatcggacgatcgctgattagtccctgccatatctaactatgtatattcataaattagtactatgtattgctatatttaagtatatatgcctatgcttctatgatcacataggactgtgtgcaatataattgctctatagtgaaattgaagggaaaggcctttatatttctgtgctgaactggaaatagataaatggcacatttgtttttaataaccattgggttgtctgaaatttagagcactgaaatgcacattgtttattgtcccttgaaagtgtaaatatatttggatcactcatgcatttatgtattcgggaccaatatatattcttaagatcattggtttagactgtatatacatgggaaatggtagcgactattgaataaaaatgtgttttggttccagtaactggatgggatagatttgttgtctacgtttggacgatatcttactgatttccagtaagatctaagcgtcggtcattttttcatttcattcctgcctctgacaataggtactgtgccgttaaagatacatgtttctattcaagttaaatcacacttatgcaattattcatggttacttacattgtctgctctgttaatctatacaacttgattgccaatggcattctctgtagtctcaagggtacatgattatgcttttcaggtcttggctaaatgcatatgaaaaaacatattgattgaactttactaaaaatattgctcgtccgggatttagtaagaatgtccctctgctcttattgatcaaatagaactgtccatatatgccttttctgatcacat

SEQ ID NO: 74006 - DNA, 17121 bp, Oryza sativa
tttgtgaaatatgtaaaattatatgcctacatgaaaatatatttaacaatgaatcaaatgataggaaaagaattaataattacttaaattttttgaataagacgaacggtcaaacatgtgctaaaaagtcaacggtgtcaaacatttcaaaacggagggagtatacgcatcttagatagataaatcacttgactaatcaaattccttcctgattgcttgatgtgttacgtgcaattgctgatgacgtggcagctcgatagacaatgtcttcgagtattgctgatcagggaaatagcacggcgacgactgctctgatcggttgcctccctgtgcaggctgactccgatttggtgatcatgccgatcaaggaaagaaatctgcagcagctgagattgaatccatcgaggtcaccgagattaacccttccgactagattggatccgagttggagaagaaaagcttggcgaagtcgtcggcaggcaagtccggggctcccaaagcggaaagcctatcctggagcgaagacgataccggcgacgtcgaagattggttccatcgcactcgtcgacaggaaactcggcgccacccctacctggcgcgccaactgccgaaacatgaattcgacaataatgaaagggggtagcgcacgagacctaaaagtggatggatgcagagacaaggatttagacaggttcatgccctctcaatgagaggtaataccctattcctgtttggggatttgaatccgccaggtgaattatagatctgatgatctagttgtgtctcatgccccctagagggcctcctgcccaccttatataggataggggataggattacaagatagaaaccttaaccaacacggtatcggtttcctaaatctattctacaatgttaccaaaccaggactttaggccgttccgtaatatataaggaaacgtaatacccaagtcatgatctgttacatattctatagatataagttatcccatataactagtcggataaccataccgtgtgggtatggggtaccataatctccaaaccttgcaaattggaattaagattgactcaaccaaatccgcaatcattccgatcgctatcaacccaagaagcaagtacaacgaacaaacggcactaccaacgccccacacttggccactagccacccgtgtccgtacacaaaaggtcgcacattacacgcacgcagctcctccaaacgcacgtataccaaatcaaccctccataccatccctccgaaaagtggtccccaccgtccccatggccccaccatgtcatcgatctaacccttgcgcgggtatgtcaccgctgagtagacaccggataacaaactgccacgtggacccgtggcccccacctcccgagacattaggaaattattttttttaaaaaaaaaagaaaaagggagatagccaaaaacgccatttgggcaaatctagctcactccgaaagatcaaacgccccacccgaaaaagctttcgtaaatcgagagagagaaaaaaagaatcgcgcaccggaaaggcgagaggagggaggaaggctgcaagccctagcgccagggcgaagcaaccggatgtccgggcgcgcgcgcgcgtgggtgcattgcgcgatcccttcacgctgcggcaagccagaggcgaccgggccgccgcgcgcgcgtcttcaccttcttcccgggcgccgatccatggcggagcggcggtggtagaagggtttcgcgagcgggcgtggatccgggggcgggggcgccggtggcatggcgctcttccgcaagttcttctaccggaagccgcccgatggcctcctggagatcaccgagcgcgtctacggtgcgttcccctgcctcgatgccccgtctatatgggattgtatgccatttgattcgttctgggatggatacgccattttggagttcttctatgcgtgtggcattgcggaatcggtaaggtggtgtgcttgcatttgtcatgcaagttttgtgaaatgtttcatcatttttgtgaaatggtttaaggcaattttacagttggggccgcaatccagtttattgggtagaagttgtagttagtgcagagattttggactgttctagaggaaattgtagtaaaacggcatagctgctatctgagcattaggctcgtactgtccaatggatgatatgccattcatactagtgttgtataaatatataacataaggtatttgctgaatggagggcagcttacctaacttctcatgagaagtgatcgttgtcattgttatttactggtgtccatgggaggtcttctatttaatcttggtccactgatgggaactcgaatgttcagtcaagattattttgaattaatgttacttttttgtttgcaattttaatttttttcctctgcaagtttaaatatttttagaattaacttagtaatggcaggtttaaatccgtctttgtatactcaatttgcttctgtttgctgtaccattaatttgtctcgtatgctatgttatgcctagatcctctagattatgtttccttaaccatttatgctttctctaatgatattaataaaatataccattctgctttttcagaattttgaaaaaaaaaatcatttttcctggtgattaataagatccatttatgcctttcaaatgtatgtggaaaagtaaatcttgttttgttgctaaaattctgtcgtcaatgtcttttccttctgtagtatttgattcttgcttcactacggatgtctttaacgatgataagtaccaagactacattggggacattgtcgctcaacttcaatgccactttgctgatgcctcatttatggtgttcaactttcgagagggagaaagtcaaagtttgctggcaaatatcttatcgagctatgagatggtagtgatggattatccaagacaatatgagggatgtccacttgttaccattgagatgattcaccatttcttgaggtcaggggagagctggctgtctttgagccagcagaatgtgttgataatgcactgtgagcgaggtggctgggctgtacttgcattcatgttggcagggctactgttgtatagaaaacagtacattggtgaacagaggacactggagatgatctacaggcaagcacctcgtgagctgattcagttgctctcaccactaaatcctataccctctcagatacgatacttacattatatatctcggaggaatgtgagcgcagtgtggccaccaggtgatcgggcacttaccttggattgtgtaatactaagaaatattccaggtttcaatggggagggtggatgtagaccgatattccgtatttacggaaaagatcctctacttgctacaagtaacacccccaaggtgcttttctcaacaccaaagaggagcaaatatgttcggctttacaagaaggtcggttgcaaactacttgaactactttccgattttagaactggtagattaattggtcagattgtgtctagtgtttcccatgctacctttcctcttaaccatgtagaagaagaaatatatatatttgcttgaagacgttctttcagtaattcctatcatcatcacatctcatttctttcatgttactcaggtagactgcgaattaattaaaattgacattcactgccatattcaaggtgatgttgtccttgaatgcattagccttgatgcggatcaacaacgggaagagatgatattcagggtcatgttcaatacagcatttattagatctaacattctgatgctaaatcgtgatgaaattgacatattatgggatgcgaaagaccgattcccgaaagaattcagagctgaggtatgtattccttgttgaactaaacacattctcttaaaactcgtgcagtatataacaatttttctttatcctctggttgaaggttcttttttcagaaatggactctgtaaatcagttagattccatggaggtgggtggtataggagagaaggagggcctcccagtcgaagcatttgcaaaggttcaagagatgttcagcaatgtcgactggttagatccgacagcggatgctgcagccctactttttcagcagcttacttcatcagaaaacattcagctgagaaagggtttgttgtctccaaataagaaagacttccatcttagctcaatttctccaaccaagaaacagtctgacaatgttgaagataaattaagcaatgctgaactctcaaccatctatgtgcacaaacaagaaaataatgacgttcaggggttgatcccacagaaacaagccaccattcctgatgaaaaatcagggtcgtctgtcatccatgagaagatgatttctctagttcatgaggagataacacaggtagttgacatcaatactggttgcctatcttcattggatatgacagttccttccaccatgaactctagcagaccagttctaatcgaccaaaattctaagcttgatgatcagtttggttcactacagagctcttcacccacaatgattatgtcgcagcagtttccagtttctaggtcaagttctgtcctttccagtgactttagtcctagattactttcagcctgcccaagatttcacagtgcaccttctgcccttggaattacggctctgttggaagaccatgctgcatttggagacactaagaattctgtcaaagtttcaagtgccgtggtcaaaattccatcaaaacagtcatcacaacagcatccaataacaggtctgggtcgatgaatcttcttttatagtatacccatattgtcttttaccatcattctcatctgaacttttgataatgttaacagttactcctgttgtaacgaagtgtacaccatcaccaccaccactgcttcctccactggctccggtggtgccagtaccatctgatgatcaaatgatatcccaggaaaaagacatgtctcaacaggctcaaaagcatccaggttcagcttacacatgttaatatattctagttatgtagaattccattttgtaattaaagttctttccctgtggcagacctttcatcatttccatccctatctcctactcaacaaaaacaatccacatcaaaattatgtcaaactattctgcccacaaatcatcaactgtcctcaagtaacattacgaaagagccactacaaatttctcctgctcccactccacctccattgcctactccatcaacttccagttctagtagttgtcattgtctccctccagattccatgctttccaccacaacagctttgttcagacctccagcaccgccgccaccaccacttcaatctccatccactcctagatgctctcctgttagaactcttgcattacctccacctcctcctgcccctacttcatcgcctgttagaatgtcagggcccttcttccccacctcctccacctgcaccaaactcgtgtcccagtagacctgcaccaccttcacctccaccttcaccacttgcttcaacttcatctcctccccgacctgccgcaccatcaccgtgtgaactacatacttcaacttcatctcctgcacgaccagttccaccacctccaccaacattatctacaattagatcttcagcgccaacaccacctctactgcctggagctacttctgcaccatccccaccaccaccaccacccccctgtagttcatcaaatcaactgtctgctccgccaccgcctcctccaagcttctcaaagaacaatggcagtattgcgcctccgccagcacctcctggtggtaatgctaaattgcctggtatgagggggcgtggacctgcacctccttcaggtccaatgtctaggagccttcaatctggtcaggctgcatccagaaggtccaacttgaagcccctacactgggttaaagtaacaagagcaatgcagggaagtctctgggaggagtcacagaaaactgacgaagcttcaaagtattgtaccaacacaaccacactcatagatggttatgtacattatgagttctatgttaatgcatcttttcgatgacttgtgcagacctccagtgtttgacatgtcagaactagaacatcttttctcagctgtcctgccaagttcagatgggaagcgttcagataagtcaggaagtcgtgcatctggatcaaaaccagaaaagattcaccttgtgagtttttccaaaagatatagcatatattgttgttcggcaattcttctgttaatctgctaaaatgctaacctgcattctttcaatgcatgtataaatatgatttcttgcgagttatgacattcagaacatggatattaattctcttgttggcacatattttcatcatgtacttattctctttattttttactttctggcttccatcgaggcaaacctttcatatctgtgcacaaaaggctttcagttgtaatcatactggttagtgtgcataaattttctagtgcattgccatgatagtttccagtatcactacaaaattgtaccaatcatgttctatatgaggtttcactagtaattgatagatctccttattatagctatagaaatatataatacaataccgctgttttttcatgttgtacttgatattttcatagacttctacgttaacatgatagacttgttaatgtcttaccattctatctcaaaacaagtaaacacaaacatagtctttgtgctttcttatgtctaaatctcctggacttgcattctcatctgtctaccatgcctaaataaacttcatttgattagtcatggttttatttttttgttacattttgctacaactcactagtaaggttaagacatgctcattctaataattctaatgattttttgtcctttgttcttaatcttaaaaccaaactgctaactgttctagtcagtagaatgaatgaaatgtatgcatagttctcagttcagtaatgcttatgttttagggaaggcctacagtctgtattgtaacagttgattaaacaacatgagggcacagccgtttatatcttatttagaacactgtaagaatggttactatccattttgagagttacttggattctgtaacatcctaattagtcaggttatcacaaagattgataaagggacataaaaagattattagcttacactgtttacaaaagccatctcatgctaatctgcatgtagcagcttaagctttaagttagtaacttgtgtaatatattgagcctgagatgctacctagtatttcaccatttcatcagttcctctcttgagaaatgattgtggcagatatatgctacagaagatttttgcttcattcatgatggtactgtaagttttgatgtgtgccttgttagcttgtttttctttgtcctccattgacctgtaaaatcttggtggttttgtatgtcgaacaatcgattgtaaacaatgttatatcgactatttatctcattctgatatgttactgcctatatacacagattgaccttcgccgagctaataattgcggaatcatgctaacaaaagtcaaaatgcccttgcctgacctaatggtaagctgatgaacaaaaaaatttagcatgttttgtgtaactattctgctattatctgaagctactgatatagttgttcatatgacaatttagaaacttgtgagaatcttctttacataaaggacgctgagaaagtgaaatagtgataataccattttttcttagagtcattggatgtgacaactgtgcgtcatacgctaaatgcttacctatgtgtagtagaaataatctaaagggaattatatcaacagtgttccttctggtcagatggctacttttgcatttggattgctgttaattatattgatcattattttcttttgaacgcagagcgcaattcttactttggatgatactatcctagatgctgatcaggtggaaaaccttattaagttcactccaactaaagaggaagcagaacttctgaaggtgatttgattactagggtctaatgtagttttcatttctaaaaacattctttcgattcatactatgctttctcgtaagaactaatgctcggttatgattaccagggttacaaaggagataagcaagtacttggagaatgtgagcaggtgacctatattctttcagtttgctttaaagctagtcagttccacatataaagtgaaaaatgtgatgtatatgctaccctctttagtgggaaggcattcccatagaactccgtattgcacgaaatccataattgacaatttacagaacacactccagaaaagttttttcgttaactgattccgagataccatattctgctttctgctgcagttcttcatggagcttatgaaattaccccgtgtggattctaagctgagagttttcttatttaagattcaattcccttctcaggtaagacaagtgatttacttattttgctactaagaactgtgatcttttggttggcccttttggtatttgaagttcatttttcccaaactacttttgtgcaggtttctgaccttaagaggagcctgaacattgtcaactcttccgcggaagaggtggggcaattattgttaattacaaatttcttattatataatagttaagattatgcatttcataacatttctatgatgttcacagataaggggttcagctaagctgaaaaggattatgcagacaattctttcactgggaaatgcgttaaaccaaggaactgctagaggtaatgaaaattgtagaagtattagttgtccaagagaatatttggtgagcaaccaagtgctattcttatttttttcataaagactatttgaaaatcttgttaattatcctttgtaatctggcatgttcgctcgttctgcatacctgctctgcattctttacaagaagtttgcctatactgcatctaagcatctacctagttaggaactgagcctagctcagttggtcgagggtgtggatgtacgcgcagaccacccaagttcatgtcctagttgaggcaaatttgggtgcctatttcttcttaattaaaaaaagccacctagttcctcgtaggttggtcgagtgttttttgttgctcttagtttctaaaatgaagtttctttttttttctgcaggttctgctgttgggttcaggttggatagcttactcaaactaagtgacactcgtgcacgtaacaataagatgactttaatgcattatttatccaaggtatccctctgtttataactttgcatatgtgtatatagtttaattctatttagtctctcagaaagcacatgatccattctccaatgtctatatgccgtatagataggatgacatacccaacagaaagatgaaatacttagtctaaacttaaattgttgtcattatctgattatgatgatgtgcggggagcccaaattcctgagctagatggtcctttgttgtatgaactctcaatcaattatattcttacctctctttcacaattttttaaaaaatattcttaccttagccttggatgccaagcatgtaaaattctttcttccgttatgaacctttgaagttatttttttctaataaaaccagtgtaaaagccacaaataataaccaatttatatgacatgtttttggaaacttggatgagtggaacttgtgtttctggtgagaaatctggagcatgttcacatatttaatttgctttcgtgattgtcccgttagctagttattgctgtagtttgttaatctaagttgcatatctagtttcttgtgccttgatgtactcatggtggattcttgataaaagaagactagacattatccagaaacccatttcactaagtactgttcaactttgcatcctttatatcctcaaatgtcctttagatttctttttgtttgtgtgtgactttaagatttaaatattagcttcttgagaaccctaacctataatgatcctgatttcaaagtggagctaagccccctccaagtagatcctttgtgtcattctgataaagacctttgtaacttggtaattatatttgtttcttttgattatgtgtgataaagtctgaattatagttgatatgcttgaactgtacagtgcttactttaagttatgacttacaggtgctttctgagaaacttccagaacttcttgattttcctaaagatctcgctagcttggagttggcagcaaaggtattagattcaagcagtgtttaatgttttgtttactttgtatgttgatcatcaatcattgattgattgagttcgaagtgaattgatttgatgcaggtacaattgaagtcattagcagaggaaatgcaggccataaacaaaggactcgaaaaagtcgagcaagaactaactacatcagaaaatgatggccctgtgtcagagatattccgcaaggtaactacaagtgttataattttctgagcattcttagtaactgacttcaactggttcactcctatattgggtacatctaggtaccatcgttctgtttaacatttaaatgagttccattaccaatatactaaactaactgccttgttttacagacactgaaggattttctaagtggtgctgaagctgaagttagatccttgacctcactatattctaatgtggtatgtgtctctttgattaactttcatgcctgaactgtagcgcccgttctatgtttggtagcctgttatccacactccaactactatgtttaactcatacaacaacattgtatgatcagaatttacaatatcgtgctacaaggggctagtgacgaattctagtccttgtctttacaggaggcaaatgatattctttttccatctggtcatctctttggatttttcttctctttatcattacatgtatcttatatatctgcagggaagaaatgctgatgcattagcactttattttggagaagacccagcacgttgtccatttgagcaaggtgaaacttgcattgtatttctattttctccagctgtatagaaactagtttcagttcagttatgactttgggagaacatactgacattagttttttttttttccaaattatatcttgttcacaaatgtttgccagtggtcattacactccaaaactttgtgagattgttcgtacgttcccatgatgagaactgcaaacaattggatctagaaaagaagaaagcactgaaggaagcagaagcagagaaaaccaagaaggagccagaaaacgcacagaaaactaaggaaccaggaaatgacaaagctaagcacaacaattcaatcaaagagttggatatctcactccaatcaccagcgcaaactgccagtgccaaatgatataacttctcttgacagatgagccaaacaacactagctttgccaataaaggaaacctgttcatggtgcctgctcctatcagtcaccctctctagctgatgtcagctggatatgttgcgctggatgatggattgaagtgaaccagctgtggcaagaaagtcgcaaagtgaatgggtaagcatcctaaagttatgcagttttttatacattttctcttgaataaataggacaaaacaaatcagtgttaagcaagttatatttgtgcttctctttgacttaaggcttcattttctggcagcccattcagcattctgtcctctgcagttattcatctaacagagcgattgatacttaagaaatgttcctggagacaagctgtacagttctaacaaaataatagaaatgatcagaagcacatttacaattttgtttatttgttccaatcatatgtaggtaatgttcgttctaacagaagaataaaatttatcagtagaatcgtgtttagggggactagcctgtaggttttgttgtaaaaggaaaaaacaaataatggctgattgtattgtatttcttgtctcatcgccgattctctgaaatgttgcttgccctagcagtacttggtaatgctgaaacccaacgctgtatggaaagatgatatggatgcagagatttcaaagagttaaagacctgaggctttgtttggtctagtaccataccaaaaggttgatagtgccaaaacctgggcatgttttagcattacctatttttttaagagtaaagtagtatttggtttgatgccaattagaagctaaaactttgattagaatatataaagcatcaaattggatattggcaataccaccatgtctactattcaagctacatttattggttggggacgtttcggcttcaatccaaaacatggagggttctggtagttgttttgttaggattgacctaatatgctagttgtatgattgtatgattatatattctactcctataaactgttacatgaacatttctaagaccattaagttttaactgtaaggttgatccacaaacacaaataagctttgtttgtttcattgcaactaattctagtatacgtacttttgaagggtgtgtatacgctggttagtttccttctttaccttttatacagtttgcagggcaatttgcagcctcctaacgcgcgttcaagtaatccttgattttactaaatttctattaaaataaaaagggacccgcttatataagaactatgggcaataagatttttaacataataaaatagggtaatacgtttacagtttcaccactatacagcttccacctttctatttatgatatcatagctattgtttctagcttattattattacacagaagtaggggtgggctaaaaatcctagagatcaaactgaaccgagcctggagggcatcgacagccatgcgcgaatgcggtggctgcacagggcccttgatttttggaggcccccacctccgagtgggcaacatgcctggcctgctatggtgctaccgagcgagcgaaagggcggcaccgctcatcgggcatgccacagcggtgcaaccgcagcggcgagcgacagtgaggcaagcctgccggctgggtgctggccgtggctggctctgcggcctcagcctcttcatcatctcttcgccgtcgactcctccatcttgtctggtaatatcttatcgtctttggcatggtcatctactcatagcattttcttttcatttcttttgtgaagccgtgtgttttctctggttgcagttgcatatagtacgtgcctgtcaatccattcgaccaagttgatatacgctcctttgcaattatttactgcgtactacttttctcacgttggtcatcgattgggctggatatatattcggtatatgataatttgaatcaaattcgcaattaccaatttaccatgattgtagttttcaaaattaaattacagtattttgaatgatagattagattgatcattgaacatgactgtcttttcttttgtttacaaaataggaagacatttatttcctcgaccctcagcatgtcttatagaaataagaagtataattcgggtgctgaaaatgatgtcttggacaatattaattatgaggatataatttaagatttcatccaataaaacgccagatgcttttcagtagaacatgatatcaatactaccttttctcttttagcactaatatttgacataaagtatgcttaattgtttacactagcattatttttttagaatttagggtccaatttgcatttcgttctagggctccaaattcttggagatgccctgccgagcaaattccggtttttggtttgtaaggctatatggtagatgttaggttggtttcttgaggatatttcaggctagtttgattggaaaatgttggttcacgggcgcccgacgcgcgtggctatccatcaggctgtggcgcagccgttggatgtcatccaacgcatcgtacggctttaatcgctcccacgcccgtgtcctgttgcaaccaccagccggaaatcacgggattcccgttataggggaggaggagatccgtttctttttttttttccagtggtttggacgtaatggagcttggcgaccccgtgagcgacgggtgagatccggcggcggtttttgggcgaggcggcgccagcaacagccctctcttctccggcgccggcgttgtttctccccccgtgctcgctttccatacattgccgccgttgacgggggagtagctatgcctagtttcgccggcgaaaactagggtttggaggagcgcgaggctacatcccctcctcatttctcaggtgagctcgtagctccggtgagcaacccgtcggccgtcgtccccttgctgtgaactactcatgtttgtttcatactactgtttctacatgtcccactgtgtttgttatgactgtttcagtattttcttccattatgttgcaccattttacttagactaacctcagcacaattaattttaatgttttagcacagtctttgtagatgtttcagttggctatccatgcttgtttcattatattaataaaacttgtttcaccacatttttgcatgtttgttgtgaactactcatgatttgtttcatactactgtttctacatgccccactgtgtttgttatgactgtttcagtatgttcattcattatgttgcaccattttacttagactaacctcagcataattaattttaatgtttcagcacggtctttgtagatgttccagttggctattcatgcttgtttcattatattaataaaacttgtttcaccaaataacaggctactagacccatccttgaagattgtaggcttccatgtttcacttaagtacttctgagctgcaatgaaaccaaggggagaaatgagcaatgaagtactggcttgttggatagaaatgtttaatgaagagtgtagagaagatagcaaaatgcaatcaaacataaaaaaatattttttatatgtcttctctccaatcatatcggtatttttttaatctagctcccttttttatcctttttttttgcaatttctccttttgctttttttaatcctaatttttccccctatgtattcgaatgttctttcaccccccggagtcagttgattgctgagacaaacaagtttcagcctaacacctgttcaaggaggcttcaagtgattaacaaggagaaacttgtgaaacaggacttgcgaaacaggagaagaaacaaggaggacaatgtttcagtgaatacatcatacttgtttcatctattacatatattttgtttcactaaattcaaataatatgttccacaaggtcaaaaaaagtctccaatcatacactgccagatgaaattgtttcagtatatactcattactagtttcagtgtttacattcatgttgtttcactaaacttaagacaatgcatgaaacaaaaccaaattggttagaacaagctattttcatcaaacctacaattggtacacatcatggggaggtaggggagctgacagtgctactcgactattcgccgaagaactcatcgccgtcggttcttcaatggaaattccttttttcttcggacggcacgattgcgcttcaatatctccgcatcaaatgtgacatttgttccagaagagcgtggttggtgcagagaagagtgtgccggctcctgtcgatgttgcagagcagcggggtagaagtgggcgtgcggcggcgccggtcggggcgttgcagtgtggcgggggagaagacggcttgcggcggcgccaattgtcattggagatctgaggcacggcggcgacgcccagcacggccgggaggagcatcttcgaaggagatcaacggtggcggtggtggctgctccggcggaactctcccctcacgtgcgccggcggtggctcgcgcctggacagcgccgtggaacaagccccgcgatttgttgcagtaggcgccgactgattgaaactcctgtttaatgcacgcagacggacgagattagggtgctggatcggacggctcggacgggcgcccgattttttttctcccagatcgggtgcccgattcgtagtggcttccagtttgatttgctattatattaaaatatttataatgtcaaaacctagacaatttttgacattgctaatattttgacgacattggtcgatatgtcagtgaagaatcatttcaaaagtactattcaaaaacatcaatgatttggtaacacaagttctggttttaaaccaaaacagcccttcggggctagaggcccaggccacggtgcccgtcgcgccacccattccaaggcctgacagcatgcatggtcacgttttagtggccagttcataattcaatttccacagttaaaacagatctgtttagggtgtattttcatctagatcgttgaagaaatctatgtctatcgaattttaaaaatgaaacaggtaagtttctttatatcttccccagagatagaattttagtgcacgtaaaacgagaaagctctttagcacatgattaattaaatattaataagtataaacttgaaaaattaatttatttgaattttttaaacaacttccatatagatttttttaaaaaaaattatttaatagtttgaaaagcgttaacggaaaatgaagaagttgaagtctggagttgaagaaaagaactgagccttaggttatgtttggtatagcttctactccatcttttctgaagctggaacccaaccaaacaatttcaacttcattttaaaataaatgagtgaaactgagtggagtagtctgacaaaataaattagcgatatagaattagggttaggctaactgtttcacaaccccacttcaaatccaacttctaagttaagtactccatataagttggagtctttattctacttcctccgtattatattttaagactttctagtattgcccgaattcatatatatgttaattaatctagatatacacatatggaggtagttttataatctgaaacggaggtagtcccttataagaatctcgggtttgggggcaatgtttcctctagacgaagagtggctaacaccccgtcactccaacctcatgcatggctggagtaacgtacgtaaccatgcatgaacgaacaccaaatcactcgaggttgaagacaactagctagccacctaagaaacgagaaacgagaaacgagaaacgagaaagatg

SEQ ID NO: 74007 - DNA, 18268 bp, Oryza sativa
cttcttcctggcgagggtgtggatccgggcgctggacgtggtgggggtgtcgcacctgcccttcacccgccaggagaacaccctcatccagatcgccgtcgtctcctgctccaccatcgccttcagcggtattccctccatttcatataactacgagagtaattttgacttttttctatagtcgtttaagtaaatttatagaaaaatttagcaacgtatgtagcaccaaattaatttcattaaaatcaatatttaatatattttaataatatgtttattttatatttaaaatgttgttatattttcatacaaactagcatggtggcccgtgcagattgcgcggctagcatcattaaattttctctcatataatagcatatatgtttactcattatattactcaaatatattaaaatgacaacataattttaaattttgcaataactttacaaaactactaatgtgtaatatttatatcatattttatatacgagttagttattaattatttttaatatcaaattttagttatttgtaaattatatatattcctatatgaactctagactcgtcttttaatatttctttttttagttccgaattttctgtaaattgtatttctatatagactctaagctcttcttccaatattatttatttttatttctgaatttttattatttctaattatatttctatgtggactctaaacttatctttcaatattctttaatttttaatttcgaattttagttacttctaaattgtattcctatattgactttaaactcttcttcccatgttttcttaatttcgaattttagttatttgtaaattatatttttatacttttagtttttatacggactcaaaactctacttttaattttattatgtttattccaaattttagttagttttaaattcttatatggactctatactctacttctaatattccttttttttaattccgaatttattttttttttctaattgtatttctatatggactctatactccacttctaatattccttatttttaattccgaatttcagttatttcctgattgtatttctatatggactctatactccacttctaatatttcttatttttaattccgaatttcaattatttcctgattgtgtttctatatggactctatactccacttctaatatttcttatttttaattccgaatttcaattatttcctgattgtatttctatatggactctatactccacttctaatattccttattttaaattccgaatttcagttatttcctaattgtatttctatatggactctatactccacttctaatattccttatttttaattccgaatttcagttatttcctaattgtatttctatatggattctagcctcctcttctaatatttcttattttttaattccgaatttcagctatttctaaattgtatttctatatggactctgctttttctttttctctgattaatgtgagaatttctagaccatgagagcgaacgtagatgctcctttattccttatttttaattccgaatttcagtaatttcctgattgtatttctatatgtactctatactctacttctaatatttcttatttttaattccgaatttcaattatttcctgattgtatttctatatggactctatactccacttctaatattccttatttttaattctgaatttcagttatttcctgattgtatttctatatggactctatactctacttctaatatttcttatttttaattccgaatttcaattatttccttattgtatttctatatggactctatactctacttctaatattccttatttttaatttcggatttcagttatttcctaattgtatttctatatggactctatactccacttctaatattccttatttttaattccgaatttcagttatttcctaattgtatttctatatggattctagcctcctcttctaatattccttattttttaattccgaatttcagctatttctaaattgtatttctatatggactctgcattttctttttctccgattaatgtgagaatttctagaccatgagagcgaacgtggatgctcctttttctattcctttaataatataactagctgggtggcccgcgcaactgcgcggctagcaacaaaacaatattttttggtatgattttacttaaattttattaaatatctatttcattgtcttaagactttgaaaaaccaaacattatcatccacgtatttctaattatataatttttaaaagtcgcaccagctgctaccccttacttctatcatatccttctttatttgcttgctcgatctaccactatttttattcattctctttgaaacctttaaaaatttgatcttagtttttagaggttattgtctcgctgggtttcgtttttataatttctagaaatcccgtcaaaggctgccattatacttctctacggcccgtccactgtctttttctttattgtcattgggattttaaaaatcgaacataattatcattcgggttcattttttttactttctaaaagtcccaccaaaccgtcagcggctttgccattgtactcctttatggctcgcccgttgtctccattctttattgtcatttagattttaaaattgaacatgattattattaggttttttttttttactttttagaagttctgaaccttaattgaaccttatagtttttagagtttattgtcttgttgggtttcattttttgtaacttttagaagtcccgtcaaacgatgccagtatactcctctacggcccatatgccgcccactctttattgtcattgggattctaaaagtcgaacataactatagttggaattcatttttttattttctagaggtcccgccaaccatcgggagctctgcaactatactcttatacaccccgcccgctgcttctactttttattattattgagattttaaaaatcgaatatgattataaatggggtttattttttaactttctagaagtcccggcaatcgccttgctcgtttgcttcacggcctgcctgtcatccctccttttaatcatcattaggattctatttggtgttttattaacaatttttatatgtagtatcaaccgctaccactctactcctttataggcttgttacttaatttatctcgtcatgtattttaaatggccttttctttcaatagtctttattttttatcaccaattttagttatttataaattgtattcctaattaaaatcttttctctttttataatttcagaatttattttttaaaaatattttttattttaatattttaatttttgaatttcatgtgtttcaaaattgtattcctacttgaattctcttttaattttctaattttggatattatttatttttattctaaattttaattaatcttgtattgggttcttatatggattcttctttcaatattgcttatttttaattccgaattttagttaattttaaattatattcctacttgaactcttcttttctttttgctaatttcagattttatttttatttttattttgaatattaattaatctcgtatatggactcttctctcaatattccttatttttaattctgaatttcaattattttaaattgtattcctacttggactctccttttcttttctaatttcagattttattttatttttattctatattttgattaatctcgtattaggttcttatacggactcttctttccatattatttttttttaattccgaatttcagctatttttaaactgtatttctatttggactttcctttttttttctccgattaatgtgagaatttctagcccttacagcgaacgtggtgcctcctttcaaggctgttttaataatataatagatagatagatttgttcaaaccttgatcaaacataattaaatttgactagaaaaactcataatatgtggaacggagatggtatctccattaatttgctgcaattaagcctcatttgaattatactccctctgctattaattttatttatcgaaataggtttgtaaagtctaattattttatgatattattattatagcatttttcaagacaaatctacgcataccaaatttataaaaagaaaattaacataagatatttatgacgagagaaagtactaattaagcggttatatgcggttagtataagagattaatttgctaagcttcaaacatggaatcaatgaaaaatgatatgtgattacattttcatttaattgctccaactagacttcgaactgggaaaactagcaaaaacgtacacagacaaacttaataagataacaaaagaaatggagagaatttacttgctttgacaagtgtaaatagctagggtaccaaatgttttttatatatatcgttgacgtcttaccgcttggaatttacaatttattgttttttataattgtgcaaattttaggtggatttgggacgtacatacttgggatgagcggcaagtcggccaacgaggggcacatcggcagtcatgggaggaacgtggaggagcccaacatagggcgggtcatcgccttcctcttcctcgtcaacttctccgggctgtttatcatcgtgcccctcaggaagatgatgatcatccgccaccggctcacgttccccagcggcaccgccaccgctcacctcatcaacagcttccataccccacatggagccaagcaagcaaggtacctaaccaataataataataataataataataataataataataataataatcagccaagatgatcatggccaattaatagtgctttgatcatcatctctttcaagaaataatgctttctttgagaaataatgctttgatcatggcaaataatttgtcatggagaaattcatgagttgtgatttatttgattctgtgttgtctgcaggctgcaggtggtgacgctgttcaagtccctcggtgcaacagtgctgtggcctattttccagtggttcttcgccggagggaagaactgtggtttccagatcttccccacgtttggcatggcggcatatcgccgcgggtaagtgagaagtttgaagtttgaaacctcactattgtccagagatttacaaaatttcgttcagtccggccccaaaattgtttggcatatttcaaaatgtaaaactccttactgccatagtaaagcaaccaaaatagatcacatttccattattgttaccaacattttacaacaggttctacttcgacttctcgacgaccaacgtcggcatcggcatgatctgcccgccgatgatcactgcctcgatgctcgccggctccatcgtgtcgtggggcatcctgtggccgtacatcgagacgaaggccgggaggtggttcccggagaacctcgacgccaacgacctcggcggcatcatgggctaccgggtgttcgtcggcgtgtccatgatcctcgctgacggcctcttcaccatcctctccgcgctggtcaggactgcctgcgccatgcgcaagcgccgccgcggagcttccacggtgacggcggcggtgccgccgttccagtgcctcagcgccacggagcggaccatgcagagcttcgacgaccgccggcgggcgcaggtgttccttcgcgacagtttccccacctgggtcgccgtcgcgtcgtacgccgccctggccgcgctctccgtcgtcgccgtgccgctcctgtacccgcagctcgggcaccgccacgtcgcggcggcctacgtcgccgcgccggtgttcgcgttctgcaacgcgtacggcgtgggcgtcaccgacatgaacctctcggcgacgtacggcaagatcgccatgatggtgttcagctcctgggtcgggatggacggcggcggcgtcgtggcggggctcgccgcgtgcgggatcatcgtcagcgccgtctccggctcgtccgatttcatgcaggacttcaagacggggtacctgacgctcacctcccctcgcgccatgctcgtcggccaggtcgccggcacggcgctcggctgcgtcgtcaacccggccatcttctgggtcttctacaaggtgtacaacatgggcggcggcggcggtgacggcgccgacgtcgcaccgtacgcgagggcgtaccgcggcatagccgtgctcagcgtcggccggcacgggctgccggaccacagcgtcctcctctgcaagctcttcttcgcgatggcactcgccctgagcgcggcgagggaggtggcggagcggaggaggtggcgcgcgctgcggtacatcccgagcacgatcggcgtggccgtggcgttcttcgtgccaccgaggatacctgtgggcatggccgtggggtgcctggcgctgcacgtgtggaggaggcacgtcgacgccggcggcgcgcggctgctgttgccggcggtggcgtcggggctcatctgcggcgacgggctcgggtcgctagcgtcgtcgatgctgacgctgctcagggcgcggccgccgatctgcattaagttcgtgtctcgcttcgagaaccagaagctggatgctttcctcgcaacacggcatgcttaattagtcctagacttgtacttcctccgtattgacgccgttgacttttcgaccaatgtttaactatttgttttatttaaaattttttatgcaaatataaaaatatttatgtcatgtttaaagaacatttgatgacgaatcaagtcataataaaataaatgataattacgtaaattttttaaataagatgaatggtcaaacgttggacaaaaagtcaacggtgtcatacattaaaatatggaggtagtatatagttattttttctgcaaaagcatgtgtgtgtatatgtgtgtatatacatatacatatatatactctctccatcaaaacaacctaacctaatcgaggatgtgatacaatctaggataggataacgaatctgttcctatgttgtcttatcatcacatagctttagttttttctttacggtagtaggttgaggttatttggacggagtgagtattattcagtcatttttgcataatttttatataggaaatgtgatgcccacctagattgaaaacgccaccaaggaaaatgatttcatcgtgagaaagattcggtgggagcagagtgaaataaattcaacgaaaccaaaacttaaccaattttgaagggaataagttcacttttggtccctcacaatttatcgtcgagtccaaaatccattcctggactgcaaaaccagatacaacttatcccctaacttagaaaactagtgtaaataagatctcttgatagtattgtccccattttggctgatatgacgcctacgtggctctttagactaaatctttgtcccacgcgcattgacgtgacgcttacgtggcaatttgatccgaaaaaaataaaaggagaaaaattagaaaaaaatatgcggggccatatgtctaatgtctacaagaagataaaaaataatgggacacatatgtcaatgggtcccacgtagggatgcgaccacatgcagcgaggaacgtgggcgacgccgcagcctcgctccatcgccggcacacccccctgagacaaaagtagcttgcggcaggagctgcgctaaggcgctcatctcccctcacccctcgcagttgcgtttcttgctccaaccgctgccgccacacctctctactcctggggatgacgaggatggatatgagatagcagcgaggctgtgtcgcactagcgccgctctcctcctcgtcgtcggtggtcgtggggctaggagctcccacagggccctcgctgatggtgaccacgggcggggagatgttggcggcggcctctgcggttgtggcctcccatgcggccggctaggtttcttcgccgccggattcttctggggatggctcctcggatgactcgaagaaagggcttatcgcctcctccgcctctgcgtcggggcgccctttggggcctccttctcctctggctttttcctctcttctcacccttccgcctctctctctaccactgaacctagctgctctagccgccggcggccggcgacgttgacggtggggtcgtaccggtcgacagggaggagggacaccttcgcggcgtcaggtccaccaccacgcgtgatcgcggaggaggatgggatggagatgaggagcacaccagtcgcggagggcggcgtgagtatggacataaggagcaaaaccatcaccatgcagagccctccgtgccgccgtggaggagttcgcccccggtggcgggatccatcccgcgccagcgccaacggaggagacggtgagattcgggaggagcaggagaggagagggaaagataggggtgatgatgtgggtcccaatgtaatattttttttacttttatccgaacactcactaacatgtgggtcccacagtttttacgagtcttaagtgccacatcaacaccacgtaggtgccacaatcagtcaaaactgctgtccaaaccaccttgatacctaatttgcaatagttttgagagttcagagacgtgtcatatctggtattgtggttcagggacaaattttgaactcggtgacaatgagggacctaaagaaaacttattctattttgaagggaagtagaggtgcagatgggcctgataatggtttaaagcccacttcaaccccagcccaaccaaatataatacatagcccaaatcatctcagtccacagacatctcaaaccaaactaaacaagcccaaatccctcctacggcccaattccccacctacccttgctggacgacgccgatcctatccattcagccattcgtctcgtctctccgcctcaagccctcgaccacctgtcgccgcgctaccttccctcctctcgcccgtgacctcgcgctagcataggcacgcccattgtgggcttcgtaccctttaccagtgcctccgaggtgcttgcactgtgggatgagtgtctttggactaactttttgggctaggggtacgggccccatagcttgcactgtgagaggccttaggcctctcacagtgctcctagctggactgtggcttagtagcgccacgtctgttttttgcctgcgtgtcgctcggccccgcgcctctgcttgggcgctcgtgaccaaactcggatgcgcaaaacctggcctggaaaaggggccgcacggaggaatcgaggggaggcgcgtgcactgtgggtgtcgttccctcgccacccggtgctctcgcatgggattcggccggcgaaatcccctattcaccctcgaaaagccacccgattcccctcctcccgccactgatttcgtagctcccgcgccggattggagtgcctcttgcctcagcgccgctgttcttccacctcgacctcgccgccctgaagtctcaattcaggacggcctcgccatcgcctccgacggcgccggaggtgccactgccgcgctccgctctaggatcttcagtcatcgtcgaggtctccatcgccatcgtgagaggtagcggtcagcaaaccctctccccaactcatagtttgaccgatttgccaagccttggttcgctgattcgatctctccatgtgatgcaaaccctagttgcagatggatccgcggctagccgatgcttttgcccgtttcctccaagatccggcatcagcggcggcgatattgcagtccctaagccagccgtcgtcggtccctctataggatcaaggcggccgactagaggggggtgaataggcggtttttaaaacttttggctaaaaccaagttttgtatgcggaagcgtaaatcaaaatggttttgcacaattcaaaacctaaatcaactagtctcaagtaagtgcacaaagaagctagcctatgttgaggtttgcaagcctagggtaataatagcacaaataaactctagtatgtaaacttgctcaaagtaaatttgcacaaactaaaggagacaagaaataaggaatttttcaccgaggttcggaaacttgccagtttcctaatccccgttgaggcgagcccaactccaccgctcaaccacgaagccaccgcacgcccccttcgtcaaggggtgggcaaggcgggagtcggcccacggagaggactaccaaagcctcgatcactagggtagttcttccttcactccgaaggtggtgaaccccaaaccactcacaaccggcgccgggcctcctccacaatctcctcggagaggtcaccgagcaacacttccacaagctgtctaggaggcagcaacctccaagagtaacaagtctaggatgcttgccgaggatgatcaagtgccacactagctataacaatgaagcaatgcacttggattggcttaactcactctctaacacctcactagataaactaagtgcacaagggtgtgagagctcttgcaagggttcaagataatcaggggtgaaaacggagcggatattatccgatccgatccgatccgaatccgtccgatgtgaggatatggtaagggttgttagatatccggccggatgcggatgcggatgcggattttgtcatgcggatgcggatgcggatgtggtatcaatgatatccgacagattcggattatccgattttttaatcagattatccgatatagtgtttggcggataatccgcaactttcaggcccatctagcattcttgcccaataacccatctattctaaccctaatccttcctctcctccccctatcccccagatcggcagatccctctctctctctctctgactctctctctttctcccgtcagctctcagtcgtaggggagtgggcgagtggcggcgcgacagcgagtcgacccagcgcgacggcgacccagcgccggccggccgctcctccttggctgctagcgccgccgccgctcctcctcggctgcagtacaggctggtggcgccgctgccattcgtcctcgcctcctcggctcctcggcgccgccaccactccgtccactgtcgcccatcagcacgtctccagcgccgggccgccagcgcaccgtcgcatccccgtcaccagcccagccgccatccctgttggctgtcgccagcagccatccccgtcgcggcgtcgccactcgccagccaccactgtcgtcagccgtgccgtgtcgtcgtcgtgctgtaactgctcgaggcctagagctgcagctgctgttccagtccaacgacaagtcgacgatagattaggtattgttttcttgtacacttgcagtccaatttgaagtatcaaatttgggatttactgatttagaaatgtagagatgagctttgcttacggaaattacgtcaatagcaagttataatttgattaattgttcatcattcattaggatcgtaaaaaatggcacctagaaaaagaggggcaaaagcagcagctgctgctactgctactgaaagtagcattgctgcctcgtcgccagctccagctgaaggggaagaagggccatcaactgtgggcagtggcaatgaaagtcccaacactattgttgttgttgatgtggataacattggtgcagagggggatggagaccatgaaaccaatgatgaacctgcagcaaagaaagcaaagaagagatagtggaagtgatgcaagtgacttggataaatataaggctgaaccatccctgttggttcctaatggagataaatttgatgttttgtcatggtggaaagctcacaaagatgtatatccagtgctatctcttcttgcccgcgatgtcttgtccattcaagcttccactgttgcttcagaatcagcttttagtgctgggggacgtgttcttgatccatttcgtactaaacttgaacctgaaatggtagaagcactagtctgtaccaaggattggattgctggatatagaagaggtgatcacttgtgtcatttttcatttatatttttgtaaaaggtattcttgttagttgattttttattaatagtctaatatagctttcttccaaatttttcagattctaataaaagggttggatctattcttaatgatctcgaggttgcggagaccttggttgctaatatgacacttgacgagattgatgatatggtatgacattttattgcataaattttgttgcaatacattttgtagtcctatcgtcaaaataaatgtatattgtttgctcatacttataggaaaagcaacagagcagtgatgatgaagaataagtgatgaagtgaggtgtgaaggcttgaagggcatgttggtgtgtggttgtgtgtgcctgtctgcctgtgtgcatgtgcatcgttcactgctatatctgccgtatgcttgtatgcctattgaacaactgtgttgtgtgctgtgctgtatgagatgtatgctctgtgctgtattgctggctcatatgctgcatgcagcatgcatgtcgtactgaactactgatgagtgatgacttataagttatattgttaaattttaagcaatgcagtgaccagtgactaatgagtgatggatgtatcttggattattttgttggatgtgttctattaagcaaaattatattattgatgtgttttggttggtttttcctagagagctgagatcatgtttagatgttattttgccatcgtattgcggctaattgtattggcgtccacttgttgtatggattgaatacaaacttgacatccgacaactttttgtccgtttccgaaccgactccgcaccgaatccgacgtccgaaataatccgctccgcatccgcatccgcacgtcatccgcacccgctccgcatccgtttaaaaaaaatggtttaggatatggtatagctattatccgtccgaatccgatccgttttcacccctaaagataatgcaatggggtgccaaaactttacccttgctgctggggagtgggtatatatacccccaaccaccaaaactagccgttggagtcgaaatccccaactcggtcagaccgccgtcggctcggtctgaccggttgcggctctggcggctttgtatcaccacaaaaaactagaccaatgcaacagactagtggggccggtcggactggccttaccacgccagtcagaccggctaacaggcccggtcagaccggcctaaggccaacggtcagaccgcaggtcacttttcagctcaaccgaccgttagtaaaacgacgatatctcttgactcgggtctcggaatttggcgttcttggactatatggaaagcttattcaaagggccatccaacccatgaaaaaaccatccaagaaacacaacttaagtcaaggataaagggctcacattccaaaggatatccaccggacatacccacaagatgtcactcactcctattggacatgcccacttctctctttgtttaggacttgagaaaactcatcacacatggctagacaagcccaccaaatgcacctatatgcatatgaactaatatggcacaaggtcatccacatgctcgcttcatagacccctcttgatagtacgacgcctatctagcaaatccggtctacaccaaacaccaagaccggaaaaagactaagaaaacattcttagttctattatacctttgccttgcgccatccaacttggggtcaatgcttgagccaagatcaacactcgtgaccatttgcttgaaccatgtttatcccgaggtcttgagcatcctttgtcaagactttcttctcatcacaatcttgacttcactattgtcaacatggcgatgtccttgtcttggtgaccatcaacccatgttgtcatccattagcctcattacggtggaacctattccttttcacatctcaaaggagaacattagtctcaacaaatcggttgtaatccttcacttgatgaccaaccggttgcatatgaaagatatggatatgtttgttgagtattcatttacacctcaagtgtcatatacccgtatgcaagctcaagtgcaaagatccgatataaataataggtaaacaacatggatctagaacatgcacaataaatgtataggatttgctccccctaagtatatgcatacaaagaaatatacaagagagacaagtgtatgcataagtaaagaagaatcaacgggggtttatcctatacacatagagaatgcatatgtagtaatgatgtagaccaatataaaacatataccttcatgatctccatgttcttaatgtaaattagactaaataagatatgactcgagtaaacattagtctcacacttatataacaataacatgaaaatcatacatataaacctatcaaaaaggagataagaagtggtacatatcgttttatctccatgcatttcatccttgtcatgattaaggtccatcaccaaagaatgcatatctaccacatctcatcatcgggaaataacctagttaacaacttatgaaaaagagaggttaatcccataaacatcgatttatcatctatcaccaaagcaacaattacacaaattgtttaatccaagatctttcaatcttttctctcttttgtgatagacaataacccgatataaacaatacaaagagatgagatgaaagataatttcaaatcaaggtagagatcttataatgaacaaaatatagaataagctccccctcaagatgtgcatacatatggatatgaaggaatgcatatgcacataatcaatcaagatcaatgagggagctcacactatattttggatccacaagagagaccaaattagaatatgtgaagtttaatacatacctctcatcatttttactttcatatccaaataagactagtcaaagaaaggctcataaaaacgttagtctcatataattagatttgtcattaatcactgaaaccaaattaaggcacttgaacttacaccctcctcttccgtcgttcccataccctcctccaccattccctctcttctgcacgcagccgccaacagcagcgccgccgccaccttcggccccaacggcaagcactgaacctttggcggcccaggcaactctatgttcggcaccggatgtaggctttgcagcgacatgcaagccttcatcgacctcaagacctggacgctgacactgtgtgacaacagagcctgcccctatccctgcctctacccctgcccctgcccctgtccgtgccgatgagtctattggcaaggccggcaggatgttgtacagtcatgaagaagacattaggctggtaagaatttacttgttgattttagtaaaaaatcgatgctagcagtgtggatgattaatctatgcaaataatagaggtacagaggtctgtgtagctgtgctagagcattttagttaggcaaaatgcgaagaaacaacatctgaattttgtagaggacatacttgtgtactacactgaacatgcaattacataaataagcatcatgtcagtatttgattagtgttaagctagaactacaaccagtgtaagagtaattaaggttcgcaattagaagtgccaataggttgcttttttggtttgctgttcataattctgtttgctataagaagcagaatgctcttcatcttttgtgctgccatgtatttgtactatgctcttcatcttttggtttgttgcatgtatacattactgcaaatatagattcattgacctagttatttccggcaggatgtttccatttggtttgagggtctcaattatttttgttgtttatcatgtatgacattgcagctacctaggtaggtaccattaatttaggagtaggttatcatgctgcctttttgtaatggttgtaggcaagtgcttggctcaaatgttcaacagatcctataggagtgaataggaagggtgagacctattgggtacatgtggccgagacttacaatgagacaactctggatggaaggaagagggatcccacctgtctcaaagggcattggcacaagattacaccgaaggtcactttattcaatgggtgttgcgtgcaactgaggaatacacctatcagtgggaggaatgacgagaagctcatggatgatgccttggcgctctacatcaagcgttcaaagaagcacaagcccttcctctaccaatccagaagtgtaccgccgtgatgcgcatgttggcctatggggtgtgtgcggatcaaaccgatgagtatgttcgcattggtggaaccactgcgtatgaatccctcgaaaggttctgtggaggtgttattgcggtgtttggtccacagtatttgaggaaacctaccttggatgatgtacaacgtctcctatatatgcatgaagaacgtgggtttcctgggatgttggggagcatcgactgtatgcattggagatggatgaactgccctaatggttggaaagggatgtacacacggggtgattatggtatagcaacaataatcctcgaggcagttgcatcacgtgacaaatagatctggaattcattttttggtgtgacggggtctaacaatgatattaacgtgctgaatcaaagcaatgtcttcacggatgtcattatgggtagatctcccattgtgtgatacatggttaacgtgaatcagtacgacttggggtactatcttgctgacgggatatacctggaatgggcaacgctcatgaagtcaattcgtcatccccaattgccgaaagataaattgttcgcacaacgtcaagaatccgcaagaaaggatgttgagtgtgcttttgggattttgaaggcatgcttcagagtggtggaaactcccacgcatttgtggctgatagctgacattagcgatataatgacggcttgtgtaatcatgcgcaacatgatcgtcgaggacgaaggacacgtttgggatactgaagacttggagtttgagggtgactacgagatcgaacctccagaacacacttttgggacaccacaacatattgctagattacttgagcgtgacagccaagttcaaagtcgaacaatgcacaaccgtctaaaaaatgatttggtggagcacatatgggcaaggtagatcctacacgttcatgaacattgatgttttaggaaataaggttatctcggaggaggattggtagttgttcggaaataaggatgatttctcaaatcatccaagttatctaggtgtaggtgtagttttaagaaagaaggaagatttctcaaatcatccaaattatacaggagtaggggtagttttaggaagtaaggatgatttctcaaatcatcaaagttatctaggagtagaggtagttttaacaaaggatgatttctcaaatgtaggcatttacaaatatgaatgaccattgtaaataaataaaggtgctgtatccccaatttgtgcatgccatgtatataaataaatgaattgcaatcggtgccatataaagtgcacaggacaaaacaattaggagataatcagcaacggaccgactaagttcagcaagccaacacaaaataggtcaggtacatacaccatcaactaaccgaaacccacagacatattgctttgacacatgccatcatccaccttacagacaccatacataacccatatcacaacattacacagttcacagtcctagctaaatatataagcatgttatatatctgttgcttccatactatccatgttgtcacgccatgaacctaaccctgcagggaaaaaatacagcatgtcaaaaatggttgtgaattttaaatagagggggacattatatgcagccgtatagttaggctcaagcattggcatcaatacttagttacaaacataactcatgcttcaactacagtgacctaatcatgcagattaggcacattgcaactcataatagcacagatttgagatcccagagcaatcgcggctttcaattttgctagttagaattcacatgttacttcttgcacatatctggcattacaacatctacttcagtcaaccagttctgaagtacaaacactctgtccatcgcccaatgatcatctctacgggaagtatcaagaaccatgcactaaactaatcatacagccaataactaaactttatgaatttgagcaaacatggcacatccaacctgtccataaatttttaacaaaggagcagagccctccattccaatatctcaaatgacaacaaaatcatcccacatctcaaattacaataaaatcatgaaacagctcaaatgacaaacaaatttgaaatgacattcgagtgagatcc

SEQ ID NO: 74008 - DNA, 4838 bp, Oryza sativa
cccatgtacatcgcctcttcacgggtttctaggcaatcgttcccagaatgacccgtgcctccgtagacttcgcacgtaacgtgggagtccaaggccttgacggtgccttggggttttttctcgtggtcgttcaaacgattcatgaggaggtccagttttgcagcgagcaactccatctccttgacggtgtgcattcctcgctgatgggtctatagtcgttcctcgctccagcccatgttggagaccatcttttctaaaagatcgacgactcctctgaccgtcttagaaatgaaggctcctctagctaccgcgtcaaggtgatcatgtgacgtgggagtgagtccattatagaagttttgcaggattaactagtcgtccattccatgatgaggacaggcggccacgtactcctgcagtcgttcccacgcctcgggaatagactcgtctctcgtctgctggaaacttgaaattttgccgcgtagggcgttggttttgcccatcggaaagaactttgataggaatgttgttcagcatttgtcccaggtgttgatcgtagcgcggttggcatagaaccactgcttcgctttcccaatgagagaaaatggaaacaatcagagcctgacgccgtcaggactgatgcccttcatcgtgtacgtgctacagatctccaagaactgttgcaaatgtgagttggcatccttgtttggcttgccacagaacgggctagcctgtgcttggtctagcaatgctagcaggctaggaaattgaagtttcaatttgatcaggatgagaggttgatgctccaatttcaacaggctgggaactggaagctacaatgttgttagctcctcccttcatcaatgttgctagccggctctaagcaatggttgttcaataaattagtaaatgccccatatccaaagtatagtgagggttttttagatgatcaccttcttgtgattcttcttgggctttattcaagtattgtctgcatagctagtcttttgggactaggaatatctgaagtagttggcagtgttcctccttggcttcctcttcctgcaaaatactagacaaaataatgcattaaggtcatcaaactgtattattgagaacagtattatggaggtcaagcagacttgcctttttttggttccattaagggaacacttgtagcttgtttgaatgtggcaaaatttccacaacccttacaccttctcttgcctcttaccagcaccctcttccctgaatcattgtcaattgaagcagttttggatttggacttcctaccaccttcaaggcaagttttggtcctaagctttccgtatcttccatttgtcttcttaggtaaaggtgcacctaacacccttggcaattcaacctatggccagtatgggttgtcacccaatggctttataatcccactataggccttcttgaacaaaatcctcaatgttcacatccatattttgttgggaggttatcaaagccaatgcatgctaacatggttttccagtgtgctgccagtactggttgtaagctttcaccacatgcttaccattactgttgttattgttaacaacttctgcacaaaagctatcagatttcactactgagaggtgacccaaacccggagttcttgccttcagctgctgtgttacagcaggcaagatcttcctactcaccttctctacaattcttctcctcttattccatagaaccataaccaacgctctgtaaatttccgcatggtcacaaattagcaatgccttgtaatccttaatccagttgttaaaactctctgcaagattgttagtaatgtaatcacactttattgttggattgaaaccactcctcatccacttcaatggatgataggtttcaagccaaggaagcacatcactgcaagcttcaataacttctttcatgtgctttttccaaatctccttcctataagccgtttgctgctaagtgcacacatcaccaccaaacctcttcacaaagttcttcattagatggcagaagcattccgtctactcagcatgctcaaacacagtatgtgcaaccttttctaatccttacatgcataggtacaaacagctagtgggttaacatctcctatagctttatgaagttgtctcataaaccactctcaattatcctcagtttcagcatttatgaacccaaaagcttagtggatacatccaatgatgcccatctacggaagtggcagtagcaaagtgaccattccatttgacattcaaagtagttgaatttatactaatgtatggcctacattcctctaagaaaccatctatacagagcctcagagcacaaaaaacctatgaaaatatactttcccacaaacctccacggtatctatctctatcacactccctggtgaagttctcggtacctaagccctccacctataaagcatatgcaaactttcttcccaggtccaatagagctcaaccatagccttttgtctacccctaaatattgtgtcatagttaattgtgcacttctgatcttcttgtagttggctccgcaaggctttagggcccatacctatattcttcctaaggtttggaattgcctttgcagctacccaactgatgtgtggtaattattctcctactgctagaacggcatgtatggaagtctattaacactttcacattcaaaataaatgcaacaatccatcaatttccaaccattatgaaaatatcaaaatgaaattactgaaattcaataccatcactatcttctaattaattaggttgcttatgtccaaccatatgccaagggtaaccatcaaatttacaaccacctatattttcagggtcagttttcaccaacttcaactcaaactccttgattatagcacattgtctcatggctagactaaactccttcatgttaggatacatagtgccaaccttcatgcaaggattattagggtcataagccatgaccatctcccctggtacttcatcatgtacaggtattgatgccccattaatatcttcaacattagtagtaggagctgcagctgctactgcagtaacaccagcacccgtagttccagcaccatcagcagctccaacttcagcagcagcatgtctagccatctcagcctcatcctcagcactcaaaccctatagctggtagaattgctcatcccaatcattttgacaatatctagcctaccttcatcatcattttgagcaagaatctctagcctattccaatcgacaacatcggtactagctgggtcaaaagcaccgtagactggaacttgttcgactactcattcaggcacaatgaggaaaacgaaatcgacggcatgatcagattcgggttcgaccacagctaaaataaccttaggctcttctagcctgaagaaaaataatttggaacacttgttagagtattctctaacaagcaaaaaaaaaagacaaatcaagcttcacaaactaaggagaaaaacatattcttaccccatgactagctcatacctggtacacccaatcaattccaccttattcctagcaccagcattccgtcgggaagtaattaagatgggaacaacggcttcgagaggctgcccttggcgtcggcggcgaggaggggaagggggagggtggcagcagtgagtaggcagaggcggcggcgggaatggcgatggtgacagctaaatctggggcgccgccacgagctataacggagtacgataggggaggagcgactgcatctcgatcccttttcattcactgacctaaagaatgagccaagggcaatttggtcagaacacaactcatttactggcttaatcgagtgaaattggaaaaacgacgaagtagcatgttgcgcgaaggtggcgatggcattttaacaaaacaagttcgcggtgtggcattacaatgaaacccagccttgaatgtggcacaatgtcaattttcttgggcaggcccacactgcagaggcgaggcaacactaacgacgcggcctctacaagcaaactcgagttccaccactggctcacctccgctcttgatgtcaagctgcagccatggatctagagcacgtcccccgggggggctagagcacgtgaccggggagtcctcacctccggagagactggatgctcattctcaactcgtcaccggctgggtcaccagccccaactagcttctctgagaccaactcctccagatccactgcgtgtgatgccacaatgatggggtagccggcgttgccactcttgcctgtgtcgctcggataggctaggtccttcgctgccgccatggaccaaagaatgggagaaaacaaagaaagtggcatggtggatgacatgtgggcctagttagttttttttcgattggattgccacatgtgctggctcggatcaaaaccgctcaaaacagtgcttaggtggttatttgtcaggattgaaatgttcgggctgtaaaatatccagttttgttgtttagaaaagtaattcgtaatgttgcgttcagtggcggaggactcagtaggataaggttttgcttgagccatacctcgctttgaccacaagtaaccccatccactcctcgccttgctccagcactgcagcacgaccaccacggcggcatcgccgatgccgagatatgtaagcgcgaaaggaggaaacaatgctctagcagtaagagcttctgtatttcattccatatgctgtaattttgggatttttggtcaaaaaccgtatccaatcgattccctactagcgctcccaatagatcgagttcccttattcggattattcgttccccacttctagccactcggtttca

SEQ ID NO: 74009 - DNA, 2866 bp, Oryza sativa
catctggtaagaacgggtgccatcctagcagaaatccagactcctgttagtgcactcgacgaccgattcgctagctggctgaagtcttcgttcttctcagagacatgtacgctagaaccctgtagccgatgatcatcgcgaccagagctacaacttctgtcacgccgttgtcaagaggtatggcattgatcagaatgtccgggacaggatgatattgcaccttcagcagtagcctgtacgtgtggtagttgaatgacaggtagcggagccaggatatgaatggtggaactctctgcatatcatgatggagaagagggcaatgcgtaagacggagtaaagacttgttcattcagtatgttcttcagcattgcatcagtaacacagggaagtgcttgctctcacctttacaaagaaccctcctgctagcatgaatgtcatgactgtaactgaagctagagttgttgccttcttgatatccaagaggctagctccaattgccaatcctaatccctgcatgattacttttttcttgagtaacagatttctaatcactgctaatatccttttgaaatatctaagatatatgatggatcaaccaaaatgttccctaacttatgaataaacacaggtgatgactacaacttcatgggaaaattccttggattttgttcccatctcaccatctatttagatagttttgatgttcatcatacattctttttctcatgtaattggtgtgtatatagacagtacaagttcaactaacagaataaacttttagaaaaataaaaaatgctataattcatttcttatataggtttcctcctttagaaaagattaagggccagtttggttcatggcctatgttgggcttaccaatttatgggtcaagtaaacagtacaaacaaaagtttggtttggatccaaatatcggccagcctgaggagaaagaatcggccacgccgtcgacaggagccgaatcgcgggcgtgaaatttgaactcccgcgcgcgcggccacacatcgaccatatgtattctacgctgcacacaaaaatataagaagataagctctagagttcccagttcccatttgtcctctgttttttgacgcccttcatcttctccatccaataaccacatctcctccaaatcttgaccaagaaaacccaagaagatcctcatctggtcatacacactcatcttctaaaccaaccgaaacaaataatagctcaaatggggtagagatttggggctacatctaggagggatgggggcgagttgaaacttgaaaggggagtgactgctcaggagaagaacaggacgagtacgtgtgttgtgattccagcagtagctgtactgactccggcgtgctcagttgctgtgaaaaacaccatcgattgctacaggaaaaggtaatcaactgatgctccatccgtacaatgcttgttcatttgtgctactaatgtagttatttatagtctgccattaccatcttaactagtagcaataaaaaacagtaggttgaataaatcttactgtcttagtgttgatttctttgctcaaaaaaatatacaggtgtccatttacacctcagtaatgttatttttagtcgacaaatctacatgttggctgggcacaatatttattcagtaaattaatttgtttttcactgaaccgacacatttccttaagtaatttgaagctgcgtatgtaatctcatccagatggagaacactcgacaacaatatatgcatcacttcttgctaacgaagaaggctgtagtggtactttgtcttttgatcatcatatggttgaggaacaaatatcgtaggaggagtagtcgcaaaggggtaaaatatgggcccctagtccacagggatgtatggagaacaagtgaactaatcaggctgatcaacatttcagataggacgtgcactcaacaattaagaatgtcccgtgcagtattctacaagctttgtgctcgtcttaggaacaagggactactagttgacacctttcatgtttcagtagaggagcaagtggcaatgtttctgaaaaaggttggacaacaccattctgtttcatgtgttggattctcattttggcgatccggtgagactgtgagtaggtattttcgtattgtgctgcgagccatgtgcgagatagctcgagaactcatttacatcaggtctaccaatacacatagtaagatcaccagcaagaaaaacaaattttatccatatttcaaggtaattctaaacaccaagccataacaatgcatattacaatacattttgtttattttaactctaatgtttcactttgatatgtacataggactgtataggagcactagatggtacacacatcagggcaagtgtgccagccaagaaggtggataggtttagaggccgcaaaccataccccacacagaatgtattagctgctgttgactttgaccttaggttcatatatatcctagcaggttgggaggggtcagctcatgattcccttgtgttgcaagatgcactgtctcgaccaaatggccttaaaatacttgaaggtaattaaacatttcaaagaattcatgattagccttgctataagttgacgttaggctctatgacatgtttgtagggaagttctttttggctgatgctgggtatgctgctaggccgggtatattgccgtcttatcgtcgtgttcggtaccacctaaaagagttccgtggccctcaagggccacatggacctcaaggcccaaaatgccctaaagagcttttcaactatcgtcattcttcacttcggactacgattgaacgagcttttggtgctttgaagaatcgtttcaagattcttatgaata

SEQ ID NO: 74010 - DNA, 2542 bp, Oryza sativa
tgccgagatatgtaagcgcgaaaggaggaaacaatgctctagcagtaagagcttctgtatttcattccatatgctgtaattttgggatttttggtcaaaaaccgtatccaatcgattccctactagcgctcccaatagatcgagttcccttattcggattattcgttccccacttctagccactcggtttcattcccaaacccttccctcgccgctctctcgcgcacgtccggcgaaatgttcccgcgcagcttttctcgcccacctcgaccgccgccaccgtcctttttctcacagccgtcggtgttggctttgctccagggggcgacacatggtgtggcaatgccgaccatgccgattggtggagcaggaccatcgctgccaccgcaagccccaccgccatctcgattcggggtgcttccacgatatagcaagaattggtccaacgccccgcaccgccgcctggccgtcgcgttgtaacaccccgaaaattttgactctaaaatacaaaaacgaaattcagaataataaaaataatcttttccaaaattcatttatgctggaatttgttgttttcctcctgtgcttggaacaaaggatgggtgtctgagaatatgcttgtattttagatttcaaaatattatttgttgaaagaaccatgattatgaaatatgttaattaagaaaatatttgcaaatactaacagccttctcacaaatccttttctatggattaaaacccatgggttgtccttgttttgccaaatagtttctatttggagaaaacccttcttgaaggttaactccctaaggaattattttaccaataaaatgtaatattgattatttcctaagaatcctttcctttaaaaggattacgtcatttggcagttatttttcaaataacaattattaataaagtatttcctggaaatcctatttgcgaagtaaatcccaaaaaggttatattaaaagaaaagactttctcagataaagtctagattaccgccttaaaggcctaaacgagcctgcataatagaatttcttatttgagagcatttgtgtgtttgtgccaagatatcgattgaatcaatattactaagccccaaaggatgccttttgatcgacatccttccttgtcctctctcctctcgtctgttttatttagcacttcggtgcaaaactaatccaagttctgaaactctttccttctatcgcgttgtgatatctctctcgagctcatggaattctatgattaaatcgaaacccactccgttaatttgaatcggcctttcccttgaaaacctaaaatcgttcgacggatttatttctcgtgcatcgacccgaatatcctcggttctatctctaaacttgaaacccaaccacgtcgaatggatttgtatgccatacaccgctcttaaacccctctttgttattgtcatcaattcgttctagtgatcgcaaaggaaattctaaatccaatcctcgaacaaccaaattagccaaataatattcgaaagcctaatcaaatgtcccatcatagagtccttttacaagtttcgaatacaattccaaattccaaaccccctagcaaattataaagttacctagcaattatccaagtcccctattacagttgggccacccttctctcttccagccctacccattccacaacacaagtccattatccctctctctgcatgccgagctctctctccctctcagcccgcttccaggccagcacatcgagccgccgtattcatccaaaatgcctaattggtgaacagttgcacgcctccctcttcacgcagcaaggccacgtggtgcgcgcggagagggggcggcggaacggcgcgggagggaggggtccaggtatgatttttttttcgttttttcttccatatgttcttcagttttcgtgtttttttatgtttttttctttccgtatctttttttagtttttttcgtttttaataagtacgtatacaaactatgtatacgtataaatacaaactttgtatatgtgtatataaactttatatacatgtatttttttggttggtatacgtatgcacgtatacaaagtttgtaaacacgtattttttgggcttttatacgtatgcacacaaactttatatacatgtgtatattttctatgcaccccgagacatgggcaatacagtgagggaaatccacaccccgagttcacaaaaccatgcttaccttgcccttcccctcctgtggcgatgtcgacatccaggtcctgcgccgccgccgtccaacctgtgggcgcgtgccacatcgcctcagccctgtgctttttcccccatgcccatgccgctctgtgccgctacacttggttcaccaccccggccaccccgctccctcgcgctctagccgccgcccttgttcgtccacgtcgaaagcgtgagccgagctcacagcgctgcgtcgccgtcctctcctctcctgtgccgccagccttctccttgaaggaaggaagaaccaactcagcaatctccctcctcgccgtggatata

SEQ ID NO: 74011 - DNA, 5633 bp, Oryza sativa
ccagccagcacccctccctcttcctcctttcccgcgtacatccgccgacgaccaccgccgatcccgtcatcgtcatcaccacacccgagtccagctcgagctcgtcgccgaactacaaccgccccgcacagccaagtcggctgcgcgggagccgcctcagcgtacggccaagtcagccgcgcgagcatcgtccgcagcggtttccacctagctccgggccagtgcccagccgagcatggtcgagccactggcactagtacactagtacagaaccttccatttgtgacggcctctaacatgcttgaaattagtggccgtcacaaggaagtcatctcaatcgggccgaaaaagcgcccgattgagataacttaggcccgtcacggatgacacatatcagtgacgggtgccaacttggggcccgattgagatatgaaatgttatctcaattgggcctaaactacggcccgtcacttatatgtatcatccgtgacgggcctgagttttatgcccatctaacatgccttcgagaccatatctcaataactaggcctgtcatagatgactcatccgtgacagactctatactaatgcccgattgagatgacttagtatttttccattttcatatgaaatgtttatatttgtgagttgacatgtagcaaaataattaactgcagtataataattcattttattagtcaaaaataaaatgatttcaaatgaaaaattgtcaacaacaaagttgtataacttatcaaaatttacaagttttattttggtcatttttctatataacttttttgaacaatttaaatttgaattagaaaatatgacaacttcaaacaatattttcaaatattaaatgatttcaaatggaaacaaagttttataactcatcaagatctataacttttattttggtcatttttctatataactattttttgaatagtttgaatttgaatttaaaaatatgacaacttcaaaacaacattttcaaatactaaatgatttcaactaaaaaagtcatcaacaataaagttgtataactcatcaagatctataacttttattttgatcacttttctatgtaacttttttttgaacagtttgaatttgaatttaaaaatatgacaacttcaaacaacattttcaaataataaatgattttcatctaagaaagtcatcaacgacaaagttgtataactcatcaagatctataacttttatttttgttatttcttcatccgataaagtgttagtaacattgctaacaaaattgacatatctgtgttatagtttataaaacaaaatgagagatatgtgaattttgtaaacaatgttactatcactttgttggataaagaaatgaccaaaataaaagttatacaattttgttgtgatgaccttttcaattgaaatcatttaatatttgaaattgttgtctgaagttatcatattttcaaattcaaattcagactgttcaataaattttatatagagaaattaccaaaataaaagttgtaagtcttgataagttatacaactttgttgttgatgacttttctatttgaaatcatttagtatatgaaagttataaaagttatatcttttataactttcatattttcaaattcaaatacaaatagtttaaaaaatgttatatagaaaaatgaccaaaataaaagttatacgtcttgatgagttatacaactttgttattgacaattttcacatttgaaaccatttactacccgaaaatttatttgaatttcttatattttaaaattcaaattttatatagttcaatcaaacccgaatggagaaatgacctaaataaaattggtagatctcaatgagttctacaactttgtttttgacagttttttatatgagttcatttcgtatcataaaattcaattcaaaatttatttttgcctaaatgtctgatttgactcctcatcatgttaatacttgctaaatatatatttgatccaattaacttggttttgctggtgaaatatgtgaaatatgtgataaaatggatgttatgtgaatgtggttgtgttaaatatattgatagttgtgtatgtgaatgaatgtacaacttcttcttcagaagccgaatcccaaagtgctctgaggttaagcgtgcttagggtggagcaatctcaggatgggtaacccgactgggaaattcttccctagaagagcaatttcgggatgggtgaccaaccgaccagcccacgggcatggctagcaaaggcctaaggctagcaaaaaaataaaatttatttatttttagattatactcatctgtgacgggctataatttaggcccgattgagataagagtcatccgtgatgggctatagttcaggcccgattgagatgagagtcatccgtgacgggttatagtttaggcccgttagagatgagagtcatccgtgacgggctataatgttagcctgattgagatgtgtgtcatgcgtgacggccggatgcccgattgagatattttatcacatcagtgatctttgcttagtgaaggggcgttacctgatagagatgaggctttaggcccgttacacatgaccgaacctgctctagtgtggatgccagcgccgtcaagccggccaccccgtccaaccagtgccccgacctcgtcctgcccggtgccgttcccttcctttcctcctctgcccggctccgccctgactcctcccctctgtgccgcctccctctccctacgcgcaaccgcgccgccacgcccggccgccgcccgcgccgtcgcgcgcctgccgcctctcgctcggacgcacacgcacgtgagacgatgggaacgagagagagacataaggcagacaaattgagaagaaaaccatgagagaagaaaaagaaaaaggaagtgggacccacccttttgactcctcaccgtgagccctttttccctctaaaagtctacatcaagtccccctttctcccttgggccacccgattaacaagtctacaaggcattcttcttggccaagcccaggaaatcaattcctacaaaagtctgtattatttccctcctccaaacctcggaccgtagcccatcagcaatcatcacctccaccaaagtccatccctcctccatttcataggataatcttgggaatatttcctccaaattctgggaaatccttttcctccatttataaaaccatttgaacttcggaaatttgtatcttgcaaaccgtaactccgattgggtccattcaacttccaggatttctctaaaatcgacatctatcaaatggcactactgaattggggggttttgtactttatttgtaggattttggatgtttatctcttattgaccgcataggtgatatttttgatatttaacgaacgtggatttctcaaagatattggattctaaaagcaaggcaaatcactacacatccctccttgagcatgttgaacctatctttataaatgtggtgattaaaaataaaattgcatgctatttataaactgcgtacctaaacttgaatgtaacccacccttgatattgttacatttatatatttgtatatccttgttgcatgagtctattatttatacgcggtcaattattgacattgctagcattgcattgtacagacaattatagataccatgtttattatatggatatggatgtgagatcactcgatgcgagtgattaatggtttatggctagagacatgagcgccacccgcgacacaaaaaccttttgcgaaaactaaaacttaataaaacaaaacaattttgactggagtggcatggatagaatatgggtggatctatgaaacggctagtcgccgaccctggtcaattaagcaccgagtcaaaaagctatacagtaaacaaaccgagtacgaccgcacttttcaaatgggtaaacccgacggactaagaaattctcgtggggcggcaccctagtcatggtggttctataggacgttggttttgttgcagtgttgtgatttggataatgtcaacgaaaccaaaaatgcgcctaactatatttaaaatgtaactgcctgttatcccgggagtgccaggactcccttcacttctggctcgaggtagggatggtttgccggggtgaaatgggcgctcattgtccttggagcgggtgccgtaacacgagggtgactgaaaaaccagaccatgacaagtctcatgtgtggggactaggctcatgggttgggtatattatggagtgcgggattaaaataatacatccactgcggtgtgattaaaccaatctattcgaatagccttgctcgcggttaatgagcgccgagacttgtattactctagactagccccataagtttttaatactgcttatattagaaatggaaaggaatgtgtgaccttgcccgatgtgtgggaaggtcgatatggtaaagattttataaaacaggaggcttggggaaggtggatgaaccctcgataattaatgacaacttcaacttaacgacttaacgtcgataatctaagtcatagatttgtgaaatgaattgtgaaaactagctttatgcaaataaaccaagccatccttgaacccctgtgtgcactaaatgcatcctgtagtggtggcttgcttagtatgattggtactcgccattgcttaattaaattttttagaaggagttgttggagccaacatgtatgtatgctatgcaaacaaagattttcaaaaaaaaaacaaagcactgctacaaacctgcgtctaaattgaacatggagatatgtaggttcttcagaaaatagtcattatacaatctccaatgactagccaatctatcctgatcaattactgcatgacctaaaacagacccaccacgcactgtgcactgcgtgacctaaaacagacccatcgtcgaactcactgtgcactatatcaaccgccgaagaaataaattcttcgtcgccattagatgaagactcttcgtcgcatttggaggagggtgctttgatgactcatctctttttttttaccaccaagttggattgcaagggagagacggccaacagagggaatggagaggtggctagcagcagtggggggatatgagagggtgttagtatttcttaacgacattactagaaatataattcccagcaatagcgcagaaatactcctggtatattatggttacagagttcatccgtaagcgcacggatatatcattgtagcatttcacccgagagtattccaagggtaccatatttatttaatcctgcgggaagatcatagtagagaaaacatgactaataatttatatgttatttgtagtaatcatattctaagtagaggttaagaaaatccaagggtagagtgacacacaagcatggaactactcattctcatattaaaatatctaagctaaatgaaaaaaaaatagaaagagaatctattcctatacttctagtatacatagtatacatacatcctagttatctgatatactagctaataccctctatccgatacccttctagtacttcgagaagccacccctaactgccgagtaccttacgacagcccgtcatgaccatacaaccggggctaaatacggatgagtacccgc

SEQ ID NO: 74012 - DNA, 4043 bp, Oryza sativa
  unsure (1)..(4043): unsure at all n locations
tgaagttaattttaagatattttcaacatattttctttttcagcattagcttttaaatcactaagaatatatataaaaaaattatctacaaattaacttttattttctaataaaccgttttaacttattgggaatatgagcaaacggtgaggttttagggctcgcaaataactaattgtaaataatttagttaattgattaattaataatcctggccccggaggaattaattggtgatgccacatcgtgtacgaacaagtgcatgctacggagtaactaattaataattaattaagacgctgcatgcatctattgcacgcgatcagagaggtcagaggatgaaccttcctttgtgttgtgttacctgcggttgagggacttgcagtatggctcgtcgttgtaggagacgcagccttcgacgtcgccggggccggcgaccctcccgccgaggatgctgagcagcgtcgtcttgccgctccccgacgggcccatcagcgccagcacctcgccgggcgccgccgacccggatatcccgctcaggatctccctcggcgtacccttcaccgccaccttgtacttcacctccgcaaactgcacgaacgaaacgagtctcatctcatgtagcattagctcactgaacctctcgcatgccggcggcgtacgtccatggagcttgggataatcgatgcgtttggtcgatttaccttgagatatatcggcaacgtcggctcggtcatcagcttcttgcgcggcgtcccggcctcgatgtccatcgctgcatacgcacagcggcacagagaatgagaatatatatattagggaagtgatttcatctctcaaggagatcggatatccctcgtttcgtctatattatctaaatatctataaaaaaattaaaaaaattagtaacataaattaatataaaatatatcactccacgaaaatacaaatttaaatccaatttttataagtggtaataaaaatgccaaatataactacgaaaggtccgatacccatatgtgcatgcagttaggatcagtaggagtgatgggacgcatactgttgtcgtcgtcgctaaagggatggagctcggcggagcacatggtgtcctggggagaaggggtaaccccggtaaaggtaaagaaaaacccaagcctggcgctgaaggcgcgcctaagggcgccccgctgaacacaaggtcctccatttcgagcttcagctgcgcgctgcgggacttgcggatgtggctgttgttgttgttgctgctgctgtagccgtggctgttcccaccggcgccggcgccgccggacgccgagcgcttcccgaagctggacttgcgcgacaggctcgtcgtcgtcgtcacgtcggccgtgctcagcaccgtctccgccgacgccgtcctgctcagcgactgcgccgacgacggcggcggcggcggcgccagctggtccgacttggtccgctcaatcatcccccctcccgtgtccatcatcggcttctccattatcgactccatgaacgaacacgaacaaactacctagctaacaccgtcacgttcctagcaagcacatttagagcagtagcttttacacgagacgagccgttatatacacagacacagagtgatgggaaggcaacacacgcagctaaggcatttggcaagcgagcgatggaggtcacgcgtgtgaggtggattgtggcgagggcgacgtgggggggaggcagcggaggggcagggggcgcgccagcgaagcgcgatgcgggacgcggggcattaatggagcgggaaagcgcgggtgtggctgggcgcgctcaggcagccagcttccacacatgccggcctcacgacgacgtatcgcgcagggcacccgcgcgagcccccgcctgcggctagcttagcccgcgacagggacgtccccggccacctcgccttcctcgctctctcgctcgcggaggcctcaggcgcgcgcgcgtcccttgcagatcgatccagcgcgcgtgcgtgtgcgttcggtttaggcgtacgtgcgcgcgggcggcagcggcggcaccgatccttttaagtcagcttattggcttatataatttataagccggtggatttaatgtcctaagtttagtggtttagttatacatctaccttacataagccaaaaaaaacttctccaacctagcttttggcttaatagtgttagagtggcttatggcttccaaaaagccaaacggaaaagctgcttgtttgtttaggtttagacttttcgacttataagttggcttataagcctaaacaaagagggccttagcccctccgcacaaattgaggcgctgggtgtgaaacacaaaatgatgacctatttagcaaatgctaacgtaaaataagtgtttagttcacgccaaaattgaaagtttggttgaaattggaacgatgtgacagaaaagttgaaagtttatgtgtgtaggaaagttttaatgtgatggaaaagtgaaaaaaaaagtttggaactaaactcgtcctaagtaaagttcctttaggcgatacatccatatctttacttgatgccatattatttactccatccgtcccaaaataagcacaactatgagtttccgtgtccaactttgatcgttcatcttaattaatttttttttaaaaaaaaataaaaaacataatttacacataaagtactattcatgttttataatcttacaacaacaaaaatactaataaaaaaattaaataagatgtacgatcaaaattggatactgaaactaatggctgtacttattttggaactgggaagtacaattcattgcagggttgctctatctcccgatcgatgctttaatttttctcgatccaaatcactgtcggactgccggtggtcgtttatccacattccatgttagcataaccacgatcaagcatggtcggatggtcctgttcatcggtttacctatgccttctatcaaacaagcagtaattttgcgcgaccaataacagctaactcatcaccacctaattaaaaacagtatagtggccatatgcctagataggatctaggaagaagacttgtgtgcgtcatgatgtagtgatttaatttttcttactaatgttgtgtttagttccacgttaaaattggaagtttgactaaaattagaagaaaaaatattgaaaatttatgtatgtagaaaaaatttgatgtgatggaaaagttgaaagtttgaagaaatagttaggaactaaataaggtctaagcaagatcttcaatatttggaacgcacattcacatcatgatcatgaactatctttgaggtggccattattgtttccaaacacttgtgagggctgagaaaaacaagcatctaattaaattaatgaaggataaagagattttttattaaaataataatatgaacgcgaaaacatgcttagaatgtactaacggcttaggagtgaaatataaaattttcgagccctaggcaatgtacagcccctatatacgatcttctagccataacacaggaaaattcggagcaggcaaaagtcgtcgatcgcagctgcgcaggagtcaggatggacatgcttggcatgatgcctctttctgttttccgtgctcacactgtcgtcacacagtgcaacgattaccatatatcattcgtgaagagaaacacgagtacacgagcggtcgagcatcctaatctcctttttaattttttttttatttttgaaaacaagcatcctaatcttgacgaggatgaaagtatcagcaacggccccaatgctattgttgacaagagatgtgatgtggctgtggctactggctggaatcnggtactgcatgtagatgtactccactccagtaggcagtacgcctgcacagtcttttcctgactgttacggacgcggaaatgtttgtccggagaggagaatggtctctgctaaccggaagaccggaaccaccgaccaatcgggaaacggcgtggcgttgccagtactgattggtactactgggtagtatctttgacctcttggttaatgcact

SEQ ID NO: 74013 - DNA, 1462 bp, Oryza sativa
  unsure (1)..(1462): unsure at all n locations
gtgggtagatgccgcttttaatgtgtttacccttttagccggcggacctcttaaggtaccgtttgcaaaaatagaccacttaagaggtccgcctgcaaaaatacctctattttttttggcaggcggacaacgatctcgcttcgcgttgttattttcgcaggcggccatttagctccaaaacgcctacccgccaagaaaaaaaatgccatcgtctagaaaaatggtttttctagtagtgtacatgactctaatatttagacatgccctttttccaattattttgactttagttcgagggatctagggggtggatccaacgtgaattctagggggattcgagtcctctctaccctgttggatcaccattgatagaagaagatagaaggggaaggaagagggagaggagctagagtagaaggagatgattcccttccaaattatattctggatccacccctgcagggagcttatttctatttttttgacattaaaaataacctacagagacaaaggcgcgtgacgatgagaagattatgacatccatacgcaagcactcgtgtcatgtgacacgttacatgcttcttcgccccacttcaatttgttcccactttccaatcttgtcctttctaattaaacggttggattttgtttataaatggtgataccaatatcttgaaatactacttgatggaccataacaaacctcaatttatatttaagtttgattgagcaaggcatactacacatttcttttggaataggagatgattcaagcttcctagcctacaccttgattacatggtcagcttagtgcaaaaaatgggacgggccatcgaaccgatctgaccactaggtcgtccagttcgactatagatggccataaggcccgcccggcacggccggcnccaggcacggataggcacggcccgagagcgatcgggccggcacggcctgattgaaatttcgtgccgtgccgtgcctgcccatgggccgcacgtcaggcccaggcacggcccagtagcaatcggnccgtgccgggccgacacgaaggcacgatcagcccattgggcctgggctagcccaggcacggcttaggaccagtggatcagtggaccagtaattcagtggattgacaaattcaatggatcaatggattgaacatgcaaaatttaaatttaaacatgccttagttaacaaattcaaatttcacaacttacttgacaaattcaaatttgaacatgccttagttaacaaatttaaattacacaacttagttgacaaatataaatttgaacatgccttggttaacaaattcaaataacacaacttacacaacttaattgacaaattcaaatttgaacatgccttagttgaattcacagttctagattcacatatcacctttacaaaaattcacagatcacagatcaaagattcacagatcacattgacaaaaattcat

SEQ ID NO: 74014 - DNA, 7404 bp, Oryza sativa
aaatatgctcgcaataagttatcagcaagtagctgaaaagaattgaacctaagagttgtttctgtacgcaaatgattaggtcatacataccagctccaagaagtcaagaagaggcataggcgaaggacacacaagatattttggagcaggcaaagtcgcatgaattatctgaaaaagcaaaatcggacaacagctgcgaacacagctcttatctgttttctctactccacacggtgcaaacaattactgataactcgtgcaaaatcatcaacacatgcatatcctaattatcttgactaggaccatcatctctaaaaatataagaccccggccccgtgcgaaatgtaaaataggtctctagctagattcatgccaccaaacatactttcactgtttcctcaagcctcatcgaatcttgcatgtcttctgggcttagcgagattaaaaaaaaagaaaataaagcaagattgaagtgaaaccttgaattgagtaagacaactgatattgaattgaggagggaaaaaaatcaccagtttgtgttctgcattcactagacgaaccgaagaaagagtgggctaaattgtgctttctattggttaacatatgggctattttttttttctctctgaagcatggtacttaagcaagtgcattagaattcagggcctcaatttgtagggtgtcctatacagctgatcacctgcccttgctaagctgatcgaaagtattagcagctgagatgggtgttaggtggtgtttacatccagggacataactttagtccttgtctttagacactaatttagagtattaaatatagactacttacaaaactaattacataaataaaagctaattcacgagacaaattttttaagcctaattaatctataattagagaatgtttactgtagcatcacataggctaatcatggattaattagactcattagattcgtctcgcaaattagtccaagattatggatgggttttattaatagtctacgtttaatatttataattaattttcaaacatccgatgtgatagggacttgaaagttttagtcccatctaaacatggccttactgttaacaagagggccctcactgctgttgagtgttgacaagatgtggagtggctggtgcatgtacgtcttcagagtctctttcgaaaattactgacaaggaaatgtttgtctcagaggagaatggtctctctgtgaaccaaagacgggaagcaccgaccaatcgggaaacggcattagccattgacccccttggtttaacgcactctgctgcaccatgtatgacgagacgtacacgtaagggaacgtgcggtaggtagtagtagcaggcaagaaaatatcaggaaaaattcttccttgtgcagtcttgcatgcttgcagggggggtgtgcccgttccctgaagggagtagcactatcgataaatttttcctcagacgtataaatataatataattacagtgttattaaattatatcataatataatttatattaattttttaaaaatctcatggtacacgctatttttcacgaggtaaagttcacaagacgtaatctcctcccgagcacgtgctatgatttttttctaacaatttaaaattatgtgaaagttgcatacaagtttagttttttttaagtagttatatacaagttatatcataactacatagaagttataatataattacattttaattataatgtatttatattaatcgagaaatacttttatagcaaataaatctttcgtggacatgtggatgcagaatctgctcgctgccgccctgttcgtgccatagcgcaacccagctccgctcttgggccggaacgggattccggcctacgtgatccccgttactgttgggccggaacggcattacggcatccgtgcgggccctgttatggttgggccgtaccggggattccgatctccgtgcggccccgggaggggggcgtggtggaggacgaaggcgacggtggcaaaatcggcgacggcgacggcggcggcggcggcgatggcgaaggggagggacgcgcggtgggagtagatactgtagtcgtgcgtgctccggaccagcagcaggtagcggcgcggggaaggaagctactggtgggggacaacccagatccctcgcccgcgactcttctactcgcgctcgcacgccctcgtcggccgcgccgccgccgcggtgatggagtcgccgccggagtcctcctcctcctccccggtcctcctcaacatcggttcgctccccttctccctttcgcaaaaactcgctccccatcccaccgctcgcgtgaatttagaggctgatggtgatggtggtggctatggcgcagggggcaagaggtacgcgaccaccgtcgagacgctcacgcagcgggagcccagctccatgctcgccgccatgttcagcgggaggcacacgctcccccggcacccggacacggtacgccgcgtactcaccagtggagctctcttctcgggagctgtagcctcagaggatgatggtgggtgcagggcatggtgttcgtggacagggacgggaagcacttcaggcatgtcctcaactggctcagggacggcgccgtcccagacatgtcggagtctgagtaccagcagctcctgcgagaagcggagtactaccagttgctcgtaattggaattctcgatcgtttcttcgattcatcagttgcagcttcccaattaaccagccgttgtgaaaacatgatggtttgttttccagggcttggctgattgcataaatgatagattgggttggaaaaatgatgagaatttctcggaggccgaattgacacgcaaagatgtgatcaagtgcatccaagctccgagagtcagatttcgtggtgtaaatctatctggccttgatctatccaaacttgtaaggtctttattgttgttctctattggagttgctcattttttgttatggttattaccactccattctagttgctcttagcaactctgatttcgtgtgtgttcaacagaaatcaataaagcattttattttttttctttagtttcttgtaattttgtgacttttacggtctacaggatttatcagaggtggacttcagctatgcatgcataaagaatgccaatttttcctctgcttatcttcgtaaagcaaagttcagggtatgccattcacacctaagttcttcgttgtttaactgcttttgatgaagtagtagcccttaggaactatgctagttatcataatattttaaggcattttagttctgtcacaaaaaaatatctaagtctttgttttttgtatgactgtcaaatgttgtatcagtaataccttaccttgtatgttcatgacagctgacagaagctacttgttcttcattccaaagtgcaaatttacatgagtaagatggtccaaccagtttcttttagcttatagataggctctaagatgaaacacggtctctccttttttacttttgtgttttttttttgtgttggatgcataagcaagcagctaaccatctatttcctcctttttgtgttatttttgtttcgctgtgttattgtaattgcttgatttggaataacaggtgtgagcttattggagcaaatcttgaaggatctgttctagataaagcaaaccttcaaagtgcaaacctacagggtatgtaatccctttctttacctgtcttccgttttatgttatatgtttccaaaaaatactattatgctcaggattatcctgtttcttcattttcttggcttttgacatccttttcaccagggaagatcatcgtccctgtagtattagacaatgtagctatgcctattttgctttcactctctcctattcagggtgtgcttatattcttgtaaaaactaagtaggaaatgattgagttgctaggcttattttgcagatgcatgcttaaagcaatgttgcttcattgaaacggatcttcgttctgctcatctacaggtttgaaagtttattgtacatggtgtgtttcatgaatgttcccagattctcgcgctgctattctgctaacatattgcattcctggtcagtatacaagaaaaagtgaaaatcatgatgaacattagcataaagcaaagcatttctgtttttttttagaagttagttttctgctgctagaggtgatcgaatatctagtttccatccttgcaatattttgtatcatccaaacttccaaagtttggctgcaaaattttgtccttgcccaaagtattatctgcaacacatagacatatattttgtccgtacaggcttgtatcgtctcttcctgaacatttgaatataaggcataaaggctccctattccaaatggttttcagtaacttaaaatacgttgatatttgggttcttattactcatttcctcagtgtcttattgtcagtccaactggattttcagggtgctaatcttatgggcgccaacttgagtggagctaatcttgaaggggccaatctcaaggtaacaaaaatggccccattcaacctgcactttcatcctgcctgtcatatgtaacttaaggaaagctacttgagggggttaaccacagagctcttacacaaagacagaaaaaatgattctaatgtatccaactcttcttttactgccaagcttgaaataaagtgtctgaagtttgcactaggaaataactctagaagaaaatcaccaggagatgttccaaaggcatgaactgatgctgagatgtgcatgtcatgttttgcttacaaaatattaacaaatagggatttgcgaaagagatggtaatcatcttaattgatgataatgcttgcatataaggttttcttttttgtaaacatgtgatgtttgacatgagtgaaaaggtttcgacctgtagtaagtgtgataacagtgcaaacccgttatacttagaaccatgaaaccatgactgtttgatatgaaatcatggttaatcgtgtactgaagtgtacattaacgaaaggtcattggcattaacaccaatccctcttttcttgtgccttagctgacaacccagttccttgtcctcgctttgttattcaaacttctttatccgtactctaagctagtctgatttgcagggagctaagttggccggtacaaacttggaatgtgcaaatcttcagcgagcctacttgcgagaagttgatttgcgcgaaactgtatgttgtcctgcttgctgcttgcttcttcttttttttcctctctctcttttcagtctaactaaatagtgaacagtgaaagaatctaaacttacttcttaaactatgttttactttgacttacagcatttaactggtgctaagcttggaggtgcaaatctgcttggagctatcagataataccaagggaagaagcttatatcttctacatttacaattaaactgaaactggtgctttggtacctcgaacattatcttgcctgcaccaacggtttgttcatgagtaaatagtttcttgctaccgattctgcagatagtcatacagctttagtcggcggttgtacatatacccttgtcacattcctctgattcgaaattcggtgatgaactgttggatacagctagttgcttagtatcatcatggatagaagctgttctagtaggaaaatttcctgcatactttgggatattgttgtgaacaatgactgaaaattttagtgggaaatatatcttcgttaatgtgcatacaattttcttttcatcatatttactcttcctttaagctttcagtaaaaccgggctcaaaagcgaggaaaatcatattttactcttgttcatgaacctatggaacttttgatgatgtagaaattaccacttgtataggctgcagagatcgatcatagatacaattaactgcaaatcaaatttgtttcggttataatttgcgtgcacagaacacttgcgtttccacacgtattccgaaaggaaacgttggcaataggtagcaatatgtacaaggtgaaggtatcgaacgtgtaagctacgtgcaggcttccgaaacttgcacgtcgtcgttcaggggggctcacgcatgcaggatcacttcagtgtgtcagacgcgcatggcgatcaatggtcggagaagccgatgagaccatgtccgccgtccgccgccgacggatccatcatcagcctgtacttggcgtagaagccggcggcggccaccaacgccagcacgacggcgaggaccaccctccacggcgtcttcctccggccggtcaccaaggcggtgccacccgccgccgccccgtcgttggccgcgccatcgtcatcttcttcttccttgtcctccttctcttgatctgctggtgcagcggtttgctgcgcctgcgcggcgccatgatcggcgggtgcggcggcggcggcggccttgggctcctcttccgccggcgacagcttgggcatggtgatgtggaggacgcggtccctggagtcgaacctggcgcggacgtcgccggcgttgcagtcatcggggacctggaaatccttgtggaagcggctccaccggttgccggagacctgccgctcgccgcttatccgcagcttcccgtggttgtcgatctgcactctcagctgctccttcttgaaccctgcaattgcacccgccatccaaaatgacacatatcaaaccttgcattgcatgaactgagcaataaaaaacaatttgtattcggtctaaaagttggtgttgaaaaacagaatgcgacgaaaaacctctaaaatcaaactgcagttcccaaaattgaaatttaattttgttgcggctcataagcgaagaggtgggaaggaataatgctcttgcctgcggcagataggttgatttgaaggaccttcttgccggcctcctcgaccagctggtgcggcggaacgaagtcggtgtagttgcgcggcgaggtggcggcagcagcggcggcggccatggctgcaggtggtcgatcactgaccggtgatcaggtgctcaggctatgatcactatcaggtgtcgattgatcagttgcaggtgtggtcgagttgatttgagaggaagccggtgttcgtgcacatatatagtgtgtggattcagggttgtttggagtgcgatgcaggaggaaggattgcttcattggacggcgtctgcagggggccggccgcgggaatgaagctaccttgcttaattaatttggttgcgctccctcggtgatataccttgtctagccttcgccaacgcatacagatttcccccacaaggaatctgaaccgtgctgttgttacttgttcttgttctcacagtataagtatttcctgcgattttctgtggtttgttctgggcggcactgtcgggatgtcggcagtcggcacggtaaa

SEQ ID NO: 74015 - DNA, 6072 bp, Oryza sativa
tgtcattttgccaattacttaacaccgttaactttaccatccaaagtaggggcaaaacgatagttcggttaaaaaaagtgggggtaaaaacgaaaaccctaaaagtaggggtaaaattaatattagacaacaaagcagggttagaaacgaaattgtcccatattaatagagggaagttgagttacacagctaaaggctcaaagaaagtaaaaactgcacacgcctgattgcaaacatgtttgcacgttatgcaaaaaaaatgatgtgaagacctcatctttgagatccattagggcttccaaaatattccgactacaaactgactcatgtggactgaaaccgtacggatcacaatgtgaataaaaagatattggtagttaagacattgtagtgaagcccaagtctctttcaaatgctcaattcagtccaattaagactatgtatttccaaattatgccaaggacaaaacaattttggcatatcatgcatggaacatttaaagaaaattctcaggcattcatttttctacgctccacctttaaaaaactttgcaaatacaaaaaaataaaacaagggtgcaaacaacattagcactcttcaaaacctattgttgaaacggattgtttgccccatgctaaaaaaaaacattttagaaacaactttctccaactacttgttgtagctacttgttaagtttatttcttaaaatgtttaagctatgtttataatataaatagacaatctacacaataatccgttcaataagctaaactaaatgggaccttaccgtagactgctaccacaacatgcacatagattatagatagcaggcatgtcataaagctaaagagaagaggagactcgaacaatcaccaatggaacaaatcatggacatcccaaaaaaatctagcattttcattcgtccatcaaatttggccatgtatatgtaaactgatcagcttgggatttggtttggtcataggcccaggccgacccatggaatcttggaccaagatcacatatacttcgtgaaaaattgttggatctattgggctttgtttcctacgcttctgtgtctacccatgtgatgagtgtatcatctcttactataataaaacctaaagcttaacatacaaagatgacacgtcatcattcactaacaattattacatttaaacatcatacaagcatgttatattattaataattttatagtttattatattttatagcttttcaaatataagcatgttaaatcatcatatcacataattcacataatatttcaatatgtttcttcatctttttttataatatcatatatacctatattgtccatcctaactcctaacttagttaatgtgctctctctctcttctctcattaagccatatcacatcaattgttttgtccttagatgattatctattgttcaaattatctccctccttttcttctcttaagaagtcatatcacctcaatcgtttttagcctttagatgactaatctatgatccaaactatctccctccttttcttctctcataaagccacatcagattagttttacatttgaatcatcattgtgtatactatttaaatttaaactaacataaaccacataaacatacaaatcacatcaacttaaataagtttatattgtctggctatcttatacattaattttaattagtgctatcataataaattcttgcagcaatgcacggggtttcacctagtatttaaaatagtaaatgcactgcatttagattagctaggttcttttgtctaagactcagcctttggcaccagcctaaatattgccatacttgcttgttacttgctggcaaaatttgctataggacataaaaaatatgtaattagctaggggacaccacaagaacatgtatctgctatatggcaccgcaaaaaactggtaattagttgctggacacccacgatattattttataggcaaattttgctataggacacttcgacttcgtggttttagccataggacaccgcccgaactcacttttgggggaaaacactccataaatgtggtaatttgccaatagacaccgtgccaattagaataataatttctggttgaaaaggagagagaaatcacgtgaaatgtcaaaaatgcccttgggcccacatgtcagctctcctatctctcttctcttctctctctatcttctcctaggcgatgctggtcaccgccgcgccactgccgcgtggtaccttcttgaaccgcacccacatctgcttcaggtcgctcgtcgacagcacgtcctcccgcccatagctcgcccgccacttgctctcctccggcaagatcgggtacagcagcaacgggagccgcaacagtagccgcaccccgtcctgcgccgtcccgagcaccgcaccgtcctagatgcgcggtggatccccatcacgacctgtcccacctctccgatctctcttgatctcctccggccggccgtcaccaccgtccgtcttcgcaccatcatcgtcgtcatcgtcgccatcgccactgccgcactcgccgtcgccatgccgacgcggctgccatggccgacggcggccatcacctgcacatagcgccaccgccgtcgtcaaagccgccgcagctgtcgccgccgtgcgccacgatcttgatctcgaggccatccgccgccgcctcctcgtcgtggtcctcaccctcgccaccgccgccccacgcggcaaaggcgtagtcaccaccgcgccgcagttgccacagccgccatcgccgtgcgtcgtcgttggcgtcgccgctgccacaaccgggacagctgccgccgcacgactgtcggtgctcctggcgctcaactccgtagacgacggcgctcccggttgaagaaagatggaagatatgacatgtgggcccaaggacattttagaactttcacgcgatttctccttcctcttcaaccggaaattattattttaattggtgcagtgtccattggcaaattaccacgtttatggagtgttttcccctaaaagtgagttcagttggtgtcctatggctaaaaccatgaagtcgaagtgccctgtaacaaaatttccctattttataatatccaaaaggaaatagagagagaaacagttgccaaaataagattttgcttatggagaagtttctatatgctgcttggaatatttggaagcaaatgaatggtttcatttttgataaaaaaaaattccatctttgtcttcttggaggcaactcttgaagagtgatctccttcttttgttgtttaggactaatgcgagatatcacgatgtaattataagctggatcaatctgttgtaatttgtaccctttctttttaataaaaatttcttaacagcaggggcctcccctgctgtgttctcttccaaaaaacgattttgcccctgcctaccaagtctagctcgcatacagctccgacgctgccaccgctgtcgctgccgttgttggcaaggcagctctctgggtgttcaagagggcccacgcgcctgggcctgtggctccgcatcattcccacgctcgtcgttgctgcaacatgaggaccacgccggtgctgaacatgtggccaccgcgatgtcggagctatatgcgagccgcaaaatcgtacattcatggctatttttctctctatttactctagatataataaaataatactacgggtgtccaacagctaattaccagttttttttggtgttccacagctgatatgcatttttgcagtgtctcctagctaattacactttttttttatatcttgtagcaaattttgccattaaatggcttaactgtagctataaggcttagcctgagatttgaagcattgggtagctcccttcgtgtcagcaacgggcgcgcatattggctcaactgggagctcctaatgaataacaaccccttgcaacctgcccacctagggggtacagaggacatgaagctttgatcaagctatggtacgaagttcgaagaacacgcgcgacttgaggttggcggcgagctagagtgacttattgggggtcgagttgccagcgagggcctgccgacctgcgcgacggctacgacgtgaagcgcatgtgttgtgttggccgtcagatagcctcgccttccgtgcagaggtccatccccatggacgatgccggtaggaccagccgctgcggcaacaacacatattggtgcaagcagttaaattattataggttttataaggaatttggccgactcgtcatgtccatcttggcctccgtctcatctgatcatctccctctccaacaccacatagaattcgagttttactcttccctgcgattcaaaattttggcatctgcgtacgacgcgatgtcgtcatatatccggtgataggactctaccttcactggatgtccgacacgacggtggcggcactccttccgaccacaacaatagttttgtcatcgtgccaccagaggaaacctcaatagacgtagaatttgcccctctggttctacttgtacaaaagactaggggtggaaaaaaagctctgtctcgcgagcttagctcgggcttggctcgagctcacttagctcggctcgtctcgattgctaaacgagccaatctcaagccttctttttagctcgttcttgaaatgagctaagaccaagctggctcgcgagccgcttgtttggctcgtgagcctaggccatcatgtacttatatgtatgattttattttctagtgaagttattatttgtcaatatgcaatttatcatctagattttgatgaattgaataatataaaattattttaattttgcatgtcgatgatttgttattgttttccttaatgattacaaattatatataaagaggtgcttcaatgggaaggctcgcaagccagctcgatcttgctcgaacctggaaatgagccgagccgagctcatgttttagctcgtttccccaaccaaaccgagccaagccaagcctaacttgttgtgagccgttgcaagccgagtcaaactcgacctggctcatttccacccctacaaaagaccacccaaggatataaatacaacacaccaagaggagaggggacatggaatacaaaccaatacgacaagacaactccaatcttgctgagttcatattcgagagagtagactatgctagtcgtcgaccacatgtgagagcttcatgtcgctagacgcacagagagtagattaggtcatcccaaatattgtactcgtgagatattgatatataaagacaacatcagcttcggccagtaggagtagggctattactcgttgacaagggggcatgaacctctataaaaaatccttctctctcgtctcttttaactcaatctctcgcataccctgacgccaacgattctcttactctacaaataccgtaggcgggtataaccctagtgtcaaatgggctctccggccgtgcggagatctgtccccacagatggcacgtattggtagggaacaatcatagggaattacccaactcgtcgtttctatctcggtctcaccatctctatctctatctctgtctgatcgtctccctctcgaacactacacatggaatcctgagttagccaatacctgaacaaataccgtaggagggtatagcccgtcgacaatacaattgtaccctcattctcaacaagcaaattgttaatgaccaaatttggtaatttcagcatcagaggtggagataaaactcaaccggaattcatgatggaaatcgttccggaaacagagcaaggatcggctaaagtcctgtcacaccctaaaaatcccaaatatataaattgttgtctaaattggaattattagaatttattttaaaagcctagaagagaagatctagttttaattaataaattccaatataaaatggggccagataaaattttattaaatactttgcttaattctataattcctaaatttttctaggatttatttgagctaaggaagtatttttaataaatggaattgcatttaatggataatttaaaatgaaaaaggttttaaaaatcct

SEQ ID NO: 74016 - DNA, 6055 bp, Oryza sativa
cgtggggctgtgtcttgtgggtacagtggtacacctctggccagagtaaaactattcgaatagccgtgcccgcggtcatgggtgggtctaacaatgtctttcgtgattagttttacacttctcaccataataaaagatgctataactggtaataatttgattaactcctggtttggaatggtatattcctggtttggagatagaactgtgcagccaggatggttgatcagaatggttgggcctatgcaatagtgtatgttgtatagcgttggattaatattgtttaattattacttaactgttttattaaattctgaaatgtttattaaatgctgtttatgcaaatgaaaccctactatgccatcctttgttatcctgtgcacttgcatatttgctgcgtggcttgctgagtatgtcatatactcaccttgcaatcattcataagaggaggagttctacagtgatgctgatggtgtggaggattaggtgtagccctggtcaagctgcctgtggagtggagtcgtctgcgccgtttatcttattttttttccgctgcttagatctttattgattgagaggaactacctacctctgtaatgacattttattcgcttattaattagagtaataattgtactctattatcaatttgttattgtgtgcctcggctgattcctggacgagggttcacacacatgtaagcgtttggaattttggatagaaattccgggcgtgacaagttggtatcagagcctccttgaccctaggttatgccaaatggttacccatagaagccctctaaaaatattggaaaagtagaactgttctcctctctttcttttataattaaaccaaactaatggcacatgcagtttataattcctttaattgttctcatttaaaaatttatttattattcctgtgttattagtaccgtacatctattactatactaatggctcatttaccagcaaaagttttacaacattggtttatttaatcttgctgcaatgaaataaatttagcatgttgattttataactttgttttattttatttctttgaaacctgttgttcaaaagtgcaaaatttgtgatcttgtttccaactgtttcaacttatcttgcaagcttggtttgctttatttacttaccttttactttgattttctaactctattcaaattaatccaaaaacttgtactattaattggataaatgtcttaactccctcctttcacttgtctttagatgccgcgctgcaagcctgagtacttgtttggtgttgagggatttgtcaaggagttgcgtacgatgtcctttgccataggatttgggactgcccctttgtatgcccagattcctcgtgatcgtgatgaagagaagtgccgagtcaaagtcaccttgaacagtaatagtgaagatatactatccgtgatgttcgaagctggaggaggaaactacattcatgcatgtcaggaggtggcaaggatcgccataggagagctccgcgatcgctacagtgatcagttggccgacactgagtatcgctaccatcctcgccaaccccagggaagtgaccgtggcagctaccttgagactgaggggattgagaatgatgctaccacaaggcatctggtcgagatgctgtgggctatggataagacccgcgcggagattgtgttagcagctcaagatcgtgaagaccggaatcgtggaaagatttgcaaactagaagacaaggtggatcgtttggagaaggaactagccgcattgaagggagaagcaccaccgcagaaggccagggttcgtcttaccgccaggaagagagctttattcgtccctcgctaccaattggcgccaaaggttcgtgtggtagaaaaagaagctaccccaaccctagcggatcctccgatcgtcaacgtaagtgatgatgaaggagaggaatcaaagcgcacccactcaaaggttgaatggggagctactcaagatgatggagacgagccgaacgagccttcaatcaactccgatgcccggaagacctagaatgccttgtcaagccgttgtcctagatcgttgtgttagtttgcttgttttaagtgtggttgtgtgtgtgggtcttgcatgtggtttacatcagtggtgggatgtaagcgcatgcgtttgtttgctttcgagtgtttggtagttggtgagtttagtggtgtgagagtcttcagttttgtaataatgaaactcagttaagatcaataaaagttaagttagtagaaaaattaattctctgtcctaagtagtttttccccggtttctcttcttgtgctcctgcccatgccagatggtgctcactcgcagtaacgggaatggccccaacatcaacaataacaacaacaacaatggagagaatcccacacttgcccaagtcctggctcaataggcacagcttatgaacatgatgatgcagcaacttcagaaccagtagaaccagggaaataaccatgcacctccccagaacaagttagcagaatttcttcgtgcgaggccgcccactttctctagcaccactaatcctgttgaagctggtgattggctgcatgccatagagaagaagttggatttgcttcagtgcactgatcaggagaaggtctcatttgcatcacaccagctgcatggccttgcctctgagtggtgggatcacttccgccttaacagaactaccgctgaacctatctcttggcttgaattcaccgctgctttctagaagacgcatataccatcgggagtggtgtctctcaagaagaaggaattcaggtcgctcacccagggatctcgcacggtcaccgagtatctgcacgagttcaatcgtctggctcgttatgctccggaagatgtgcgcactgatgaagagcgccaggagaggttcttggaaggacttaatgatgagctttcttacccactcatgactggggattatcatgattttcagaagttagtggataaggctattcgccaggaggacaagtacaaccgcatggagcagaagaaatgccggattgctcacttcaaggcacaacaggggaatagtcagaggccgcgtcttactttaggaccacagtccatgccacggggaggttcttcgtctgttgttcgtccgcagcgtcagttcttcaacaacaatgctggcaacaacatccgcaatcaagctccacaccctgttgcagctccaacacagcaacagcctgccaagagggagcaaggcatcaagcccggggtgtgcttcaactgtggtgaaccaggccattactctgacaagtgtccgaagcctcgacgcgtgaaggttgtccctgcccagagcaactctaccgcaccagcatcaaaggctcgtgtcaatcatgttgctgctgcagaagctcaaggtgctccagatgtgattttgggtacgttccttgttaactcagttcctgcaacagtgcttttcgattctggtgctacacattcatttttatctatgagttttgcgggaaatcatgggatggaagtagaagatcttagacgtcctttgatggttagtaccccgagtaatcaagcactctctttgcaacgtagcccctctgtcagaatagaaattcaaggagtaccatttctggccaatcttatcctgttagaatccaaagaccttgatgtcatcctagggatggactggttagccagatataaaggtgtgatagactgtgccaacagaaaagtaactctcaccaacaatgatggtcgagttgtaactgttcatgcattgtcttcggagtctttaaggtcaagtctgaaccaaatagctttggaagagattcgcatagtacaggaatacccggacgtgttcccggacgatttacctggtatgccgcctaaaagagatattgaattcagaatagatctggtaccaggaacaactccgatccataagagaccctatagaatggcagtcaatgaattagcagaagtcaagaggcaagtagatgatttgcttcagaaaggatacatcagaccaagttcgtctctatggggagctccagttatttttgtggaaaagaaagatcatacccagaggatgtgtgtggactatcgtgcactaaatgatgtgactatcaagaataagtacccgctgcccagaattgatgatttgtttgatcagcttaaaggtgccaccgttttctccaagatagatcttcgatcagggtatcaccagttgagaatcaaagaagaagatatacctaagacggcttttaccactaggtatggattgttcgaatgtactgttatgtcttttggacttaccaatgcccccactttcttcatgaacttgatgaataaggtgtttatggaatacctagacaagttcgtggtggtctttattgatgacattcttatctactctcgaacaaaagaagagcatgaagaacatcttcgtcttgcactagagaagctacgagaacatcaattgtatgtcaagtttagcaagtgtgaattttggttgtctgaagtgaagttccttggtcacgtcatctcagccggaggagttactgttgatcctagtaacgtggaatccgtaaccaactggaaacaaccaaagacagtttcagagattcacagtttcctaggtctcgcaggatattatcggaggtttatagagaatttttccaagattgctaagcccataacacgattacttcaaaaggatgtaaagtacaagtggtcagaagaatgtgagcagagttttcaagagttgaagaatcgcttaatatcagctcctattttgattttacctgatccaaagaagggtttccaagtgtattgcgatgcatccaaacttgggttaggttgtgttctgatgcaagatggcaaggtgattgcctatgcatctcgtcagttacgtccacatgagaagaactaccctactcatgatcttgagttagctgcagtggttcatgcattgaagatttggcgtcattatcttttcggtactcgtacagaggtgtacactaatcacaagagtttaaagtatatttttactcagccagatctgaatatgagtcaacggagatggttgtaattaattaaggattatgacatgggaattcattatcacctgggaaaggttaatgttgtagcagatgcccttagcaggaaaggctattgcaatgctacggaaggacgacagttgccattggagttatgcaaggaatttgaaagattaaatttgggaattgtcagtagagatttcgttgcagccttacaagcaaagcccactctaattgatcaaattagagaagctcaaattaacgacccggatattcaagaaattaagaagaatatgagaagaggaaaagctatcggtttcttggaagatgagcaaggaactgtatggttggacaagagaatctgtgtccccgacaacaaagatttaaaagtcgcaattctaaaggaagcccatgatactttatactccattcaccctagtagtaccaagatgtaccaggatctcaaggaatgattttggtgggcaagtatgaagcgtgaaatcgcataatacgtagcagtatgtgatgtttgtcagcgagtcaaggcagaacatcagaaacccaccgggttgttgcagcctttgaggataccagaatggaagtgggaggaaatcggtatggatttcatcactggtctacccagaacggcatcaggccatgactctatttgggtgatagtcgacagacttaccaaagtagctcatttcatcctagtaaagacaacatattccggaagtcggttggcggaattgtatatggcaaggattgtgtgtttgcatggcgtccctaagaaaatagtgtctgatcgaggtagtcagtttacttcaaagttttggaagaagcttcaggaagagatgggttctaagctgaactttagtactgcttatcatccgcagacagacggacaaaccgaaagggtaaatcagattttggaagacatgttgagagcttgtgctttagacttcggtggaagttgggataagaatt

SEQ ID NO: 74017 - DNA, 619 bp, Oryza sativa
tatggttccagccgagccgagccgagccgacgagaagctctagaagagtggcgttggggacgtggacggcgagagcaggtgacgcgttcccgcgcgacgcgggccgaggtggcgagctgcatgcgcctcatgcacgcacaccaacgcaccaaccagcgagttcactctcccatactactagtaccactctactagactccgttcgctgacacgccccgtccactcttgtccacgctgcgccgcgcagtgtcgcgcacaccccaaaaccccaaccaaccaaacaacccgacccgcggccatggatgcggcggcgggcggcggcggcgagccttcgccggcgccgggagtgggcggccggaagcacctctcctccatcgccaaccacgtgctccgccaatgctccctgtgcgtactttctctaatcctaaatcctaatcaaaccctgttgatggttgatttctccatcgtgtagaaactgtgttgttgttgttgttgttgttgttgttgttgttgtgtgtgtagaaactgttgctatcaattcgaaagaaactggcagtgttttccttgtagcagactcatgtgctttgatcttgtacgaacagaacatattggtatgaag

SEQ ID NO: 74018 - DNA, 60734 bp, Oryza sativa
  unsure (1)..(60734): unsure at all n locations
tgttttttttaagataatgtgaaatgcagaatgctacaaaaggacaagtgtagtaataatatcattgaaatacaaaccaagttttgggaatctttctcgtacaacttcctcaagaacaagctggtcaacctgtaaacgggcagtaacattaacgaggattttgggaaacattacatgtatcatgaattaagaagtacctgagattcaatcatttcctcagtgtaataaccatcaaaatactcatcaatgacccccaccagagccctgaaaattcaaaatgatgagcgaaaacgagaaaaataaagtggaattagagttagcatacaatcttgaaaatacaaagaaaaattatcaatcaagtattttttttcaagagacaaggcatttaataaaagcataccagaatgcatgctcttcaggcatgaataataaaaataggccagcaaaaaagttcatggcctgcaagaagaacaatgaagatataaggtaaagagtaaaggcactctagttatattgacaaaagaaaatgcaacagatgtttctgagccagattaatggtgtctagcatatagaacatttaatgattttgccagccttgcaaagctagctaatagttgaattgcatatttggaacttgggatagacttaattgattttaaccttgtaaatcacctctgaagttacaatattcataattcgtttgtcagcgtggatgattgaaaagtgacaagtttcatagttcacgatggatctctcagtataaaatacagccctcatcaattcatcttttactcaaaggtatacattatttcgcagcacatgcatatgattataaattgggtaattttaccatccttgagaaggtaccacattttctagtgtaaaatttggtacctctaggtactaggtactaagtaccttgattcaaaaaaaattgaatcagacgagtggtcaaacgttgcaagcaaaaactcaaaatcccttatattatgggacggagggagtagattacaagaggttaaaaactaacataaaattatccaatgagcatttgttcacctggcagtatccaactgatgggttatgccttgcatatgctgttaataaccgtcgcaaagcatttctcccgtcctcatctagtgcagggtgtcccggaaatgttcgaggcaaatcctataatgataacaggcaaatcaagcattcaagtgtgtagagagtagagacctagaacagtagaacttctaaaacatgacattagttcctcccatttcaaatcagagagcaaccttctctatctgtcccttccacttctctgggggctttttctgtgcatttgtctgatctttcaactcttggtcctcagggttcttttcatccaattcctcagtaccttcatctagtaatttgttgtagtacccagtaattttacgagcaccaacacccacaaatgcttgccacatctgcaataaaatcaaccatatgtgagtgtaggtatatatctattataaggatataaaaacagtacagataattctggttacagttgcacctctcctctaagagccattggcacacctccacggaccaagctctcgagttcctccctccaagggaaataagactcgccattgcctccctccaaagcagcactcgcagaatcaccttgttccctgtcctgtgcctgctccaccttatctggattagaagattcctctgctggatcccctctacaactcttatctgctgccctttcctcctcttcaattgatgcaagctgtgcttcaccatttccacacatgtcatttgcagtgttccttatcttgcccactcgagagctcatcattttctcaatgattctgattgatgcccgcacccgcttcccagactcaactcttataggcttcagttcatccaacaaccccttatccaagaaaagctcttctaacttttccgagttgtcgttgttcgcttcacctaatccttccaaggcaccatgagaatcttttaatccttcagaatcaccattctcatcatttaatagttcctctgaacacccactcacctccttcaattcttctggagctttgtccgattctacggagtttgcaatgctctcctgtttcagattttctgagttggcagatacatcattgatatcgtccgcctcaccatttgcttcttgcgattgattgttgccatcaatttccttcgaattttctggtgtatcgctcttttctgcatcctcttctccctcctcttcttcattgttgcattttattccacccctattgctattctctaagttttcagctccatcaaggtgttctccaccattgacatctccagcagcagagtcctctttggaaggtgaaatgctggttgtgatgtcatctgcagattcagccaacctgtccaagaagtccttccatctgtccgctctctcctcttcttcttcctgataaaccaaacaacagccaaaaaaatagtacagtatgtatcaaaacttaacctgaaacaaacaaaaacaacgcatttccatttctactctgcccctggtaaattaccttgtaaatcttggcatactcgcggaaacgctgcagatgctgcggccgcaccgcgaatccatacgcgtccctgcgccaaacctcaccaccatcaaccacaactcccgaaggcaattccaaccaccgcattatgccacacaaatcctaacccaaatccaacctaaacgaacaacgacgtatgcaacaatacaagacaataaatgctagcgagagggaggcggaggaaaggaaaaggaggcgccttttattgggttttaccggcactcgccgtccatggggatcaacgcgcattaaagaagaagcgacagggcgacctcggcaccgcacgccatggattgaccaaagccatactaaaccctagccccgcgccccgagatccacgcacatggaatggggaaaaaaaagaaagaaaaattccgcgaagggaatcaaagaattgcgacggatcgcggcaaggtggagctgcgcgcccgttaattgcaccacgcccctccccgcgcgcgccgcccgaggccccagacgcgaagcaacggagatagatatagagagagagagagagagagagagagagagaggaatagaagaacaagaaagagaggaaccgcagattgggggggaaccagaagacgaagaagaaaaaaaaactcgtttttcgcatcgaggctagagcgggaagcacgtggcgcgcgggacgacgatgccgcggcgagcgcgcgcgccctcgcctttgactcctgctgctctgcctgcctgcctgcaatctgcatggcttcgctgtaagcagctcggtctcggcgatttacctcttgtactcgaagtcgaacgccgccgcgcccatggcgcccatggcgggcggcggcggcttggcggcgcacgccgtgccggccgggtcggggagcaaagcaagcaaaagcagagcccttcttcttcgagcacctgtcacgtggaggcgtggacctgtatactggaaatggtgcgagccgagccgagggtgcagagattgcagcgctagtcagccttggaggggagaacgggaatagaaatcgaatcgcctggtttgacctggatttggaggttgtactactcctacccgtttggtatagggagtggttgtttacagttgtgctatattagagcaaggtcaacagtatagccaactgctggctccaaaacatttatagctaatctaatagctcattcatatagtagttaactatgaaaatatactacaccattaatacacggtctcacctctcatacacagataacattttagaaaaatccgtgttgcagccggctacaaatatgtagctcgctttcttcttttttcttttcgatatatggttacagccggcattgtacctgttcttagcagtactagttgattgatgaatggtccatggtgtcattcactcgtgtggtgtgttcttgtttgtgtcaggcatttggccatttgcctacactcctgtaggataatctttgctctcatccagcatctggctcgtcgtttggtggtttggtgaggaccggataatccgtgggccagcatcctgatgaaacatggtactagtaccaaatcggttgatggtgtcacctgtcagctcatcatgcgatgcaagcacgcccacaatccgaattttagacagccgcatgcctgcatcttgtttgcgcttctgtagttacacctgcctgtagtcctgtacaagcggaattagtacgcttgagtgtcgggctgaacaggacgcgattcctaccggacggtacgatccatctgggtcccttttgttcgttgccgcgccactcgccagcacatggcggggcgaggagagcgcgaggcggcgcggcgcctggtggatggtgaccgccgggggccgtgcaggcacgggggggtggttgggttgggtgggggtggggtgggggaggaggagctcagctcgcgcggcgcgtgcgacgactggcggagaacgagaaaatcagcggtcgtggtctcgcgtgatgatggcaaagcaaatcaacccttccgcccgcgtaccgggccggcctcgcgcgcgaagcagttgcgttagaccacgctcccccgcggcccgcgggcgtgcaagcgcgagggcagaggcgcggtccaacttgcgtgatggtgagacggcggtggggaggctcggggcccggtgattttgagcggacgataggaagaaaacgagccgggtaggtgagacggaactgtatgggcttaggccagcggctgagcggcctgctgagtaagtactttgggaaaaaaaaacaattttaaccctctttaaaaaaactagcatggtggcccgcgcagattgcgcgactagcatcattatattttctctcatataatagcatatatgttttctcattatattattcaaatatattaaaatgacaacataattttaaattttgtaataactttacaaaactactaatgtgtaatattcatattgtattttatatacgtgttaattattaattatttttaatatcaaattttaattatttgtaaattatatatattcctatatggactctagactcgtcttttaatatttctttttttttaattccgaattttctgtaaattgtatttctatatagactctatgctcttcttctaatattatttatttttattctgaatttttattatttctaattgtatttttatttggactctaaactcatctttcaatattctttaatttttaatttcgaatttcagttacttctaaattgtattcctatattgactttaaactcttcttcccatgtttttcttaatttcaaattttagttatttgtaaattgtatttttatatggactctaaaaactctaattttaattttattatatttattccaaattttagttagttttaaactcaatttctattatttcctaattgtatttctgtatggactctatactctacttctaatattccttattttttaattccgaatttctgttttttcctaattgtatttctatatggactctatactctacttctaatattccttatttttaattccgaatttcagttttttcctaattgtatttctatatggactccaaggttgtcaggatcgggatactaggtagtatcgttttgctcaaagtaatatcgtatcgtaggatcgggatactatgagattttcttttttaaaatttaattaatatttatattaattatatatagccattctatataaaaaaagtagtaatgatatatgtcatgtaaatagagacatttattaagagaaaccacgttggttttgatatatttaactgattttcatataaatttgagcatatttagttacactattttcaaaccatgttattttaaataatattttgtagtatcgtagggatcgtagaatcgggataccacctaagattttgtaggatcgtgcagtaatgaatagtaggattgagatgctatgaaaattaggatactaggtgggatcggtatcgtttcggcttggtaagagatcgtagtatcgtaagatattaggatactgtcggtgacatgggatcaggagtatcatgactagaggtttgaggcagacacaatcgcacacgtggcctggtactcccgagggacgtcgggcccgagggtgatatgttcgccctcctcttagtccccccgagggggtcgggccgcacccgcctcggccccgagggccgaggcgcccctacccctcgtgggtttttgctccgagtgtatgggttaggtgagcacagtggggctcacctaaccacatttattgtggtttggctgagcgtgtcacgccgcatgtaacgcagtgcagtgcactcatttatccggtctgtgaccagtcacagaccggtcagatcgcgggttaggtggcgacaggcgatctgacgcacgcctcgccccatcccgtcaggacgagggcttctaggcgctcgtccccagctggagctagcgtgttacctcccagagatgacacgatagtcctggtcagatatatgccaggcttcatcctaaccattacaggcaagatgttgtgtgaagaagggcgaacatgtagattgctaagctgacacgtggtggacaagaatgaccgacgtgactggtctgacaccggtcatgtcgtcagcggacagccatgattccacgtcgcatctgctcccggcgaaagtggaggtagttgtgggccgtctcatcagaaggtgactcggacggcaactatacaaatctccgtccatttatgaaaaggtggggtaagtccccacaaaaaagagagaaatggtgcatgtggtatccccttaagatataaaaggaggaccttgcccacttagaggggggactggacttttccagattgggaacccagaacaagggagaggctggctcatactttgtagctccttcctacacagatctcacaaaaacataggagtagggtattacgcttctcagcggcccgaacctgtatacatcgcccgagtcttgtgtgtttccggtctcgcgaaccttccacatacagagagcttagaatctcaccctgagtccccggccgaaccggcaaaggggggcctgcgtggtctcccggtgaggagccccacgctccgtcagatacgaatcgggatactgacaacattgatggactctagtcttctcttctaatattccttattttttaattccgaatttcaactatttctaaattgtatttctatatggactctagtctcctcttctaatattccttattttttaattccgaatttcagctatttctaaattgtatttctatatggactctgccttttctttttctccgattaatgtgagaatttctaagccatgagagcgaacgtggaggctccttttttctattcctttaataatataatagataggttgaatctgattcgtatcacttaaaccgctacaacgactcctcaaactactaaaaacactctaaactaacttccttaactggtttgagagtggtttttactaatataacatccacgtggcagccaaattatttgatgaattaaaaatagatgtgcacccatatgtaagtaagtgacaaaaaaaatacggagtccatatgccagagccactctttcttcgttctttcagacgggctggcacaagaacccactaagtgtgttgtcattgccgacagccttctcgtgccttcttcatcgccgctacatccttgccagagcacaccaagaaagatgacgaagcacaagaagcgacgagattgaaggagctcatcctctccttggtggggccgcaacccatcctacaccacggcaccgtaaaggcctcattgatgccctcagccggagcttcttcctcccgctgcagcttcttgctcaatgacgtcgcgatgacccctcctctctgacactcgctgtcgccgggcatggggataagcccctgccgcatggtcttgtccgcaacgtgggcaagtgccatagggagggatagcgccatggaaggttgtgggagggggaactcggtctcttcaatcaccaacaatggtggctcgtctagcggctccatgagagtgtcgaggttggctgtcgaggagtgtgccgttgactcacactctgccgccttcctcggttgatccgctttctcactctgctgagtttggaccaccgccgctccatccttcgttcggagcgagatataggaactggcattcttccgccattgcatcaccccaaacgcccaatgagagcagagagaggaagaaaggagatatatagtgttattgacaagtgggtcctacatctttttttattattttcttttaagactggttgccacatagatatcacatcaatcaaaaccaccctcaaacccatcgagggagtcattttacgctggtcttgattgattgaggagtcattatacccggttttgtggttgagatgtacaaatcatatttgaaaattttttcctagtactttccaccgtttggccctctttgaaaactttgttttatatactatagtagaagaacttttttctaaaaaaggtggaaccctttcaaacaggaacataatatttgtggtcatgtaggtatacataggatggtccatgaaaaagttttcatcggagtttatttgtgaggaaggaccaaaactccaaaagagattattcacgccaacgtggtatccagtccatcatatgagcttctctaatcggacagttatgtgtgtccatcgggtcatttggattcacacgtcgaaatgtgaaaaccattcacttgcaaaaccacaaacatgcgaactatatccaccaccacatgctagctcattggacattggtgttgcaaaagctgtagaagtactaatttcatcttgctttggtgccgaggctggaacgtcggtgacctgttgcccttctagctcggcacgagattattgatgcactgcaaaagcgaaaacaccatgctgccggcccggtatcaaaacaacgtcgaccgtttcatttgtggcacagtggcatagtgggttttgcgtcaatcccaaaacgccaccacactagatgcttgtttagttcttaactttttcttcaaacttttaacttttttatcatatcaaaacttttctacatacatgaacattaaatttttttcttgaaacttttaattttagtcaaacttctaattttaaggtgaaactaaacacagactaaaatactgggagacggaaggtatagacgtagcgacggtagcgtcgcctagccgcgtcggtgcgaggcctaggagtacagcattgtagcggctggctaacatcaacgtcgccgccgtcgcgttcatacggtggtggtgatggtagtgcacccgtgcggcccatgcaaaagccgcgccggcgaatcgccatcgaacgtggggacctctccgaaacgtgagggcaagagcggaagggaaggatacgatcaacccaacctagaatcgaatgcctctggctctccgtccaccgtccgccacagaaaatatcttcgtccatttccccctgaccgcagtggcccacaatacagtagtactagcactactccccggtgtccagatccagatcccggcgtccccatcacgtatacgtccgtggcggtggccgccgctatcagtcggccagcctaaccgaaacccccaagtttagccgtgcgatgcgagtgcgtaagcgtaactcctccctcctcctcctcccacgtcccccgcacctttccccccaacccgcagcccaaacaagagggaatcgaccaatcaatccatcaatcaatcaaccgatccgacccatgcccccatccgtcgccacccacgcatccctcctcctcaaagccgccgccgcagccgcgcacctccaccccaagcccttcttctccccacgcgcggcgccgccgcggatcccgtctgcccccgcgccgccggccgcaggaggcagccgctaccgtccgacgacgacgacgacggcggcggcgacggcgaccagcgccaccgccgcgtgccgctggttccggtggcccccgcccgcgcaggcgcccgtgaggggtctgtgctccttgccgcattctggcggtggcggtggtggtggtgagggtatgggatctgaaggggtcgggaggaggaggcgggtggtggcgcctgcggtgaacggggtggcgaaggacggggcgccacagccgcctccgcccaagctgctcacgctgcccaccgtgctcaccattggccgcgtcgccgccgtgccgctcctgataagcagtaagttcgagcgacagcttgtttgttccttttaactttgggaatttttttatgcgtttcttgtcgggttgtgacgcggtcgtgtatattgatggaactagtaccgagagctttgatttgttggcgactttctttcgtgtgctagtaatgtgggaaatctgtcaagatgatcagggttgtccttcgagcacaatcaagttccccgaagatagtgctggaaacgctaggaaattgtaggttatcttgctgcgagtaatgtgccggaacaaattgattgaggaatagttgaaactggaaagttttggagtaccccagctagatatgctaatcccctatgtccctctcgttcgtggtgcatatccatttattgcataaaacaattattattgtgcttaatcgtcaaggaaatggaatcagcagatcggtagatcaggtaggtaataattcctgaatcgtcagaacaataaccataaatggaattgatggtccaaaagatcgacactatcctccgttttatttttaacatgctgtgctgctaactggatgatactgctatctgtttttgtatccgtaatttcctaaattcagaacatggtgcatcgcagtagttgacatataggggcacctgtgcagatagtctttactgcctcttctgtctattgttttccaggctaggcctgtctactctacttagaactgttaatatgcactactcactagactttggagctcatctcctatgtgacacagtgctgcgcttagtctgcttagtctatttcatcaaaccttcacaggacctttttccatcctcaatttttttactgtatcccatgttgtgcctgagaattcctaagaatcctcccatatgaaccctgttgcattatacacattactcttcccacccattggggaaacgaagtggttttcttgttaatctgtgtgctaagaacatgttcatttcttctcccaagacacctacttttttatattttcccttgttagactaagaaagcatgcctcagtcactgtatttgacttttttctagaacaatagggcaagaaaaaccttttccaagtccagttccgttataatgatgctgaaaggttgtcctacgtgatgcttttcacctcctataaactgaagggatatgcaaattaaagtatcctatcagcactgcatttttaagtttctgggataatcactatatatatagaaggtttaaatatctagctccaatgtacatcccttttacaaacatgaggagcttttgcattcattcacagtttacatccattagctttatcgaaatgactagtgatgcttttttgttatcaatgattcatggaatttctgcaacagttagatggatttgtacaaacttatcatctgtagaaagtaagaaaatgtacttgtttgtttcctgaggtcaaatagtatgtttacctgacaataaccagcaggtaaggtaacatcaatgtagttgaacttatcgaatcacctttacatcctttagcagttatgctctttcttctatttggatattgtcttcacagtctttattgaacctttgcctatatatttctatcagtttacactgataaatactggttgatatgcatctggttctggtgcctgtttgtttatttttgacagactaatgccaatttgtcgctctgatttatttacattttaactaacagcttaatatttgtattgcgaccagctttctacatggaggggccttgggcagcaactgcgacaactggcatcttccttgctgctgcagtcactgattggctagatggttatattgcgagaaaggtgtgtcacaaataccgatttaataacatgccagacaaggtgcttaccagcatttttttagccctttaattgtttcctcacacaattttctgtacagatgcagttaggaacaccttttggtgcatttcttgatcctgtggctgacaagggtgcttttctctttctgctgctcacttcttaaattgcccttcccacccattttgttacttgaacagctgtgttttcgtttttcctgttggattgtttatgttcaaatgtgagctaactttgttactgccattccctgctgcagcttatggtagctgcaacattagtgttgctgtgcaccaaacctttggaaatttcactgctcagagatgggccatggcttctaacggttcctgccattgctattattgggagagaggtatttccttagccaatctacattgtcaattcatgcacatttagtgaaaatttggtttatagtaaatttttttttgttggtgagctagcataaatcttgggtaacatcttgatttcttgggttattggatctggtcagcttatcttaatctctaagtttatgtttcaaacctatgcaatatatgataagttgacaacttcccataataaaaagaagctgacaacttggtgttttgcttttgcaacgtaggttctatctagagcacagatctaagggtaagactacataatttatgatttaatgaatgctgtttggccaacctctatcttttgggattgagccaattcattctcttttctgtgaggtagagtgccaccatcatgtggcttgcttgaaacagaagtgaaaagcctgcattgaataagaaattttatctcttctttttttcatgctttaagaccctaattccatagtttcttgtcaaccttgtaattccatgcgaaggtgtgtggtaccatgagcaccattatttctattttctagttatgcaaacacgtgtatccatgtagaacaaacgtaactgacacagtgtggtggaatagtgatggttgctacaagctagtatcctaacctattacacatctatcttgtgtttatgtagatcacaatgtcagctgtgagagaatgggctgcgtctcagaataccaaagttcttgaggttcctcctgtgctcagttatccttggattccattgtcataatttgttcagccatttaaatttctacttgctacaacaggctgtggcagttaacaatttggggaagtggaagaccgcaacgcagatgacagcattgactatcctccttgcgagcagagacaaaaggtattcttgtttggtatttgcatggagttttaacattgcgcagcattctttttattatttctgtgttgatggttcggttttttgtgctttgtactttgcagtcttcctgcacaagatgctctggttacttccggcatcgcattgctttatgtatcagctggacttgccatatggtccctagtggtgtacatgagaaagatatggcggatacttctaaaatagccgtagcacatagtgtaatagaaggaacaggagcaagccagcaaggtgatattacatttcaagagcatacaatttttgaactgcggagttgattgatggacctagaattggttgagatcctcagctacttacgcattgtctcagtttggcggattagttgctaagttgctgtggctgcaagatctccgtagaaacaaaaaacatagtagcaagtagtatgttgcccgggtgattacttcttcgaaagctatttcagagcctatcacggctcgagtgttggacactgggtgtaatgatctgcaaaactgaaaaatgcagaagattgtaaccgtatacgaatacaaaaccatgaggtttgagtgtgtgactctggggtttctatagtttctaccattgtaagtttacccatatgatatgtcagaagcgaacattattctttggacaagtggtgttcttgttgtgcatttgagccatttaaccaaatctgtttgatattacacctggattgctacacctcctttttcaaagaaaattaggtgaagaaaacagctattgccgtcatatgtgccacttgctctcgtgggcctcgtggccgtttgatctgatctcaacggtctagatcacgcgaggccctgaactagtaggggtcacagccaaaagcccaaaactctcatgcccgcgccggcgggtgatcggagctgagcatttcacgagcagcggatgaagctgccggcgtggctcaccgccgtgccgccggatcctagggcgtacggtcacctcatccagctctgcgcggaatccggccacctcgccgctgcccggcagatccacgcgcgcctcgtcgccgcctccgtgacgccctccaacttcctcgcctccaagctcatctccctctactcccgcgccgaccgcctgcgcgacgcccgcagggtgttcgactctatcccgcagcccagcctcttcgcctggaacgccatcctcatctcgctctccctccactcgccggacccttccgcggccgtccgcctgttcgcctcctccgccgtctcccccgacgagatcaccctctccacgctcctcaggtccctcgccgcgtccggcccggcgctctccccactcgtcaccggggagctccacgccgtcgcgttcctgcggggcttcgggtcagacctgttcgtgtccaatgcgctcatcaccgcatatgcgaacgccggggacatgcgctccgctcgcgctgtgttcgatgaaatgccgagaagggacgtcgtgtcctggaactcgcttatatccgcgtgtgcccgtgcaggctggtatagagagtgcttggatctgttccaggagttcgtgcgggttcgttgcagtgatggtgatggtgttgggccgaacggtgtcacggtgacaagtgttctgcatgcttgcgcgcagctcaaggttgttgatttcgggattggtgttcaccgatttgctgcggagagtgggctggacatggacatggcagtatggaactcaataattgggttttatgccaaatgtgggaggttacaatatgcacgacagttgttggatggaatgactaggaaggattcaatcagttacagtgcaatgatcacagggtacatgaataacgggcatgttgaagagggaatgcagcttttccggcaagcaagtgctcggggcatcagcatgtggaattcagtgattgcgggcttagttcaaaatgggcgccagtcagatgttcttcggttgttgcaagaaatgattgcctctaaagtactacccaattcagccacactttcaatcgtcatgccttcagttccttctttctcaacactactgggagcaaagcaagctcatggttatgcgatcagaaatgactatgatcagagcatcagattggtcagtgcattgattgatgcgtatgcaaaggctggatttcttgatacagccaggaaggtgtttaaactgactgaacatagaagcacaattgtttggacatcaatcatatcggctgtcgcagctcatggagaagcagttgaagcattgagcctgttcaatcagatgattactgctggtgcgaagccagacactgtaactttcaccactgtgcttagtgcgtgtgcccattctggcaaggtagctgaagctcgtaaggtttttaactcaatgcaggctgtttttggtatctctccagtgattgagcagtatgcttgcatggtttctgcactcagtcgtgcagggatgctcaaggaagcagttaagctcgtcaacaagatgccttttgagccaaatgcaaaggtctggggtgcattgcttaatggagcagcagtagttggtgacgttgagttcgggcgttatgcatttgatcgcttgtttgtcattgaacctaagaatacgggtaattacattgttatggctaatttatactcaaatgctggcaaatgggaagaagctgaaaccataaggagcatgctgtggggagttggattggagaaggttcctgggtgtacttggaattgagggagaacaatcgcttgcaagttttattcctgtgtttgccttaaagccgaaagctacacacattgatttggttgttgaggggttaaatgggttgaatgatagaaaagatcttgacatcaacctaagagttggatgaagacaagttatgtcgatagcattcaatagagctaaaagttgaaatgtgattatcatgcctgaaagcacatcggcattttggaattatttggaccatcggattccatacgccattatgtggtcaattatattgatctgaccaattatcaaaccctaggatgacaaaggaaaatgagaactggaaacaataagagctttgctaccacaatcttcaaacctttcgaagtgtatgatcttgagctctaatttttaataaggccaacagttactacagcaacaggaaagtcaatgattacaaaaatgatgaaagcagttgcattctgatttgaattttcaggaagtgcctccacaagttaaatctcagtgtttgatgaaacaccaaaagagcagcatacaaaagttagttcagttcatcaaaagtagttgttctagcttcagtgtttttatctcatgaaaatcactactggatcatttctttagcccaccatgcttttttgcattttgaaactggaatctgtggttaatgggattgaacctgtgattttttttcaacatttttttctccgtccaaaccaaatccttgtctgctttgcatgcatgtgcccaatcctatcctgcattagaattacaactgcatagagctagcacaacaagatctgtcttttagtaccctcgtgcttgtggatcacggttcacatgcttggatcattctacctcttcacttcccaggtcatgaactccaaaaaggaaaagcacacaagcagctctccggactgtgcccaacttgctctgatcttactaccagaaagccacgactcttatttcgttctgtgccagcactcacatgctaaaacttcacaggctgaaggttgcagcgatctccacatgcactgaccgaccaaatgaagcaggggatagtattactagtggcaacattgatgtgaattccaatgtgagctccagctcatcctggagccttggagttttttgccgggtggagccttggagttcaagtgaagctaagtgagtataatcaccacgacgctcttataatacaataggtggtacaatctattcattcgcatttgaacgtatacaggtggagcgctccataattgggatcacatcatgcataggcgttgagcacttgagcctatgacagaggttgttactcatccanagagtcccaaggccagcaagacaaatcaggtggaactgtttcctctttaattttcttttggctttaccttcactgtttgtatctacattgttgcgcggttgtccatttctgtgccttgatctaatccagaatttcaaaatgttttgaatagtttcggtggtattatatatgttatatctctgtgcacgtgatacacctcccaagcctcccaggtcacggtaatgaccagcggtgggagacaaaataggccgtgtccttcagtcctttgtgcattggctgagcggtgagccggtgagcgtggcatgggctatgtcctatgtgtccctgcattcacttgctgaagaagcgtcatcatcatcgttcatcggcctgttgcaaaggctccactcttagatcaggaatgatagtcaccgttgcgtagtagggtcgtcgtaatgatgccgggcaaaaaaaaaaaaaagaaaagaaaagacctggaccagcagtagaagaagaatagtacagtagtgtacctagcagttactagttacatagcatttccagtggaatctggttggaaattcttggggcaggcaagttctttttattgttccgcttccatcgctttgatactttaactgcctgcttttttcaaagcataatttttgacccggaaagctctttgtgtagctatggtggtcgaagatcctgcggcctgcagtatcatcgctccagaatccgaagcctcagatgcctaggaaacactgtgcaccgtactgagcttatagcatgaaaaagccgcagctatctgtctactacgtaccactctactacctccagccaaattgttggtgtataatttcatagactgttaagctcgtgggcaaggaattgttgcgccaatagaatcagcaggagaatcaaaagtacactcgcagatcaccactcatccctcacatgatgttgggtgcagtgctaacttccaatctcaccaagcaccagcgaattcctcgacattcaacgtggcagatcagttcagctcagcctaaatattccttccgttccattttaaatatataaatatagttgtgaatttttattttaaatatataaatatagttgtgaattttcatgtctaacatttaactatctatcttagttgaaatatttttatgattaatatttttgttgttattagatagtattttatgtgtgacttgttacttttttaaaaaaatataattttttctaataagacgtacggtcaaatgttgaacgcgaaaactcacaaatgcatttaaaataggatggaggtagtagtttacactaatttccaccaaattctgtatatattgttttcagagttcaggctattatttttaacagccgcatgcaggagaggacagctcaaatgtcattgttaatacttttgtcctgtcgctaatctgatgggtaaccctactcaaatcatttcaaatgcagaagaacacccataggccgctcgtgactgaggcgccgcgacagggacactcgaggcgtttttgtctttgtactaccgcagtgtagccgtcctcctcttcttttttctctagaaaatacagaagtcggtggcttcccagaatttcagatgctgctaaaaaccacgaggaaaagaaaacccggcaagaggacaccaaggcctgagaagatggggcaaaacaacgagcgggttaaatgaacattgcagagcggcctttcacgtggccttctttctgccctccccttcgcttcgctccctcttacactgcagttatgcaacccccaaggtaatgaccccacatgtcccctgcgaccatctctttgttaattatactagtttagtagtatcattaccacgcttatctgtactttgcaagttaggttaggtttgagcttgtgtacagtatacaattgacaagtcttgttggcagttggctgatgcaaacttttcttaagctcctcaacacaatctctagcatgttacttctcccttctgctccagtgcatccatctcaagacctcataccatctctcttttgcaggaaactaatgtttgcgtgcagattatgtgactgtaaaaaaaaatcaagacaaatgcaagaagtgcggtcattgaagaatgtagggaggtgtaaaaaaaggaggtttctagggacaccagttatgcacctcacgggtggcggtcacggacagagccggttactgtggtcatcaaatcagtaggttcagtacacgtccccttaccgtgatgaggcgcctcacctcacgcctcagccatcagacatcagacggacgccttcggcttcaagcctccactcctactacctccctccaattcagcaaccgtctgcaccccaagcccaaaagcagaggcgcatgcagcggcagaagcagccacagccgtcacatatcgtacgcccatccctgaccccaaatcttggtcccttggatactactactaccaccagaaacgtcgacgagagaagggaagctaagctaggagaaatggctgccacagccatgcaatgcaggtttgctacaattttgcttcttgggttttttcttggatgccttcttctagctaggatcagttcttggattttctgttgatggatttatgggatcctaggatcggttccttgacatcatctgcatttgcgttgcgtctcattgattgcaggggaggtgagcgcagcgaggacggcggtggcggtggcatgaggacagtggagtgcctgagagggaggctgcttgcagagagggtagcatccaaggctgccaaggaggaggctgattcactcgccaaaagggtatcttctcttagccacattccctactgttacaacctccttgataggaagtgtgtgatactgttcttgagctttttttggtggttggttatgatttggtcgcagctggatgagctggagaagaagctctccgacgaggtcaagatcaggaacaaggcggagaggaggctcaggagggccataaagaagctggagtccctcaagattttggatgtggagctctcggacagctccatcgggtcactctcctccaatagctgctccggtcaccgcgcgccggagacggaggcggacgtgaacaatcctggctcctcggctggttcatgcactcaggtgaactcctcccaggaagggagctggtgctctgttgtgtccgagcaatcaccatctgttcattgcaaggaggaggaggagaatggcttggaccctgaagatgctaagaactgcggctctggggaggaggctggtgaccatgactcagagaggtaagcatgcggattaacaagaggtgttttattattggtcaaaagttaaataacctgcttaatgtttctaggattaccgtaatttcggtaggaactaaacaatctcgcataggtatttctgcattttaggtttctatgttgccttatgtctcgccagaactaggacataaattccctcctcctacgttttgtttttcggttcatggcggctagctccacaggcatatttcacgattattgttaggtattgaggaaacaacctgtaccctttgtgtctccacaagcagaatgattgtgtttaggatagcaaggagatggacggattgtcggtgttgtacgccacacaaattggaccaagcccacctgaaatttttcactttggtgaatgttagtaactcaactgtacgaagaactgactacgtgtagctgccaccaattatagcataaacatgtgcacaattgactccggtgttaaaaatagagcagttgcgcttgcttaaacggcaacttgatccttcaaatttgactattttttaattccttggaaaatgtcaaatgctaactttgtacttaacaatttaacaacctgtattactgatgcagaacacatggaacgctcccatgtagcagggatgatgaacctgttcatgtgccatccgacttcggctcatcaaaatcccaagataaccaacgcgacgaggacgacgacaggctagcgctggtgctggtagacccgcagccgaatgcagaaacaggcaacgaagacgatatgcgtatcgatatccaagcacggaaggctcaggccgagcccagagagggagacggcgaaatggaggaggcgaatgagctcgcgatcgtgctcgtggacccgcaacccgagcccaaggcggagcctgcggcgacggcgaggccgcgcaacgacgtgcagtccgtgctcctcgcgctgcggcaggtgaaggagcagctgcggtacacgatcgagaggaggtcggagctcgtcgcccaccaggagctttgcggccactgttgagagcgctgcacctcgtcagttttgagcagcggctcttgctagtatttgccacgatactactagagttcttgacagtgatagtgtagtagagtatttgtagagaaattggaataagattttgctcccgtggctgtgttacatacacgggagacaaactgagataattcagttgtgtacaatttgttctccatctgtcaatgttatatatgatggtctgatacgtctgttgaaaggaaagcatttcatggatttttactatccattgcaaatttccaggatatccatcggttggctctttagaagaaaaaggcggtttataggtaaaacttctgtatatatgtccataacgatttaaaagaaaaggctataaaataaactacaataaaaaagtttataaaatcaactctaaaattagttttaaaatttaaattttggcttaaaagcggttgaagaagcgaaacgatgggagccacaagcttttagtagggagatcgtggaccatgtatgcactaacgaaatgcatcatcagatattcacatgccccgctgccaagacattggcattgttgcgtatgtcattttgtaacacgaaggaagcatctaaaacttagaatacgataacgtcttaaaagctaactacaacaacataagttactactggtacatacctaaggagccatggtcattaaaagagggaggtaacaaaagtacagtattatcccaaaccaagcagcaagtcaagctacactgctagggaagtaccgtaagcaagtcaacacagtaaatagcactcaacatggctaggagaaaacatgatgccactgatgtcgttagtgttgtacaaactacggcttcaccccaaaagtaagggccatgtccgagatctgcaagaatggagtgatactttgcatgtcaagcaacaagcccttggcaatgggaaatattgtaggatgatagcagcaatatataacctcacaaaaggcagggagtgcttccattatgccgtgcctgccacagtggccgcgtcctgcgtcttgcaacacacatatgggtcggatacaaaaacacacaaaagaagcaaaagttacacacaataccatgataaacttaccggcttggagctgtctttgccattttcttgagatggtccactagatgtttctgcaaacctgggaaagtagtgaagagatgtcagctatagctgatagctaggttaagattctattagcaagaatgatatagcactgccacattcgtacctaagagctcgtgcctttcttttctcttcttcccccttgtcaacatttgtactctgaccaaatcgttctaaacgagcttttttcttagcgtcttcgtcagcagaagatgaggcaaggccaaatctgacaaagtgacaattcatccaactatgtatcagttcgccattacggggaataagaaaaatctacaatagcagagtgcaaatagtggtattaacacacctctcagccctggacttcctcttttgttcctccgccttttcatttgaagatccagtcccaaaccttgtaaacaagatgagagttagtaactgaaataagttgtttgggcaacatatctgatgcaaagctaggagaggcagaaaattagtttaacaaaggagacacttcatttagttccagtcaaatttaaatccagcaccaactagattgaaagcaggatttacttttttaaaccagtactaatacacatgattgaatgacagtctagtaaatgagctctgatatcaaccaaaggtaccattatttccatccgaataacatctaaagtagctgaattctctcaaaagcttttgatgaatcatgataaagcaaacagatggtttaattctaaaggaaaaaaaccatagcttttgtattcaaaacaccctcttcattaagagcaagaaatactatcataaaagaatagggtgtagttaacggccttttattggattcaatataagtctgtaaaaggaaccaagaaacttcttaaacatggtgtaaaatagtataaatcacagtaattaattaaaagcatgaatgccttaagagcattcagcattcatccgtacaacggcttaatttggatgtggcttgcctgtgccctctgtatgcttcaatctatgttcctcaagcaagtgtcaaccatcaaactttagtccatgccagagaatttttctcctctaatctgctccatctcagagaagatatcatggtggccagtgttggatttcatagtgattgaaagctagtcaataagggtagcctaagaaccttcctataagagaatgcacttttcttgtaagttaaaccatgatgcaagtttattgttttccttgttgtaactaactgcacttcatctaaacaatttgaactggaacatattttcacaagaatactattaacccaaaaacagatatttaattttcaaactgtggcagctagatttcagacatgcattgaacacaccattgggtaaaagctttgttaagcatctcccacctgtattcttagtgactgaatatagataaaataactatgttgccaatggttcatgggatttggtagttagtccaatgaaataaaggttgatagccaaaactcaaactgaatacccaaaactaggaccactactgtattacagaagcagtatgaaacaggacatttagtgctaaacgcctaaaccaataatatcctagacaaatgaactatggtttgcgctaggacctaggtgatgcagcgcatagagactaaattagcaagcaattgcataaacctcacaggatattgccaagggagaaacacgagcacccttctcttaagcagggaaaccttgttaaaagagactgaaaggaatacatcgtattcgcctttttaaaggctcctagccgtctggtagcaaacaacaaagtactattttctaccacgggaaaatctcctcaaaatccatgtataaatgatagagtaactaaaaactgcaacattggtgcacagttaaatcctgcatgcatcctatatattgttttctaacaatactaaacacatctgttcatggctcaatattaccaaggtctttttctgaatccatcatttcaaaagacgattaattatcccatattcaccctcaccatgaccacgaaatctccaggatctgttaggccaaaaaaaaaaatctaaaccctagaaaagaagggactggacagagcaatcacctctcggcgcggctgctgcgcttctcctcctcggacatcaccacggccgtcccgaaccgctcagcgcggcgcatcttcttctccagatccgtggccccgccagcggccgcccccgcggcagcggtagggttttgggctggcgtggcggccgacgcggggttcggagccggcggcgcctcccccgctgctgcggtggccgccggcggggacggctcggcggcggcctgcgcgggcttggtgctctgcgacgccatcgaggggggagctctcgtcggggggagagactagagagagaggtagagaggtcgcaccgtcgcagactcgcagtgggcggagtgcggccgagagtcgcctggtttctttctccttttccgcgattttttttctgtgttttttgctttgtccgcttgcgttcccccgtttcgacacctgcacttcgcatatgtgctaccaaatgggcccttgggccattgtagatgggccataatgctccttatataggagaaattgcatttttggaattttttattttaattttttaatatttagtagaaaataaattcgtattttaaaattttgcagaaatatattcctccgacgatattgtaggacatggcatgtaaattgccctatgagatggcaatttatttgacgtgacacaccacgagagatgcgtcgtgccaagtttttaggtggcctcctctgtgataaaccgctctcccctaggacgatttatcaaaattgtcatggcacgacccatgcatcatcaaactttgcgtcgtggcaattttgcagccacccccacaataaattgccctatgggagatgttacatagggagataaatcatcgggaggggggcacctacaaaattgtcgtgttacatagattgctctatgcccctccctaaggtagagcgggaggagatttttgcaaaactttgaaattgtaattgtattttttattcttttaaaaaataaatatatttttttcttaaaaaatcacaacactgttgttgtgagataaggcataaaacctggtagcacaagcatgctatctaaatcgtatggtatatggatatgctgggaaaatatgtggtggaaatcacatatgtacttatgtagggcctgttcggccgcttggtacagccgctgcgctgccacagccgaaagaaacaacacactgtgctagttggctgcagcacagtgaaaataatggcagtcgaacatagccgtagtggaaactcggaaactaccgatggattgaaaaatggacatccgagattcgtccatgtcatcacgagtaaaaatgttgctcacggatatattgcgagatttttactcgtaatgatgtggacgaatctcacaagtcaatttttccatccaatggttgtttccaaatttccactacatatgtggtttccaccacatattttcccggatatgctacctagtttttaataagatggcatcgttaatttttaacgcatgtttaactgtttatcttatttcttaaaaatatgtaattattatttattctgttgtgagttgttttattactaaaaatattaacaatgatgatttatctcttatgtatttgtataatttttttactggaggaattctatccttactcatttttttatataattgcctggcgaaattttcgtttataattagatcgcataaaacactactcactatgtcccaaattataaagcctatattttttacatggtctttaataacatattttaaccaatattttattctattatatgatcccaacaaatataaaattagcatcacatgaaagtacttcacaataaatctagtaatataacgtacataatacttaaatctagtgatataatatatataatacttagtatagatatagttagtatgattattagtcaaaatattccgaatttgattctcttaaaaaaaaagagcgtcctataattttggacggacggagtataacgctatcagtgactaagctactcaagatgacataatcagttatgtcacaggagaccaccaaacaaaagctatagaaattagaaaagggccaaaaggcaggttacattcttcagccacaaaacctaccacttaaaacataaagatgacccaatcagttgtgtcaccctgccattacgcatctcaacacaccattagtccagtcaatgattggagctaatgaacttggtttgccaagtgccctcgccgccacggacacagacgtttccaaaccatttgtccaaacaactgcgacccaataacacaatgtgttaactaatcaactcgtctcccatctcctgcaagtataaaaatactcacccagatcaaccacgaatcactcagcatatcacattcacaggccacataattggatcactcctccctctcccagctcatcgccatggccgcagctgcagcaccgcgtaggtaagccatcatttgattagtagtagtgctgtgaaccaactactgattagctacggaaaatggcaaagtttttaccctaatgacgatctctgtgattaattacggcttcgcgtgtgatgcagctccgggaaagaagcgcttcccgctgcgctcggctccgcctctgagccccctcgcctcttcgacggcaccaccaggtgaggttaacttacgtgacagataattaattaccatgcctctaaatccctttttttttcttttaacttctgcgtcgaagtaaatcttcttttgtgactcttgtgaaggctttacatttgctacttctgcccgtttgctcagcgcgcttggattatcaggaacttcaaggtgtttgtttctgaacttctctgacctttggctgcagagtttcatactccttttactcctcctgctaaaaacctgaattttttttgtacttttttttggctgtcaatttggccagggcttgcaggacaagatcgagctagtcggcattgatctgcaggacaaaccagcttggtacaaagagaaggtttacgaacagggcacggtacagtacacctgttcttccttcctgcatgtcatctgaatctcttcatgtataatttttgtcgatgaacaattgagtagtatggatgttgttgtctttctcgataggtgccttctctagagcacaacggcaagatcatgggggagagtttagatttgatcaagtacatcgacagccatttcgaaggccctgcactgctccctgaagtaaggcagagaaattcagtgtaacacgtgacagtgatgcagtttttttagggagtgacaatgatgcagttttctttttttgggagtgacaatgatgcagtttttttttctctgagacgtggtttacagcttataataatgtttggatctggaaaatgacaggatcctgagaagagacagtttgctgatgagcttattgcgtatgccaatgcgtttaccaaagcactctactcacccttaatctccaaagcagatttgtcagctgagacgggtaagagctactccctccgttccacaatataagtcattctaacatttctcatattcatattgatgctaatgaatctaaacatatatatctatctaaattcattagcatcaatatgaatatggaaaatactagaatgacttatactgtggaacggaggaagtagttgtgtcaatctagcattgcagcatctatgccatgtttgtagataaggagatttgcagttttaattcatttgcatgctgttcgagaaaattcatttgcatacatgctgatttactgaaattatgtatcatcatcagttgctgctctggacaagatagaagctgccctgtcgaagttcggtgatggtccattcttccttggacaatttagcttggtatgtcgattcggtttgttacaatgtggttcattttcctttccaatgtttaggatgtgtcgaaggtaagggttgggaacttctttcccgcgtacataaaacggagtaattcattagcgcataagtaattaagtactccctccggttctataattcttcatgttttagacaactatacggtctccaaatatatctttcactatgttttttattataatatgtaaattaaataaataaaattttacttttattatagtactttgtaggtaaatctattgctctagtgactttaactaaatatctttaaagttattgatagtcaaaggtatataaaacattgttcaaaatgtcaagagtaataaaatcggagagagtattagctaaaaatacttgaaaaatgaatcaatatgatttttgattttttaagtaactttcgacatattttttttaagaaaaaacaatgcatcctttagtggctcggaaggtgtgcggaaaaaaaaacagagagtagaagttgaaactcctacggagcacacccttaatttctcctaaaaaacttgtggccattcttcgatttccaggtggacattgcgtatgtgacaattattgaaaggattcagatatactactctcatataaggaaatacgagatcaccaatggccggcccaacctcgagaaattcatcgaggaaatcaacagaatcgaagcatatacacaaacaaaaaatgacccgctttacttgctcgatcttgcgaagacgcatcttaaggcaagaccacttcctgaaacaaatgctcagcctccgcaactttgatctgccagttttatagtcacttgacaattgcacttctttaatttccaggttgcctgaagatgttgagccagcgatgtactgaatgacagaatgatgatgatccatgccccccccccccccccccacacacacacacaaaaaatcaatactcttttcttgctactccagttgatagtacatgttttgcagcttttgcttccaataaaccgaagttgacatgtggtgtaaaagtcatgtttgagtaataaaatactggtgtaattctatgttactcaatgtcgttggtcttaaatatactttcatgtcattgaaaataatcttttgttgtcaaacttatttactagtatttattatccctacagtttcatattaataagacgttttgacttattataagcagacctctaacttaacaaagtttgtagaatagggtagtaatatttttaacacaaaacaaatataatactatgtaaatgttagatttaacgaaactaatttaatgttgtagatagtgttatgttttttttcctataaatatagtcaaacctaagaaagtttgtctgattaaaaagttaaaacatattataatataaacagagaaatatgttttttaaaagggaaataaggtttttgaattgttgagtcacatcataagtcctttcaaagcaccattagtgtgagtgtttcggtgaaatcattggtatatatgaccatacatacgatgattctggtgcctataatattacatagacttggtcttatttttttatgaagccatttggcacacttgaatgatatgaaaacataacacccttcactagaacgtttagcaacaagttaggagtttgtgctattaatagaatgtttcgtgacgttatctttccttttaacggaaaatagcacaaaagtgccttttcatttaatagagtagaagaaaatacaacctctagggtaaagcgaaaaagagagaggtcaccgtaagctatacactatacaagttgcgggacgaactcgtgcaatcttttagcccctgctaaagcccaaaggctagcctcttctttgatttttgttaggagaaagcttgttgccacctctttgtggtcgaaaatccgtcgatttctcaccttccagatttcccagacgactaacaagatgagggatcgaagacccttttttaggacgttgagcgtatttgctaggctctcccaccattgatggactgaccgagcttcctcccactgagccggcaccaattgttgatatcccacccatctagcaacgaggtgtcagattatctttgtatatcctcacatggtgacgagatgcaaggccgtctcggctttacaacgacagagagggcaatggctgttgttttgtcaactcctttcgcaagccggtcagacgtccaaactctattctggatgatgagctatgcatggaatttgcatttccccggcgcccagattttctagaacaaggagttgagacttgtgtttggcgcccgcaagcactgtgcatggtaggccgaggaggatgtgtagtgcctattacttatgaatttccaaacaatctggtccggttcttcgttgtttaagttcacattccgaaccgcttcccactagcggactaactggtcaacaaggttgattgtgaaatatgagtctgcatcgagggtcaggtcatgcacccaggtgtcgtcttcttttacttggcgtagggactttcctttgttcttggagatcgcatagacaagaggcatgaggacttttggtttgcacccatcaatccatgcagaacgcttgatgttatggtacgtcttttaagtgtgtcaaagggagcagcttttcgtgtgtgtgtacgtaggggtaaaaacggtcgaaatcggtagcatctcttcaggaacaacggtcgatcagccggtaattgatcatatttatcatttaaactactcagtgtcgatattaatacgatgcagaaagatattagaaaaaacaaaattttaaaatagcaataaacggtatggtcgaaaatggtaccctttatacaaaaacggcgtttggaatttccgtaaccattttcacccctatatgcatgtatgatgcgcacacgaactcaaactaggatcgaaataaaacatactacttcgtccgtcctaaaatataaggaattttaggtggctatgaaacatcctatcacaataaatctggaaggcttatgtctaaattcattgtaataggatgcgtcaccttcatcgaaaatttcttatattttgaaatggaggtattaatagttaggtgggtctcaacaggcctatctagaacaattccctatgtagtgagccaaggaggtaggatagttccctccgtaatggatcgaggatgtccgtctccttaacccacttcaaaacgaacatattgtggttttgtataatttgggccgaggaaaacccgaaaacatctccctcggtcccaccccaacaaaccaccggtttccttctggagaaatcccggaagaaagcacaggaacacgggaggatgtgcgtgcacccacaccacgttctcgtccaggtgctgagcggcttgacgaacctgaccttccgcgcccgaatcagctgctgacgtatcgcctccgccattaccacctcacactctctctccccatgaattcgctcgctttccctcgcggccgatgctccccgtcaccactgacgcgcccctccacctcccgtagttcttccgtcccatcgtcgcgcacaataaagattcgcccgagctcgcgaagcgtcgcccggtgcaacctccgcgacgccaagaatctctccccgtcccgcaccgtcgccatggctgccgcggccgccgcaccggcaaggtgagcacgcgtgccggctgcggcgaggctgaggagaagaataaaccgcttgttgcggttcttgattaaaatctgaatttctttgcttctcttactcatgtgcagctctgagaaggaagtgctccccccttccctgacctcctcatcggagccccctcccctcttcgatggaaccaccaggtagggtttatgcagacaaaaaaaaaagtttaaaaaagaaaaaaaacgaaaggaattgcagttatctgaacttttctggtttctgcaatctgcatagattaggggtaatttgatttgtttgccttgcgcaggttgtacgttgcgtaccactgcccttacgcgcagcgcgcgtggattgccaggaactacaaggtattacatgctgttctttgatttgcggactcggttcgtagttttgggagattggatcacataccctccatttagatcgggaattgaagacttctctagttttgtggtggtgtttctccgataaaattggatcttttttgtttgtcttttcgtttccagggtttgcaggataagatcaagattgtcgcgattgatcttgcagacaggcctgcttggtacaaggagaaggtttacccagagaacaaggtatagagtatccctggtgttgagttgtgatccaaatttatttgcacttaataaaagcgagcttcagccgacggatcgtcatctttttagggttccaccatatatatacctcttgtaagccgccgtgcggcgatgtaatctcaccccagatataatgaagatattttgctggctagcgcccgtggttttttctgtccggttttggaagggttttccacgttaaatctcgtgtcttatatgattgatctattattatttatcgtttgttcgcctatcgtttcctaacaccttgttactgtcaagtctcaactctgctccaataaaaaagaaaaatcctttacagcttaatttgctataggtgtgcacttacttttttttgccgggtctgtgtatgcacttttactttttgataggtaccttcacttgagcacaacaatcaggtgaaaggagaaagcttggatttggtcaagtacattgacaccaatttcgaagggccagcattactccctgatgtaagacgatatgttcaactttcactggtgtaatgcttgcaaaaagagaagtaatttataatgtgttagcctttgaatgtgtaatttgacaggattctgagaagcagcagttcgctgaggagcttcttgcgtacactgatgcgttcaacaaagcatcgtactcatccatagtcgccaagggagatgtgtgcgatgaggctggtgagagcactcgtgtactactacttgattactcatttgaacgattttttatgcataaattctgcagtttgtatccacgtgctaatctgctaatataatactcttcgtcagttgctgctcttgacaaaatagaagctgctctgtcaaagttcaacgatggcccattcttccttggccagttcagcttggtacgccactatagtctgggaatgtttttccctggattatcatttaaaattatttttgaaagctttttgtttttgctgaaaaaaatgtgcttgatactccttatttctttccaggtggacattgcgtatgttccatttattgaaaggtttcagatattcttttctggtataaagaactacgatatcaccaagggccgacccaaccttcagaaattcatcgaggtaattcagaatgatggtacatgagaatgtgagattgcgccatatgttagttggttgggattatgtttaccctatttttattgacgttgtttcgaatactagttcctgtggccaaagatcacatggtgtagttcaaatcaatgttcttgttagaaaaaacttcgctgaggagaaactaactcaaattgatatgttacaggaagtgaacaagattcatgcctatacagaaaccaaacaggacccacagtttttgcttgaacacacaaagaagcgtcttggggtaagatatatttacaattgttcttatgatctccttccgccgacccggcaaaattgttcttatgatccatttcatctgccgacatactacatttatacattttttgcacattttaacttccagattgcctgaagatgtgaccaaggatgaacccacaacaacctgcgatggagacagggagctggtgcagtatatagtagataaagactagtgtgcttcattttagcatatggtttatcttgaataagataatgcatgtcatgcagaccatgcttatggaacaaactattatgtatttttggtttggctgtgtacagctgttaatgtgaatttcccgtcatataattaattacaagcttcgcggggcgttgtctaataaatcaatgcttcttgtatcattattactagttgtcaggatgattttcatagtgaagtacttctgcaaatatgctaagcagaagtcaaccggacgttctaatgatgggtgaggaaacttggtgataagcacgtatcataaattcacaatcctccagaatggatcgttgagaaacgtctcctgcgagaaagcgcagtgaactgcgtatgaaaaagagtaaaacagagttcgttttttgtttctccgaagccccgaatggattgaatcgttactgcttttgccaacgaaatgaaggccgatcctgaagccctctccctctgtccttttccactttgctaatcttcctcgtagaagcatgattatgcagattattgcattggcgtaagtgtgaggacatgccatggttgatcagttacagttagtggttcaaccatggcctattggttcagagctgcaggtgttactaacttaccagtattaggcgattcaaaagcattcaagtagtataaaaccggcggagtaatttatttgtgttcagtttacagcggcaactgcaaatattactcatgctcttgttagtactaccttgtaatcctttgcttaatactccactactacatgaatacctttgtatacatgttaagatcactgagttggctgagcacgagtagtcaaccaaactcgagaaatgaacacaaatgccagtgtccatttcatgtggccttgaaaaactaatcactcttttgacagtcatcaccatacaagaagtctacgatgtactccctccatcccataatatagcaacctagtttcagacgagacacttcataatacaacgaatccggacatgtttactattcagattccttgtaccatgaagtgtcccatctgattctaaattattatattatgggacggagggagtagcaaaaattggttagatgtctataccacgcatgatgattttagttgccttgtattctcttaaaatacttgtatctccctgctctctcttttttggcacctctctgtgacaccctttaaatgctgaaactttgtatgttgaaactttgtatctctcttcttctataaacgaaatggcagagctcctgcccgttcctaaaaaaaattgaccgctctggcacatcctgtgtattcttctccagctcgtgaagaaccgtgtgcaagatgccgactaatcaccgctttgtaacgtgacacgttccaggagcgacatggcaccagccatcaccactcgctcctcttttgcttcggccgtcaccgctgacgcctcaagttttcttctcgttttacctttcaacgcccgtcttactcctgtactctcgtttaccagagcacggtgtgacagatgcagcggtttcacctacaaaaagtgctcatttttgcaagttgtgtacggcaatcgcaatggcaatggcagcagcagtagcagcaagtaggtgcgatgcagtttctactctctttttttttcaaagaaaagtttcttaggacaagttttataaaagaggtggatgttgcatctaatgttgaccacatcatcagctaataaatgtagaggtaacatgtacaatatatcacatatatactaattctaatacactagccccaatgtttgtttgcccaatctactcttcacctctctccttttgtcttgaattttgtgtagtggttgcctcttgcatgagaggtggctgctttatctctctcatctcttctctcctccacctcactattttagcttatgtggcatctaggagattatgcttggatgccatagtacttgccctaaggcagcgttcgagagggtgagagagtgagtttgtttgtttcgttttccgcacgcacgtttcccaaactactaaacggtgcgttttttgcaaaaaatttctatagggttgctttaaaaaaatcatattaatccatttttgaaatttaaaatagttaatactcaattaatcatgagctaatagctcacctcgttttgcgtatcttcccaatctcctcaatccccttcttctcaaacacacccttactctattgcaacgaataatacgtactatatctgaatcacataattgcacggtatgatttatcgtctctgttggatttaggcttgcaatggaagttctcccgcctactatgccatctgcttctaagcagccacctctctacgatggcgaaaccaggttgatcaatcattactgtttatctgaaattaccttctccctttcaaatctttcagaaaatatgctatctgtaacgtccacaatcaccttgatctgcatttgtcaaatcatctcgaccttgctaatgtataaaaagttgcaatggcagattgtacatgtcaacatttgcccatatgcgcaacgggcatggatcgcaaggaactacaaggtactacaaaaccaagctggtcttctgaacaagcttgattcacttgtcttctttagcaaattgtacgtcggtggttttgaattttgattgttttgggcatcagggtttgcaggagaagatcaaattagtccccatggacacgaatgataggccagcatggtacaaggaggtgtaccccaagaatacggtgtggctagtcttaaatattatatgaaaatgtagataatacttgttttcttaatgcttgatacttgtcatgacagctgccatccctggagcacaacaacaaaatcattggagagagtttggatttgatcaagtacatagacatcaactttgcaggccccagattgactcctgatgtaagcctatcaaactgcttaactccaaatctgtaataacaagccctgacaggattgatacctctactggtgacattaggattctgaaaagcaaaggcttgcagaagaactcctggcttattcagatatcttcaatcaggctgtgcgttccgctctgatctccaaggatgctatgacagcagaagctggcaagaactgaaaacactaaccataattcacttgtaattttgacatttttttctctttcaaatatgagactgacttacgaagcatccctgatcatcagctgctgccctagacaacatagaattctccctatcaaaatttgatgatggcccattcttccttggccaatttagtctggtaatttgcataaatgatttgaaaacctcacccactggttattgctggttaaacatggtattgatgtttttctttatcttttggacaggttgacattgcgtatgcaccttttattgatggatttcagacactgtttgctggcataaagaactatgatattactgaaggaagggctaacatacagattttcattaaggtaacagacagcaagagaacaaaaaagaagaccaaagatagagcatatgaatgatgattttgatgatttacttgtgacacggaaaataatgcttaacaggaattgaacaagatcgatgcgtatatgcacaccaagcaggatcctagcgaagtgattgctctcacaaagaagaagctcggggtaaggacgtaaggttgaccagcaaccaagaaatgcttattacaatatctgcaaattactcaaacttgacgttattttccctgcagatatgacgatattcacatcgatcaactggtgaaggatgcacgcataggataggaccaacctgctatgagcacaataaaatgtcactacgtagtgcagttagcaaggacgtgtaggactatctcgtcaggcagatgtgcacatttgtgatttaagacaaaatggcattttgatcaggggcggattcaccgttggggcttgagcctcagctccatctcggcagaaccccctgccctgcatgcagagcagcagccgcatggcttcgggagagaagcagcgtattgcataagtgcagatcaaccaggtcgcaaggaaggagcaaacgaagacaacatttcgcgatccatgggtgattaagtggactaattggctgctggaccttccttattaagctactgtattagtttttgctttcttttctgcctacttcaatggatggaacgatcaggggattagtgaagtgagtggtttttactcacaaagtaatccaacaattatcaacaattgtgttattgaatttgtggttgtgcctttgtcgtattgtctttcataatgggaaagcgttttcattcctcgaggggatatcccatcattttatgcatgtcatctaaataatcatcaaaaaattgaaaaaaatgattaatatgaaatatatcactccacaaacatgcaagttaaatttcaacttctacaagttgcgaaaaaaatatataattgtgaatatacgataactattttcaatttaatttgttatttttgttgtaacttgtagaagttatatatttacggagtaatatatctcatatcaatccatgttgtcatttttttcaaattaattagaactatttagatgacatgcaagcttccatcatacttcctaaaactcattagaaaggagcaccccctatatttttgttctagattcgccactgattttgatggtgtaatgatgtataagttcataacaaacaattccatcatatcgctcaaccatataggactactccatcagtcctaaaatatactacctccgtcccataataagttaatctagtatgagatatgatatatcctagtatatgaatgttcatattcatactactaaaatatgtcatatgttgtactagattaacttattctgggatgaagggagtagatatttctagcgttcaaattttgtcccaaaatatagctacttagagcaccaagagatgtttatagtgaattagtgataaaatgtctaaaatacccctatgttcacaaccccaacctcccaccaaccaggataattaacgaaggtaacccagtcttccttaatctctataagaagtagctatattttggacggagagagtacttctatattgcatcatactatggattaaagtgcctgataaatatcagctaacacttaatggaactaaaaggagactatttgtggttaatggaaaattttacaacatatttcatcccagcaacaagccaggcgtttcaggcaggcattttgaatgcatgatatgcgccaccataagcatcccaacaatggaaaagaaatgtgcaattttgaacatttattacggataattccttctgatgtttctgttgtaaactgggggcaacagcaacttccagtttacacatgaaattagagaaatgaagtagcacaactaaaagcacaaacaaaataacataaaagcgactgacagtagagtgcaaacgtacaaagtcaaactttctaccacatttgcagataggagttcagatccaaaggctgagagggttcattttggagctgattgccataagcacgataaaaatggacgggctattgaagaacacgcatgctcacagggttgttcaggcagaaaccccggttcttagtaatgaaagcattggcggcatcagtccttgagcggaatttaaccagcaccactctgataggatctgggacaccaggtctgtgcagtagacatgggtggaatcaaacaaggatgaatggaacaaatttaaatgctacttcctccgtttcatattataatactttctaacattgcccacattcatatagatgttaatgaatttatgaatgtggacaatgctaaaaagtcttataatatgaaacggagggagtagcaaacaaggatgtctgtccaaatgcttacctgagaaagctttcaaatggcggaggttcaacattggtgccacacaggaatcgttctatgtcctctggtacagcatttcgagggactccttgcaatagtatctgcatgggcgcagacacagattacaattatttccagataaattattatatccataattgcatatgaattgtaactataagataatgaatagctggtaaatggggggaaataagataaagatatgtcctcccgatttttgacacccactcaatagtattccctcagtccctctatccaaaagtgttaggcatatactccctccgttttttaatagatgatgccgttgactttttctcacatgtttgaccattcgccttattcaaaaattttatgcaaatgtataagatataaatcacacttaaaatactatgagtaataaaacaactcataacaaaataaattataattacgtaaattttttgaataagacgaatggtcaaacatgtgagaaaaagtcaacggcgtcatctattaaaaaacggagatagtatcagtttttgctttattcaaaagagatggtcatatttgtagtcgccttgtgctaaattaattgttgataagaacccaagcagccatcttaaatacttattggttgcatgcatgcatatagttccatggttttgttatatgaggggaaaagggggggggagttaattcctcctttgtcttggtgacaaaagaaatactcctatgtcttacattttttgatggagggagtagttaggaagaacagagataaaactacacttgcttgccaaaacacaatatattcaagttttactggcctgcccagaggacaaggcaaaacaacaacttacagcttttccatcataagactgcttcagatcaaactcctcacgactgatctgtaacatcatagtataaaaatatattggtgttttgccataagcccataaccaaatgatagaagtgacaaaaacaagcttagcctaaccatctcaagcctgtactgacgaccttctcgtgtttgcctgactgctgtgttaaataatggcactgaagaaaacctcaacaacctgatcaagtgaaaaaaagtttcaggtcaatagtcacatcgcaagtgggcagaagaaaatcacttactcatatgttcaacggtaaatctatgctcttgtcactgtaacaatcacagtgcagttaatgagagtgcattccatacatttatttttcaacagcattaagggaaagatttttatgggaagagatcagctattcatttttaaaaagcctgcctagcaaaatggagaatatgaactaatgacgaaaaagtcaagaagtaactatatttcctgcgtatcaagcacccaagaaaaagtgaaatgtgttggcagcctgatacatagtgtactggccaacaaaacatgagcattcactttagactttagtactttatgaatagacaatgacaaagggtaatctggactgaagcttaccaaatacaaataaggcctcaagaaagacttcaaaagtagggatgggcacgggttactctgtgcctctgtgggtacccgttgacccactctaattcaacaaatcaactaaaatgcactttttattgttttgtgtatttagttcatttggttgaaataaaagtggctgttggttacccacgttgtgcactgcacctatgtttatcattatcgaaaaaaatatgttgacacttcaattacaatcctaatttctaacaggctaaaaacatagctgctctagttgattggaacctcctagcatcacagaatataataggaatattatgatattactcagcaatataaactgcttatgcatattcagtccaaaatcaagtgaaaaaggtacataaataaatggatatatgtagtatttgacacaaaacaaggaaagatgggaaataggaaaggaaccgtacgcgcccactggataatatcccctgttataatcaatcttcacatcgtccagtgacagttcagatttatcaaggtggtggataatatcagttttgagcatgctcttagggagacggctgcctccaggaataacactgtagaaccttccatatgccacacctgtttccacagaacattatttctgatatatacgatgtgatactgtaaagccaaatgtaaaaaatgaagtttccagagttacaagacaatgtaagttgcggttatatgcacttgttaatataatgggaaaaaaaaccgtattgcaatatgatagtgcaaaagtacaacttttagaagctgtggttcgcatttccaaacgtttgacactcgtcatgtgagatattcgcaccaatatggaataaaaagaatgtaatttctcattagtgcaacatcagagtgaggtattttactgtatctaatccatcaatctacattcctgaccccaaatcctaagcggctaaagacattataaacatttaaacctcaaacccctaattacagatcaccacagggaaaaaaaaagcaatcggctccgcaaggatgggagacctaccttcgtcagaaggcttgaagaaaggctcgtcctgcgacccctgggcggcggcgcccgccgcgggggtttctccggacgcctcggtggagaagaggcgaggcgcgaacggagcaagcacggacgagcgcgaggaggacgaggggatcccagatgcggcggtggccctccggagcgcggctgccgcgagcctcgtcatgcctaccggctactgctcgtcggcttcggcggcggcggcggcggaggaggagaggaacgacggagcttggagcctttgggggacacacgaccgacggagcaacacgacgcgaatggacccctgatgggcttctgatcggtggctggcagcgaactagcaaattataaatgggcctaaatgggctaggcccattatgtacatgggccttcttgggctgtctagagttattgggctatactatccttgagacacggcccatcagcccatgtagtagtatttgcgtttaatcgatataagaaatacgttttcgtagaagagaacacgggaaatattaggttacgcctttcgcacgtggctctggtttgtcaagcatcgggttcgcgcaagaaggaaccagtcctttctctttctctctctccatcgggtggacgacgagacgacgacggcggcgaaggaggaggaggaggaggagaagagcgaggaaacccgtctgcgcggccacgcgacgctagggggccgagagcctgcagcggtcgccgcggctggagcatgaggtggccgcggcccatctcgcctggccgccggctcctcccggtcgtcgtgctgttcgtcgccctctgctcgatccctggtgagatctgagctctcgcctcacctaaggcgggtctgtttaccatttttttatgttgctaatttgatcgcgcggacaacttgaccgtattaatcgcatgtgttttttctattgcttcgatgggaagtgctagcaatttttttaagtttgtgtaattgcaatggatttgtagatggccagaaaattggctgcaaggtaaggtattggatgtgattggcctctcaagttcaatcggcgttgccggaagggaaagtagaaatgatgatttatggagccctgtgtgcaaagcaattgaatttaatcagattggtcatagcaccgcattgattttaatagcaaataggatcagcaatttgaatagcatataaggtatgtttggaaaggaaaacttagccagagtagtacacattcctgattaaatatttccaaaaaaaaaggagatatggacaagagggaaggtctttagttatatgcctgtgatgcagacatctctctcctggtccgagttgaatcaagcaatgccgaactctggacagtctgttttatggcgtatttattggttcagctgaaggaattttttttctcagacttcataaggtagtttaagtgttgggatgttctttgacaaataatagcggaggacagattgtctttcctactcttgttcctgccatattgtcctaataaaggatgggcaaattttggatccctcacctaatattattacacggaaaatgatttgtgtactaatttctagggtcacgtgagaggaacccgattcccgatttgaggagtagggcataacactataaattgatttctgcatatataatatgctgcatttcacaagttatattcaaacagacttgctgtgatgagtccaggggactcaaccagcgatgctaggtaaatgtttagttaaaatgtaacgatatggcctatttctctagaacctagataatgatcggtactgtgtttatcctgctttgttgttttcttaaaataaggctggctactgcctatgttccaaaacagaaccgtgctctccctctgtaaaacattgtctggtttggttattagagcaatagattgaatgctccgcacctcaagtcattgatgattttatcaattccagttagtaaattatatattgcatgcccatgttttatgtcattgacggatagcctcaaagaaagaaaagccaaccgatacttctcctttgttaaaatagatcccagtgtgacacgagtttgaaatacgttattctttttgtggggttggggactatatggaaggtaaactggtaaagtgcccatttcaaagccgtaaaggcttaataatccttaatgtctcttatctctgacgagatggagatgggtaaaactgaaagtcatggatatttatagtagtatcatttttaactgctattttttgcgttgtcttttctgatacttggagagggtagctgaactccatagatgccttctattacactcactagctctttgttcatcactgatgatgcttaattttgtagggattttttctcagaggctcgtcacacttgacagcattgatatatttactactcatgagtggttcccgagtaagccaactgtgtatttcctttgcaatggtgaggacaaggtgtatttgcctgacgtgaaggatgcaaacaatatatacacctttaagggcgaagaatcatggcaggttagtcaaccaaaagggctgcttcctctcatgtctcatgcgcatcacaactatacttttctgttttcatttcttagtttccttttggcagcccttaacagaacttccagaaaagaaatgcaagaggtgtggtttgtacgaagaggatacatttaaacatgatttgtatgatgaatgggagctgtgttctagtgatttcaaaaaaggaaaatacacccatttcaaggagggccagttcaatgctactttcctatgcccaaattgcactgcctctgcgggtacggctcatatccaatgcctatgttttagtttgctaagatatttttcattcataaactcattgagctggctagatccacagttgcttttctgtcatatgcccttttgattttaatttcctctatagaattgattaatcataaaatactagtaatgatcttggtggtttgagttcatcataaacattgcttaagatacctttttccctaccaggtgattctgcaaaccatgattctagctcagaagtggaaactaaaaagtcatccgttactgtaatcataatagtcagtgttctttcttctgtccttgttatcattgcattatttgggggctacaagtactggctgaagaagaagagggagcgggatcagttacgattcctcaaactcttcgaagagggagacgacattgaagacgaactgggccttggcaatgaactctgaacagcacatatagttaggttcctgaagctctgtggagagggaggtgacactgaagatgagctgcccctggcaaggaactctttccaaaacatcacgtacagtctgacctgggaccttttcagatggattctccatgtcatgtataaatggacagctttagcttagaaatttttgttatgtagtgatacaccatagtttctgaatgaatgattgacaaaaaaatgttcttcaattcatagaagttttccccagatacaatgtgcatcatttggaaaccttctactggtctacatcaaatttcactagagttaacttcggtttagctacaaatatcactgcacatggaagaggcgcattgcatattctagtcttcgtcatatgcttctctctcccccttgtcagacagatttccaagcttgtccaagtagccaccgttgacaagctgaccaaagacattcttcagcactgccggttccaatgccgggtcaaaaatctcaaaccccgggatgccgtcagcggcatgtcgcttgaccatgagcgcgaacctgacggccgcgccatcttgcctgatgtgtgggatggtgtgctcgtcgagatcatcgtactcctccggctggtagagccggtggcagcggccgggccccgagaatccggcgatcgccgcccgcgcggccgccgcctcctttgagatcctcaccggcggctgttccgacaccaggccggtgtcgacgacgtacgtgatcccgtggaccagcacggccgtctcggccacgtcggtggccagcacgactctcctccggccgtcgggcaccggcgagtttatcagcatgatgtcgatgagctccgccgggaggttgtcgtggacgtagcgaacggccagccctggcactggcaggccgagcagcctcgcgtggacgccgatgatgtcggcgttctccggcaggaacgcaagcacgtcgccgggcggctgcgacgcgtggatggccgccacctcgtcggccaccgcggccgccatgtcgagcacgggccctcgcgagtaccgcacctcgacctggtgcgccgcgcgcgggatcgagacgaccggcgcgccgccgaagaaggcggagagcatgccgtcggccggcccgccggcggtgcagaccaccaccttgcatcggccgcccatcgtcgtccccgtcgccagcgcggccttgaccatcccgaggaggacgtcggtgccgagcgtgcggtcgtgcgcctcgtcgatgacgacggcgccgtacccggcgaggaccggcgccggggagctgaacctgtcgaggagctgccgggttgtcgtgaactcgatgtccgaatcccactcctcgccgaccttcgccatggccacgaacgcggccaggtggcggggctgcgcgcagagcaccgggccgtatccgctctcggcgaggcaccgggggagcaccgacgacttgccggagccaggcgcggcggagacgacgacgacacggtggtcttcgaggtactcaaggatcgccggcatctggtggtagattgccggaggccacgactcagcctcgtgctcttggttagagccggccatgactgaaaaaattgcgggaagcgacgagacgtggaaggaaaccgtgacgcgcgcacaggaaccgttgaaaacgcgagtcaatttattgaaaatcacactagattgtaccagtcagagttataaataagattatactgttaagacttggcggggtccattataatatcaaagtcttatacggaatcaatactcatatacgaaagttatttgcgataagaaaataaaaacagattcctactcgaacactacaaatattactcgaatcatacctctctagttatatttgaacaaggagacatctgacgatataaatagaagactcctcaagaggagtggggaatgatacacgaagacatgcctagatggaatgatagatctagacaagccagtacagatcaagacaaaaccaataacacattgacataagcctagacaaataccatatgaagccacaaagaccgataaaagggatttagcgcgacctccaatcttgctgagttcctgttcgagaaagccgatataaattatccatcaaccacctgatcgagcttccgctattagattgacggagactagatcaactcatactcaatattgtactcgtaagatattgatatataaaggcaacactggcttcggtcaaaaggaatagtgttattacatgtcagtaaggggcctcaaacctatataaaagtacatgtgtcctatatattttcacgtgtatactctgatattaacgatctccgtactttacaaatagtgtagacggctacacagcccatcaatagtaacacacctcattttactcaagcttcgcctaaaaaattcaaagccgatgttattatagccattgagctgacattcttttcaaaacactccaccataccaccgaggtagtatatacaggagtagtttgtaggaatacatgtgagcaattccactgttaacataaaaacctaattacttactaatttattttccacatagtggtataatttcttttaaaaattacaggtggaataagcggatagatgaaaagtctccgcttgcccaccccgtatacctaggctatgtttagtttacgtcaaaattagaagtttggttgaaattgaaacgatgtgatgaaaaagttaaaagtttatgtgtgtaggaaaattttgatgtgatgaaaaagaaaaaatatttcggaactaaacacggagctaatatcttgtgcttggctgctactcctgccttgcccgttgctagttgctgcaagctaactatagtaactactgctgctgctgctcgctactcctgcatgtggctagctgctgcgtgctatctactgttgctgctgctcgaatgggccaaggcccaaggccggcggctctgttgctgcatgcgttagctagctgcgctgactgcttctgccttttttttttttttgccttttgctcttcttctcttcctattttcttttctttactacatattaatcttgcgatagatttatagctttggatgtttctaaatttttaatcaactagaaaaaatgcccgtgcgttgcagcgggtgaagactattttaattttattattgttatatggtttaattaagatgaaaatcactttgagaattcgcttggatatatgttcttctagaaaatcataagccacaattaggagtccgatcatcacaagttagaatgcgagttttttaaaaatatttttttctacgactccttctgtattttcaaaagagaacgaacttagaacttgactcaaatacagatctacatttccaaaagcaaacgaacttaaaaaccgactcatatatggatgacttaccaaagtaccggcaaaaaaacaacttcaattttttataatagtagagatataatatatatatataataggtaaagaaatacaaatattacatattcaactggtgaatctgtcaacgggtgatacccgtagaccggatatagaggatatcggggtatgttggtacaagggtctacgtaatacgacatccagcaaacaaaagacgaagattatactagttcaggccccttgataagtaatagccctaatccagttgatgtgggatatatgacggaaaacacaggttacaaagggaacgatggaactcgatggatccggcgagatcgtagtcgagttggttcgactagatccccggcgatttggctcctgcaggctccgacttcgtaggctgtgggggttgtgttggctctgagattcgatcccttaggtcctccccggggggtcccttttatatcgcaggtcaagcggttttcaagtaaaactcggagacatcagaccctacacgatacattgacgacccagtcttgtccgagtaggactcttttcgtccgtaaactccgtaaaggatttccttagtgtatgtagagagtatccgtatgcgcgtgggtatgccataccgatatgtgacgtatatcgaaaggtaaagggtatacctaacccgtaaccccgaatacaaatattacatattcaactggtgaatcaacgaaagaaaaacaatgaatacagttaaaagtggcttagtgaaaagatgcacaacacaaacgtacatgaaaaacgcatgagttgataaaattatcaaattcatcataaatcatgtataatatcttatcccatttatttataccaacataaagatgagaattcaacagaaaaaataataattaactatttagctgggcaggagcagaaccagccaagacaggaaggagcccaagaggcctacggcgatggacagatggctcagctggtaaaaaaaaatcaggactcaagagcgcttactgccttcctcggtcagatgcaacagcgcctgtacatctccgtctccgagcgacgtgcgggcgtgcggcaactatgccgatgcgacgacggataaaaaatcagacaacgtacgaaaatttgaggcaaaaacatcttaaacttttataatagtggagatgtatatggcccatttaaatgaaaataaaaaaaataagcatataaaaatctcaaatatagagaaaaaaactattctaaaatctaattttgatgcactataactgtgtgtaagtagtgtaagggacgcatgcatcattggaatttaagaccaaacattgaattactcgactcgatgatcttacgagttagtacatctttcgactcgaattatacttacaacacctgcgaccgagaaaactggtgtttcccgcgaccaatgcaagtttcttgcatataagagatcaatgaaaatctacaactttcaagttcttccttgaacataaatacagacacgaacatgtacagagacacggtgttgttcatctatcggcgtacttagatcctgaagaagaactgataaccctccgcgtcctccgtgtagctcgagatcctaattaccacggcagccaacctttcagccgatcttcgccgccgtctttcgccggccggccgtctccgatgacgccgactgacctcggcttcttgctcggcattctcgccccaatgtccatgcacggacacgcgagctgcggatccttcttgctccccgggccaacgatctccatgcacggacaggtcctcacgacggcgccgacctcgagagagctggcgtcgccggagcactgcttgcgcggcggcgcggggtggaacaacgtcccgcacgcgaaggtgtcgagcaggacgagcacccgcacgccgccgtgggcgacgcgggggtcggcgcacgcggcggacacgtacgcgcatatctgcttgctcgccacggccacggcgcggcggtcgaacgggtgcccgacgagcgggaggacgcgctcggcgaggacacgctccacgctctccgggctccgtagcccgcgcgacggctgcctccggacggcgatgtcctcggccaccttccggacgatcacggcgccgccggcgcccttcgtggggttcgggccgacggggaagtgcctcctgacgacgaccctcacgtcggccatcagcgccggcggcggccctgcggcgccggatgagccgcgtcggccggcaccgggcgccgtgtaggcggcggcgaggtgcagctggctgccgacgcggattgccgggacgacgggaagacggaggccgtccatggatgcgacaatgcgaatgcgcgcgcgcgctctggtttgctgaatcgctcgaacggtggcactggacgagatcacgagaacacgcgaagaccgaagaggtggggagaggagagcgtaatggtgcgaccctatatctatatgacgtgttctgttcttcctctccattacggagtcggagatgtaatccgaagcgaactatgaatcggcgtatgcttccgaattccgatttccagttcctacctcggtttgataattgggccgagttgggaaacctgaccctaaccgtaatgggcctctgagttgggcttttttgggccaatagaccctaatcgcatgcgttcggcccacttagaaatggatcgctaccattgctcctggcctcctgccaagagactcttacacatgagtacatgaccgtggtctgtctgaaacataaggattagtatttcagattaaaagaacttgtttagtgtccttcagatcatacaaagaagagcacctggtggctggtgctccatgctccaatatttctgtacatgtactttactggagtgtcaagcgtactgtagtacagtgtgaatcaaagagattgcgagaagattgaaccaaaagtataactgagaggttgtttgcttgctagccacactttgctaccgggtaagacttaggatatcaatgtgtcactaatctcagtagttaataaataaaatcccaacggaagacgtaaaacaatgttcagctattcatgcacgacagacttgttcacatattcagatttcacacccttctgaatgattaatgagtgggtgaaactgtcaaagatttcacgagtaaaaggcaacggttgatggtgatagttgcatcacctttaggatatgtatttctacatgtaaatgcgtactgggcaaccaaatcacatctacacgaagacttctgaagaaaatatctgcaagaagatttgcttccctatgtccctttcaagttaagaagtcgcagcaatatgtttcagatttgttgccgcagtccgcagatcgtgctgctttgacatgtctctagtgagagaattgtaatcgtgaatactagcaatcagctatatcttgctcgtcaaatgacggaaaaaaaatgtaaccagtgcgagagattgttgtgaactgcaaaatgttcagatctgcttggaagaccggacttcgctttattctctgcaaaaacaattcgatctccagacaatctagaaaattgtgggggctatcccaaaagtattatattagctggcagcagcggttgcacatgctcggtgtgattatattcagatgcgcctaccgaaaagcctgcaccaagaactcaagaatcaagagcatatgttttaataatgcaaactgtaagcctccttttgaaacaaagaaaatgtataggattaaatcatttttttcttctatttgatcatttgaatcatatgattggagctttctaattaaatcctatagaattcgaaaggattgactcaaatttttttagataatggaaatggacatctccggcttctgtcataagacacacaaccataagtttaatagtaataaaaaggtaaggtaaaagtaaatcaaaatgagaaataagatgatgggacaaatccccaacttccctttattattgactagtgttaaaccacataaaattttttttagctagcaattctaatggaactacgccacccatagtgaaataagagacccttggctaccgattccaagagtatagcaccattgcacatagtatcttgctcctcctgtggtagcatcgtagaccaaaagtggagcaagtaagaagacataaagataacctgcatagggttagataattgtttaccattaaaactttatcattacgacaacgccaaattgaccagtatataacactagctccaattagaatcatcttcttaatggacctagatactcctctaagccaattaccgaaaatgtttttggcgttacagggtggggggatattaaaagcaaaaaacacacatctccaaacaaactgagcgacatgacacttaaagaaaggaggttggattgtctcttgtgcatagcaaaaagaacaatgtttgtctccccccccaaatttcttttaaccaggttatctttcgttagaatttctttcttgtgaagaaaccacataaagaccttgatctttaatggaattttcaagtcccatagaattctctttttatctgaatattacagttcatgatcgcaacatacatagatttaacggaaaattgaccattcttatggagcgactatacacagagcagtccttttcatttgacagagttatattaactagcctgaggatcaaatcgttctactcgattagcttttggccaacaatagctctcctaaaagagatatttagcgccgttgtggtcatgacctctgccacagtagactgtttctttcgagccacattatataatgtagggtattgatctttgaaagcacgcgatcccaaccacgtgtcttcctaaaatcttatgtttgttccattgccatatttagtgcataaagattttgtagaaaaattagtaagagttctaatctcttgttaaatttcctttgggtggatctttctaatttgatttttatgtcttttctatgatctattcaaatgatcatcaatgtgtttttcatatattttacatcggattcctgtgaaaatcctatattgttttctattgcaacgctttctcacttctatgattcaaaagagccataaatttcgcctcattttattttttgtttatgttcggacagtacaatagccacaagttgagagagcacattacaaagcaaactgtaaatttcgccgcaaattatttgttcatgttcagacagtacagtagccacgagttgagagctcttattgcaagttgcttaggccgtgtttagtttcctcctattctcaacttttcatcacatcaaaaacttttctacacacataaactttcaactattttttcaaactctcaactttcttcaaactttcagcttttttcaggacaacacacccttacaccggattctaattctcgatccaccatctatcaaagaacaaaaaaggcaatagaggacggcagcagggtttcccttaccgccggtaaccgtgcggttaccgcggttatcgggcttaccgccggggtacggtaatataaataccacggtaaccttcttaaattcaaataaatttaaaaaataatttaaatttttgataaattttacacgattttgtatggttttttacggttaccgtggttaccgcgcggtaaccgtgcttaccgtcgggacacggtaaccccgacctcggcggtttgggaaaccctggacggcagcgagttgctcgcctggtagcgacgacaagaagatcctgctaaaaccacatttgaaattgccgcatcgctcccagttgctgcatgatctttgcttcactgatccttacgtgagcaattaaacagcatttgggctcactaccgcaataattcagatttttttagcgagaaaggtctttgctttttttaatttcattatataataatagtcctagacatatagtaattctacatgtggcgatcttatcgtttgagaggttgtcaatggtcatgatttgcttctatgacaagcatgccacttagcttagacttagagaactcacttcgtgcaagcaaaggttacgtggataatatacctggtgacttccatgtgttcgcacgacgatagggctctgacttcttatggaagatgaacatgataaacgtagatgccttttcatatagtacgacctacctgaagacatgagatgagatttattagacgttttgctggtcaacacacaacacgtcgatgactcgtgcgacgcaaatgcaaatccagatgagttagtggaccctcacacttatacataggagtaggtgtcatctgagtcaatatactagcaagagtgagtttgaaagagatgttgggattgagcttttttttagcacatataaaacgagataagtcattactatatgattaattaaatattagctattgcaatttgacttctatgtaaaaattttttttcaaaaacatatacattagtttgcaaagcgatgaaatagtttacccaacttctctttagaactcagcctaaataaatctaacccctaaatatgctaaatgtgccagccctagtccaaaatttaatgagacctaccataagaatgttgacatgacatcttcaccaatcctacaaacccttaaaaagttaaaagtttgaagaaagttggaagtttagaaaaaaagttagaagtttatgtgtgtagaaaagtttttgatgtgatatgatgtgatggaaagttgggaatatgggggaaactaaatacggcctaacaagtatggcacacacacgctttatttttaccttttttcttctttttattctgtctttcattctccttttctatttctttgcttctatgttcttcctcaagcgagccttccttgagctcaagttgttgccattgagctcatggtgggctggtgggcatagtcgtgcactcacactaagcaactatcgttaagctttccatggctgctgtaacatcccggcccagggcttaataggattaatataagacttgtgcacacgagtgaggacaaagtgtgcagaaaagacttgtgttggtctgtgagggcagtctatgacctatgaaagctgccagatgtaagcggaccacttcttttctggaagccgatgtccaaagaactttagggttaagcgtgcttggcctggagcaatttgggatgggtgaccgaccggaaaattcttcccaggtgcacacgagtgaggacaaagtgtgcatgaaagctgccagatgtaagcgggcccagcttgggagaggcgggacgttacagctgcgatgcttaagcgtccctatcggccgccaccatcgagctcgtcctacccttggtcaccaccactcctctaccatcactgagctcctatgcatccacggccaaaacaaaaaccctatccttacgtatctcctctttcaccaaccgaaacccaccctagcctccattgcttcagtcaccgccattaaacaatattagatcgaaatcctaattcttcgccagcacaaaatgactaaattcattagtgttgcttctcatgttccaaaattaaacatgtatacgagttcattgtacccggtaatcatttcgcctctcctatccttgggtgatcactagcatagttcaccatcacgacaagcaaccataatgctcaagtgtggagattgggggcgaggcgaactcgacagtgatggttggggacaagagctcgagcatcctgatcatgggatgctcaacgggggtcatggcaagctagacagcggaaagctcaaactcaagaagaagagagaaaaaaagagaaaggaaaaggaaaaagaaaagaaaaatcttttataggtggcccacttatcctttgacgtagaattggtgaaggtgccatatcagcatcaatgcgacatgtcatatcggattttggtctaatattaatacatttagtaagttaggcgggattaaatgtgtgccttttaagtttatggacctaaataatggctacttacaaaaccatggcttgcaggtgtatgttactcaaaaatttatttcaagcggttatcagttataactggttaactggaataagcttggtgtgcaagactacatgaattcaatatcggtgacatcaagaccttatattgacattataattgaaattaagatactgtgaaatttagacagcgacatcgtaaagcgatggttcgatttctggacagatacgtggaaaatttataggttaaaaactggggaactaatggtgtgccgctagccttgcctaccatttagcagtagtacatagcttcagaccctgtttagatgggaataaaacatttaagtccctatcacatcggatgtttggacactaattataaatattaagactattaataaaacctatcaataatcttggactaattcacgagacgaatatattgagcctaattaattcatgattagcctatgtgatgttatagtaaacattctctaattatggattaattaggcttaaaagatttgtctcatgaattagtttttatttatataattagttttgtaagtagtctatatttaatactctaaattagtgctaaatatagggactaaagttttcagggatgctgtttgcccgtgatgtggtacagttaagcatcaattggtactactactactcgcatcaattggacttgtattctcgcatcaacaaacttccaccgagttgtgtcggagatgccgcccagagatgattcggtggagcaccgaagtggtggacactcttgtccaatcccgtcgtcgccgttatctgctcatttgtttactccttccagggcgtcgttatcgtaggctgccaaagtgctgacgtgccaaagcgcctcttttttcaacgcgatcgtctacggcgtggctacaatgtactcccttttagagagcgacacggtctctaaaacacaaatttgactttttatttctataaaaatatttatttaaaagtgatatatgtatattttgatgaaaatatttttcaagtcaaatctatcatataatttttatatttttaaactcaacaacttaagagttattcatgatttatattcccaaagtttgacttaaatattgtcctaaacgatttcttttataagtacggagggagtatggagtgcttcctctattgttcctaaatactccgtctccgtgtaaatatttttaatttaggttgtgtttagttcatatcaaaattggaaatttagttgaaattgaaacgatgtgatgtaaaagttagaagtttacgtgtgtacgaaagttttgatgtgatagaaaagttggaagtttgaataaaaagtttggaactaaacaatgccttatttagcaaagattacaaataaggaaacagattccatccaaatcatctcattggtcaaatgttagattcttttatattcccctcttaaatacaccctttccgtctaaaaataacacgttttagttatatgtttttgcacacaccttcaaacacaatatttaattggttgaaaatgcttgtattttttcttcttgagcattttcttgaaactgagagtagagtacagttttgctctgcgggcccgtttagcataacttcaactgttaggtggtgtttggatcacatgaactaattttagcccctgtcacattggatgttgggacactaattagaagtattaaacatagattaatgataaaacttactacctccgtaccaaaatatagttatttctagcacagtagcttatcttaaaatgaagttatttttccacctaccaccttctctcaaccaatcacaaccattctccttcacctagtacttcctcttttcaaccaatcacacacttcctctaatcattcgcacctactttcttaatacccatgccgacctaaaaatactaacattttgggacggagggagtattctataaccctggactaattcgcgagacaaatctattgtgcctaattaatccatgattagactatgtgatgctacagcaaacatatactaattatggattaaaaaaatgtctcacgaattagctctcatctatgtaattagttttataattagtctatgtttaataatccaaattagcatcaaacatccaatgtgacagggactaaagtttcgtccctagatccttggactaaattagttgtacctcttctgaagttggagtacaacagaactatttcagctctatccaaaaaaggtgaagcggactaaagtgttatcacaaaatgaataaggtgaaactgggtttagataactttacaatttcacttcagacctaactttaaagttaaatttagaagttgaataccttaaaaaaaagaccgtgtatttcaggccgagtttagatccaaagtttttcttcaaactttcaacttttttcatcacatcaaaactttcctatacacataaactttcaacttttccatcgcatcgttccaatttcaaccaaactttcaattttggcgtgaactaaaaacaccctcagcacggttggtcgcagagtttaaacagctgcgaggaggtgcaaagaatccaggtgcactgcagcgagtgccatcaaagcgagaggggtccggtgtcccgcctccccatgctagatcgacaggtcacaggtcaaggcctaaatttccggagggatcccacgcagccactcccctcccccctcccgttcccgtcggcgccatatccgcccatacgttcaccgcagaatcatccatccaccaccacacctt

SEQ ID NO: 74019 - DNA, 21584 bp, Oryza sativa
  unsure (1)..(21584): unsure at all n locations
gcacctcatccgtccgtttccgcctctcgccgcccttcctcctcgccgaaatcaagctcgcgtcgtcgttctctctctccgccgtcgccgccgagctccggtcagccgccgtcgtcgccccggaccacctcccacataggcgccgcctccttcggcttcgccgtatcctcgccgacctcatccacccctccatttcgctcgccgaccgccggaacaccgtcgaccccgtcgacccgagccgcgccgccgccttcctccgctccggccgccttttttcgtcgtcgccgtcgacctagggtgagccgtggaccgccgcctcttttcccccttcccttcccctctctcggccgccgctccgccgtgcctatggccgccgctggcgaccataggggcgcgggcgccgcctcccgccggctgcgccggcttggccgccctcgggcgcgccgagtggctgccgcgtggggcccggctgtcagccgcccgtgccctcgggtgcggctgacgcgtgggacccacggcgccggccggtgtgagcccgggtgcacccggtccaccgtggaccgtgaggctgccgcgtgggccccacttccgtggacccggtccgcgcgccccctcccctcggctgacgcaataaaccctttttaaattaaaatttaaataaagaaattcgcaaatattcatttaaagagcatataaacttcaaatgaccataacttggccatttgaactcggaattggaccgttcaagtctctaatttttccttaagaagtcaagaacccatttttgtgctttgttcctgcttgttatatggagtttattagagtaaaagccttttcttttccgttggtcgtgtagacgctacagcttcggaagatccgctcttcgtggaggttgatgccgacgtttgggaaagcgagcaaggcaagtcacatcatccttgaacatattgaatcccagtttataaaattattttgatttaaattattgcattaccgctttatttaaatttccgcgttatcactgttttatctagccatgcctatttacctttgttatgaccttattattgttattgttattatttcgttgttcaccctagaataaacaaaaccccaactagtggacactctactcatggtaccactagtatgattttaggtagatgtttcgctaattaattaggcaacattatgtggttttataactctagactttgggaatattctcatcacctggacactatggaatggttggattattgtggaattggattcacacctccccctctattcaaaaccctcaaaatggttttaggctaggctcggggtgcatggttttgatagtagcacctcggccatataaggaccggtcttcgggcctctgttggaaagcactaccgtccttccacatgtctagtgggtaaggcttagtttgtggctcagtctggttataaacaaaagtacacggatggagatggatgaagtcggtggtcgatggacatctctaggacaaatgaaggctacacgagctgcggcccggtagtcgagatgacatggcacagggccggtgtcctgctgctaggggctcagtcctgcctacttgtcccgggggttccggccgtaggtggggttgggtcggtactcttctctatggctaggatgggttggaaactatgtcacgtcttccgtccgtataccgtggtggtatgtggcacgtggttacacgtgaggaagatgtgtattgtgggtaaagatgtacacctctgatcagagtataatctattcgaatagccgcgccctcggttatgggcaagccgagcaatgtacccaagttagttttttaattcttaaaacctgcttaataactaaaatgtggaatggttggcctgggttggcttgggacgagctgggacctagggtcgggttgccagttcggtctgaatcatcgtaggccttgggttaaggcaggttcgtgtgggttcacggccttgtttaataatattgtatagctctagaatcgtgtttacaaaatagctttgagcaactaagtgtcttttaatgctgtttactgcaaaccctaaccctttatattataacgcccttatactcccttgcatttatcctgcacttgtgggtgtgtcttgttgagtacggtggttgtactcagtcttgctcaatttttcccaaacccagaagttgatttcctggaagatgaaggctttggtgtctagctcgtgtctgccgtcaagcgcctgtggtcgtcgccctagtcttccgctgtttcccgtttgtctttgtgtgtgctgggccttcgccgcccatgtaataaattatctatttacgcttctgcttgataaactctgaaatgtatcaacttttggtgtaccttgcctcctgggacaaggaataatacacgcacgtaaggagcgcccgttgggttaattccggtcgtgacaagttggtatcagagcccccttgaccctaggacgagccgtagatcccaagccttagcaatattttcaaaataaaaatcctttcttatttgtgaaaatcctttagtctctctttgtcctgctgcttcatttatcgtcaaaatctgatctttaaaatgttgcttttctcgtttgtttgtagatggccggtagcatcaaccgtcgtggtctggacctgactggcttcgttttgaagctgcggagcatgtgcgctgtcctggggtatccacatggagtggactaccagggcaagtagctcccggagcaggagggtgacgatgcagagccccacgctgcttgggaggttactgcagtgatcctcactggctcatccgagaggacttcgttggcagtcaccgcgggtggagattccttctccgccgcttgccagaacgccgcactcctcgccatcggcactctacaccagcgctacccggacgagttgcagcacttgccctaccgctaccaccctcgtcgcggaggagcccgcgactacgccaccttccgggatgctagctcggaggatgacgctaccatcatgcacctggcgcgcatggtggaggatacgacgcggcccgtatcgacttccatcagatggtgcatcgcgggttggtcgagaacaacatgaagatcctggagctgtgttaggagaatctgcagctgaagaaggacctagacgcagtggaggcgcagcggtgtcaggtcaagatctcccagggagaggtctgtcgccccaagcgtcgccgcgtctgccgcagcctgaagatcaccgcccgcaagagtacctccaggcccgagcttgttcgtcagtccctggcgtggacctgcttcgtcgagacccctcgtgccgagcccacccccatggttcctcaggaggagggagcctctggcgttggcagcacggaggatgcgctgctgctcaccttccgccctggcccgtcgcagaagtagacgagtagttaagtaggcttgcgcgnntgtgttcttctcgntttatttttctngctagagtcgtatggggcatggttatgccggtgtgtggtataactgtcggagcctgtctttattttatttgcttaagcaacttgaaccttaatgaaccaacttaatagcagtaataaattcaagaattatggtagtcgtgggtggttagttttaattgtcagctctctctgtttgctggttctgtgtgggattttcagatggtgacgactaggagaagtgctaataccggtgatggcaaccaacccgaaggtagcaaccacaacaaccatggcagcccacctccacctcctcctccacctccaccactaccaccagacaccaacgccatcctcacccaaatcctcgcccagcaggccaacatgatggctgctttcctccaccacatccaaaatccgccacagcataatgctccaccactacccccacaacactctaaactcgccgagttcctccgcatctgtccgcctaccttctctagctccaataaccccgtggatgcgttagattggttgcatgccgtggggaaaaagttagacaccgtgaagtgcaacgatgaggagaaagtcatcttcgccgcccaccaactgcaggggcccacatctctatggtgggaccatttccaggctacgcagtcagaaggacagcatattacttgggctcgcttcaccgccgctttccggagaacccatgtgcccgccggagtcatggcccttaagaaaagggaattccaagagttgaagcaaggcaaccgctctgtgatggagtatttgcatgagtttaacaacctggcccgatacgccccggaggatgttcgtgaagatgagaagaagcaagagaagttcttggcaggaatggaccctgagctgtccgtgcgtctggtctccagggactatccggatttccagcgtttggtggacaagagcatccgtttggaagccaagcacaaggaactggagtcgcacaagcgtcgcttggcaaatttccgcaatcaacagggggctaaccaaagggtccgctacaccaacccctatccagggggatcctcctcacagcagcagcagccacgctccgcgccctgacctcaattcgtggtgcatgtcccacagccgcagcaacagcagagtcagcaagggactcgtgcgccccgtcctcctacgccagccgtgcagcctggacaaggccacagagacattcaaggtcagcagcgtctgtgcttcaactgctttcgagcctgggcactttgcggataaatgcccaaagccgaggcgccagcaaggccaagcacctccccgccccaacaacggtggtaaggatgtcattcggggtagggtgaatcacgtgactgccgagaatatgctgacaactccagacgtcatcgttggtacgttcctcattcattccatccctgctaccattttgttcgactctggagcttcccactcgtttatatatgtgccattcgtggggagaaatcggttgggggtagaaaggcttaggaaccctctgctcatcaccacccctggaggggttatgacagcaaagtattatagccctgccgttcctatagaaatccagggaattccttttccctcggatctgattcttctagacaccaagaacttggatgtgatccttgggataaattggttggctcaattccaaggagtagtggattgtgcaagacgcactgtcactctgtaccgagggccggaacaaccggttgttttctttgcacccccaacctctgtcggtagttcagaacttcatcagataggactgtcggaaatccccatcgttagagagttcggagacgtgtttccggaagaactacccggtatgccgccgaagcgagagattgagttccggatagatcttgctccaggaaccactcctctgtacaagcgaccctaccgtatggcagcaaatgaactggccgaagtcaagaaacagttggaagagttgaaagaaaaggggtatatacggccgagtacttccccctggggtgctcctgtgatttttgtggaaaagaaagacaagacaaagaggatgtgcgttgactacagagctctcaatgaagttactatcaaaaacaagtaccctcttccccggatcgatgatctgttcgatcagcttaaaggtgccactgtattctccaagattgatcttcgttccggatatcaccaattgcgtattcgtgaagaagatatcccgaagaccgcattcaccacgcgatacggactgtatgaattcacggtgatgtcgttcggtctaaccaatgctcctgccttcttcatgaacttaatgaacaaagtgttcatggaatacttggataagtttgttgtggttttcattgacgacattctggtgtactcacaattagaggaagaccatcagcagcatctccgtctggtgttgggaaagttgcgggaacatcaattgtatgccaagcttagcaagtgtgagttctggttgtccaaagtcaaattcttagggcacgtgatatctgctaaaggagttgctgtggaccccgaaacagtgaccgccgtcactgattggaagcaacccaagacagtcacccaaattcgcagcgttttgggtttggcaggatactaccggaggttcatcgagaacttctccaaaatcgctcgacccatggcacagttgttgaagaaagaagagaaatttgtgtggagcccgcaatgcgagaaggcgttccaaactctcaaggaaaagctggtttcctcgccggttttaatcttaccggatactcgcaaggacttcatggtgtactgtgacgcttcgcgccaaggattggggtgcgtgctcatgcaggaaggtcatgtggtagcctatgcctcacgccagctacggccccatgaaggcaactaccctacccatgatttggagttagccgctgtggttcatgctctaaagatctggcggcactatctcattgggaatcgctgtgaaatatatactgatcataagagtttgaaatacatcttcactcagtcggatctgaatcttcggcaaaggagatggttagaactcatcaaggattatgatgtgggaattcactatcatcctggtaaggccaacgtggtcgccaacgctctaagtcgaaaaagccactgcaacactcttggcgtccgtggcattccaccagaacttaatcaacagatggaagccctgaacctaagtatagttagtcgtggattcttagctacgctggaagccaagcctaccttgctcgatcaaatccgcgaggctcagaagaatgatccggatgtgcgtggactcctcaagaatatgaaacagggtaaagccgctggtttcacagaggatgaacacggaaccctatggaatggaaatcgggtatgcgttccagacgacagagaacttaaacagttgatacttcaggaagctcacgaaagtccttattccatccaccctggcagtacgaagatgtacttagacttgaaagagaaatactggtgggttagtatgaagcgggaaattgcagagttcgtggccctttgtgatgtgtgccagcgtgtcaaggcagagtaccaacgaccggccggacttctccaacctctccaagtaccagaatggaaatggggtgaaattgggatggatttcatcaccggacttccaaaaacccaaggcggatatgattctatatgggtagttgtggaccgacttaccaaggtagctcggtttattcctgtgaagaccacctatggagggaacaaactagccgagctctacttcgctaggatcgtgagtctccatggtgttcctaagaaaattgtatctgataggggaagccaattcacctctcacttttggaagaagctccaagaagagttgggtacccgattaaatttcagcaccgcgtatcacccgcagacagatggacagaccgagcgtctaaatcagatcctagaagatatgctccgtgcctgcgtcctagatttcgggaagaccggggataagagtctcccctatgccgagttctcctacaataacagctaccaagccagcatacaaatggcaccctatgaagcgttgtatggacgcaaatgccggacaccgctattgtgggaccaagttggggaaagccaagtgttcggaactgatatcctgagagaagctaaagctaaagtcagaaccattcgggataatctaaaggtggcacagtcctggcagaagagttatgcagataaccgacgccgtaatctggaatttgcagtggacgattttgtgtaccttcgggtcacgccattgcggggtgtacacaggttccagacgaaagggaagcttgcccctcggttcgtgggtcctttccgtatcattgctcggcgcggggaagtcgcttaccagttggagctgcccgcctccttgggcaacgtgcatgatgtgttccatgtgtcgcaactcaagaaatgtcttcgagtgccatccgagcaggccgattcagagcaaattgaagttcgcgaagacttgacctacgtggaaaggccagtgaaaatcctggacaccatggagcgcaggatcaggaaccgggtaatccgtttttgcaaggtccaatggagcaactacgctgaggaagaagctactacgctgaggaagacgagatgaaggcagcccatcccgatctcttcgtcagttcttccgaatctcggggtcgagattccgtttaagggggtaggtttgtcacgtcccaaaacgactctaaaatacatcctctaaattatgtctagaataattaaaatccgtgtgaaagcctccaaaaattaaaatgtgcaaagttaaaagtcaaataaggcttggaggatttttgtatatttcctaaaagcctaaaatgcgtaaataaattttagtggaattttcagagcacaaataataattattaagaaataaacaaagttaaaatggttttataaaaagaaaaaccctaaaggtcccctttccctccctccccctcttgggccggctcggcccatctccctccccctctctcccctctccccgcggcccactcgatctctccccgcgcgcgcgccgctgacgggcgggcccgcccaccaccctcgctgacgggtggggcccacccgtcatccccttcctcccgccgctcccgccgcctcgcccgcgccctagcgccgccgccgccgccgaatccgccgcatcccgtcatccccgcgtgcaatcaataggggggaattattccccttgattctctctccctttcccccatttttccctctctctctcgcgttcaaacgggcggacttgcccccgcaagtctcgccggcgccattgatggcggccgacatcccgcgccggtttccttccttccccggccgccctctctcgccccggctctatttaaacccaccccgcacctcctccgtccgtttccgcctctcgccgcccttcctcctcaccggaatcgagctcgcgccgtcgctctctctctccgccgtcgccgccgagctccggtccgccgccgtcgtcgccccagaccacctcccacctcggcgccgcctccttcggcttcgccgcatcctcgccgacctcatccacccctccgtttcgctcgccgaccgccggaacgccgtcgaccccgtcgacccgagccgcgccgccgccttcctccgctccggccgcctttttcgtcgtcgccgtggacctagggtgagccgtggaccgccgcctcttttcccccttcccttcccctctctcggccgccgctccgccgtgcctatggccgccgccggctgcgccggcttggctgccctcgggcgcgccgagtggctgccgcgtggggcccggccatcagccgctcgtgccctcgggtgcagctgacgcgtgggacccacggcgctggccggtgtgagcccgggtgcacccggtccaccgtggaccgtgagggtgccgcgtgggccccactcccgtggacccggtccgcgcgccccctcccctcggctgacgcaataaaccctttttaaattaaaatttaaatgaagaaattcgcaaatattcatttaaagagcatataaacttcaaatgaccataacttggccatttgaactcggaattggaccgttcaagtctctaattttttcttaagaagtcaagaacccatttttgtgctttgttcctgcttgttatacggagtttattagagtaaaagccttttcttttccgttggtcgtgtagacgctgcagcttcggaagatccgctcttcgtggaggttgaagccgacgtttgggaaagcgagcaaggcaagtcacatcatccttgaacatattgaatcccagtttataaaattattttgatttaaattattgcattaccgctttatttaaattcccgcgttatcactgttttatctagccatgcctatttacctttgttatgaccttattattgttattgttattatttccttgttcaccctagaataaacaaaaccccaactagtggacactctactcatggtaccactagtatgattttaggtagatgcttcgctgattaattaggcaacattaggtggttttataactctagactttgggaatattctcatcacctggacactatggaatggttggattattgtggaattgggttcacacctccccctctattcaaaacccccaaaatggttttaggctgggctcggggtgcatggttttgatagtagcacctcggccatataaggaccggtcttcgggcctctgttgcaaagcactaccgtacttccacatgtctagtgggtaaggcttagtttgtggctcagtctggttataaacaaaagtacacggatggagatggacgaagtcgggggtcgatggacatctataggacaaatgaaggctacacgagctgcggcccggtagtcgagatgtcatagcacagggccggtgtcctgtagctaggggctcagtcctgcctacctgtcccgggggttccggccgtaggtggggttgggtcggtactctcgtctatggctaggatgggttggaaactatgtcacgtcttccatccgtataccgtggtggtatgtggcacgtggttacacgtgaggaagatgtgtcttgtgggtaaagatgtacacctctggtcagagtataatctattcgaatagccgcgccctcggttatgggcaagccgagcaatgtaccgaagttagtgttttaattcttaaaacctgcttaacaactaaaatgtggaatggttggcctgggttggcttaggacgagctgggacccagggtcgggttgccagttcggtctgaatcatcgtaggccttgggttaaggcaggttcgtgtgggttcacggccttgtttaataatattgtatagctctagaatcgtgtttacaaaatagctttgagtacctaagtgtcttttaatgctgtttactgcaaaccctaaccctttatattataatgcccttgtactcccttgcatttatcctgcacttgtgggtgtgtcttgttgagtacggtggttgtactcagtcttgctcaatttttcccaaacccagaagtggagttcctggaagatgaaggctttggtgtctagctcgtgtctgccgtcaagcgcctgtggtcgtcgccctagtcttcctctgtttcccgtttgtctttgtgtgtgctgggccttcgccgcccatgtaataaattatctatttatgcttccgcttgataaactctgaaatgtatcaacttttggtgtaccttgcctcctgggacaaggaataatacacgcacgtaaggaacgcctgttgggttaattccggtcgtgacaatgacaataaaaatgagaggcatcggacgggtcatatatgagtacaatggcagagccgccaatggttgctaggacttctagaaagtaaaaaatgaattccaatgattgttatgttcgggtttttaggatcccaatgacaataaatagtagtcggcagataggtcgtagaggagtatagtggcagcgtttgacgggatttctaaaagttataaaaaataaaacccaatgaaacaatgaactctaaaaactataaggtctaatttttaaaggttcgggcttctaaaaagtataaaagaaacccaatgataaacatgtttgattttaaattctcaatgacaataaagaagggaggcagcgggcaagccgtaaaggagtacaatgactaagtcgctgacgttttggcagaaattctaaaaagtaaaaaatgaacctaaatgataattatgttcatttttaaaataccaatgacaataaagagaaaatacagtggacgaccgtagagaagtataatggcaatgtttgacaaaacttctagaaattatataaacgaaacccaacgggacaataaactctaaaaattataagatccagtttttaaaggttctaaggagaatgaatagaaacagcagtagatcgagcaagcaaataaagaaggatatatcataagtaagcagtagcaactggtatgacttttaaaaactataaaattagaaacacgagaatgataaggtttcgtctttcaaagtcttaaaacaacgagatagatatttaataaattttaagtaaaaacatatttaaaaatataattttgtatgggtgctagccgcgcgattgcgcgggccacccaactagttattatatactaaaagtccatgaaacttcctacaaacactctcaagccgccacttggcgctctaataaaatagagaaaatcctagatattctaagaaaaaagcaaaacatctattctttgattttcacttaaattggtgggtccaatattatacaccgttagataaaattgatcttaaaacatactaattaccgtgggtcccacctatcctcctcccgtgcattggcatgtggagtatatacgtacatacgtacatacgcttccttcccctccttttcttttcttttttcttatttttttaatttatatatttaatggatatattttttaaataatcattattttacaaataaagaatctaccatcatataatttaaacgggtgtactctttactttgtacaattattttcaaataatgcactactttaaaataaattttacacaattatatcgtatacttatcaaataaacaatatctatattaacttatttatacgtgcacttaagctgatagccccattatataaatcatcggatctactttttattacattgatctattactcttaagtaatgcactctttcaaaataaggtctacaccattatattgtctatccatattgtgtttcataaaattcacggaaatacttgccactaccctcccatctctctgcacctcatacatgcatacatgtatgcatttttgcgagttttaaaatgatttttctcataaactaattatccaatctatgatttgattacaccgttgtattcgttgtaattaaatctttacaacaagatatcacatgattatattttgatagaagaaaaacatatgtttcaatccgttaacactagttgtttcatatgtggtagcgacatgtttcaacgtatatcttcatcatgtttcataaaatttttaaatgtttcagttgctgattttttttcaccatatataatttgatgtttcactgctcaatggtcaactagtaacatttgaccaaccaattttttttggacatcagacgtcagatgggaagattccttatgattgtggagtgaaaaataaagtgcagcaacatgcacatgcacatacgctcagaggttggctgggcgtccgatatttggtgggatatcggacgtccgagccgtagcgctctccgaacatgcaaggcccagcccacagctccacacacacgggaggcaaacagaagtccaaaacgtagtccgccaaagtcgctaaccctctctctttttctctcgattcttcggaaactacggcgctagttcctctttttgcggcacagagcgacggttctttgttaccagacggctaactctcacgcagggttcaccttaccgttttagggtgggttaccgaccccccgcggtaaccgcgcggttaccgccaaaaaccgcacaaattccgcatccaaatttttgaattcaaatcacacggtatgatcgaggttaccacacggtttcagtcggttaccgcggtaagtaaacggttaccgcgatatgtgaatcagaaaataaggagaatgcaaaaaaaaaggagaaacacttaaatgtgagtataatttggggataatagctctaacaaaaaatatatggggataatagctctaacaaaaaaatatatgggagacttgaaaacttaagatgtgattatataatagaaaaattcggcatgacctttcttttctatattgtgcagttcaaatcaatccaataattcataacattataattcaacaataacaatcatcaatctcatatttgaaagcataacgatgtccacatgtagaatgaatagagtccacaataacaacagagtccacaatataatgtccacgattacagttctagtttgaatgaaaggaaataaacaaggacatgcatagctacgcgttccactgattatatgccatattgtactcctctatggacatgagcatcaagccatgtgaatgtagcaaccccgctttgtatgcctcccatctttgaccagtccatgatgatgttgtttgccactgagcgtacaattgagcataccactgaggctcttgccattcatacacccatgtaggcgcaggataatcagaagcttgcggacggttatacacatacgttggatagccactttcaatgctagaggcactgaatgagctggagctatcctgttgtatgtcaacatgttgttgctgttgttggcctctcgatgcaatggtagttcgttgagagcttggagcaccatgatcgtggtcctgagtagcatgagtaaagtcagcctcacctgcaaatgagaaagttgcaagtaaattaactagtactgaattggatggtgaaggttgaaatagcaattaaattatatcacaccagtgaattgaatggggctgtggtgatctaactgttgggtgtgacccctaggaggcacatcagtagttccttggcctccttgaccatcgtcgtctccgtcatcggtttcagttcttgaactactatcattagactcttggtagtctgggcttccttgagtctcttcatcgctatcaacattagtcgatcgtagacctttgccctttgtctttttagatggacgtgcttttggtggctttcgagtcttcctttttccaatatgagtgtcacctacattcttatcagcccactcaacaaaactagaagctcccgtggtcctgtgcaggtcatccaagtccactaggtcggttacaagtggactaggcaagggggcgtcactctcatttgaatcttcatctagttcagggcaagcattcgaccgagcagtgtccatccatttcttgatctgattgttagtttcgtagaatgagaggtccgctaatctttgaaggggatcgtcgtcctccgtcctaacttgggcatttgctcgccgaattcgaaggcgaaggttgtagttcacataaactagcttgttgagcttcttgtgggtaagtctattacgaaccttggtatgtacgaaagcgaatgtgctccaattccgttcacatccacttgaagagcaacattgaccaaccaaacgcaacgcaagcttcttcaaattcggcgtgtctgaggcgaacatagaccaccattgtgctgcaattgccgagtaacatgtcattttataatattgaatacatcaagatcgattggacatatcatagttccatgattagaaacataccaggagacgttttcccatctatggccatctttcttgctagtgcccttccaaattcgcccgtcttacgtcgatacatctcaacctccagcaaagcggcggcggctgtatcgatgtccgtcatccactcgaatgcctgtcggaggtcttggaagacagtggcacttggatagtacgcatagtgcgtcctagggttcaatgcggcagctacaaaacatgtcataggttaagtacgagttacacaatacgacatgtggattatgttatgaccaatacttactggcattgatcagagtttcattggttaggtcgtgcatccttctgttaacaatctccatgtatgcttcaaacttgtccctttgattcgcaaaaatactgccgtactccattttgagcaactgatatctcagaagtacctcactcaaattggggttcttgtcctcgtcagcaaaccgaaggaatgagtacataggttggacagaattcactactgcctctaagttctcccaccaagatatgctagatagacatgcgtgtgcatatctaccttccgttgtcccgctgaatttgctttgcatgaagtcagaggaagccatccattgcatgaaaagatctcgcttcctaaggaaactctggaggaacatgtagttcgtcccgaaccttgtaacattccacttaaccagttcaccacctatagctgtgaccatcatagcatgcaacttgttatgattgtatagccatctgcaaatttttctaccacttgcaatcaccatttcgtggtttggcattttcccaacatccttaagcatcaagttgactgtgtgtgccacacaaggttgccacacaattctttggtattcttgccgaagtagtctgcacgccttcttatagttagacccattgtcagtgataatttgaacaacatgatcagggctgtaacgtcccgccttcccccaggccgggcccgcttacatctgatagctttcatactgtaggataagccaaatggtcaaaccttaaggacaaatcttccgaaaacataatttgtgaaaattttcctttctttcttatctagaattctttgcaaatcgttttgtcgttcttcccccttcctctttcaacttgagtagtcgttaatcttgatggagaaactcgaagacgtcgatgttgtcaacttctgcaagtcaagtggatcgaggaataagaagatgatagtcgaatcttaagtgttcagatagagtgaagtttggaacctatcttagaacctatgccgccaaagtgtctttgaagaatagttagtagggtagaacgcttgttgtttgctttgtgtgtaggtatggttgcattcccatcattggagtagttcattgatgagtgtgtaactatactaggttgcttgcttaatcaacttgaacaatataatggtctacacacatcagatcagtgttaacctggttaaggtcttgtctttagtgtaacccctctccttctaccttttctaatctgcatcagaatggtgggatcatttccggatgaacagagcagaacgacaaccaatcacttgggaagagtttaccgaaggattcaagaagacacgtacctgtaggagttgttgctttgaagaagcgtgagtttagggctttgaagcaaaaggatcgtaccgtggcagagtatcttcatgagttcaatcgtctggctcgctatgctccagaagatgtgcgtactgacgaggaaaggcaagagaaattcttggaaggtccgaaggatgaactgtcagttatgttgatctctcatgactatgaggattttcaggagttggttgataaagcaattcgactggaagacaagaagaacaagatggataaccgtaaaaggaaaatgactgtatcccaggaggcacaaggtagtagccagaggcagcgtatcaagccactccaaattggtgaatctttttctgcaggtcaagaacagtcacaacagttgggcatcagtggtgagatcaactcagatactaatgcaagcaatgaagacaatgatgagcaagctactcaatcagtgtcatttcagcaggatcagtctcaagaagataacagtaatggaagggagcatcgggtgtgtttcaattgttatgagccaggtcacttcgtaaaagagtgtccgaagccgaagcgtcaacagccacaaggccaagtcaacaacattgtcctcacaggagcaaatgcagtgccggttgcgtctcaagggatacagctcagccatcagttccaaagcagcagtagctttctttaaaaccttagaataattattggagttgtggaataaaagatagactgtagtttacctatgcctttttctttctagccgttccgaatctcgggacgagattctttgtaaggggggtagatttgtcacatcctgattttcgtttcaggatttataaattatttaataaattattaatagaatttatattaaacgttcattaatttactagtgaagttaaatgtgggaaataaaatttcctaaatataaagcatggaaggatttaatttttattaaattcttcatggttaattatactctctggaattttctcagatttttcggagctcaattcctaatttttaatcatacaaagagcatttcagtaattacccacatattaaattaatcattaaatggtctaattgtaatttttttaagtactttgagtgtccaagtattttcaggatttttcttgaaattatttgagcattggaagtatttttaataattcaaagatcatttaagtgattattttaattgggaaagtaataaaatcctcctcctcagcttgggccattttcagcccattccttcctttccttcctctctcttccgccggcccaacctgagccgcctcctctcctctcagcctagccagaaaagtctattttctttccctgcgctactgttcatcttccaactcaggcagagcccgagccagccgtgccgtgcacagtgccgccgcctcttccttccaaatctcgcctccccgttgctctttttctccaattttgttgaggggaaatattcctcttatcctcctctatctttacccccaagaatcggagcaaaccgttgagtattttatccgaatcgaactcgtttttgagtttatctccaaaaccgagtttttgatttcccggatcgatttcttgcgggaggagtccgatctcttcaatccaaggctataaataggaccccctagtcctcctctttcgtttgccccctctcccgtcctcttccgtgctccgtagctccgtcgccaccgccgccaagcaaaccgccgccgccggccatctccggtgccgccgcgccgccgtctccatcgtcgtcgccggtcgccgtcaccaccgttgggtgcgccgtggtgaggggaagctcggccacccttccttttccgtcgctggtcatcggagctccgccgccccgtgcaacccgagccgccgccgtcgcctcctcgtcgccggccgtcgtcggtcgttgtttggcacgagggtgagtatcgttgggttcgtctcgtcgtcctctacgtgttcatgtcctccaaatccgcagccggtcgctctatctccggcgaggtcgccatcttggtccggccattgatgatgtcatcatgacgtcatcatcttctccttttccagttttttctaatagattaaatcttcggaaattcataactaaatcatcgtaactcggttttgagtggttcaagttgctaaattcatctaaaatcatgatctacatgtttgtttactttatatgtactgtttatttggtttttattagtctttttcttcgttttgcgtgttagcttgtcgtttccgtcgttgcgaaggttcgtgagtgcgtcggaagtgatcaagaagattacttgaagaccgattattgcaaggcaagtcacacagatcctaaacacaatcctttgagcatattgatcctatatttaaattctctatttatttcatctgtgcatttattttcgaatgtcaccgggtggtgtgaacttattcctttgttatggccaatttgcattgattactttattccttgataccttgggttattataacttgactagttgggctttatatattggttcagctagatattagttatgattgcttagccatgcttagaaacattagcacactattgggatgacttatgactcactattatttaaggatggcttaatgatagttcacgatggttaatcgtgattggttaattaattacttgccaactaaaacttgataatggtgggttgtgagcacatggttttgagagtcgtgctcatgacaattaaggaccggttcgcgagctactgttgtgaaacatttatcgtgccaaccacaagccagcgtgggcaacggctttatcttttgtatagcgtgattcattatagtgcgccagactgagaagtggcgagaagtccacgggggtcgctggggagtccatgcctctagtttttgagggggtgattatgatccaggaaaggtgcgctgtaatggattatgttgtgcatggggtattgtcacaactcctttccgaggtaccgtggtggtattgaggcacatggtgacatgatgtggggttgtgtcttgtgggtacagtggtacacctctggccagagtaaaactattcgaatagccgtgcccgcggttatgggcgggttgagcaatgtttttcgtgattagtctcacacctctcacaataattatggatgttaatacctgataataatttgcttagctcctggtttggagttagatctgtacagccgggtatggttgttcaggatggttgggcctgtacagcatgggtgtgctgttcagtgttgattaaaatttttaattaattactctactgttttactactcttaactctttgctaaatgcgctttcgcaaatgagcctatattatgccatcctttggtattcttgtgcacttgcatatttgctgtgtggcttgttgagtatgtcatatgctcattcttgcaataatcaatcaacctcatttgaagataaaggatccagaaggagaagacgtttggcttataccccagttgagctgcctgtgggagtggagctgaagccatcgctagatcgttattccgctgctgttttcttttcttttgtaagtgtgtaacgttattattatgatggatttgtatattaaattgtcagtttgtgtacctcggctgattcctggacgaggattttatgcacaaataagttcggaaattactagtgaatttccgggcgtgacaagggcctacttcgcgtaccaccttccttatctcctgcattagtacatcacaaaataaaaattagtccatgaccctaacactgacgataacagaggaagaagtaatttgttgcatcaacgacgtcaccttcagcacgaagttagcatcctggctttggcccgtcgcatcaatggacttgtggaaaaacattattccattgcaatatatcaaaaaattgattacagacatacccgtcgggccagtccaagaatcacacattatagtaacaccgtactcatcccagtcattcttgaacctatcgaatatcttcttcacatccttctctgtagaatcaagatatttgccatctatctccctaccagttggagaaggaacactttcacctataattgacgtatgaagtaattagaaaaatgtgttagaaaaatgtaattccttaataaatacatacgtaccccacttttgtgtctcccgaacggcgctgacaaagtatagattatcggcatttctaccaggaatgccggcggtaaagaagaaccttgcccatgactcaccaatggcctgcctagcttgcttccccttctttgtgaagaatcctgtgtcaatgcgtgtctgcacaggggacttggcagatgctagattgtaatctcttacagcaggtgactccctatgagatgtagcccttcgtagcatattggtaattgggttacttctacctttccgtgcctcgggctgagcggatccactcccaccaccatgctcataagtgccaccacgctcctccacgtggctcctgaagttttcctcttgtcgtgaggctgccatggctgcttccatttgttcctcctcgtcggcatcacctgttaggtcataatagttgacccctg

SEQ ID NO: 74020 - DNA, 5823 bp, Oryza sativa
gccggcgtggtcgccttcgggcgcgccccgcgtttgccatgtggggccgggccgtcagccgccagcgccctcgggtgcggctaacgcgtggaacccacggcgccggccggtgtaagcccgggtgcgcccggtccaccgtggaccgtggggctgccgcgtgggccccactcccatggacccggtccgcgcgcccctcccctcggctgacgcaataaatccatttttaaattaaaatttaaatgaagaaattcgcaaatattcatttaaagagcatataaacttcaaatggccataacttggccatttgaattcggaattggaccgttcaagtctctaatttttccttaagaagtcaagaacccatttttatgctttgtttcagcttgttatatggagtttattagagtaaaagccttttcttttccgttgttcgtgtagacgctgcagcttcggaagatccgcttttcgtggaagttgaagccgacgtttgggaaagcgagcaaggcaagtcacatcatccttgaacatattgaatcccagtttatgaaattattttaatttaagattattgcattaccgctttatttaaattcccacgttatcattgttttatttagccatgcctatttacctttgttatgaccttattattattgttattgttattaataccttgttcaccctagatcgaaacaaaaccccaactagtggatactctactcatggtatcactagtatgattttaggtagatgctacgctgtttaattaggtaacattaggtggttttacaactttagactttgggatattctcatcacctggacacactagaattgttgaattattgtggaattggattcacacattcccctctattcaaaatcctgaaaatggttttaggctgggctcggggtgcatggttttgatagtagcacctcggccatataaggaccggtcttcgggcctctgttgcaaagcactaccgtacttccacatgtctagtgggtaaggtttagtttgtggctcagtctggttataaacaaaagtacacggatggagatggatgaagtcgggggtcgatggacatctctaggacaaatgaaggctacacgagctgcggcccggtagtcgagatgtcatggcacagggccggtgtcctgctgctaggggctcagtcctgcctacctgtcccgggggttccggccgtaggtgggattgggtcggtactcttgtctatggctaggatgggttggaaactatgtcacgtcttccgtctgtataccgtggtggtatgtggcacgtggttacacgtgaggaagatgtgtcttgtgggtaaagatgtacacctctgatcagagtataacctattcgaatagccgcgccctcggttatgggcaagccgagcaatgtacccaagttagtgttttcattcttaaaacctgcttaacaactaaaaggaggaatggttggcctgggttggcttgggacgagctgggacccagggtcgggttgccaggtcggtctaaatcatcgtaggccttgggttaaggcaggttcgtgtgggttcacggccttgattaataatattgtatagttctagaatcgtgtttacaaaatagatttgagcaactaagtgtcttataatgctgtttactgcaaaccctaaccctttatattgtaactcccttgtactcccttgcatttattctgcacttgtgggtgtgtcttgttgagtacggtggttgtactcagtcttgctcaatttttcccaaacccagaagaggggcctcaggaagatgaaggctttggtgtctagctcgtgcctgccgtcaagcgcctgtggtcgtcgccctagtcttccgttgtttctcgtttgtctttgtgtgtgctgggccttcgctgcccatgtaataaattaactatttacgcttccgcttgttgaactctgaactgtatcaacttttggtgtaccttgcctcctgggacaaggaataatgcacgcacgtatggaacgcccgttgggttaattccggtcgtgacaagttggtatcagagcccccttgaccgtaggacgagccttagatcccaagccttagcaatattttcaaaaataaaaatcctgtcttaattgtgaaaatcctctagtctctctctgtcctgctgcttcatttatcgccaaaatctgacctttaaaatgttgcttttcttcttgtttttgtttgtagatggccggcagcatcaaccgtcgtggtctggacctgactggtttcgttttggagctgcggggcatgtgcgttgtcttggggtatccgcatggagtggactactagggcaggcagctcccggagcaggagggtgacgatgcagagccccacgctgcttgggaggttactgcggtgatcctcacgggctcacccgagaggacttcgttggcagtcaccgcgggtggagattctttctccgccgcttgccagaacgccgctctcctcgccatcggcactcttcaccagcgctacccgtacgagttgcagcactcaccctaccgctaccaccctcgctgcggaggagcccgcgactacgccaccttccgggatgctagctcggaggatgacgctaccatcatgcatctggcgcgcatggtggaggcgtacgacgcggctcgtatcgacttccatcagatggtgcgccgtgggatggtcgagaatagcatgaagatcctggagctgcgtcaggagaatctgcagctgaagaaggacctagacgcagtggaggcgcagctgcatcagctcaagatcgcccatggagaggtctgtcgccccaagcgccgccgcgtctgccgcagccagaagatcaccgcccgcaagagcacctccaggcctgagcttgttcgtcagtccctggcgtggacttgcttcgttgagacccctcgtgccgagcccgcgcccgtggttcctcaggagggggaagcctccggcgttggtagcacggaggatgcactgttgctcaccttctgtcctggcccgtcgcagcggtagacgagcagttagtaggcttgcgcgtgtgttctttctcgtttgtcttcttgttggagtcgtgtggggcatggttatgccggtgtgtggtataactgtgtcggagcctgtctttattttatttgctgaagcaacttgaactttaatgaaccaatttaatagcagtaataaattcaagaattatggtagtcgtgggtggttagctttaattgtcagctctctctgtttgctggttctgtgtggggttttcagatggtgacgaccaggagaagtgctaacaccggtgatggcaaccaacccgaaggcagcaaccacaacaaccatggcagcccacctccacctcctcctccgcctccaccaccaccaccagacaccaacgccattctcacccaaatcctcgcccagcaggccaacatgatgactgctttcctccaccacctccaaaatccgccacaacagaatgctccaccaccacccccacaacactctaaactcgccgagttcctccgcatccgtccacctaccttctctagctccaacaaccccgtggatgtgttggattggttgcatgccgtggggaaaaagctagacaccgtgcagtgcagcgatgaggagaaagtcatcttcgccgcccaccaactgcaggggcccgcatctctatggtgggaccatttccaggctacgcagccagagggacagcctattacttgggcccgcttcaccgccgccttccggagaacccatgtgcccgccggagtcatggcccttaagaaaagggaattccgggagttgaagcaaggcaaccgctccgtgatggagtatttgcatgagttcaacaacctggcccggtacgccccggaggatgtacgggaagatgaggaaaggcagaagaagttcttggcaggaatggaccctgagctgtccgtgcgtctagtctccggtgactatccggatttccaacgtctggtggacaagagcatccgcttggaagccaagcacaaggaactggagtcgcacaagcgccgcttggcgaatttccgcaatcaacagggagctaaccaaaggatccgctacaccaatccctatccagggggatcgtcctcgcagcagcaacaacagcagcagcaaccacgctccgcgccccgacctcaattcgtggtgcgcgtcccacagccgcagcaacagcagagccagcaagggacctgtgcgccccgtcctcctacgccagccgcgcagtctggtcaaggccgcagggacgttcaaggtccgcagcgtctgtgcttcaactgcttcgagcctgggcactttgcggataaatgcccaaagccgaggcgccagcaaggccaagcgcctccccgctccaacaacggtggtaaggatgtcattcggggtcgtgtgaaccacgtgacggccgaggacgtgctgacaactccagacgtcatcgtcggtacgttcctcattcattccatccctgctaccattttgttcaactctggagcttcccactcgtttatatctgtgccattcgtggggagaaatcagttgggggtagaaaggcttaggaaccctctgctcatcaccacccctggaggggttatgacagcaaagtattatagccctgccgtccctatagaaattcaggggattccttttccctcggatctgattctgctagacaccaagaacttgaatgtgatccttgggatgaattggttggctcaattccaaggagtagtggattgtgcaagacgcactgtcactctgtaccgagggccggaacaaccggttgttttctttgcacccccaacctctgtcagtagttcagaacttcatcagataggactgtcagaaatccccatcgtcagagagttcggagacgtgtttccggaagaactactcggtatgccgcccaagcgagagattgagttccggatagatcttgctccaggaaccactcctcggtacaagcgaccctaccgtatggcagcaaatgaactggccgaagtcaagaaacagttggaagagttgaaagaaaaggggtacatacgtccgagtacttccccctggggtgctcctgtgatttttgtggagaagaaagacaagacgaagaggatgtgcgttgactacagagctctcaatgaagtcaccatcaaaaacaagtaccctcttccccggatcgatgatctgttcgatcagcttaaaggtgccacggtattctccaagattgatcttcattccggatatcaccagttgcgcatccgtgaagaagatattccgaagaccgcattcaccacgcgatacggactgtatgaattcacggtgatgtcattcggtttaaccaatgctcctgccttcttcatgaacttaatgaacaaagtgttcatggaatacttggataagtttgttgtggttttcattgatgacattctggtatactcacaatcagaggaagactatcagcaccatctccgtctggtgttgggaaagctcacgaaagtccttattccatccaccctagcagtacgaagatgtacttagacttgaaggagaaatactggtgggttagtatgaagcgggaaattgcagagttcgtggccctttgtgatgtgtgccagcgtgtcaaggcagagcaccaacgaccggccggacttctccaacctctccaagtaccagaatggaaatgggatgaaattgggatggatttcatcaccggactcccaaaaacccaaggtggatatgattctatatagagtaaatgtggaccgattaaccaaggtagctcggtttatt

SEQ ID NO: 74021 - DNA, 45078 bp, Oryza sativa
atatatatatatatatatatatatatatatatatatatatatatatatatatatatatatatatatatatatttacagcatgtggatgtcattttatcttttaggaattatttgggctacctcattggatgagcatatctaggacacacaaaataaagcatatcatcggcgtaagattaattaagtattatatatattacataacccgtgcttatataagaaaaatatataaaaaggtagaatctagctatttatttatacaaaacccgtggatatattatttcaacaattatatatatctattcaagtaatccctcactacgtacgtacaccagagttatcataaaggaaaaaaaagaagagtgtgtatacgatcagctgcatcaagtagttttctttctttctttctttgcagctatgagattttcctcgaattgtgcatatgagtagcgaccactcctgacgagattgtcgaagaatccacgtcgccacagcaccacttcacgccatctcactaattttctaaaaagtatttgtccatgtttgatgtcacaattctggtatttgcatggtatggggatcgttggtgctagggtatacgcgagactgaggtaaaagaggcggagacagggatttttatacaggttcgggcccctgaattgtcaggtaataaccctacatcgttttggccgaagccagtattgctcttattcatgataatcacaccagtacaatatttggggtagcctatctaactgttgtcgacatggcggtctgacgatctgactcgtagtcgacaacagggtagccttcctcctcgaatccgtgcccggcgagatcagagatagcgctttcgtctctcctgacagtatccagagacaccgtagggtactagccgtgcttatccctgaagtcgatatccggcggcgtgtcttggcgtatgtaggcttctatattgtggcttctatgtcgattgtgttgggtgttgatcctccatggtgggtgtccccctgtcctcctaggggggcttgtatttatacccataggtgtccccttgtccaagcagaacgaatgaaaccaatatggatacaatccgggtagtccttatcgtttccatgtagaactctgggtgtctttccttatccggaactcctcctatatccgaaggttgtttccgtataggacatagtatgtggtgggccctgccgagattcagtcaactattattaggtatgtggtatccataaccctgacaatattttttttactaattatataaaaggcattcacgagcgcatatataaatgtatgcacatccatcatataaatacacatacgcacacctacactaagagaaaaaaaatttgtctccaaaagagaggaacaagtacgtgcttagtatttgccagaaaaaacatatacacattcaatgaaagtgtcttatggaaccacatcatatcttcttttaattatgtcattctcatctatataatgttaataattagcacaaataattttgacaatatagattattctatcttataatacccatgaacatgcataggtgaatcaaatgtataataaaagaaaaaaaaacaaaaaattatgaactcatatgtttacaaacaatgatgataaatgagtttatatataaccgggacaattcttaccgtcgttgtagtttaagggtgtaattcagactttttcctttaaaaagtcatttccacataaggatttataataaaattttaatcatcactaaataagtaaggtgcctgcacatgtgctataaacgctctcaagtcgtcacgtggcactcctttaaatgctcctatgccaccacgtggcattttaataaatttaagaaaatcacaaaaaaatctgagaataaacaaaacatccgtccatcgattttcactaacatgcagtggacccgttgttttctatcattagacttatttatccaaatagataaggataaaaaaaaggcccccatatctcaaacctctcctgtacttactccaaccagtatgtaccttcccagtcccaccaattttccttctctcctatttttctcctattttcatcaatttgttagatggaaaaaatatttataacccattattttctatcattagatttgtttatcaaatagaaaaaggaaggataagaaaacaagccccgcatatccacccctcccattcagtacatacgtgcctccccacctattttctttctcccctatttttctcttttagttagatggaaaaaaatgttttatgaaaactaattttaaacaactatattatctaaatcatatagctactttttaattggtgcacaccattagattatttactataaaatttaaaactgaagatctaagttaagtatattattaaagaaattcattactttgtgtcatatatatactacggactaactattgttcaccgattcatacattttgaagaaaatatcaagtagatttttaaaccttctgattaataacatgtacttcgactagaacaatttaaaacaatctaagtggtttaattagaaaatacaacacccaaagtattttctaatcgatctaaaattaaaattaaatgtatttataaaaatatataactcaaaactaggacccataatatctcttaaaaaaataatatcctaacaaccaaaaatttattaaaaatatgtattaattaaactccctcgcgagcgttcataagtcactctctatcatgtcctaagttaaaaatacaactaaattgatgtatccattatttttaactattagatctatttcttaaacataatcttgaattgtggtgtgccacgtcctataaagcaaagaaagtatcttagaaattcttaaaaaaaagtgaagcaccccatcatcggctatcacttaaatcatttagaaaaattacaaaaataaaatctcttccacctcctcctcgccctcacatgcgcacaacactgcccatccccttcatattgtttagatattaaactaaaagaaaaacaatcaataatgtttgatattttttagaaacatattacaaatataggcactcacaacacatgcacactcacccctatgaatgcataaatacatagcctacccctatgaatgttttttttgaaacacacaacaaacgtaggcgctcacaacttaatggacgcacactcacccctattaactcccaaacacataggttacccccatttgtgtatctccaaaagattagacgacatattttgagatttaagaaatcaccacgggcgtctcgctgtcgatggatacgccacccaccactgaaagaataattagtcgtaaatgcgagcacccatgtcaaagtataggacttgaacccggtggcaagttctaatataaggaaactaaccagttgagctacactcactttacaataatattgaattttaatcacacataatttttaagctatatttttggaatagtcctatgccttttaaatcggtggaaccattatttcttatcgttggatcgatcttatataaaaaacaaatgtgtattcatgctatagtaatatgaatactataacatttcaaaattaatacagcacaattatgttgtcattatagtattcatgttaggctgtgtggagtgtctgaccttgtgtacatgaaatgtttatagatggatcacctctcaaatacatcagttatattaggctatataaacccatacatttagtggagcttcatgtcccacccaattctcctctattaaaccatgataatatatatgcaattaaaaaaaaccttactttatcttttttttgacatgttttctaaagaaaataattctacctacttttcaaatgatggagaagattataaataattacttgtagatattactaaaatatcatataagataaagctcataggttagaaaattataaaagcaattaatgccaacaaaaataatttatggagaaatcgtagcagatgttctctggttaatattttgctgctataagtgtccccagcttagcgtacgatgcatgcccgcgcgaatgcgtgggctaccttcctagtttagaaaaagtagctgtgccttatattatggaatagagggagtattatactataatccctctgtacttataaaggaagtcgtttaggacaatgtttaagtcaaaccttgggaatataaatcatgaataactctcaagcaagttgttaagtttgaaaatataaaaattatatgaatagatttatcttgaaaaatactttcataaaagtatatatatatatatatcacttttcaataaatatttttatagaaaaaaaagttaaagttgtgttttggagaccgtgtcgctgttttaaacgacttcttttacaaggacggcgggagtacgataccttttattatcacgagttaaatctgaactgatatcgatgtgttatatttattttgtttatgtttagatagagagaataagccaacaattactcacccatcattgctcacgcacgcgtgctgcccgctcgtgggccgtgcgcggcgcggagagacgtacacgagcggttggccgtgccgctcgcccgccctcgcgcgtggaagtcacgcaggctcgcggggaaaattgctgccgcccaccgacgatggccggtcgaagtggacgtcgaaaccgtgcgcgcgagcggcagctggctgctaccgatatcattcaattcgatcgggccaaaaccgacgatcgcttttgtcatttgcccttgtagatcctacgctaatctagttggcaatgggaagtttcaagggtagatgactcatggtgtgtcagcaggaatcgcaaattccaggtggaattgaatgagtgtgctgtgacacacttgacagcgacgtaacttgtagatagtgatctcgttgtacattagtacatactcctccattcttaatacatgcagttcttagagaaaagattctcattttcaattatcttgttagttaaattttgatttttaaattgtttggatgcctcccataagcacctaattggctgaaatcactactggagaagtgatgtttgttggttcggtccatttccacaataatcctagttgctaaaaatcgggagtaaagatctttactcccggtttatttgtgcaagaggactatgcgatctttaatcccggtttggtaacaccaactgagacttgatctttagtcccggttcaccttgtgtcaaaggctgtcaggtcctcagagatctttaatcccggttgactaaagatcgatcctaactttagtcctggttgttgttccccaccgggactaaaagtttttatagatctttaatccctaaaaatcaatataccttatataatccctttgcacttatcctcaaaaatttctatctcctattccttctcactcttatcctctctttatcttcctattcctcctcctcctcctttctctcacacagtcttatcctctccttttctcacagagctggcaaggtgcgggcggggcgcggtggcggggccagcgaggccggcggtggggcgcagcggcggcggcccgcgcgcgcgaaggaggaggccgggagggcggcgggagacggcggcgggctagcgtttttttttttgaatttgtgattggatctgagatgtatttgatttgtgtgtgatgtattcatgtgatgtatttgtggtgatttttgtataacttgtgatgcaatgttttataatttatgatgtatttggagattatcaatttgaggatttggagatatcttttgttctgtgatctgttggatttgtgatctgtgatgatctatttagggatggagtgaaatcaatattcaatgttaaaaacaataaaataaagtagcaatcggtcctggcctggctacatcttaccgaccgggactaaacatgcatctttactcccgggtatttgaaccggcattaaagaccgccatctttagtgacggattctcccttccagttcgctacccgggagtaaagggggttgcgaaccgggagagaagagggtttctccggtagtgaatactgaaatctttttttttgaattaaaaaaaatactcggattcttgtgtattagaattaatcaatgtccctgaaatatttatattgtgtaaactccaaatattagaaatactaaaatttgagaacggtggagtatatgctttcgtctattgattaagaacctacgtcatgtatttgatcggaccagtcaacttgtaagccgtatgtatcacggcgttgcaaaagtgatgacaaaaatatgatacttggtgtaaccagcatcctcaaaaatattaaacccgaaaaattccaaaatattctagtaagccattgtttcgattcaattcaaggtttatggagggatgtttcactttttttttatctttttagtaaacgtattcatagacttaaacaaacttattctataaataatcgttttcgtggcacaaacaacattggcgtcgtggttcaacatgacaacatcaaagacgttggcgtcattccctagcacccaaatagaaactaagtcattaatgtgtaggggatagcgccaacatcattgacgactaggatatatttgtatgtttttttgaaaaagtacctatttatagaaaagcacttatttgtaataaaaatatttataaatagatccttgacgcaagtgactgtgccagcgtcactgtactgaggatctatttgtaaatatttttttattacaaataggttatttttaattattttacaaataggttcttggcaccaacaatattggcgccgtccctttcacactacagtgacttagctttcacctggaggcgaggggatggccccaatgttattccaatcatcatgttggaccacaacactaatgacgttggtgccgcgaaaaggagtcgaataagttgttttagtgatttatttgtagaataagtattaaaaagaccaaaaggtgaaaaatccagggtttatgatgccgaccaatagagcttaccccaatgatactctcaaccagcttcacccctgcacaggaagaataaagatgatattgcaaatattggtaatacttagaaaacttttacggtacaatatattgccagtatatactggcattatatagacgggtaaatagtattatggcagtatatagatgagtaaataggagttttatagaaaattaaaataagactttttgagtaatttcatggttgagagttaatacggtctagttaggacatactcatgctcaatcactaaatattttttataaaaataatagtctaaagtaatggtctattggtttaaatataatttagtcaatatagatcttaaataatgaatttagtgggtatagaatataacagtgtaaactttattttcaaatagcgtgttattcgaaaataatagaacaaaataatgggtcttccgtttaagcgaaaattatcttataatttagtgggtaaaaattttcagccatgtccctgaacaaaagtgcataacagtacacccttccttcatgacatcacgaccctcttctcttagcaacccggaccattgtcgagcacagtacaccctttaaaataattgttttttagtaaaataattgttttttagtaatttcaaaatattcgagattacaaatgtagatattgacagtttgatgtgttggctgacttgaattatttatttttggtaacattagtaatgtagaaaattaaccagccacttgatatgctttagtgaaaaataggatttagttaaagattagagaagtacaacctagattaaaggtcctcctccccaggttatgtgtaatatacgtggtcctcaaaatttaaagcctgatgattattccctccgtttcatagttttgactttggtcaaaatcaaactgttttaagtttaactaaatttaattttaaccaaagtcaaaacgatttatagccttccccgaaaaaaaaaagatttataacatgaaacgcagggagaagtagagtcatgtaccacaactccagtaccacacattgtcacgttcagtgcttcctgtcaattcttacttcttcgccaggattggttaccatccttgcgatcgatacggtatcacctcattccagtttacgtgcgttcaattattggcgagtaaagtttgatgatgggcaccgtacattatcttcaaatagacatcctaataatagttacgtaccaaagaaataaaaaaaatgtccatattcaaaatatatatcacttagaataaggatcgaaaaggacatgagcaaatcaaaagtaaagttgagatcgcagctcgaatcaccacctgatacctcaaatcttgctagctacaaggacgcggcaaagcaaacggttgcagaatccagattcttctttcaaaaatggtccgtttcactagcatccagcaggaacccgccctgagcggtccaccgtcctagacacaaacggcagcgcgaacccactaaatagatccatgccactacaaatatgttgattcaaacaaataccactagtattcgtgatatgtaatacatgccacgggaattttgaaaaattggaaccatgccactccgtcatgttttcttcgtctccggcacatacgccaaccaccatcaccaccagcaatggcggtggcatcacccctcattcaccggacctcaccgccaagccaccccttcacgctgaccgcaagccgcgactgccccaaccaccatacagacacacattgtgccgtctccctcaccaccatcgacctcctctatggcgggagggctcgggcgcctctgcctctctcgccaatgacgtcactgatgccatggatggggtcaaagatggtagtggtggccgataaggtcgaagacgatggtggcgacggcggtggctccaaagtcctcacgccgtgaaggaggtcaacgacagcccgccgcgaccgtctctctcaccgtcgtcgacctcctctgcggtggaagggctcgggcgcctctacctccctcgccgatgatgtcaccgatgctgcggatggggccaaagacagcagcggcggcggaggccaatggggttgaagacgacggtggcgacggcggtggctcccaagccctcccgccgtgaaggaggtcgatggcggtgcaacggcggtggcttctaagccctctcgctatggaggttgacaatggccacggtggtggctccaagccctcgcgcgacgaggtcgcgtcgacaacagcccgccgtgagggaggtcgatggcggcacgacagtggtggcttgcgagccctctcgccttggaggttgacgatagccgcggcggtgcctcccgagccctcacgttgtggatgggatcgatgatggcagcggctccaagccctcttagtggtggaggatgatgaccatcggagatagagtgaagagaggtaagggaaagaggtgatgaagatggaactgacagctaggtcccacatgcagttggggttaacggagatttttgacagaaaacgtgacggagtggcattgttccaatttttccaaaattccagtggcacgtagccgatatcattaatagtagtggtgtttttttgaatcaataaatttgtagtggcatggatccaattaacccaaaaaaaaagctcaaaaccgtgatgggtcatccgtagttttgcctctccgcactcatgacagattcgaccatcggtaaatagcctctacaattccaattgaagaaaaaaaaatacaagtgaaatctttgcttgatgagataatccattttggatagaatgtgaactggatagatttttactggaatggtggtagaaaaagaccattcaaatatcgttaagattgaggaaaaaaaagtttgcaaaaactcgatagaaggcaatcaaagttgattgtgcaccgaactgcatgcccatgtaacgcgccaaccacacaagcacatgtcgctgagagtggaacctagcactaaaccgaacaccgctatgcgtggccaaattccactggcctacaacaatctccactgagtctgcacactatccagtgtgtagactccaaacacaacgcctccatggaggttatgccattgatgatgcgctgactttgcctatccaagatggacatggttttcaccagagactcttgccaagaggaggtaccttggcagcgccctcaggagggttacggtgttcaaaggtgtaattgttgccgccccagtgcaacattgggcgaggcttttgcctagaaccccctacaacattgaccgtggttcgtcacccatcatctcagtttccaccatccaaacgttgcatcatatgcagtggcggagccaggaatttcgtgaagcctgggaaagcctaaccaaaatggctatccacatatataatgtctataccttcattttactactaactaaagacaaaacaattttgttagtttaaatgcatgtaaattttcaatagttgaagaaaaataatgttattgtaaaacagacgatttatataagctcgagtgcgtcacatcatccattgtgattcaggtaaattggcttctggtgaacagtacaactcaatttcatgctatagggcttacaaggcttgctgcttgtacggtccaactgaagtaattgaaagtttaatctactagatttgttgggaagtcattaaatccatggattttaccattcttgttcacactcacttttactagatttgctgaaatcagtctcatttgcactcgtgcagcccgagcaactgtctgcccaagccaggcggtgaatccgccactgatcataaggcctctgccacatgggaccaacaaccctccgcaagccaacttccagtcctactatcagcaagaccgctgctgtgcactgctattagcaccctttagcgtgctgcggaaccaccagtttggctgacctgtgggtgccactcctatccaccgtctttcaccaggagatgattggtgggcccctatgggggttgaggatggtttggtcctagtttaggttggttttgactatcatgattggccggaggtgaatttcatcgtatggtgggtgtaatttcttccaaaaccacctgcatacatatatttaccaaaactcgtggaaacggtttgtaattaacccctaccactaagtttgatattttattttgaattcttttatgcaagagttaacggttaaagtttgcacttatcgaccatcaacactctctccggaggactaacacatgtgaagggaaagagttgccaccagcattgctacaccaggctggcacctcaactgctcctccgctccaacccatccctaacgccaccaacttccatctccctagccagccagccgtcatagctgctcatccgtaacgaccaagcatgagaggatggtaggatgactgccatcgacgccaccacggtgctttagctgcaactccgcacaatccgtcgccccaccaccaatgccagcgctatccttagatttgtctaaacaatggcaacatccatgccgtcggctttgagctcaaggtacaataagaagccatgtcgccactatccttgcagacaccaaggggagaggaaggggaggaagtgggacgacggtgctgcggatagttatcgcccgtaagtgcgacaggtggttttttttccttcatcattttctatcactagtaaaaaaagatttttgcatatctcaacaacagattttcgttggcagattgaggaactacatgcccctttaatttgtaaagatcggcatatttttgggcagcacaaccgcatgtgaaaagtgattttcattggcaatcaagttatgccgcccacctgaaaaaatatgcataaaaaataaaaattccaaaaagtcgcaaaaccctagcttcaacagcggatcagcccctcccaaggtcggccgcacgaagttgctgtcgctcgggcttagtcgttgtcaccaaagcctaccactccactcctctaagcgcccgtgcacgaagctactgtcgcatgggctttgccgctcactagaagaccaccaccttcttactgccggatccacgcagctattgttgttactgtattccaacccccttctccttggcccgccaccacccagatccagcaatggttgtcgtcatttctagatcgagaggagtttggagagggagatgggagattagggtggatgccaccaccacctccaccattgtttggacttggcctccccactgctccccaaccagtcgccatccggatcaagccaccctgccgcttcctagctcactaccatttggatccagcagccgagtagcagtggtcatcgtcgtggagtcggacccaccaccgacgccgagtcggacctgccagtgcctctccatgtccactgatggcctggttcggcctctttgtcataagatctagctagcttgcaaatagttatggttttgtgcttttggttgcgtgtaaaaaaccgtttttctagtagtgtcatgctcattctacaagattagttctatgtgtcaagggctgttattatattgaaaatgggttttggcaagtttgaatttgaagaaaaaactaagttgaataatccagaacttggattcacgtatggactgagagtgttagtagatgctattaagttgaataatccagaatttggattcacgtatgaacttaaggctaccaaattaaccgaagaagaggatacctgtggagattatgggtaccccatacccacacggcatggttatctgaatggttatagggataacttatatctatataaaatatgtaacggatcatgacttgggtattacgtttcctagtataatatggaacggcctaaagtcctggtttgttaatattgtaaagtagatttaggaagccggtaccgtattggttaaggtttctatcttgtaatcctgccccccatcctatataaggtgggcaggaggccctctagggggcatgagcacatatgatcgtcagatctatactatacccggcggattcaaatctctaaacaggagtagggtattacctcttattgagagggcctgaacctgtctaaatcctttgcctccgcatccatccacttttaggtctcgtacgctacccccttttattattgccgaattcatgtttcgacagttggcgcgctaggtaggggttgcgtcgaattacccgtcgaaaagtgcgatggaatcaactccatgagtcaccggcttcgtcttcacttcgggattgtcgcttcctcgtcgccgacaacatcaacaagctctcgttctctgacttggattcaaaccagtcaggagagattcaatctaactaagaaggagatgccacttttaggagttatctccccgacgaggcctcatcagttccgcccgaccggagaacgccgccactgccgacacgcaaggagggagatcgtgtgctgcatgtgcctgcagcggtgtcagcggtggcctcgcatcgcgctcgcgatagtgctcgtggtgacctcgcgctggtgtcgcgaggcagcaagaccgatctctccctgatggcatcctcggatactccaatctatcatcattagattgatttctaatcagattaatttgctctgttctgctctctgtttttgcatgtactggtgacgagacgggcggcatccaactgaggtcatctctgccacgtattaatccatgcatgtgttgctggattaatgccgaccaaatctccagtcaatcatgctattagcaaacgaaccaacatgcatgcatactgcatatatgcaccgacacgtgcattatatctacagagcattaatctctaattactaattagatttatttataatcacaacttaactgaagcttgtgttcgctattttgttcgcatgtttggagattccacacgcctgggggctgcgggccagcgccgcctttgcgtgcctaacgcggcctgactgctcctagggcacgcacgacctggatgcgacgccgcatgtcgggggcttcggtcttcgcccggccaacacagcccgactacgcctcttccgccgcgggctagggggttttgcctttgtgcgccgccgcctcatccaccgccgactggtgtcctcgcctacacggttggttggtcacaccaccgttcataggcatccacgtcttcaacgactggctggatttcgtcaccgccgactggtgttctcgcctacacggttggttggtcacaccaccgttcataggcgtccacatcttcaccgaccggttggatttcgccaccgccgactagtgttccacctacatggctggcctattatgccgtcgttgttgggcgtctacgacttcaccgtcagcctgccttcctcgccgccgactggtgtcctcgcctacacggttggttggtcacaccaccgttcataggcgtccacgtcttcaccgaccggctggatttcgccgccgccgactggtgtctccgcctacatgactagcctattatgccgctgttgttgcctgccttcgtcgccgccgactggtgtcctcgcctacacggttggttggtcacaccaccgttcataggcgtccacgtcttcaccgaccggctggatttcgccgctgccgactggtgtctccgtctacacggctggcctattatgccgccattgttgggtgtctacgacttcaccgttagcctacctttgtcgtcgccgactggtgtcctcgcctatacggttggttggtcacacccccgttcatgggcgtccacttcttcaccgatcagcttgcctttgtcgccgccgactggtgtctctgcctacacggctggcctattatgccgctgttggtgggcatcttcgctttcaccgtcgaccgccttcgtcgccgccgactggtgtctgtattgttattgatggacgacttcgttcccacatccacatcggctacttctattgtcaccgagggaatacgaaaaagctaagtcctcattaattttctttatatgatattttccttttcctctgcctcactacatcaactggtttaccgttgactagtgaatcgggggctacagatgttatatcatattttttcaacaattttcataatatttatcttgattgtttgcgacataatccgagtacaaagctacctatcgagttatggagttctatcttcctatgctttccgtttggtttgtcaatggatagttgcctttgggccgattcctagcacccgggggctcgttggatggaccgagtaacacaaagtgctaagtattactcggaataaatcaaaagtatagagataagataatttattttctactcttaacaattgcaaaagtacccgagtagtaaactctgatccgtgaatctttgttccattaatgacgaactcatgtcactcgtatgcatgtttgggagtcattcgctatgactagtcgggcagagtgtttaaacgtaaggagtcattcgctcggggaaatcaaaattgacaagaggagaaatacatatttataaacattttaaaaatacttgaattctcctcgagtattatatttacataagatactactcatcctatatgtttgttctgcaggatccagatccaaatatgcataaaagggattcatggttttaagcttatctcttacgctccgggaatggatcagtcagaacatcaccaccggcttgctgtcgccgccaccgactagtgtcctcgcctatacggttgggtggtcacaccgctgttattgggcgtcgttgtcttcaccgaccggccgcctcgttcgccgccgattggtgtcttcgcctacatggttggttggtcacgccaccgttgttgggcgtctacactttcactgttggcttgcctccgtcgccgccgactagtgtttccgcctgcacggctggcctattatgccgccgttgatgggcgtctacgtcttcactgaccaattgccttcgccacctcgtatgatgccaactggagctatcgtcttcacagctggccacgtcgctgccactgctaataggcgtcgtcatcttcaatgcaagctgtctatgtctgctgccgactggtctcttcacttccatggctgcatgattctgccagtgttgattggccttatcgtcttcattgccggtcgtctcgtctgctgctgactagtgccctcgcctctacgtctggtttataccgctaccactactgatggacatcatcatcttccgtcgccgactggttatatcgccgccgactggtgtttttatcttcacaactatgcgtcttcgctacggtttgcttccgttgccgccgactcgtgttcacttcgtcacggctatgcaactttgtcaccatggtggagcgacttcatctttattatcttcggcaccggcaaacccaattgtcgcaacttcgcatgttttgctacttcaccaaccacgtctacaagagcttcgacatctcggcatgcacttccatattcgatgccgtgttattctactacaacaagtggttccctaattttcaagatttctattcggacatcctcaacacatatctttactcgtgcaatgagtactcgatgacaagaagctacagttctcgactctatgttcagttgccttctaactaaccaaagagtcgggggctacacaaatacaagactctcaaaattcaacaagctgaagaaatcaattaatcagccaacgagtcaactccaggagtcgttatcttcatctttgcttcgaagcagatattctacttcagcaactccaattatttcactagcaattttggtttctggacgctgccataatctactccaaatttctcaaagtatcaagttcaagatttaatctacatgttcgagagtttggagttatcagccaatcagcttggtttagacgagttggacaacagcatctactttcctccaagtgaagcatttacaacagctataacactaagttctgcagtcatcttcgtacatcaagaagcgttgcatcagtcttctttatgcacacgctctcgtcaaggaaactacttgagctttgatatcttctgaacagtttgatggattattgtcgctgacatcatcactagcacctctgcttcattagccctgacatctccgctgttgctaatggatgactatgtcttcgccgacttattatttcaccttcacggttgacctacaatgcaaacgctgatgagcgtcttcgtcattatcatcagttgctacaccgctattgactggattaccaacatcgtcatcttcatcaacatcctgtcaagcctcttcaacatagcctactctgctgccgttgatgggcaacttcgtcatcatagccggctatctctgttgccgctaatcatcattaccgtcggatgcgtttgccatcgccgactattttcttcatcttcataattggtggatttcgccatcaccatcgatgcgtgtctacttcttcatagtcggcttgctttcgtcgccaccgactgctctgtcgttgttgttgggcgccttcatcttcactgctagctgacctgactactgtcgactagttttttcgcctcgatggctatgcgacttcatcatctttgattggtgtcattgtttttaccaccaccaacattttcgtcacctctgacgggcgatatcatccccatgttcgtcattttgccttcatgtcgactgcataagctattgccaatggaaaattttgactatgacagaaggacaagttatatatgctcaggggcttatcaactcaatcacaaggatcatatcttcaatttggacttgttccggatacattcaacatgaatttatggtcacgagtcgatttcatatgcttaacggctggactattcattattccccacaagggctatcaaccgactacttgcgctagtcgggattcaatttttatatctattttggagtatcccataagggataatcactcagatcagaagctattcttatgagctacagttggtctatatcacccggaagatttattactcaggagcatgttacatgctccatcctttaaagggtgtcaaaggcatatttttttgcctaggcctaatatgtctgcagcccatattttcaggtgtggcctgtcacattcttttatgtacttaggcacctttcgcttaggccaaagtgcgcgtgatcaaatgcccaataccttaaaatccttttatatcgcagttactcaactttttaggagttggtacaatgcattttaaaaggtgcccaacagtgaagtttctcatagctgccccgctgacttttttatatagtcaatgcgttgtttgggtttataaagcaattgattggatacactatcattgctttttgtcacgtaagtgtgcattattattgaccaatattatggcttaggctgattaaataatgtggtcatttttcagacggttggtaaatccttatgagtttatttactcggattttacaccacataggccatatatttccaggtgtggtgaaaccatgtgtcttttagagatttaagcacatctgttaaagcagtgtgcgcatggtgtgtgcccaataccttggaaatttctttattcacaacatacaagcttctttagagctgttttgctatgtgaattttcaatgatatagtcaactttagattgcatgcatcatgctttacaaagcatttggtatatcacatagatcatgttattcgggatttcataccgcatatgctatatattgatatcaagtcacttggttgactataattatcaaaaatcactctcagttggttggattatttattccttgactatatgcttggtttgttcaactaaccatagtcgggggctacacctattaggtgcatctattagatgcacctgaccttatttttcagccctccacagtcctctgatttggtaaaagtactcgggagaccatggcgaagatgattgaagcactcggctttagagtaatctggttcgaggaaagattatcttctcgattgtgaaggtcttaggggctactgtggagattatgggtaccccatacccacacggcatggttatccgactggttgtaggggataacttatatctatataatatggaatggcctaaagtcctgatttgataatattgtaaagtagatttaggaagccagtaccgtattggttaaggcttctatcttgtaatcatgccccctatcctatataatgtgagcaggaggccctctaggggcatgaccacatatgttcatcagatctatactatacccggcggattcaaatccccaaacaggagtaggttattacctttcattgagagggcctgaacctgtctaaatcctttgtctcctcattcatctacttttaggtctcgtgcgctaccccttttattattgccgaattcatgtttcgacaataccaaattaccaaccgaagagacaacttctcaagaactcatttagtacggaattaataactgaaagaggtggctacgatcaatacgaatattcgaaattgacagtagcagaggctgcaggcgctgaggacggatggccactggcactactcagtgatgagaacaagagagagggccatggcgacgatggattgaatggaaatcagggtgaaataattgagctgagggcgcacggccgcgtggggcggcggacatgggactggcttcgcccttttggtgccattgccacgcatgcatgccagatcgaactagccataaagcggccggcagggcacaggacgagcatgattaataagcctcacatgaatcaattccatcgaatgtacgttccaaggaatttcacagaaaattgttatgttgcctgcagtacgaaattcgtacgtaggtatgtacgtactctatatttgtaactgggaatttctgatgctacgtacgataaccacatcatattcttcttgctaggccatcagtcacgagagagtgcgcggaatattgcggtgcgttatgcggataatgtgataattggtcatgcatgttaattaattaggggctatattaattcaactttgcataatttctattgctaacagcaatataattaaccacaccgataatctcttggcattttatattgcaaggcgactcgatgtatataagcacgtgtgatatttcgcatttcatgtctccgcaatactttttttaattacatgcgttggcgcgcacacacgtgaaaatataactctctaggacattcttaagacatacttcctccgtttcacaatgtaagtcattctaatattttccacatttatgcattcattattaatatcagtatgaatgtgggaaatgctagaatgtatctatctagatttattaacatcagcatgaatgtggaaaatactaaaatgatatacattatgaaacagagggagtaaatgataattaaaagatagatccatgaagtaattatactagtgatgctgttggtaacaaaattcagaaattaaagaccgtaccaggcatgaaagcttagcattggttggaaagatgtctgagccgtactattctagccgatggaatcaaaatcatgttctctctcctaagtctaaacagctggaggcacgacgctctgtcctttgtttcatggatcatgccaagattgttcgtcacgtgttgcttaactgaattcaaggccatggggctagaatttgttgctggcaactttgaattcctgtgtgtagggccgaatcaagtctatctactgcatggaagaacaatctactgccaatattctaccatcttgataaggtattaggaggtatcacattttctattataaaacttatatcacatccttataaaactatgtatttcgagttatcaaaatttgtaaaattttgttacgtataaatatttttaatattttccaaggaccgtaaaatttatccccttttaaacctctgaaggtacatggattttaaggccaagccaaagaaattaaaccttggagttacaaaataaggccatatattaagaaacaacaatagcaaaaatgtaatgtttgtttcgttacataaatgcaaatgtaacactaagaattgcattaagcattcgtcctaaaagagtattaagtaaagatattatgtaaacacttactgatatcttaaaaagtctataatacccttgtaaagaattcttcaatgttatattatcttatatgactaactacttctccattcttattttgatcaattcctagttcccttcctaagttaaaattggccatttggtaattaatcttctcctatttgaaaaatggatttatttgctttttttaaacaacttctatatataattttgttaaaaaaacatatcatttaatagtttgaaaagcatgctaacggaaaacgagaaaattaaaattggagttgaagaatagaaccaggcctttgtagtatatacttataactaaatatttggggtcctgttctatcgccatattaaacatgcttatacacagcttaaatgtttttgtttttcacttatggtacaaataattataaatattctaaagtatgccagaatacgatatacacatggagaaagaaaaatatcagattagacttgaaaaaacatagtcacatttgcaatttgaattttttttgtccatgcatattgaatttgattttgcaagtttatagggacgtctacaatcaataatccaagttttctaatgtttctagaaaaaaaaatgtaagaaacgagggcttaaaatctccatcctattatcccagtatcaacggaaaaccatctagaaacattaatttgaaccatacaatatgctttcattaactttgacatgaaccaaaataaagaatgtaagtaggtaggtaggtaaaccaggacaaataaaggaatatatgataattataagctgcaagaaacatgcacaccggctcttctgatagggctgcgctgaaaacatgtcatcaccggttcctatcatgaggtaatcgatcatattcggtacgtctctctcctctcctggagtaggcagacgcaatcttacattcttacctaaatcactttctctaatccgccattacagccatgaattggagtaaagcagcttggtcagctagcactcatcagcaaaaggtcttatgctttcctacaggaagaagcagccacatgaaagagctgaaaaaaacagagcaagaaccacttcctttcggttttctagtgtagcactggcaaacatttttttcactaaccaaactcaagattagtcggctagctagtgattattgcagaatggttttgttaagaccaccctaatctataattaggagttaggcttagccaaaagtttgatcatggaagcacaatcacttcatgtctgcattcgtgttacaattttttttagataatggaaatggattacatctccggtttctgtcataagacacacagccataagtttaatagtaataaaaaggtaagataaaagtaaatcaaaatgagaaataaggtgatgggacaaatccccaactctcctttattattgactagcgttaaatcacataaaatattttagctagcaattcttatagaactacgctacccatagtggaataagagactcttggctaccgattccaagagtgtagcaccattgcgcatagtattctgctcctcctgtggtagcattgtagaccagaagtggagccagtaggaagacatgaagataacctgcatagggttagataattgtttaccattaaaaactttatcattgcgacaacgccaaattgaccaacatacagcgctagctccaattagaatcatcttcttaatggacctagatacccctctaagccaattaccgaaaatgtttttggtgttacggggtgggggatattaaaagcaaaaaacacacatctccaaacaaactaagcgacatgacactcaaagaaaagatgttggattgtctcttgtgcatagcagaaagaacattgtttgtctccccctccccccaatttcttttagccaggttatctttcgttagaattactttcttgtgaagaaaccacataaagaccttgatctttagtggaattttcaagtcccacagaattctctttttatccaaacattatagttcatgatcgcggcatatatagatttgacggaaaattgaccattcttatggagcgaccatacaaagcagtccttttcatttgacagagttatattagctagcctgaggatcaaatcgttccactcaattagcttttggccaacaatagcccttctaaaagaaatatttagcggcgttgtgctcatgacctctgccacagtagactgcttctttcgagccacattatataatgtagggtattaatctttgaaagcacgcgatcccaaccacatgtcttcctaaaatcttatgtttaccccattgcgacatctaaaagaaccaaacctaagaaattggtctttgactttcattaaaccagcccagaactgagaaatacctatcttgctggacataccagaaagaggtttaccctttaagtattaatttcccaaaaggtcttgccataggccttcaccattaaacaactagaaaagccatttgttaataagtagctattacgataacagagaacttttacgatgatctctactggtagtatcacggacggcacaatcaacggcgggcgcttcaaaaacgtgaagggaagtgggagtatttaggacccttcccagcaatctcacccatccctccccttcccctgcttcggcagctgctggtgtggtgatacactcgcctagctttggccaccactaatctctgctctgctttttctcctctgctccactgatcatccaattcttctcttcctgattggccattctgattggctggtgacatgtcgaaggtgagcctttcttgctcttggattctgatcctgattagctcgtgtagaatcaggatcatcatcttttcttcttcagatcccaacaaccttttttcttgcttgtcttcctgaattgtatcatgttcaggtgtttgtgattcacacattgccaaccttaaccctctgtttcacatgttgctctgctgcagaaaattgtggtgaagctggacctgcatgacaacaaggacaagcagaaggccatgaaggccgtctcctcggttatcggtacgaacaatcgtctcgaatctcgatcgatgcatccaccatttctgtctgtgattctgtgtacatcaacgaactctctgaagtctgaacatatgtctgattgattgttgtgtgtgcgtgtgtcaggaatcgacgccatttcgatggacatggcgtcgcggaagatgacggtgatcggcacggtggatccggtggacgtggtgagcaagctccgcaaggcgtcgtgggcggcctacatcgagtcggtcggaccggccaaggagccggagaagaaggaggagaagaaggaggaggccaagaaggacgccggcggcggcggcggcgacggcaagaaggaaggaggtgacggcaagaaggaggagggcggcgacggcaagaaggagggggaaggcaagaaggaaggcgacggcggcggcgacaagaaggagggcgaaggcaagaaggaaggcgacggcggcggcgacaagaaggacggcaacggcgacggcaagaaggagggcgacgcgaaggccgccaagaaggaggaaggcggcggcggcggcggcgacggcggagggaagaaaccagccgcggtggcgccgatgccgatgccgatgccgctgcaccacctcccaccgcagtacttcaacatggagtacatgaaccagtatcaccggccgccgccgccgccgccggcctacccgtacgtgccgccgccgcagtactactacgtccgcaacatgagcatggaggagaaccccaactcgtgcgccatttgctgatcgaaaaaaaaaaacgccatggcaaatgagcaccatgaatgctttgcatctcaatgcatgatctgtgtgcacttctgcagcaggtaggcgacgcgtgcgtgcgtacacgcttgtgttcttgatcgatcggccgtgatgtgtatagtataagatctcagtgtttatgatgagaagaacaaattaagtttgcgtgatcgaaccagtacgtacatagtagtaagttcgttttttttttcttttcgacaaattcaaccaacctcttcatcggtggatatatccggttaatgaaatatatgatgagaccaacaaagtttgcaagatcaaactagtatacatagtatgtttacggttttttcgacaaaggaattcaatccagcttctgcaggatgtattttggccgaattaagtactaccttcttctcaaattttatgggtaaaatctcttatattttaagacagaagatttacgtacaatttgtaattggaaatttgtgatgctacgttctgtctgacccaggtgcatgcttcctactataaccacaccatcctttttctctaaaaaaaaccacaccatctttttctttcaagcaaagagaaccagcagtaggagagatagagagagatgggcatgagagagtggggaatatgcagcgcatgatagatgagtggtcatgcatgtggtgggtgctgttcagactttgctttctagctaggagcattagaacatcaccaataaaactttggcattttctctcccaattgtagctcgatgcatgtgtattaccagcctagagatatggagcatattaatcatgtttctacagtttcttgagaagaaattctcttggcaagaccagtcatggaaaaagttagcatctgttggcctgaaagatctctgggccgtacgatttatttttttttgaaacctaagttggaactttgttccacttttatatttagaagaagagaattgacccagtttataaggaaaaccgggcccgaaaaccatacagttgcacggttaattacgggaaaccggctaaaacccaccacacagaagaaagcaagagacctaactacaactagcatcgacggcggagcccaattgtaccacatcattgtcaagctaaaacacagaagcggcctaaacagctctaacatcacagaagaggtgttatcgttgccgagctggccgcccaagcgacccagcagcgccgacttcacaaccgcagcgacactggagccgcgaaagtcaccagagcgaaaagcagctccgacatctaacaatggacatcagccaagccaccaaagagccacttccttcacacggccagcaccaaactccttggaagagactgcaacttgtcatcgtcgccaagcatcgccgcaccccatcagcgagcagctccgacttcatcagcagaagcaaccgaagagcgtgtcgcccaccacaataacgaagcggacccaaggaggcgaaggcctcgccgaacgccaaggtatgaaagtttttgaaccgaaaaagaccctccacggtcatcgatgcataggaactcctccgaagcgacgcccccaagaaggacacgacgcgtaacgtcgccgcctctcgtccgaaatcggaacaaggttttcacctggagatttgtgggaaatatgaaagaatgccatgacaatgcctccaaggaggtttacggtgcccatgagcgtcgtcgtcgttgaaccggccaaaggcacggcaaggctttcgccagcgtcttcacatcacgcacacaagcaccccacatcaacgaccatggaatagtccatgacgtctcacaagcagtcatacctcgacgtaaccaaacacgccaacgcatccacatccacacatcacgagcaggaggctcgccgccagcgagcaaccctgccggagcccgcctcgacttcgcgcagccgctgagcttgccagagccctcttgagccgtgcaacgccgccacacgcaaccgccgcccacgccacgcccgctcccggtctcctcctttccagccgcccaactccttccccgccttcatatgctgccgctaacgtcgacacgccgtctgtcgcacggcgccaccgtcgccagccaacaccaccacggccgccgccgtcagccgccgtggtccaccggtcatctccccgccaccatcaccagccgcggccgccagccgccaccatcaccggtcgctgccaccagccgccgcccgtgcagatccggccggggtggcgcggatccaggggacggagcacgcctcggtgccgggctggagcgagacgaccaggacgacgcggcggaggtccctgccgtggcgtcctggtcgcgccgcggtccaccaccgacgtcgagtcgtcgtggtccgccgccgacgttgccttcagtcgccgaggtccgccgccgtcgtcggcaccgtcaccgtcaatccccccgccggccacccccctccagatccggccggatgtggcgtggatctggccgccaccgccgccgccccggacagctcccccagccgccgagcgtggggtgggcgaggcgagaccccgccgccgccgtccttgcggctgcgcggctttgccggcacccgctcgggcggcggcgaggtggaggagggggcggtgggaggaggaaagcggcggcgcgcgcgtcgcgccgcgagctgcccgggggagggcgacgcgagggcctatctccctaataagctgttcgccgtacgatttatagctggtaggaatcaaaatcatggtctcctatcagctgaatgcactccactttgttctttgtttgctgaaccataagtcaaacaccatttgtttaagattttgacagttcttgctctttggagagctgaaatttatgtgtaaggggagagtttgtgtctagttgacctatatatactccctacatccataatttacaattgtttggccttaatccgaaattgatgtactagttatctcataatcaactctaattctattttctatacgccttgccccccaataaacattccactcaccactgtggaaaaatctaatctaattgttgtattcatgttttctctaatctattacattgatcctcttatggggtatatatagaagtacataagggatagagagtaccccctccattccaaattgatctacatatagttttttgaggttattgctaaatgatctacatatttgtgttcattcatgaagtatattcgttatttgtgcattggagtaaatggatattgatgcatgcatccatgcacataagtatttataacccacatgcaatatcttggtttgctattggctaggaaatagtggggatggtgcatgcatagagtttgttgctagagtaaatatagtatgagagagttattagctttttttggttttggtgtacctatgaaatatgtagatcaatttagaatggagggagtacaatacaagtaagagtcgatttatctctagaattctatctctaggactctatcttatatctaggattctatctctagaatatatcttatctctataatttgtatttgactcttatctttaaccgtcatatttatacttctaacaacgatcacctcttgtttaatgagacatcctagtttttttctttatccttgatccctcaaaaaggacaaaatctcttcttatattacaggaaagaggggagtaatatatggtaaaactcatcggaacgcttgagtagcgcgtgcgcacggtggttattatatcctactcctgatccgtcccagaatatagcaacctaaaaccgtataggacatatactagtactatgaatctagacagagagatatccagattcatagtactatgatacatcccatccggtcctagattgctatattttgggacggaatgagtatattctgggacggaaggagtataacgttagcagtttgatcctatcggatgctaccattagaaaattgtcttgagccaaatattataattcttttgaattaatttaataaattgttttgcaatttcaaatatttttaactgattttctgtaatttctctcaaattctgaaatttcagaaatcttaatttccagcccccatctgactgtttttatcatttccttccgcaacatctcgtgtgaacatagcacatactctactacgatgacacattacacatatatgttactgaatttaatttgctaattcagcagttccatctatgatgtcatcgtttagcacttaatttcccacatgaaggatcacgctaattaaattgaagattagtagtgcgcagctaggctgtaggaccacacactaattagtagtacgtgtgcatgcactccctagaaaaactgcacacggtaaccacacatataaactatgcatataagcttcctaagtagggatgtaaacggtatgaaaacttttcggattccggacctattttaaaaaacagaatacgtcggttggaacttttcggaaatggaaacgaattcggaaatattttctcggaaacgaaatcgaaaatgataagggcagtttctgtcggaactcgaaatcggtcggaaaactttcctgaaactttctcagaatttctagaaattttgtgactgaaataccctggattcttttttcttaagcactgaatagtgaataccatggtgattggttgttattttttaaaaaatatttgttatgcaaatctaaaattacataagaatattttttttcatgcattgggatttatcaacagcattactctcttaaacatagataatttattccatagattgtgttttgtaatgtacgattggtacttaacaattggatttatataattgtgttttacgatgaattgttgaccgttgagacttgagaattggatttatcactttaagagattttttattccgataaatttttgttaccgtatttgcgccgattcatttttgctccgttttcggtttcgataatattcgattctgttttcgtatccggggttttcgattccgaaaataatatgaaaacgaaaacgataaagatggtttacgtctgtttccgtaccgttttcacccctattcctatgtataccttgtacctaccaattaacaaatatcccagaaaattctaaaactaatctgacatgtactcttaaatagtattacacgtatctacaaattcgtatatttaaattcattatatttttgccgtcaaaaaaaagaaaaatctaacggttttaagagtgaaaatctatcagaattttatcttttttttcgtctaaaatatattgagtttgaatatgacatttcacatataggtataatactactgaaaatattatctatttttttcttgaatttttccttaaatttattagttgatgtgtatgaaacatgcacgagaaacttgtgtcatgttccatgtatataagacttatggattgcaatctaggtttgtttaatttaataattatcacttagcaaagaaagatgtcatgtcatcacaatcaccagggcatcaaaaggttggtaggttttaatttacaacaaaactaacagaataaaatatatgttttgggggaaagtcatatatatgaatgcattcagaagcgagcatgcaaggttgtgatttgtgtttagcgataaaagtgttcatgaaatttttcgaatgttcgattgtccttttctatataaactaggaagtagcctgtgcattcgtacgggcatgcatcgtagactatgtttgagaacttataatgatgaaatattaatctgaacttataaaagatcattttatttatttggattatttgagcatatttagaaaaaaaaattaagtaattggactattttctctaattaaaggaactcaatgttttatgtagtggctcagactattcatattttagttagttattttttttacgaagtgtacgtttaatttagctatacatgtttcaaaacatagcatggtgcgactctatgttgttgagttatttctttttcttttggcaaattaaatatgaaaattttattctggtactatattgatttaatttagctatgcatgtttgtagaatttttcataatgacataatatttattgtcaaaattttaaggtatttagatgtggtgcaaagtgcatgggtggactgtgcccaaatgctataattcttatacagtaaaatataggcatatataaatattacattgttagtttaattaatagatagagaataattagatagaaatcagacatgtataggttataaaaaattgtagttgtttcaacattgattgtttatcgtctagattagtagctacaaaaataaggaatgggagggcagtgttctctacatgtggaggaggtggaaggattttagtgaaaaccaatgagagatgtttcttttttctcagcatttcttttattgtttttatagctggtaagacatgacacgtgttgtcttatgtttttttttcccaaaaaatagatgacatgtgtacttatggttctttcaaaaatagatctaattgatgaaaataatgaaatccatcgagttaagttggatcgttttctattttttgagacatgatacatggttacttacaagtgcaatatgggacgtttaatcaaattttatcaagtagactgatttaatataacataatgcatatagtcaaccttttcgaaatgtctcattcctatttggtttccatgcaaaacataggtgccaatgttcaaaagaatttaaatttataataaaaatatggataatatggaacttgaattatttatttagttataaataaaacaacaattgaaactaactaaaaataagatacaacttttaaaattataatcattaatctttctaattattgttttttcacataatgttgtccattgaaaaaaagagaggatgtgaagggagagaagcagagataatgtacgtatggagacgtcacttgaacacatacatgacgtgtgaaggggtaggaagtgggtcttttccgtttttatattgttaagatagcagtagaaaataataggtacaccgtgtttaaattaaaataattgatggttaggtgtattatgtaatttctttaggatttctaggatttattgtatactactggagaaacaatctttggtcggtcgccaagaaaccacaataatcctagttcgaatagaaatcgggactaaagattatttttagtcccggttaaaaactttttgatctttagtccccagttgatgttaccaatcgggactaaagatcatttttagtcccggttcaaagaagttattgggtcgagttaggccccaattatcttagatctttagttccggttctttatatcaaccgggaccaaaaatactcccgagcgcacgtcgagtcctctcttatcaataagaccgataaaaaccatttgcacttcctctctcattataaaccatctccactctccagcctcctcgatcccatctcaatctcaggcgttctccttctcgatcggcctcctttgtccgatccccctctcctctccccttcctcccacttcccctctcctccccctccccgcctcctcctcctaccacggcctctctgggtcagcggcggccggtcgaggtcggcagcggtggcggccggctggccgggctggggaggcgcgcacggcggccttcggaattgattttctttttttgaggaattgtgatgattgtttttgataatttgttatgtgattaaatgtgggaaaaaaatcaattacacagtttgcgtgtaaattgcgagataaatcttttaagcctaattgtgccattttttgacaatgtggtactacagtaaacatttgctaataatggattaattaggattaataaattcgtctcgcagtttcctagcggaatctataatttgttttgttattagacaacgtttaatacttcaaatgtgtgtccatatatccgatgtgacaccccaaaacaaatttttttgggaattaaacctggccttagtagagttctttgtggaggttcagtcttttatctttatgaatttataatcggatgaattcatattgttttaatttacttaatactatcgttctaatttatttgtgatggtttttcaaaatttgtgatgtaattttttttagaatttatgatgaatttgatttggggatttatctgttaggggatgtaatgattagtgaaatccatatgaaaaaaaaattaaaaaaactgccaaccgccggttctagctctagcatttttagtctcaattagtaacaccaaccgtgagtatagggggttacaaaccgggaggaaagaccatttctccaccagtggtagtgtcacatggtggcttaggtgtgttcgtaggagtcccgcgtggtggtttcagagtattttgtgggaattttagttgacttttagcatataatagatagatatggcgcaagttgtcgaaatgtgcctaatatatatctacatgtttctttagggaatatatttctacaagtaaaattataccggtgtaaactacatttttctgacattgtagaactattttagttacatgccagtgaagttattatatagcatgaaacaatataataatggtcactttcttttcataatttttacaagctaaattatagttaagaggtgtattaaattctaatttgtgattttagtcataataatgacacaatagaacatgtaatttcatccgatagcaaaaaaaaaaaacttccttaaaagaaaaacggagaggagttatgtacatgcatatgcacgggaagaggggatgcctctttgtaagaaatagaaaaatcaatctaatccaagtatccaacggcttggagtgatgggcctattaatattaattttagtgaaatcaaaagctgggtttttttttcagatttttcctaatttattggagcgccacgtggcattataggagcatttatataagcatcatgtgacagcttagaagcatttataaaatttttcacggactttactatataatagatagattgaatattatcgatataatttagtgaaacatatttgtagaattatttaaggtgacatataatataccaaccggagatgaggggagagagggagtatgtacgtacagaaggccaggaggggaacatacttgtggtggggaccggtgtggagaggaggattttatttattttatttgatctaatggttaaaaatgttagacccaccaatttaaaagaaaatcaacggttagatttttagactgccacttggcgtcttagaagcatttgtaggagaacacgtggcggcttaggagcgtttttaagaagtttaatggacttttagtatataatagatagataaatggtactgtttaagaacttttagctatctgtaaaatttaaatgttctattctttttagcatcgttttgatatcaatataaaacacgaatattagaaaatgatctaatatcatattgtattatttcgttaaatatgatcgatcgccgatcgaccgaggatcgttgaggctaccgattctgacagtcttcatctctagttgtggtgtccaaatttgcatctgtattttgcatatcccagctgctcgatctcctagcccaaatcaaaataatcaaaacaaacagatggtgttaatcgcttgtcaatttttgcggtgcggatgagtcggatgatcccgacgtctcgtcgtcccctgacgacagccagtcgtccgggccggcagtgacagcttatagctctttcaacgcctcatggacctaatgaaaaaaaagctgatgatgaggtaaaaggcgacctatccttttcgtttcgataaagaatgatagctttcagcctgatccagatgtgtcactgaactaggcgttgttaattgtgaatttatgtgggtgatgcaggttttactattaaagaatatgatgatactgtgaagtcacgttcagcttctgatcatccactcgcaatatagtactatataatatgagaacgggaaattagcttagctcgggaaatggagcgacgtgtggtgcctgcgtgcgtgcgtgcagtggactggtcggtgacgatgttgactgaagaaaatctcagagacgatggagttgaaaattacctctagctcatgcctgcggttttttcagccgcacctgcatgccgctttcattgtcacacttgcgagcgtggagataggccggtaagaaataacagcacgaagaaaaattgccatatatgagtgtggtataagtaggtggctagctgaaaatatacaacgttcagtcaatgcccacgttaaatacttttgaacggagaaattatatcttaggctctgttccttaagattattcacactgattatttgttttatgttttgaaaatatgttttccaaatgatctttcttctactatatcgcttaattagaccactcattttaaactatttgtatgaagtatatatttttaaaaatatttgatttattcctatagtcaagtagataatccattacaataatttgaaaagaaatggcccttaatatatcttaaatgtattaaaaaaatagacctatccaaggcatgaccttaaatacctagtcttgtttgtgaatgcattgcagagccagaaaaatatcgagagcttaggctaatctaagcatatgcatggacatggacatatgcatattcagatttgtaccaggattggattttttttttacatgttagatggagtcacatgcaaaagagtatatagagttcaagcatgtaaaatttcttgatccgtgctttaacctcatgatactgcgaatcaactactcctatgaagttagcggacgttgacaattgagtgtcccgaggcagtctatgtcagaatgtcagatgattgtagtgtaccgactcaggggctcagggcgatatcactgacagacagcaacaaagcagccactgttttctgctgttaaatcgtaaccaccggctggcgtctgcatttcagatcgatttctgtcatcgcactcaagcaaaagccatttttgcagcgtcggattcgatgttagtgtttcacgggaaggcgtacggtacttctttttgggacagtaaacatcggcatttgcagcagtgttacgggtacgtcctgattcctgatggctaactggcctttttcgtcagtaatcgcaggagtcaccaacataatgatggtgcacaccatacgtaccagtttaccatgggaatgtgggagtcgcatccaaagtatttccccattattttgaagttgtttggcggaaatcaaggttgggaagaaaagattttcctgtgtataccctaattaaatgatcaatggattaagataggagaatagttgagattaagatagaaagaaatttgaacgaaaaataattggtagaataaggagttatttgaatgcttatattggtggataaattttaatcccttaacttatattgatgaacatatgaagtagtttgacatattagtttcagagggattttatgggtgtgtttagttcacgctaaaattggaagtttgattaaaattgaaacaatgtgacggaaaagttaaaagtttatgtgtataggaaagttttgatgtgaccgaaaagttagtagtttaaagaaaaagttggaaactaaaccagccctatgtagcatgaacgaatcgaaacggcaacctgcagatgtctcattttgattttaaggaaaagctaccggcaggcacatccatgactgaatattggttcagactgaattcagtagtgcagatcattggcattatactaggagtaccaatttagcaacttgcaataccttgaagaaacaggacaatctgcagatgtcaaagataaaattgatctgtattccgcggagttgatgctctggaaaggttcagtgaaatgccaatccaacttgttagaatgtagattatcaccagaaaattagttcaggttaagtcagtcaatttgctttatttctgcagtcttgctttaacctttaggatggtaagtaataataagtacggatcgaagacactatggttggcagctcaagtatcctctggaaactaaaagagtaaaaaaaagttaggtgcagatggaagcacgcaatattcttagctgcaagatttgcaattaaaattcaaaatcagtctatactctttagaagcacattaattcctctttgtttaaaaaatagagaagtgtgctttcagaaggaatcgagatggcaacgtactctgcatttctggaacctgcagaatgatctggtaaactggttctagatattggttacacattaaattcagtagcgcagatcattgattcatctagccattgagataaggggctccctacttatatattaggtcatttgcccttccacaaccaatgtgggactattcaacacatccggcccaggtggcgttggccgaggcccaataaattaaggttgattcatcattcatgggcattgatatatccggcctaggtggcgttggccgaagcccaataaattaaggttgtccggaccccaacagttcttaggcacacccactcgggaaaatgaccaatctccctaaaatacagtccaatagaggaatggtggctctcccttttaaggtggcttaatcctcccaagctaagcaaggtgggattattcagaggctcacacggtcgccgcccaactacaactggaccacttggccccttattgcgtctttgccagcggttaatagtggaggatatcctcatcaggcatagtacttcttcagataataatgacaatttgcagatgccaaatatacaattatcttatctgtattccacacagttgagatgctctacaaaacttcagtgcaatatcaaagaatgttggcatgcagattattattagggtaagtttatcatcattgagaagatacctagagatatcatattttctagtgtaaaatttgatacttctatatactaattcccaaaagtaccaaaatttaagtatctgaaggtactttcttaatgaccataaaattcctcttattattaactcttatgaacagaatatgagttcataacttcaggttaagtgggttattttgcttcgtttcagcttgaaaccttcgatgtgttgacgtttttttacagagtttactcagagaactcggaacatggtgaatcaattaaggcccggtttagctgtttagttcaggaaaagaaaatttttgggtgtcacatcggacgtttgaccggatatcggaatgggttttcggacacgaacgaaaaaactaatttcataactcgccttgaaaccgtgagatgaatttattaagcctaactaatccgtcattagcacatgtgggttactgtaatacttatggataatctaatcatgaactaattaggtttaaaagattcatctcgcgattttcatgcaaactgtacaattagttttttattttatctatatttaatgctttatacatgtgtccaaaggtttaatgtgattttttggaaaaaaaaatatgggaactaaccaagccctaaaccaaggtagagtatactgcaatatgtacagtaaattaacgcattcaggtttcttgccgccagtaagtcaaagtatgataactccatcgatcaagaaagacgacgtgggttagccacataaaatccaagcagaaccgtgtattagtacatgtcttcaattgtccattgaaacaaaaaagagtgaagtagcacagtaacatgaatcatgcgaattccgaaagggtaaaggaataatacctcagatatcatataaaaaatgggcgatggaaagtacaagctaacacacatactagtatttcttagcgggagctgcaagcctgtaagtgatttctgcactataggaagttatgcttcggtttacaatattcaggattatacagctatctcagcagcacagtaccatcaaactctccctatcagccactcacttcattgtaaacatgatagaggactaaattaaatacgcataaaaattaaattcagcagtgaagatcataagcactataacatgattaacacgttagtaacttagcagggtagcagtcataaagaaacagaataatctgcagaacaaagaagcatgaactgaaatgcaaatctgttgacacgtgtataggaaactaactgaacggcaattcatcatcttcagaatttcttcactgaattaaggaatccttcatcagcttacaccagcaagaaacagtttctacacgagatcaccatcgaactcagcgagaagcttgaaagaaacaagcaacacacagaactgatgaaggcatcaagcacattgatctctaactaatcacctgatctggtgcccaaacttgccgcctcacttaagggagaatcctcaatggttggtagctcaagtatcatctggacaaaggaaaaggataggtgctagatcaaagcacacaatgttcttaggtgcaagtgattgttttctgcggagggactctagaagagtgactctagacagtgcgttgcggcttgcgttgtgctgggccggtgatctccaagacaggcctatctgaaatctcatagcaggccaagatgggcttcttttgaagcgagaaagatccatcggagcattttgggctggatttcttcaggtccattaatctgttccaagccaattgcacacaacacatggtgacatggagcagtgtagctgggttcgttttgagcttttttttttttactttttaaatttttaattctaaaaacaaactctccaaaaacttagtttcaagtacgaatctttttgtcatgccagtcgaactgactacagtgacgaaatgaagcttccatgctgacgccctcttgggggtgtgtattgttgtttaacacgcttggcggggtggcatggtcaaaacgtttatgaggatttatttttaaattaaaagtaaaataataataaacattatcgttggaatgttttagtagggctctaggtcctatattctggtcttatatagcaggccggtgcttaagcaaatggcagtccatttagaacattttgaagaccatctcatattcattgcaaaaattaaattcaggagtgcaataaccgcactgcccatcaatccatacgaaattattcataagcctctgatccactatcctggctgatcaatagagccatgcccactcacccacacgctttttattttttctatctttttaataatggaatgaaacatcttggcttttgctcaagagctatagccaattattacaaggttcacacaaaaacaaactcacacagtgagtatgtagccagtagccaaagtaacaaaaccaaaagtagaagcaaactaataagaatcaaacaaggtaaagacctcataactactgaattctattgatgaatctccacttgaagttggcaaagagcttcatgatcgtcgactcaaatatacgacacgcatcttttattagcttgatatgatcatcatgtctttgtaactgagcccattcctagagccaatatgttatcctgaaaagtgcctacaaataaaattttgaaggtgatctatcaaaaatcatttcatttcactaagccagagagcccaacatacagttgaagctccaacaaaaataagttccttgatctttttattttttccatttagccactcctcccccaccgctagctattcttctccgccgaccttctcaatgtaggatctgaaacaccaagcaactgacgaagtggatgaacaacatgttacccacgtaggacaccttttatctcgccaccgcaaaaccacaatatgcggaagataacaatcgaaccatcaatgtcagttgaaagcaaacaggatcttcataggatcatcctctttcccttttatgtgatcgtgccaaatcataggaagaatgggtagctagaccctcacatagttctagctaaagctaatttttattcataatattgagtctcccttacaatggacgcacacctattgcttatatataacaatcctaagacctacaaacaagaaacaaactcgttagatgacttggacacgaagaaaaaaaaacttttgttgcagcaaccctatgctagtttggtagattaccgataaaccatgaagaatgtgaaggtgggaccaaaccttgacatgagtcataaaattagctttccaacaagtaatcaaatgtccaaaatagagtccgtatgtgaaatccacgactgtttcatcataggcttgtccaggctgttcgaaccgaatagaaaccttcttattgtaatatcaaggagttgatttatattttgtgtgatgaaaacattggtggttttcgatatatcatgtgtgaaagattggtttcttatgataagatttcagagtttaatagatgattgattttgtgaagtgatgtttctgttgaccccgggtgtcgcccgtcagaccgtatgtcatgcagccgtcagactagccaacccaatggtatgaccggcaggatcctgatcattattggtttcgggttatcttgttggatttggatgttttcttcgaggatttgacttctagatggtttatatacgtatggatactattgttatactaatgtgagtcaagttgggataaacttgtgctcggaatatggtttcttggttgtttgcatgtgcagatgttgcttacggcctcgggagagtgttgccggtgatagatcggagttgacttgggagaagttgatgtctagggatcaggagatcatgtgggatactaaaaggatagagaacaatgcacgtggtgatgaagaatccatatggtatgcaagagggattgtgtatgtatggaaagaggagtcaaatttggaagggagtccaaattctagaagattgatagagataaggaaagggataagttgtatacttgcaatagagggtttcccacatggttaggagtcctaagttgtgtttgctttgtaggctttgcacagcctacctcgtgtataaatagaaagggaaggtgtggcctcccggtatcggttgttgagagacttaagttgagagaaagttagggtttcgagtttagttcgagattttggtgaggaatgctgttggtgcactttgtaaacactagttgatgccaaaaagtcgaaagtttcaatcttcatcttcgaatttgtcatctgtcagtgctttttgggtcctgacggtctatccgcatgtgttcgggtggtctaaccggtgggatagcggcgatctgaccgcacgtgttcgggtggtctaaccggtggcaggtgggcggttcgaccgacgacaatagtgcttcgtcatctactctattcgaggtaaatcttttattccgcaaaaaggttttgggttttaggttttccctaccattcaccctccccccctctggtagatttgtttgatcttatgtgatccttcaattatcttcgaatttctcatttggaaacaattcaatccgtgcagatgagataattgttgacttatggattatggatagtgttggaatagacgaaaactatctaatcataccgtagaatccacaaactctccaaacagagcaattatgtcgtgtcacttttacaacatgggcaaccttcagtaaaattgccactacttttgattggaacatccaaatcatatgactttgatctgttagaaagacgaattgaaaacctatctaaatatgaccttttgatactttgaattcctataatttgatgcacaaatcttcagacaattgacggctagtactgcaccatatcctcatcaacctcccctcctcctcccaatggcatggaaaggttcgatttatttgctgcgaattcagggcctgatgatcttgtggcggtaagctcttggccaccaaatctggcttgtccatgtgattctggcacaagaccatggcaacggtaatgattatgacttcatccgatgcccaaattcgtccactccaaggtgagtgctagcataggtggtgatgggcacgataggcaatggaggcctatagtgatattcccttcgtcccacaataagttaatctagtaatggatgtgacacattctaattttactaatctggataggagcctatccagattcatagtactaggacatgtcacatccaatactagattaacttattattggacggaagtagtactttgtgatggtgatggaagtatgagatctatcaaatgaatggttgacgactcggcataggtgactcatgccggttgggaaccggcgataggtggcggatttcccaaccagtaccctgcaagcaacacctttgaggttcttggaatgcaaaaataaagccggctccccatcaccactgagatcaccgtcatgcccatcacccaagaacatgatcacaaaatcaaccttgaaaaacaaaatttgagagggatgatcaaaatcaacaaaatcacatagcgaagaacacacatagaatgccacctttgccgatgttgccttcgtcgagagggccatccctgtggttgcgatggcggatccacccacccccgagcttgcggcggcgtatccgtccaccaccaaggggtgggcgcaaggcggcagttctgcccacccccgagtgcacggcggtgaatacggcagctcctatgctcgtggagtagatctagccagcctcaagagagaaatgaagcgatgtaggcgaggatttctatcggtggctgtggcaaagaggagacaccgtgagcgaagacgaccgtaagtggttacggctgcatcggtggagaggaggagacgtcatgggcgaaatggaccggtggtggctgcggtggaggagaggaggaggaacaatggtgggggcgaacgatgatgatgggcgaggaagagctagccaccgcccgtgcccgagaggtggccggccatcgtccgtgctagagaggtctccgagacaggagatgaggagtggagagagcagataaggatggggagagcagcggtctcttctactaagtggaaacggtgaccgtaaaaaaaaccggtctcacccatggccggtcttggctcgctctagtaggtgtcgtctttttttaaaaccagcaccaataacactattataagtaccgatttattaaaaaaaggtacaaataattattagtgctggtttaataagaattaatggtgccggttttcaatttcagacgtcccatgaatggaaagggatcatgagtgccaattttagataaatcggtacctttagtgcgtatcacggccggttaattgatcggctttgaaggtgcttgggcataactgcttcccctttcaatgattcggttcgtgggctccaaatccggcgttggttgcagtttgcaactcgggtatgcgcgcagtagcaaacgaatcacgaaatgttcgtaaagccctgacgactgccactggtggagatgtgctttttagtcccggtttgtaaacccctgtagtcctgttttttaaaccgggactaccaatccgggactaaatatcgctatctttagtcccggttcaaatacctaggactaaagatcgatctttagtcccggttggtatcaaccgggactaaagagaggggatctttagtctcggttgctaacaccaaccgggactaaaaagagggaagcggcagtgagatggtccccttttcttttttttcttttttattttctcccgaatcgagtgggatatatatcccaaatcaaacccaaatccccaaatcaaagtaacatctcaaatctacatcacaaatcttaaagttacttatacacacaaatcaaatacatcacaaatcctacaaaaattacaaacatatcaaatacatcacagatccatacaaacgtgcaatgaatcacaaaattatccacacaaatatgcaaatgggctgccgctgccgccggccgcctgccagccgccgccgggcgtggccccaccggccgccgccgcacggccgcctcgctccgccgctgccgcacggccgcgcggccgcctcgctccg

SEQ ID NO: 74022 - DNA, 4713 bp, Oryza sativa
cggttggcggaattgtatatggcaaggattgtgtgtttgcatggcgtccctaagaaaatagtgtctgatcgaggtagtcagtttacttcaaagttttggaagaagcttcaggaagagatgggttctaagctgaactttagtactgcttatcatccgcagacagacggacaaaccgaaagggtaaatcagattttggaagacatgttgagagcttgtgctttagacttcggtggaagttgggataagaatttgccttacgccgaattctcgtacaacaacagttatcaagctagtctccaaatggctccttatgaagcactgtatggtcggaagtgccgcactccgcttttgtgggatcaaatgggagaacgtcaggttttcgggacggatatcctgagggaagcagaagaaaaggtgaaaatcattcaagaaagattgcgtgtggcccagtctcgtcataagagttatgccgacaatcgtcgtagagatataagtttgaagaaggagatcatgtgtaccttcgtgtcacgcctcttcgaggagttcatcgtttccacaccaaaggaaaattggcaccgcgtttcgtgggaccttacaagattgtcagtagaagaggagaggtcgcttgtcagttggagttacctcaatctttggcaggagtccataatgtgttctatgtatcgcaattgaaaaagtgtttaagggtacctaccgaagaagctaatcttgaacagatagaagtccaagaggatctgacctatgttgagaaaccaatccgtatcttggaaatagatgagagaagaaccagaaatcgagttatccgtttttgcaaagtccaatggagtaatcactcggaagaagaatcaacttgggaacgagaagatgaattaaagtcagctcatccgcatctgttcgccagttcttccgaatctcgaggacgagattctgtttaaggggggtaggtttgtcataccctaaaaatcccaaatatataaattgttgtctaaattggaaatattataatttattttaaaagcctagaagagaagatctagttttaattaataaattccaatataaaatggggccagataaaatttcattaaatactttgcttaattctataatacctaaatttttctgggatttatttgagctaaggaagtatttttaataaatggaattgcatttaatggataatttaaattgaaaaaggtttttaaaatcctcttttggctttgggccgaaagtcggcccaaaaccttctctcttctccccggcacaagccggcccagtccgccgcagcagccgcgtgcgagcgccctcggacgctgacaggtggggcccgcctgtcaggccgtcgtctacctccggccgcgcgccgcccgagccctagcgccgcgccgccgccgtctccttccaaattcggccgcccctttccttttccggtgaaatcaatagaggggaaatgatcttcgggatctcctctaccttttctcttttggaatcgtcggctaaaatcgtttggaaatctgtggattcgagtttgattcggatcgatctctctcctccaaaccctagactttccttcacatcgccggtcgccgtgggccttcgccgccacctccttgcccctataaaaggacccccggtgtctccgctacccgccgccaccctcgcctttaccagccgccgccgtctgtagcgccctagcaccatgcagccgtgcgccgccgtcgccgccgctccagctgtgcgccaccgtcgctccggtcatcgtcgctgctcggggaggtcaccgtcgtggtaaccaagccatcgccgatctcgtccgcccctccgccgtcgctgtcgaccgccggaacaccgtcgccgtcgtcaagccgaaggtcgcccccgcttcttcctcgacgccgtcaccgtccgttgatcttccgccgttgttttggtcaccggtgagttcgccgcgttgccctctacgtgttggttccctccgttcgcgctgtcgtgtcgtcgttcgccggagagcatgcactcccgagccgccgccggtggtgacgccaccgctgacgtcatcgtcatcgttccccgtggcccggtcatggaccgatggatcttggccgtccgttttggatgaatcgatctcggccgttcgtttccgtgagccgccgccgtgctcccggttcaccgcgaaccctagctactgacgcaataattcccttttccttttcaaaaataattcattattgcgtcataattcaattaaaatccatataagtgttttaatccgatttaatctttaaaaattcataactaattcatcttagctcggatttagttggttcaagtctctaaaattttctaaaattgagatctacatgttaaaaatatccacatatactgttcatgcttgtttatgtgctgtttggtgattttgcccctttctgtttagattccgacgttttcagagagtctgttttcgcaggagaagaatttgaagagttccaaggccagcaaggcaagtcacacagatcccaaacaaccctttgagcatgttgatcccgtttaaagctattgtttctattcaactattgcatttattttcaaatgtcattgggtggaattaacctattgtttgttatagcccttttgttcttgattattttattccttgataccttgggttattataacttcactagttgggctttatatattggttcagctagatattagatataattgcttagccatgcttagaaacattagcacactattgggataacttatgactcactattatttaatgatggtttaattatagctcacgatggctaatcatgattggttaattaattaatttgccaactaaaacttgataatggtgggttgtgagcacatggttttgattgtcgtgctcatgacgattaaggaccggttcacgagtttcggttgtgaaacattaaccgtgccaaccacaagccagcgtgggcaacggctttaccttttgtatagcatggttcattgcggagcaccagactgagaagtggcggagataagcccacgggggtcgctggggagtccatgccttgtttataagggggtgattatgatccaggaatggtgcgctgtggtggattgtgttgtgcaaggggtactgtcacagctcctttctgaggtaccatggtggtattgaggcgcatggtgacatgtcgtggggctgtgtcttatgggtacagtggtacacctctggccagagtaaaactattcaaatagccgtgcccgtggtcatgggtgggtctaacaatgtctttcgtgattagttttacacttctcaccataataaaagatgctataactggtaataatttgattagctcctggtttggaatggtatattcctggtttggagatagaactgtgcagccgggatggttgttcagaatggctgggcctatgcaaaagggtatgttgtatagcgttggattaatattgtttaattattacttaactgttttattaaattctgaaatgtttattaaatgttgtttatgcaaatgaaaccctactatgccatcctttgttatcctgtgcacttgcatatttgctgcgtggcttgctgagtatgtcatatactcaacttgcaatcattcatcagaggaggagttctacggtgatgctgatggtgtggaggattaggtgtagccctggtcaagctgcctgtggagtggagtcgtctgcgccgtttatcttattttttttccgctgcttagatctttattgattgagaggaactacctacctctgtaatgacattttattcgcttattaattagagtaataattgtactctattatcaatttgttattgtgtgcctcggctgattcctggacgagggttcacacacatgtaagcgtttggaattttggatagaaattctgggcgtgacaagtccgaatcaactgtgaccgggatcggcagaatccgagttggacaaggttagccaattgagccgagtccaacaatgcgacgcagtacacgttgtcgagttgagttaatgtgcttcatgaggattgtcatgcatggattgagtcctgagaaggcaattgtatctattaattaggatattttatgtaatttccttagagatatgtttgggcaaaattctgccgcaaagacttatggtatcttagagtttgttaaagataagagtcgtgtccgacatggacatattttgtaatctcgggtataaatagacctcgagccccatgtaatacaacaacacacgttcaatacaatctcggcgcatcgccacccttttactttcgttttgtttcgacgagctcttgctttcgggttgagctgcatcggtttcaatcttcaactagaggtaaaacttcttatggcggcttgcgttctcgggattagtgctttcatctttatgatactctaatcttgtttatgtaatttgtcgagttatcatatattctatataatctttggcaatattgttatctaacctccagtcggctaacatctgttgctagaaggcagccgattaggttaaataccaacgttgacttagattatataggatatctaccaccctatgaaacaatcagcggcttgattgtctagatattgtccttcttttcatacttatagctgcatcagttgagtttgatcttataaatcatgcttagaatctcaat

SEQ ID NO: 74023 - DNA, 8412 bp, Oryza sativa
tgttcatcagaggttgggcctagtgaacgaagatcgtgatcaagaagacgatgaggacagaaaaactcaatggtgtccttatggtatttttacaaagaatcagaagagaagggtcaaaaggttgaggaatagagaatgttttcgtggggtagagccaagagatcaaccatcggctgaagaaagcaaagcccaggcaagaatggcgtgttaaaaggcaggatccaacagccgatgaggctaaagccaatgaagcaaagaggctggccaaaggaaagagtgtcgtgactgcatcggttaacatggtttttacactgcctgcggaatttggagctaaacaagccgatgttgatgaagttgaggaagcttcggctaaattggttttgtcaccagagcaagcagtttttgaaaagccagaagggacagagaatcggcatctcaaaccattgtacattaacggttatgtcaatgggaagccgatgtctaaaatgatggttgatggtggggccgctgtgaatttgatgccatatactacgttcaggaagttgggcagaagtgctgaagatctcatcaagacaaatatggttctcaaagactttggtggcaatccatcggaaacaaaaggagttttgaatgtggaactaacaatcggcagcaaaaccgtccctacaacattctttgtcatcgatgggaagggttcctatagcttgttgcttggaagggattggattcatgccaattgttgtattccttcgaccatgcatcaatgcttgattcaatggcaaggcgacaagattgaaatcgtgccagccgacaggtcagttaacaatgctaatgtcgatttagctctttgggagatggacggtattgattgcttgtctggaaaggtttgggatggagattttctaaaagtgtccgattgtgatatacatccaattgaagacggagagcccaaattattgttttgagggcgtcgtggagggttcaagcgtctacaccaaggatacagtagatgatctcgatgacaagcaaggacaaggtttcatgtcggctgacgatctgaaagaaattgatataggtcctggtgatcgacctaggccgacatttatcagtaagaatttatctcctagattcagaaccaagttgatagagcttttaaaagaatatagagattgcttcgcttgggagtattatgagatgccaggactaagccgatcgattgttgaacatcggcttcctataaaaccgggggctagaccttaccagcagccaccgaggagaagcaaagccaatatgctcgaaccagtcaaagctgaggttaaacatttatatgatgctggtgttattcgtccatgccgatatgctgagtgggtttcaaacatagttccagttatcaagaaaaatggcaaagctagggtgtgcattgattttcgagatctaaacaaagctaccccaaaggacgagtacccaatgccgattgctggtcaattggttgatgccacctcagggcataagatattgagttttatggatggtaatgctggttacaatcagatctttatggcagaagaagacatttataagacagcttttagatgtcctggtgcaatcggcttgtttgagtgggttgtaatgactttcggcttgaagagtgctggggctacatattaaagagccatgaattatatattccatgatctgatcggctggttggttgaagtttacattgatgatgtggtggtcaagtcaaaagaaatagaaaaccatatagccgatttgaggaaggttttcgagagaaccaggaaatatggcctgaagatgaatccgacaaagtgtgctttcagcgtatcggctggtcagtttttgggatttcttgttcatgaaagggggattgagataactcagaggagtgttaatgcaattaagaagattcaacctccggaggacaagacagagttgcaggagttgatcggcaagataaattttgttagaaggtatatatctaatttgtctggaagattagaacctgttacacctctgttgatattgaaagccgatcaagaatttacttggggggcagagcagcagaagactttggataatattaagaaatatcttagctctcctccagttttgatccctccacaaaaggggataccttttagattatatctgtcagctggtgagaagtcaatcggctcggtcttgattcaggagcttgaaagggaaagagagagttgtgttttatttgagccgtcgggttttggatgcagagacaaggtattctcctatggaaaagttgtgtttgtgcttatatttctcttgcacaaggttaaggcattatctattgtccaatgaatgcactgtgatatgtaaagccgatgtggttaagtatatgttaccggccccaattctaaaaggaagggttggaaagtggatatttgctttgatagaatttgatcttcggtattaatcaccgaaggcgattaaggggcaagctatagccgattttattgttgatcatcgtgatgactcaatcggctcggttgaaattgtgccatggactttgttctttgatggatcagtatgcactcatggctgtggtatcggcttggttataatttctcctcggggggcaagtttcgagtttgcctatactattaatgtaacatacccgaaattttaggacttaaaatttcttgtcaaaatagttagaggttaacttctccaaatttcgagagccaaaaatttccgttttaatttaggtgatgaccaacttaaaccattgcatgattaaaatttgagaacaaaataaaatcttttcattcccaacattagactagaaatgtcatcaagcatacatgtacataatgcatgcctaggctcgagttctttgtgcatttggagttttggtcttgcattccataataggtcccatgagcataatctaaaagaattatttcactaaacaaacctatagttaatcttgggtgataacatgtggacttaatattaaactcaaatatcatcttctcagtccaaaagaagtttaatgtaatccctataataatattagatgaaattatgaagtgggaacacatatacaaacaaaggtcatcctaattctctaaaatattttgtgcaagataaaatcatggaaaaatttatgtggacagtgattagcacaaacttatcctctgtaattttggtaacatgttaacactcaagttgaaatctcaaattaatcggtcgaagcagacaactaaaagaaatcaaattaaatttaatcggctaaaaccatatttcatccaaaagaacatttaactgcacataagtgaacatgggaaataatttattcaaatactagattagttatcatgaataaatataatttttctagaattttccttctctgtttaatcctcctaaaaattcaatccagctttctaatagcccatctttgtttaatttctgtgagcagtccacccattatttttgagtgcaaccaaagaaaatggaatctaggtgtaatcatttacctccagtaaaatcaacactaattaatttggtccacacattgaattatgtagttacaaagttagaggagaaaataattccgaaaattaatctaaaaatcaagtttacccagaatcttacccaaccctctcaccctagcctagtttgccacgacctggacccacctgacagcctcttaagcttgccttgactctgtccatcacttcctccactgttccagccgagagaggaagagattgagcgagccgacgcgtggccgcaacgtgtcgtcgatctcggtttcccttttctcgctctctactcctcccagacgcgccgccattctccattcatcactctggagctgaagaagcctagggaggaggttctctgcctctccatcgccccaaaccttgccgccggtcgtagtgacgacgaccttcgccatctccgtttgagtcaaggtcacctccatctctttcgcgttcccatctctccacacaatgccgagcatttcctcttttgacctaaacccctctcgtgcagtgcatcgccgggaacgcgaccacgccgacgacgccctggagcacgcaccggagcgtcgccgcttcaaccatcatcgtcgtccggccattctcatccacctcagagaaagccgctgcgccattgtcatcgcctcaacctcctcttcaaaacgcctcaagaaccccagccggaaacatcaagaacacggagaacacatccttttcttcaccggcgccaatctaggatcgcctccgccgtcatcgtcgattaccgctgcctcggtgagccattgttcgattcctggcacatacaccatctccttgacctcacaaccctcgtgcatgcttgctgaagcagctcattgtcccgttcgagccgtcgtcgttcacccgagaagaagccccgtcgtcgagccgtttccacaagtcaccgctgccgccaaagacctcgacaaccatagctcgacccacggtgagcatcctgaagtctagaagaccacatgcatgcatccttttcgttcgtaatcgacttccatgcgcacatgcactttcaccccaaaaccaccgccgctcacactcgccatcggcgctactccgatgtcctctaaccaagaaaactagaggaatggaaacgcgagagcttgctcttcattttatcttttgacctcaacctcaaacgagccaccgtttgccgccggcgagctccagatcgagctcagccatggctagctctgctatgtctagagcagagggatgacttccgtgaattagattaagtgcagggatccgtttacaattgtagaaacacactgacatatgggcctaggactgtgggttgattcctagaaacctcaagggcctttgtgcatattggtccctcacagccatgtggaccccatcctctaaaatctgaagaaaaattaggaaaatgcccaaacaattatatgtttagcagaaaaatgcacaaagttgtaaaatctatataaaatcaaatatagctcattttgaagtgattccagtttctgtagattcttgaagttatgaactttattccaggaatataaaacttgacactcactgtacaaataatgtctctaagatttatctaagataagtcatgcataaaacatgtacaaacttataaaatacatagaaaattcatttcaactcattttgaaacaaaatcaaattctacagattcatcattcatcatcatacagtctctgattaagtgaaataaaagtaattacttactttgcatcaaaagcctctaaaactattatctttaaaatgactagttttagataagctaaactttagaaattcatgtagaacccaatttagcttcaatttgaataaacttaagttatgtaggatcactaacatatgtatttccaagttatgaaataatattatatacttactgtgtagtaaaagtctctaaatattcatataaggatttactaacatagagcagcctttaatttgtaaaacttgtagaaaatttatttttagtccaaatgaaatgaacaaagtttctatagaaccagcaaatagttatcttcaacatagtaaaataaaatttgtcaccttttgtagagaacattgatcaaaaccttaacttagtgaaataagaatttaaacacatagtgttgtttaagtaatacataaacatgtataagtatatatatacactttaggtctaattaaacctaaataaaaacttgattgaccagtgaagccatagttccatttccatccactaaaattagaagaacttagctcatataacaatttctaggttaatataatatattgctagtttagattaaagcatctctactttataaaatatgaaccatactagtaaagatcataaacatgtgaactaaaaatgttttagttaaccaaattattccttttattcaacttaaacaggaagtagcatgttctgaacctatcactcaaaagtcatgcacatataaaacactatatgcctaaaacacgttgtaacttgtaaaatctataagaaaatcattataactccaaaaaaattgtgaaaccaaatgtgttagtcttagaaaacacatctccacacccctgtgaagtctaatctaataaaaatcactttacaaaagtacttcataacactacctaagactatactactataaaccgataaaacttctaaaaattcataactccctaatggaataagataaaataaaaattctttcacctaaattcattttagatcagtaccaacccactgtgcataaatcatgcattttagagcattttggattttcagctctttcggtgtttaattgcatatcgtgtcctttatctagataattgcataatcggtgaagaagtggattaggtgctaacaattctctgatcaaggcaagttttctcctcccatcctttgaacacattgaatcccatgatttgaggaatgaaaatatttgtttgcaaagttgcatgtgaacttagactatatcggtatttgaaattgggttaaggtagttatgacctatttgctgcatattccaccttgaataattgatcctcttgctgtttgaacccctagaaatggttagagtacactctttgtgctcaaatgggtttatatatgctctatgtgcaattacttgcttagccatgcttagaaatacgcaaatgctcattccatctataattaaaatgtggttttgatacttgaacctttgctggaataaaatgaatatgatgggtatttgcgaattaaaatgtgtaaaatgtgattttatacttgggcggcaagtggtgtgcatatggtgttagttgcataccgataggggaagtgtttgcccaagtccataaggaccgaacttgtgtcacccatttaaagttatccgtacatccacatgtgctagtatgggatggcctaagctgattaatctatttaggactagccttgcattctggtaggccggtgtgtatgagttagtcgataattctgaggaattagtcgatgattcagaggaacttcctatttgccccgacgtggtagtttaggtgactaagtctgtccaatacaacggtattgtgccacgtgggtgggttcccgttgtgtccgccaccacggcgttaagtttaaggcgtgggcccgccacttaacggttctagacatatttccaagtatgcctaggatggaggaacacgtatcgtgctggtgcaaggctagattctaagtagtgtaaaggcttcgttatgacctctagatcacattcaacatgaagagtgtgatggagtcttgcaaactcaaaacaaactagagagttcatatcatgtgggtaaagctgtacaaactctgcagagttctttaaactaatcgattagccgtgctcacggtcatgagcgctttggtgatgtgtcatgagtatagactatgttttaaaaatgtgatcatgtgatattggtttgaaattaataaatgtgttgagttgtgtgtgtgaggtgatatattatgtcttgttgtcaaaggatgacaacaggagattgattataatggaattatgatgaattaaatattgaaacttaaaatttgttttgttaattgaagcatcaactcttttacaaaagaattgcgaaacaaaacttgctttatgctgaaaatgaactacatattgccttcctttgaatatatgccttacatgtagtatggtaggattgatttgtgcttgccagtacattaacttgtttaatgtactgactcttgctgtttgatataaccttttgtttgcaggtttagtcttagtctttgagtgatgcgggttctgattgcttcttctaggatgagaacttaatgaggtaaacccctagtcggtgtgcttgtgattgggtagtcaagcttccgttgttctctaataagtctatttggccggtcggcctatgtaattattaagttgttgtaagtcttaagtttctttcatcttagttgtgtttgctatgtataatcatgcttaagatgaaagtgtgaatctagtgcacatcctgggaactagattcacatgagtatgagttaggaatatttgagaggttgtagatctttagccatttttgtcaagtctcctgaatgtgtaacacatctggtcgccgccttcgagtggtttgacgggcacatctcaggctgaagttgactggcaggctaagggcccagcaatgtctccaatattcctctctcgaggtgtcggatgtttcattatgcttgtttgatgacttgaattattcacttcatctctcaaatataatggaaggtccggagagcctacgacaattaagccctatgcaaccaataatcaggttgagtacgaagcggttctcaaagggt

SEQ ID NO: 74024 - DNA, 570 bp, Oryza sativa
aattcctgcagcccgtccatacggtttccacgaagacgaaagagatatatttacatcgggccaccatattaatttgtgtaggagcccgtgatgaaggcctcgtttggtagggctccaaactccaactccagtgagagctagctcctgttagagttgaagactcgttgaaaagttgaaaagttttttgctacctttcagctctagatctggaaaaaaaatgaaaaaaaatgaaaaaaagagacctagccggcggccccaggcacgccgccggctgccggccgtcgccgccacagcacaaggcgccggagcggtcgcagcttgtcatcccagtgtagcgcccgttccgtcgtggcgcctagcgggaaaattatctcttaaaaaccctaattgcgaaatttgtttctttgcttgttgtctagtgtccgtgccatctcaagatctcaatccccgatctatcgtcgagttcaattccgaatccaaatccctccaaatcaatttcctccgcaaaagtctagtttgcctcccccgggttcgatgggccgaatccagctcggcccatctctcccccgg

SEQ ID NO: 74025 - DNA, 1049 bp, Oryza sativa
ggcgaaatagtgggcgcgagaaacgaggagccgggcatagcgttggcaagggtataaaggcactgaggaagggacttgtttccttcctttcgccattattccccttgtctttgctgcttgcgccctaactcctcctttcctgcgccctaccctcgccacacgcgctcgctcttaatcttctcttcctccggcgccatggcacggggctccgctctgctcgatggtagcgtgctgccgccctcccgcatcgtgagcgagaggcaggctgggctgccgcgccgcttcatgccggaatcggccaccggccgggagatagtcacgctgggcgagggacgcccggcgccagactgtcacgtactgataaattcatcccgaattaaaaatcattcgctaaaaggaataatagaattaattaaaattcgaaaagaaattggcaaacactaaaatacgtacaagaaaaattcaaatgtggcccggagaatttttgttaaattctccttggtctaaaaagagccctcaaattttagtggaattttcagagcacaaataataattattaagaaataaacaaagttaaaaaggtttataaaaagaaaaaccctaaaagaagtcttctttcccccccttcctctcttgggccggctcggcccacctcgctctttccctctctctcctccccgcgggccactcggtccctcccccgcgcgcgcgccgctgacaggcgggcccgcccgccaccctcgctgacgggtggggcccacctgtcatcgcctttctcgcgccgctcccgccgaccggccgtgccctagcgccgccgccgccgcggattccgccggattccgccgtccccgcgcgcattaaagagggggaaatcactccccgtgattccctctccgtttccccccgcttttacctgtctctctccctgggattagctcggaatctttcccctaaacctagccggcatcaatggcgcccgagatcgacgcggccgtttccttcccctccggcctctatatctccctcccggcgctatataattggtcccc

SEQ ID NO: 74026 - DNA, 1221 bp, Oryza sativa
cccgggggaggcaaactagacttttgcggagggatttgatttggaaggatttttattcggaattgaactcgacgatagatcggggattgagatcttgagatggcacggacactagacaacaagcaaagaaacaaatttcgcaattagggtttttaggagataattttcccgctaggcgccacgacggaacgggcgctacatactgatcttgagaagacagcagcaatgctggcttggcctgtgcctacttctgttactgaattgaggggatttttgggactgacaggctattacagaaaatttgttcagggttatagtatcatagcacgaccattgacactcttgttgaagaagaaggcctttctttggactgatgctgctcagcttgcttttgatcagttgaagacagctatgagtaacactccagtgttagctttgcccaattttcagcttccttttactttggagaatgatgcatgtgcttatggtcttggtgctgttttaagtcagcagagtcaccctattgcttattatagcaaaactttgggtcctgttaatcagaaattgtccatttacgaaaaagagtttctagctattatgatggctgtggataagtggagatgttatctgcagagaggtccatttatcattaaaacagatcacaaaagcttgtgtcatttggatgatcaaatattggggactgaattacagcaaaaggcaatgactaaattgatgggtttgcaatattctttccaatacaagagaggggttgataatattgttgctgatgctttatctagaatgccttcctcctctcaattttgtgctctttctgtggtccaaccgatctggattcaggaggtgatcaattcttatacagtggatcctcaagctcagcagctactagctgagttggctgtgcattctcctaattctcaagggtattcattgacacaagggattattagattccagaataagatttggattggatccaatgcaggactgcatactaagttgattcaagcttttcatgcttctgcacttggtggccattctgggattgctgctacttatcatcggtttaagaaattatttgcttggcctggtctcaagttggatgttgaaaattttgtgaagcaatgtcaggtttgccaacaggccaaacatgaacactgtcggcttcctggactgttagctcctctcccaattccaaaagag

SEQ ID NO: 74027 - DNA, 4659 bp, Oryza sativa
agagaatggctggggccaacttggcaaaaagaaatcgaatttatctctctccaaactctgtctctcctctgcctcagctctgtttctcttcgtccccaactccgatctcgtctaaatatctctctctcttgtcggcggcgagtttcgcggtggcgtagtgttacagattagtgttgaataatcgttgactagtttaacagtagaaacgagcttttccccttttagtccgaattgcgccatcaagaaagtggaacaatacccgttgttattgccttattggtacccacgcagctcaatatgttcctttcactgcaagaagttttagtttggtttaataatttggtcacttaaacctttccattgttcatgtcgcaacgtagtctgttagtctgaaaatttttcactagcagccttgacaattacttatagtggctttagttagcttactgttgttccatctcctttctgatcaaatttactaggtgcgtctgagtaaggagcgcaatactaacgaggacaggctcagcagcttacctgatgagatactcatcctgattctcgacaagctagatgcacgcacaacaataaccaccactatcctttcaaagcgatggcttaatcttcctcggcgctcccacacatgttacgacttcgccgttgatgacctcctccctccacgctaccacaggttgaagcgactgtggatggaagccaaggcagcgtatgaggcagagaagtcaccatatgtgacaacaaacagggatgctgtgaacctgagcgacttttatgccatgaaggacaagatggatcagtggacgaggaggatccgtccactcacggctgccctggaacgctatgaacgctgggccatgcggcactatgtcaagcgggtggatgcattccttctgccccccgatggtgtgcaccgaactatccaaaagctaaggcttcaaacctttggcaggaagtggaaccaattcattcagcgatgggttactgcagcgattgccaggtggggagttgaggattttgagcttaacgttgaaggccgttgcatcgcctatgacttcaagatacttgatggatgtcagaatttgcagctgaagcggctcgttctgttcaactgccctcccttgggttcatttaattccttgacgtttcagaggctcacgagactctccttgtgtaaaacttcgtactttggattggctaatcggattttgacacattgtgtgcatctattggactttagtatcagatattgtccgggttactgtgctggtggtctccgtatcaatgtcccaacatcaaggttaaagaatctgctggtggacaactgcaaatttgggaaaatctatctgcattcactgccctgtcttgaaacttttgcttgccggggcctactgccttccaagatatactatggcgaggtgcctggacttaggcatgtaggtttggactatctaaaaaccgaaggcgacagcaaagtcgatccaagtgttagcaacagaacatatccactgagcaaattcttgaagaggatcccgccaattgagagccttgttctgcagttcaaaggacctgaggtgagcgatcatacatactcctgaaatgaactaacagactagtcactagtgtatgaactaatagtaatagtgtagtggcctcttgtctctaagtgaaattgcgttgcattttcatgtgtgcaggtgtggattgagccaatagctgtacccgacccgttgcttcatctcaagaagctattcattgcaaacgtaccaattaattgggatatattctggattgtcaccctgcttgatgctgcgccggttttggagtcatgccatgttcatgtatgcactctacaagtctcttttccttaaatatcctcttcaatttttttggaatatatctgtgaattcacacgagaattctcaaaccttagtgcagattgacaacaggtcggaaaatatggcttcttggctagacgtgcaagctcaagatcgtcagtaccattgcctgaaggagctcgttgtcgtcggcttcaatgcagtagggtggcaaatcggctttgtcaggcatgtcatgaaggcgtcgccgaggatgagacgggtgcacttgctcgatgggcatgtcgttgaagacaaggagcgggtgctcgagggattggaggtagtcccacatacgcgggagtggcacgagtttgagagatcagaggtcctcgatgatctctgggatgggaatgggatctgctcgccgcaactggaaataattctggaatgatctgttggcgacaggctaaggtataattgtggaaggtgtcgctaaggctgatactggttcacctgctcggcgggtgtcgactgtcgagtgtcggatttcaggatttgcatcgtctgatattacggagagaatggctgagagcctgagacgcacagtaaaatgtgccaggagctacaatatcttgccataaacacagtaaaaacgctgtgcgaacagtgtcggagtactgttcactcatacggtatcggtttactgttgattaccgtagcgatcgatcacatccggccgcatttaatctaacggctaaaaatgaccaatggtagagagtacggtaggtttttgacaaattcatcactaaattttatgatatcataccttgaatatagagtttcgtgaaaaatatagtgttaatatgtggtttgtaatactacctctttaaatctatagttttataatagtttgataaaagtagaaatagttctataaaatttacttaaataaaaaacggatcagagaagcagccatataatgcttcaaacaaaccaaaaacgagtctcgtgactaatggagtatcaacagtcacaaactcatgacacgataattatttttacatgcccttattgtcaactctcggttattttgtattgagtcaaacaatgcctcatcaagcaaataaataaacaaataacacaattaaacacgtgatttctatccggcacgtaacgtaccccacatctcatggagcagacgcagatccatccaagaaagcgattgtttcgtttatccagggaatacgctaaacgcggtatatttgtaaacgaaaaataatttataatttttttatatatgtgttattaactatctacaaacaaagactgcaaaataaattttgatgggaaaactttaaaattaattttgaatttaaggttgaaaatttaaattttggctgataaacgtaagtactccctccgtattttaatgtatgacattgttgactttttgattaacgtttgaccattcgttttattcaaaaaatttatgcaaatatgaaaatatttatatcatgcttaaagaacatttgatgacgaatcaagtcataataaaataaattataattatataaattttttgaataagacgaatgatcaaacgttggataaaaagtcgagggcgtcataatatagaggtagtataagaaaaaaaaagattgggctaaagatatcgtcaatgatagcttatcgtgacagcgcgcgtcaaacacaacccgcggaggaggggacgtgcacgccgcaccaccaccaccaccaccatccatcaccctcctctcccccgagtcagccacagcccgcctccaaccccaaccaccgcacgcagccgcgccccgtgccgcgcccgtgccgtcgcgtgccgcgcgcccgcgtggcaaaccacccaaccacccccctctcgcagccaatgcgacgcgacgccctcctctcctcttccaaagtcgccatccgtttcgccgagagcccgagcccgagaccaacacaatacagtaatacacaagtacacaacacctccacccattgcggcaaagttggcacgatctctcgctgccttggactcttctagttctagtttagtttgccttctttcttctccgtctcctcctcgcggcggcgcgcatggagcggctgatctccaagtccgtcgccgcccggatccctctgccggggggcggatccccatcccgccgcctcgccgtcgcgggtctcggcggcggcggcggcgtcgagccgtgggcggggaggctacgggcgcagccgcgtctcgggccgatcgcggcgcggccgcacgatggtgtgtcggccccgccgcgggaggccgctccggcggcggcggttggacctccgtggaagttgctgtggagtctgctccccaaggtgactgccccaattttgggttttcttttttttcatctactggaattgcaatgtttggctcgaaaatgatgcgcgcggtagaattgccatggtaggttctcaactagtgctagtcgtagtacttaattgtggtaattatgccccttgagaaagttcgttcagcttgacaaatgacaaccttctgtttgagatcgaatagcatgacacatgcctcgactgggctttgacaatgccacggctgtgtatgggatgagaagagtagtatgctttgtagcaaatgaaagagatctccaaatgaaatgctgtttttgtgttggctctacctctataaatgattaagctggtgttttctggcgcttccatatacttcatatggaaaaatacaaagccaatgcacaagaaaatctttattttagcagaacagaggggaacatgtgagcactcttaattt

SEQ ID NO: 74028 - DNA, 921 bp, Oryza sativa
attcggtcgcccctttccttttccggtgaaatcaatagaggggaaatgatcttcgggatctcctctaccttttctcttttggaatcgtcggctaaaatcgtttggaaatccgtggattcgagtttgattcggatcgatctctctcctccgaaccctagactttccttcgcgtcgccggtcgccgtgggccttcgccgccgcctccttgcccctataaaaggacccccggtgtctccgctacccgccgccaccctcgcctttgcccgccgccgtctgtagcgccctagcaccgtgcagccgtgcgccgccgtcgccgctgcagctctagccgtgcgccgccgtcgctccggtcgtcgtcgctactcggggaggtcaccgtcgtggtcaccaagccgtcgccgatcccgtcgctgtcgaccgccggaacaccgtcgccgtcgtcaagccgaaggtcgccgccgcttcttcctcgacgccgtcaccgtccgttgatcttccgccgttgttttggtcaccggtgagttcgtcgcgttgccctctacgtgttggttccctccgttcgcgctgtcgtgtcgtcgttcgccggagagcatgcactcccgagccgccgccggtggtgacgccaccgctgacgtcatcgtcatcgttccccgtggcccggtcatggaccgatggatcttggccgtccgttttggatgaatcgatctcggccgttcgtttccgtgagccgccgccgtgcacccggttcaccgcgaaccctagccgctgacgcaataatccccttttcctttataaaaataattcattattgcgtcataattcaattaaaatccatataagtgttttaatctgatttaatctttaaaaattcataactaattcatcttagctcggatttagttggttcaagtctctaaattt

SEQ ID NO: 74029 - DNA, 518 bp, Oryza sativa
  unsure (1)..(518): unsure at all n locations
ggaaaacactccataaacatggtaatttaccaatggacaccgcgtcgataaaataataatttccggttaaagaggagagagaaatcgcgtgaaagttctaaaatacccgtgggcccacttgtcatatcttccatctctcttcaacggaaagcgtcgtcgtccgtggagtggagcgccaggagcatcggcagtcttgtgtgtgcatgatcagctgttttaacatagctgatcatgaacacacaaactatacttgttaaatcacattcgtttgttgaaaatggggtacaattgtattgtcgacgggctatacctgtctacggtatttgttcaggtattggctaactctggattccaagtgtagtttgtgagagggagacgatcatacagagatagagatagagacggcgagaccgaaatagaagcgatgagttgggtaaatccctatgaatgttccatacaaatacgtgtcatccggggggacatacctncgcacggacagagaggccattcgacaccag

SEQ ID NO: 74030 - DNA, 1252 bp, Oryza sativa
ttcctcattatccgaatcttccctctccatttcatcaacaattataccgactctctccccctcatccgccatgcccatggcctgctcctcccttggttgattttcctcattttgcatcgatggtccaacaacatcccctgcattgataggaccctctacatcttcggtttgcattgaaacatttatatctttctcttgtaccgacacaaatataacgaggggccatgaccgttcaaaagccatttccacataccgtctccaagcagcagtgctgtccatcggcattagttcccaaaaataaccttctgttgcacgactcactacaactgatactgacattgtgtagacttcttggtctattctaaatcctctcaacaaccaactataaattgactgaaatgttctctccgcaggcctatcgatgcccttagatgtcattacaaaatctgacagatcaacaccatctggaccaaatctaatatttccttcaccgtgaactatctaaaatgtgaccttatttgacattgtgcctgatgaaaacaataactgcgttaacctcgcatttctgtactacgccctaagttacattctctacaatattgttctccaaaattctaaaagtaggttacattctccagatcaaactaaactacatcttacaattaacactactgtctatgtctcaattcatactattatattctatgctctggatctacacatatgtgctgtgtgctacagatctgctaaaatatatggaactaaaactaaaacgcaacatatatactcaaacataacatattagtacaaatgtaaaagatgtatgggagcatacctgtgatgaagtgagcgaaccagcagggcttcgccgctccccttctgctgccctcccctctctctctttcgttttttttggatttttagtgaatataatgaaatttcagagaggagggactgggctttataggggggaggcaaaaatcgccctcccccagggcggcaagggggccgcctgcaaaattccatgccccctcgccgcccatttgcaggcggccccccgcacagtacaaaatcgccctagcggagggcggcaagggggcccgctacaaatttcgttgacggccgtcgccgagagcgaacggccgtctgacacgtaatttttgccgccctctgggatggcgatttttaaaaatcgcccttccagagggcggtaggcgactactttcgtcaattttcaaaatgaaaaaatatt

SEQ ID NO: 74031 - DNA, 2863 bp, Oryza sativa
tcaactacttcgagctggtgctggtgaccaacatggccgggagcgggtcgatcgtgagcatgtcggtgaaggggtcatgcacggggtggatccagatgacgaggaattggggcgccaattggcagtgtctcgctggactggccggacaggcgctcagcttcaatgtcacctccaccggcggccagaccatcgtcttcgacgacgccgtgccggcggggtggtcgttcggccaaaccttcagcacctaccaccaattcgactactgattgagctatatatgttcagacatcaggaatatcagatcctcgtctgaaatctgaatgtctatctgatcgatccagcattggtaatctgtttcattgtaagatcgagcattatttgggagtaccattcatttgatcgttttaattgctagtcggtggatgtaaatcaagttgaatccactgctatctttaatcgatgtgaaactgtagtagtaccactgaagatcacattccatcagacttcgattacatcataaaacgtgtaccacatgctgatgacagccgacgagtcatattcctcgatggaagcagagtggcaattaaaggctacgactagagaggctcacgagaaaaatacatgtacaagtacgcaataatatcaacaccaaagccatcaaataattcgagactcgtacacaagaaaactgacaggaagacagcggttgagctgattctgaacgaagcctttcgtgtggaggtgattaccaaacgagacgagctacgcaggacagacagcgtcagccgctgtctggtgatgcatgacagcagagacagctctggggatcgcaacaagagcttttacttgtggacggacgcttgcaaaatccatcgacgatcgtgggacgtggctagctcggcgatcaatccaaaggagtaccaggagactactagctaggagtgtggaaccttatccaacaacacaacaagacaggagaagataaaggccccggattctcacgtaacagcgtgtgttttgcgcttgcgttttttttttttttgacttttttgcgcttgcattcgaatcacgttcctgtatcttcatgtttatgtcttctcatcagtcatccctgcatgcgttcgagagatcaccttttccttttctgggttccaaaagatccgttaaaatttggggcttatttggtttaataccctatcaatatatgttggtagtgccaaactctaggcaagttttggcactacaatattttagtagggtagaattgtaaatgagtgcatttgaatttataccaattgagagccaaattttaaattgtggtgaagaatattctaaaattatgccaaattgagtattggcattaccaaacatttggcttcaaaccaaatcatcacatttgctatttaaaccaccaaaaaattggtatggcaatattttggtatcaaaccaaaacgccccttaatataggcaaaatactgtagagatgcatttgatagtacagtgataaggagcgtattcaatcttcaacacgaaatattgcaccaatagtaacacgctagaagcatatctgaaaattcttggttgaaaaggcagaacaaagaatatatgctgattcactattgttttcaaaaacaaggagctggggcagtgagcgatgaggttgggcggcgaagggatgaggtcgtcggaatccagtaggccagtagtcgtaggccggagagacaaaacaaagatgggcggtgcccctccctcctcgaccaccgctggattttctcatcccagacgtcgcaattatttcactttcccatgacgtggatcctccgcggcatcccccgccgtcgatccggcatcggacgggccgcaccccgcggggccgcgtggatcccacactaatacctaccggtgccacggccaggtcgggcccacgtgccagcttcccctccgcgggacgccagcgcgagcggctttagagcggcgcgggggggtgggccccacaccgggataacaatcgtggccgtccgtgtcgatcggacggtggagggcggtgtgaacaggtggtcgctgcggacttgtctcctctctctctctctctctctctctctctcccttttgtgaccccaccggagaaagcccttcgctgcgtccatccgtggaagggaacggaaagggggaagaagagctgcagcgagcgacgagggcatcgccgcctccgccgccgccgcgcgcgacggtttatcccgtccccgatccgatcgtcgccggggctcctcctcctccaccctcgccgcgggcaatatttggaaccccccagggaagtatctctcaccgccgatcgcctctcatgccgtgctgagtggagcgcctaccgaatccctacccccacccgccgccgccgcagcagctcgtgccgtatcctgtttacagcggtttgtgggtgatggcttccaacgccgaccagcacgcggcggcgaacggtggtggggggacgacgccggctgcgaccggtagcccccctgccgggaagaaggcggcggccgctgcagcgtggaagaggccggggaacggggcggcggtgccggtcgtggtggcgcctgggagccccatcatggacgccgactcatggccggcgctgcccgggctggcgtctccgccgccgacgacgctgacgccgacgccgatgccgcccaaggcatcgcccaaggtggctcctctaccgccacccgctgtaagtgtttgatccagttgattgtagaataatagggggattgaaatttattgccgtttgatgggattgattgggttttcccgttggggaatcatctcaggaggcggtgatcccaccgatctccttggggaattccgg

SEQ ID NO: 74032 - DNA, 2791 bp, Oryza sativa
ctgaaattcagagttacaaaagcagtttcagaggccaaaccaaaattgtactgacacaatcaatcccaaaactgaacgtgcaaatactcctctgaaacaaattatgaactgatgacatgttcttcgattttcagtaaaactgaacactggaaaaacatgtacaagaaagaaagggagtagaatctcactgggatctctgacgcttgtctgaacagcgtatcctttctccaggagcatcttgacgagcaatgaagcaacgtacccgttgccgccggtgacgcacaccgtcttcctctcaacctccgacgacatcgtctctctctctctctccggtcagttaatacctctcctgtgacagagaaggtgacttgggtttactcccaggtagaatccgagcagcacactgatgatgaggtttcttttgctgattgcgctgttgtggcacttgccaggacaaatcccggagagcaggaacataatacatttgacttagccaacactattttacaagcgacgacgccagtcgccagacagagaggcagaacaagaaatgcttttcgtgatgcatgcaccatacctgctcttctgattgattttccttccttagataatgacctgcactgatcgattatgtcgatcgatgaacatctcacgcttcacatttttaatgcggtcgatcgtgttttcaaaaggtaaagcttttgctccaagaaaaaaggatcatcttatcttcccagatgacgtgtgtacaggttcattcttagaattgaacttttttttttaggatagaggtagtacatctgacgctgaagcctgtgacgatttaacatcgttgaaaatgataggatccgtttctttctctatgcaaacaaaagcgagagaggaacagcacacgcgccattgaaaagtaacccaacgctgcatgcctgcgaattggacttctcgtttgtgtgtgtgattaatcataccaaaaagtaattcctgcgatgcccgcaaagttgagctgagagagctagcataaaaaaaaaagctagcaagttagttcatgttattagtactccctatgtttacaccattgactttttagcacatacttgatcattcatcttattcaaagaaatttgtgaaatatgtaaaactatatttatacatgaaagtatatttaacaatgaattaaatgatagaaaaaaaataataattacatattttttttgaataagacgaatgatcaaacatgtttaaaaaaatcaaacggcgtcaaatatttagaaaaggaggaagaagttgtcttcgcatctctgtaataactttcccacactaaggttgtgtttagttcacatcaaaattagaagtttggttgaaattgaaatgatgtgatggaaaaattagaagtttgtgtgtgtagaaaagttttgatgtgatggaaaagttgaaagtttgaagaattattttggaactaaacacggcctaacacgacctgatcttcagatgctgaactggggaccttgaaagaccttgtgaggcttcgttgttccaccagaatattttctttgctacttaatgaaatgacagatctcttgcttgtttcaaaaaagaaaatcatagagccacaattaggttgtgttctttagtgagggttgtgaatcctttcctcccgacacataaaacggagtgacggattagcgcatgattaattaaatactatttaactgaaaaacttgaaaaatgaattgatatggttttttaaaacaacttttctatacttttatcttgtaaaaaacatattgtttaatcgtttggtaattgtgcatgtgaaaattgaggggtagaaattgagaaaatgttgaaaggagcacaattttattgaacagtttgacgtgtcaataggcacgtttttcataaaagcggatgggaacaaattcactgctgttttacacatacttatttttgcaagagccgtttggttgcgaagctgggtagtaacagcattgtcgtcggcgtcagtagtgcagaatcccgagtgccatgccgtactccacgaaggcatcatcgtacatctcatccaccgtcttgtacatgaactcgaacccttcactggtcagcttctccgacgagaggaggatcgtcggcttctcagggaggccgccgccgagtctgcatgttccgccgccaccgtcggagtcagctcgcagtggacacgcataatctttgagaccagttcatgattttgtcttacgcatcgatgtcaacgttgtggtgcgggtatttggcggccagggaacgggcgatctgccgcatggtggtgttgagggcgcagcagatgtacctccccgacggcgacggcgacgctttctcggcgaggaatatctcggcgcggcagaggtcgtcgacgtgaaccagcttcagcccgccggagtactggtcaatcattctcagggtgttgatctcctcgttgcctgaaatcgaatcggacacgtgagtccgaaccagatactccctccataccatgaaaactctcgttatactaaattatattacattctaatactaggttgggtttttggaagaaggagtttattctagcacacttaggtcgtgtttgctactgagggttctcaatcttctctctcgtttttctcgcgcatgcttttcaaattgctaaacaatatgtttttgcagcaactttctatatgaaagttgcttaaaaaaattaaattaatctatttttttaaaaaagttaactaatacttaattaatcatgtgttaatgaactgttccgttttccgtgcgg

SEQ ID NO: 74033 - DNA, 41859 bp, Oryza sativa
tgaggctgccatggctgcttccatttgttcctcctcgtcggcatcacctgttaggtcataatagttgacccctgccgcttcaacccttctattgctatcattctgacgcttgtcacctgtttgttttatcctctccaattcacgcttgaagaaatcacggacatccggaggcactgaattgcaatatgtaacccccttccctttgtgtcccaagtgcatttttagtcgtgtggccccaccacctttcttcctctgatggcaatacttacaacgccatccaggtgcaaaattctccccgtgctcccacacaaggtccctactttctgccatctccaccctatatgaaatgcatgaaaaattatcactaggaattataaacatacctctcataacgcaataatatgtatacagctaagctttcacccaaattcgggcatgtatacaacaaaacaatcaaatgtacttcacatgcatggttttaggcaagtacgggcaaccaaattcgctaataaactcatattcccaacgtacttcacataatccccaaatataattcatattcacaatgttttcacctaatatgttcatatgacagtataaaaaaacatataccacggtttcacgcacggtaaccacagtatcaaccacggttaccgcggtttaaacaacgattaccgtgctcaacaatagcagcgaacgtaaataacaggctacggtttctctcccaaaccgcacggttaccggacaaatctcgcggtaaccgccccctctcatgcgcatacctgttggtgggcgagccagtcggtaaccgcctcctaccacacggttaccgctgcataccgcgcggaaatcagccacgccggcgcggaggcggcggatctggcgcggcagtcctcgtcgccccttcgaagcaatgcgcagctgtgagagagagaggaaagaaatagaagaacgcgacagaaaccaggaagagatgcggtagatattttccccccactgttgggccttattgggcctcctgaacagtgcatatttggcccattacattaattattttttctattttctaatcgacattagtttttgcgctcaaatttgaatttctcttactatttttcaagaaatttttacaccataacaacatacaaatcaagctatacatccatgatttttttttgattttttttggttatttttgaaaattttgaatttgagcaaaatttgctcaaaccctaccgtcggtaagggttaccgaccccccgcggtacggccggttaccgcggtaaccgcgcggtaaccggcggtagggtgaaccctgctctcacgtggccagatcaaacccccacctctcgttaaccctaccaatcagctgcttcggtaaaaaaatgaaatcccaaacaaaccaaaccgattttgttcggtcttctcgtgtcggttttattttttctacaactagaaaggtagcccgcgcattcgtacggacatgcatcgtagactatgtttgagaacctataacgatgaaatgttaatcggaacttataaaagatcactttattttttttgattatttgagcacatttagaaaaaaacattaagtaattggactattttctctaattaaaggaactcgatgttttatgcagtggctcggactattcatatttcagttagttatttttgtttatgaagtgtatgtttaatttagctatatatgtttcaaaacatatcactatactctgtgttgttgagttatttctttttcttttggcaaattaaatttgaaaattttgttccggtactatttatttaatttagttatgcatgtttgtagaatttttcataatgacataatatttattgtcaaaattgtaaggtatttagatgtggtgcaaagtgcacgggtggactgtgcccaaatgctataattcttatacagcaaaatatatgcatatataaatattacattgttagtttaattataaatagagaataattagacagaaatcagacatgtatagcttataaaaaatctgtagttgtttcaacattcattgtttctcttctagtttagtagctaaaaaaataaggaatgggagcgcagtgttttctacatgtgagatggaggatgaggtggagggattttagtgaaaaccgatgagagatgttttttttttctcagcatttcttttattgtttttataacttgtaagacatgacacatgttgtcttatgttttttttttaaaaaatagatgacatgtgttacttattgttctttcaaaaataaatctaattgatgaaaataatgaaatccatcgagttatgttggattgttttctattttttgagacatgatacatggttacttacaagtgcaatatgggacgtttaatcaaattttatcaagtagactgatttaatatgccataatgcatatagtcaaccttttcgaaatgtctaattcctatttggtttccatgcaaaacataagtgtcaatgttcaaatgatgtatttaaatttataataaaaatatggataatatggaacttgaattatttatttagttataaataaaacaacaattgaaacaaactaaaaataagatacaacttttaaaattataatcattaatctttctaattattgttttttttacataatgttgtccattgaaaaaaagagaggatgtgaagggagagaagcagagatattgtacgtatggagatgtcacttgaacacatatatgacgtgtgaaggggtgagaagtgggtcttttccgtttttacattgttaagatagcagtagaaaataataggtatactatgaatgagttaaaataatcaatggttaggtgtattatataatttctttagaatttccaagatttattgtacattactagagaaaccatctttggtcagtcgcccaaaaaccacaatagtcccagttcgaataggaaccggaactaaagattatttttaatcccaattaaaatatttttgatctttagtcccagttggtgttaccaatcgggactaaaaaaacatttttagtcccggttcaaagaagttattaggtcgagttaggccctaattacctttagtactgttggtataaacaatcggaactaaagatcaaataactgggactaaaaatagatctttagttccggttctttatacctaccaggaacaaaaatcctcccgagcgcacgtcgagtcctctctctcggtcttaccggtaagaccgataaaaaccatctctacttcgtctctcattaaaaaccatctccactctccagcttcctcgatcccatctcaatatcgggcattctccttctcaatcggcctcctctctctgaccccctctcccctccgaccccccctctcctctcctccccctccccgcctcctcctcctcctaccacggcctctctgggttagcggcggccagtcggggtcggcggcgggccagccgggcgctgtactggatcgggcgggagggcaggaggggcgttggattgggcgggagcggcggtgcctctggctcccatccgccagatccggcggcggtggtggaacgacgacggcggcggtcgccgggctagggaggtgcgcgcggcggccttcggaatttgttttctttttttgaggatttgtgatgattgtttttgagaatttgttatgtgatgaaatgaggggaaaaaccaattacaccgtttgcgtgtaaattgcgagacaaatcttttaagtctaattgcgccacgatttgacaatgtggtactataataaacatttaataatgatggattaattgggcttaataaattcgtcttgcggtttcccggtggaatctgtaatctgttttgttattagacaatgtttaatacttcaaatgtgtgtccgtatatccgatgtgacacccaaaacaaatttttttgggaactaaaccgggccctagtagagttctttgtggaggtttagtattcttttatctgaattaatttataatcggatgaattcatattgttttaatttacttaatactatcattataatttatttgtggtggttttttcaaaatttgtgatgtaatttttttggaatttatgatgaatttaatatgtgattcggagatgatttggggatttgtctattaggggatgtagtgattggtgaaatcaatatgaaaaaaaactctagacttatatctatatattcatagccaatgctagaataacttacattatgaaacggaggaagtacatttttctgacattgtagatctattttagttacatgccagtgaagttattatatagcatgaaacaatatactaatgtcactttcttttcataatttttacaagctaaattatagtcaagaggtgtattaaattctaatttgtgattttagtcataataatgacacaaacagaacatataatttcatccgatagcaaaaaaaaaaaaaaaacttccttacaagagaaatggagaggagttatatacatgcgtatgcacgggaagaggggacgcctcttcgaaagaaatagaaaaatcaatctaatccaacggtttggagtgatgggctaggttttagtgaaatcaaaggctaggtttttttttctcaggttttttctaatttattggagcgccacgtggcattataggagcatttatataagcatcatgtggcagcttagaaacatttatagaaattttcatggacttttactatataatagatatattggatatcattgatataatttagcgaaatatatttgtagaattatttaaggtgatatataatatgccaactggagatgaggagagagagggagtacgtacgtacaggaggccaggaggggaacgtacaggtgatggggaccggtgtggagaggaggattttttttatttgatctaatggttaaaaatgttagacccaccaatttaaaaggaaaatcaacggttagatttttagactgccacttggcatcttaagagcgtttataggagacccaccaatttaaaggaaaatcaacggttagattgttagactgccacttggcatcttagtagcgtttgtaggagaacatgtggcggcttaggagcatttgtaggaagtttaatggactttttagtatataataataactagaaaggtagcccgcgcatatgcgcgggcatgtgcgtaaaattttattacgaatgtccatgtctggatggttttatatcaaaaatattcttttactttatcataaactaaaatttaacatatttaacgtgctttgaacgttggttacttgctaacatataaattgtgaactaaaattacttcaaaacagtgttcttttaattcatgagaaaattttgtatcgaaacaattgatgtgtttcctatgaatgtccaattttttttttggttaaattctatttgaaattttaaatatattcatttgattagtcctggtaaaatgtttggatatttctatttagaatgggttataaacccaacgaaaagaaatttaaaattagataaattttgtttaattttcatttctttttatcttcatttttttggacaaatccactttatgaagcatcttgaaatgctttgatctatgtaaatcgggatgaaaatataagtgggttgatcctacaacctagcatggggtaaaggcatccattctaaattatctcgctccaatcaactaagaaaatttaaaatagaggccatagtattttcttagcaaattaccactgaactggagcgtcatgtaataattacacgtttctagattgttctatgctatgtcacaaattcgcgatgtactgtagcaagttttacccgaaaagtaaatggatacggtcttttaattcctatctggaattggcttatatattattgaggccacataatggttgttttactcttaagattccttggtgcaaccaacgtgcttagtatgatcggtatgttgttcaactggccacgtgacttcatagatcatatatataatatagatgatatgatcattttaagattatgtatttatctcctaaaatgatcatttattcataaaagcatcaatatcaaaatgtatgggtaaatagctcctgtatactcgctgaaaataaaattaattaagttgatagaaagttgttagatgtctaacgggatataagtaatggatctaccagttttattaaaaattaaggtgggatactttgatttttagtgagcaactttagtattttattttatttagggtaaaatttgctacaggacattaaaaaatgtaattagctagggacaccgtaagaatgcgtatcagctgtaggacaccgaaaaaactgctatttagttgctggacacccgcaacattattttataatgtccaatggaaatggagagagaaacaataacaaaagtacaatttttccccttgcctaccaagtccggctcgcatacacctctgacgcagcaaccggacccgccaccggtgaggtggctatctagaggggggagggggtttcaaggagagcccatgcgcctgggcccgtagctacatgtcgttcccgcactcatcgtcgctgcagcgcgagggccatgccagtgtcgatgctctgccacacaccgcgcttgagggtgagcacaacatggagcacctcctgatttatgtcgagcagggtgccgcagagcgctggctattgttgtcggtctcacagccacgccacgccacgccacgctgccatatcctccaccgttcatgtcgtgactacaatggcgtcagacctatatgcgagccgcatatggcaggaaggggcaaaatcatactttcatgattgtttctctccctttcctttcgatgtaaaaaaataatgccacgggtatccaaccgctaattaccattttttttctgtgtcccatagcatatatatgttcttccagtgtctctcaactaactacacttcttttatgtcctgtagcaaattttatctttattaagtagaggcttcaatatggatgtgggttcataaagtaattttttttataaaaattagcacttaaatatagtcaatatcggtattaagttattgtttccacttaaaaaaaaatagccggctagacctaatagatggagattcatttgtggtcttttctttgcccataaaaataattttaattttaattttcatagagacagaaaaaacagagaaaagtaacgctgcacaccgcatggggacggggatggagggaggtttggtatgtttcttttttttagaaaaaaaatgattgatctgacggcataaaataatgtgttgaagtttaagccaaaatcgatggttggatattattttttttctcagatttattataatcttttctaatttaagtgagacaagtagcagcttggcaaaatgcccatagggatggagaggaagagaggaagggaagatgatttgaggtgtttttttagtaaaaaaaagatccaataacgatgtaaattaatgtgtccagatttaagtggaaaccaatggatcgatgtttctctaatgtcatacaacgatttagaaatatttatagaatgtttaatggactttaacacctatttatgagattgttttgcataatcataattttaatttaaattgtgatagggataaaaaaaagagaaaggaacaaggagcctggtcgcacggatatgggaacgtgggaggtgtgggaggttttggttttctaccatagatctaacgatatagaataatgggtccactgatttaaatgaatatcgatatttattgagtgacttgagattatttatagggtgccatgtgacggtttgggagtgtttgtagaaagtttaatggattttatttattatataatagatagatagatagatagatatagatggtactatgtaagtatggttttttcgctttatcttatacggtagaaaattatattctatatttttcttccgatgatactttgtttgtattctttttttttttgctttatctctattttaatacggcctggcattttttttcttccacgaacggaacatgagcgctttttttcctgaatcatacgtactggagatacttgatttatttttgccaaccgtaggtactttcactttttatacagggaagatattatatatacactaatgattaatctaaactaatgggtacaccaatttaatgaaaataaacaatacatatatatctaatctaatagaccaaaataacaggtccaccaattaaataaaaatcgatggtgtgattagatagtgccacgtgacggtacatgagtatttattgtattttttttgctttatctcttttataacatggccgggtaatttttttttcttccggcgaacggaacgtgaacgcttttttccccgaatcatatttaccggagatacttgattttttttttgccgacgtacgtattttcacttttataatgggaaggtatatacatttgtcagggatacgggttaggcatactctttacccttcgatatacgtcacatatcggtacagtatacccacgcgtatacggatacttactgcgtattccaaggaaatccttcacggaatctacggatgggaagaatcctactcggacaagactgggtcgttgatgtatcgtatagggtctgatatctctgagttctacttggagacctccagatctgcgatataaaagggaccccccggggagggcttaaggcatcaaatctcagagccaacacagcccacacagcctacgaagtcagagcctgcaaggagccaagccatcgggatctagtcgaaccaactcgactacgatctcgccggatccgacaaattccattgtcccctttgtaacctgtgttttccaccatataatcccacatcaactgaattagggctattacctatcaaggggcctgaaccagtataatcctcgtcttttgtttgcttgatgtcgtattacgtagatccttataccaacgtaccccaataccctctatatccggtctacaggtaccatccgtcgacagttgcgcgccaggtaggggcacttggtacttaaggttctactactatgtcatccagcttcgtcgacaacagcgtcaacaccaacctcagccaagtactccctgctttaacgatgctggtgtggaatcaagtcggcgaaatcgtcttcccggtttacaccacgacgccgatctcaaccgatcccccaatgaccggaaacgagaacgcagtggctacaaaccaacgagactccatgtcgaaaaatcctcccgctgagacggagaacggagcatcgacgacatccgagctcgagaaggattctgatgtggccaaaccttgtccttccgacataaaccgcgagccgacaaagatgacttccgaagccacaaggtcctgttgtcctatccacaaaaccaagaaacacactttgcaagcctgctgggttttcctcaatgtccgcgctgaaattcgcgcctgcaaagagcgtgggattcagcgtatttctccaattcgcgatgtctattatcctattcacaagataaagaatcacgacatctcaagctgcgaggtctttctcggcgccatgaaagctccgtctcctaagtcatacgtccccatcagggataacgacaagtaacaaggagcgactccaacttcagatcgattcgttggggtaatcgatatcgatcctcacgaaccatcagtcttacaccttctcgaagactatgggtcatcgacaacgagcgcgccgtgggaggtattggccattgatgacgttggcacgtcagcccatgccaacgcagaagcggggaatcaattgactacaccagcccagcacattagaaccgttcaagctatactgagggaaactccctacgatcccgttctgaacgatgacctcgagcattggatagaacgactacgggaatcagtgaccaacctcagcaacgcgttcgaagaagccgctaccgcagtgcacccggagcagccaccaactggcgatgccaatggtgaaaacccggaacggagggaataacctcaacgagctacccctccacctcgcggcactagcgatctccgagatcacatcaacagccgccgagaggcacaacgcacacgagacaatgtgaatcattctcggcgtcatgtctcttcacagcgccatgataacgaaaatcgagaagaccgctcaaacgacgaccgagaccaggactaccaccacgatcacaacggtcgcaaacgacgggtgccagacaatactggttgaggccgtcgccataacgacgacgatgacggagatcggcgccgagacaacagcgggagacgacgacaagattcccgagatccaggccgacatcctcgtaatcgtatgccggaaccaagtgacccatcgtcatcgtcatcatccttgtcctcctcatcgtcagacagacatccacgaaggacacacgaccgccgacaacccaccgcccccaacgctgggtgtagggctttcggtcgttccctgcgtgatgtccgatggactgagagattccgacctggagcaatagaaaagtatgatgggagcaccgacctagaggagttccttcaagtctactccacagtgctctacgctgctggagcagacgacaacgcgttggcgaattatttactgtcgcgtcccaaaacgactataaaatacatcctcaaaattgtgcatagaataagtaaaatccatgtgaaagcctccaacaattaaaatgtgcaaagttaaaagtcgaataaggcttggaggatttttgtatatttcctaaaagcctaaaatgcgtaaataaattttagtggaattttcagagcacaaataataattaagaagaaataaacaaagttaaaaaggttttataaaaagaaaaaccctaaaaagtttcttttcccaccccctctccctcttgggccggctcggcccacctccctccctctctctcctctcccccgcggcccaatcggccccctccccacgcgcgcgtgccgctgacgggcgggcccgcccgccaccctcgctgacgggtggggcccacccgtcatccccttcctcccgccgctcccgccgcctcgcccgtgccctagcgccgccgccgccgtgaatcccgccgcctcccgccgtccccgcgcgcaataaagagggggaaatcactccccgtgattccctccctctttccccccacttttccctctctctctccctcggattcgttcggaaagtttgcccccgctaacttcgccggcgcatcaatggcggccggatcttccgtggccgattccccctcatccggccgctctctccctctcccaacactatataaacgctccccgtgcctccctccaccgtttccgccactcgctgctctctctccccgtcggaatcgagctcgcgccgtcgttctctctctccgccgtcgccgccgagctccggtccgccgccgtcgtcgccccggaccctctcccgtttcggcgtcgccttcttcaggttcgccgcaacctcgccgacctcgtccacccctccgtttcgcccgccgaccgccggaacgccgtcctcgtcgacccgagccgcgccgccgccttcctccgctccggtcgccgttcccgtcgtcgccgtcgacccggggtgagccgtggaccgccgtttcacttcccccttccctcccctctctcgggcgccgctccgccgcgccggtggtcgccggcggcgagcatcggggcgcgggtgcgccgcctcccgtcggctgtgccggcgtggccgccttcgggcgcgccccgcggctgccatgtggggcccggccgtcagccgcccgcgccctcgggtgcggctgacgcgtgggacccacggcgccggccggcgtaagccgcgtgcacccggtccaccgtggaccgtgaggctgccacgtgggccccactcccgtggacccggtccgcgcgcccctcccctcggctgacgcaataaatccgattttaaattaaaatttaaatgaagaaattcgtaaatatccatttaaagagcagataaacttcaaatggccataacttggccatttgaactcggaattggaccgttcaagtctctaatttttccttaagaagccaagaacccatttttgtgctttgtttctgcttgttatatggagtttagtagagtaaaagccgtttcttttccgttggtcgtgtagacgctgcagcttcggaagatccgctcttcgtggaggttgaagccggcgtttgggaaagcgagcaaggcaagtcacatcatctttgaacatattgaatcccagtttgtaaaattatgttgatttaacttattgcgttatcgctttatttaaattcccgcgttatcactgttttatttagccatgcctatttacctttgttatgaccttattattattgttattattattattaccttgttcaccctagaataaacaaaaccccaactagtggaccctctactcatggtaccactagtataattttaggtagatgcttcgcttttaattaggtaacattaggcggttttacaactctagactttgggaatattcatatcacctggacactatggaatggtttggttattgtggaattggctgggctcggggtgcatggttttgatagtagcacctcggccatataaggaccggtcttcgggcctctgttgaaaagcactaccgtacttccacatgtctagtgggtaaggcttagtttgtggctcagtctagttataaacaaaagtacacggatggagatggaagaagtcgggggtcgatggacatctccagggcaaatgaaggctacacgagctgcggcccggtagtcgagatgtcatggcacagggccggtgtcctgctgctaggggctcagtcctgcctgcctgtcccgggggttccggccgtaggtgggattgggtcggtactcttgtctatggctaggatgggttggaaactatgtcacgtcttccgtctgtataccgtggtggtatgtggcacgtggttacacgtgaggaagatgtgtcttgtgggtaaagatgtacacctctgctcagagtataatctattcgaatagccgcgccctcggttatgggcaagccgagcaatgtacccaagttagtgttttaattcttaaaacctgcttaacaactaaaatgtggaatggttagcctgggttggcttgggacgagctgggacccagggtcgggttgccagttcggtctgaatcatcgtaggccttgggttaaggcaggttcgtttgggttcacggccttgataaataatattgcatagtactagaatcgtctttgcaaaatagccctgagcaactaatgtctttaaatgctgtttactgcaaccctaaccctttatagtataactcctttgtactcccttgcatttattctgcacttgtgggtgtgtcttgttgagtacggtggttgtactcagtcttgctcaatttttcccaaacccagaagaggagttcctggaggatgaaggcttcggtgtctagctcgtgcctgccgtcaagtgcctgtggtcgtcgccctagtcttccgctgtttctcgtttgtctttgtgtgtgctgggccttcgctgcccatgtaatagattaactatttacgcttccgcttgttaaactctgaattgtatcaacttttggtgtaccttgcctcctaggacaaggattaatgcacgcacgtaaggaacgcccgttgggttatttccggtcgtgacatttaccaactgcgttgaaaggttctgcacgttcatggctgatgcatcttcctccctactcaatctcttcgtgggcagacctgtggcaacagttcgtcgccaatttccaaggaacatacaagcgccacgcgatcgaagacgacctatacgcgttgacacagaactcgggtgaatcattgagggaatatgttcggcgcttcaacgagtgcagaaatacaatccccgaaatcaccgacgcttctgtaattcgcgccttcgattccggtgtcagagattgctatactacccaggagttggcgacaagacgcatcacaacctctcagagattgttcgagattgttcagcgatgcgcccacgcagatgatgcgctaagacgcaagaacgataagccgaagaccgggggagagaagaaaccagccacaaacgcatctgagtcaagcaagaagaaaaatcgcaaaaatgggaaaaggaaagctcaagcggaagtcctcgcagcggaatacgcgaaccctcctaagcgaccagacccacaaagtagcgacacaaggaaagcatggtgccccatacacaagacgaacagacattctctggaagattgccttgttttcagaaaatcgctcgagaagcacatcgcatttgaaaaaggcaagcgagtacgcgtggtcgagaagaatgaggaggcagttcctcacgaatcggattcagcatttccagactccgacttccacgtttcacacatcttcagaggctccacaacgtactcctcaaagcgagaatacaagaaagtggaacatgaagtctgttcgacttggcagggggctgcacccaagatgaagtggtctgagcagaagatagagttctcggaaggagaccaccccaagaccgccgtcatcctaggacgatatccgatcatggtcgaacccactattcggaacatcaaggtagcgtgagtcctcattgacggtggcagctcaatcaatcttcttttcgccagcactttggacgcgatgggaattccgcaaagcgagttgacaccaaccgatcaacccttccatggaattactccccaatcatcgtctagaccattgggcaagattacgttgcttgtaactttcggccaagccaacaacctccgaacagagcagatcacctttgatgtcgctgaattcgatacagcttacaacgccatcatcgggagaactacgcttgcgaagttcatggccgcatctcactaagcgtatcaagtgctcaagatgccgggaccgaagggaacaatcactattcaagggaacgcaaaactggcggtgcagtgcaacaagcggagcctcgacatagtcgagcaaacgcccaacccacccgccacgactgagccacccaagaaagtgagcaagacaaacaagacgccgaaaccagatggcgccatcaagatcgttccactttccagtgccaaccccgacaagactgtcaagatcggggcgacactaaacgagaaataggaactcgcgctcatcaccttcctccgcgataatgctgacgtgttcgcttgacagccgtccgacatgccgggggtccccagggaggtgattgagtacaaactcatggtgcgacccgatgccaagccagtaaagcaaagactgcggagatttgcaccagaccgaaaacaagccatacgagaagagctcgacaaacttctcaaagctggcttcatcagagaagtactttatccagagtggctatccaatccaaccatggtgtggaaggccaacggaaaatggagaatgtgcgtcgacttcaccgacctcaataaggcatgccccaaggatcacttccctctccctcgaatagaccaattggtggattcaacagccggttgcgagctgttgagcttcctcgacgcttactctggctaccaccaaatcagcatggcaaaagaggacgaagagaagacagcattcctcacgccgttcggggtattttgctatgttaagatgccgttcggactgataaccgcagggaataccttccagcgcacggtccagggcgcacttagcgaccagctcagcaataatgtcaaggcatatgtcgacgacatcgttgtcaagaccaagacaggcgactcattgattgacgatctgcgggaaacgttcaacaaccttcgacgatatcgcctcatgctcaatccagagaagtgcacgttcggagtaccgtcgggcaagctgctcggattccttgtttttggcagaggaatagaagcaaaccccgagaagatcaaggcaatcgagaacatgaagtcgcccacaagactcaaggaggtacaaaagctaaccggatgcatggcggcactgagcaggttcgtcgctaggatgggagaacgaggacaacctttcttcgctctgctgaagaaacaagacaaatttgtatggacacaggaagccgaagaggcattcgttgcactcaagcgctacctatcaaacccccctgtacttgttgctccccaacctaataaagaattattcctctatattgccgccacgccatattccgttagcaccgtcattgttgtcgagagagagaaagtacaacgaccagtctattacgtcagcgaagctctccacgacgcaaagacaagatacccacaaatccaaaagctcctttacgcggtcatcatgacatcaaggaaggtatgccactactttcaagcccacagagttacagttgtctcctctttctctctcgacgaagttgtgagaaacaaagacgttatcagccgcattgcgaaatgggtagtcgagctgagccagtttgatgtccactttgtgccacgaacagccatcaagtcccaggttgtaacatcctcaaattttaaactaaaatttgacggcatcatgctggcttttgattaaatttgtttggttcaaaaatctatttgatttttatttaaaattggttcaagtattagagcccaagcaatttactctaacttattccctttattctaaactctagtgaatttgagcaaattctctcaaattcaaaccatagattatttctttagcttatcctaatattagtggagatttgctatactctaaaccctagtgaaaccttttcaaactcctagtttgaattcaaatcttttctaggaaatattcaaaatttctgaattctactattcattgcacataaggtgttcggaagaatgtctagcccacctagagcagcccaactccatccaatcttgcacaaagtttagatttgatcctagggaccacaccccactcaaaaaccgtggatttcattgcttcttcctccccttgcacgcgccgcactggcatctgattttgccgcgcgccgtgtcaccgcgcgtcggcctcggggccgtttgcatgtgcccgactgccttggcgcgccgtcgcctgtccgccgccctcagcccactgtcgtcgcaccaatattgacgacgacaaagccaggactacgaccgctgcaagaaatcaccgctcgacgccatgcgcacccgtccaagccaccgccgagttcgatttcgcttctacccggggtgaatcgcgccaattcttgccgcacggtaggattggagatagacggtggtatcccctctcacaattcaaaccattcacccccgagccagccattttcaccttcgccgccgccacgcgtcacgcccggattggcgccaacacgtcgccagcagattccaaccgcggtcaagtcaatccttcgctggtaagtattcgaacgtgacctcccgcctctcaaatcgatcttgcccgccctctctcagcctctgccacctttgcctcatccaaatcccgagctcatccaaggcgatgaaggtgcccgagctcatccgttcctcctagccctatgaataggaccccaatcccttccctgtccagcatcgatcatcaacaaccatagccccacaaccccgaagctctgcttcaccaatccatctcatcaaccaccctcgcccgtcggtcgagcaccttgtgcgcgatcgactccacccctctccatccatcttccgccctaaataacccttagaacacctatatcctaccatgttctagcataataagccctaaccaaagcactgcgtcgagttttacctcgccgcaccaaaccaagcaccgccgcccccacactgctctgttcttcgccgccgcgaagtttttccggccgcaatccgtcgtttcaaccaatctcggtgagttcttctgttacaaccatctacatactacctagattccattttagcaatccctttgcactaacatgccaccctctgagctgccgacgtgagcacggccgccacctatggaggcgctcgtcggcaactatgctccgcgccttgtcaaaggttggcaagctgtcggaatccctctggacacctcgtagatgctctagaaccccttccctagccatgtctaactcttatcaccttgatcactatctcggcctaaccgtgccaccgccgccctagccgctaggccgtccacgcatcaaattaactcctccgccgccgctcgccgtcgacggagatccctagccccctcccctcctcggccgcaaccactttcttcctctaacgctgccgcaatcctaaaccctagcgccgccggcccgacttggggaacggccggaggtagaagaagagaagagagagagactaacaggtgggacccacacacagtgccatttcacatttatttgattttcaaactttagaagcccatatattttaaaatatagatccaatttcaatgaaacttggaccaatattcttctaaaatcattctctatcttttggaccccttttcgctatttttttcattttattttattttctctatttttcttatttttggattttatttaaactcctttttgaatttgaattttatatgtctaaccctaggtcttgaggattcctctgacattctagataatatcaatcaatctcaggacatcgagcaaggcaagttaccatatacctgttgatcatttaagcctatattttataaattatttatttatagccttctattcaatattccattttctatgcataaattaatcatagaaacccaaataatttagtattgcttattttgcttacaatctggttaaaataccctatacttagattgagacaatacgtaagatttggatgatttccgggtggctagtattgtctcaatcgatataagttttactaggtacttatgtcgaacgaacgagtacgaccgcagtttctaaaatggggacagacctatttattaggttaattggcattatggcacctatgtatagtggttcttatttctaagtcctcgcgcaggaggcaactatagccgcgaagggcaactttaaccattaccatgtacaggtaaatggtttgtgatactcgagtataaactatatggtatatttctaaaccctgatcgagatgacgtggtgtcatacgatcagttcccgttaaatacctcgggaacgccataactcctcttactgctgttaacattacgttcagaacatatgaggatacaagttcatggaacaggtgccataactgttaatgacttaatactgggccatgactaaagctgataattatcagcaaatcgtggactgcgggtaaagcgtacatcatctgcagtagaatatctttgaaactattcgaatagccgtactcatggagttgagtaccgggactcatatggtactctggttagaaatataaagtttatatgttttataaattctgctataacttttccagattgtccaataccgctttttgcaaagaaccctattatatgtcaattcataacatatttccatcataacttgctgagtattgtgaatactcatccttgctcttataacccctttttcagatctgggtcaagaggaggacccatatgactattactacgaagaccccgataacttagaaaatccctgagggttttacctcactagtcagaatgtatagaacttccgctgtgtactaattagataggtgagtacctattattgtaaaacccttagtattgtaagactttaacatatgcaatgaagaaccagttatattgtatgtatcaatttttactgatccagggattgatacattaatctcagtcggatccaagttgttagttttgggctccgacacaggtactcgccgatttcgttgccgattggactatgcctgataacaaattaaacaaccaagtcgacaacgaaacatggacaatggctttcgatggcgcactcaacagccaaggagcaggggcaggattcatcttgacgtctccctccggagatcaattcaagcacgcaatccacctcaacttcagggcgaccaataacacagccgaatacaagggactactcgccgggataagagcagcagtcgcacttggggtcaagcgactaatcatcaaaggggactccgagctagtcgcgaaccaggtgcacaaagattataaatgctctaacccagagttatccaagtatctcgcagaagtcaggaagctagagaaaagattcgatgggatcgaagtccgacacatctaccgcaaagacaacatcgagccagatgacctagcacgacgagcgtctagacgagaaccgctcgagcccggcacttttctggatatcctgacgaagccatcagtgaaagaggttagcggcgaagttagcccggacacccccgacatcagctcggaggtcacaaaggcagaacgcgctgttgccgatatcgagaccacagacgactggcgcatcccactaatcaaattcatcatcagcaaggagttgccagaggacgatacagaggccgagaaaataacccgtaaagcaaagatctactgtatggtcggcaacgatctatacaagaaagcgccaaatggggtacctctcaaatgcgtctcgtccgacgacggcagacacctcctcctcgatatacatgaaggcatttgtgggtcacatgccgtcggtcggacattggtcaggaaagcttttcgacaaggtttttttctggccaaccgcccttaaaaatgcatgcgacatggtccagcgatgtgaagcctatcaattccacagtaaacacacaaagctacccgcgcaagcactccagactatccctctgacttggcagttctcgtgctgggggctagatatacttgggccattcccacgaggacagggcggctacaggttcttattcgtggctatcgacaagttcaccaaatggatcgaagtagtacccatgggggaaatcaaggccgacaacgccatcaaattcatcaaagggatattttgcacatacagactaccgcaccgcatcataaccgacaacggctcccagttcatcagcgccgatttccaggattactgcatcgggttgggggtcaaaatatgcttcgcctcggtctctcaccctccaagcaacggacaagtcgagagggcaaacggcatagtactacaagggataaaaacccgcgtctacgacagactcatgtcacacgacaaaaaatgggttgaagaactcccatcagtactatgggccgtacgcaccacaccgacaacgtctaacaaggaaacacccttcttcctcgtgtacggctctaaggccatgctccccggcgagctacgacattagagtacatgagtacagaagcactccgacgaggaccaggaggaacagcgagacatcgatgtaaatcttctcgaggagcatcgtgaacgagttgccgttcgagcagtcagctatcaacaggccctccgccgttaccacgagaagcgcatccgagcacgcatactttcgatcggcgactctgtcctccgacgggttcaaagccaagcagggcggaacaagctctcacccaattgggaaggaccttacacgatcacataagtcttgcagccaggcgcattcaaaattgcagacggcgaaggtcgtgagttagcaaattcttggaacattgaccaactacgtaaattctatgtatgagtcaataccatccgtacctgtaagacagcttacagtatcaataaagccaattcttaggcccatgttacaatcaaagtgtttttgcccaatgatcccttaccctgatgacacctagcgttgaaacctgtcctcatgtccctttacgctgtcttgacaaggcctccgaggaacctaagggatcttcggctggggacgcccagtgccgataaggccttgtcagatcctgtagagacgaaagactatgtaagatctggtcgtgtaagagttctcaccgtgcgtattaaccaagccgtgaaatcggaaatcaactttccaacttcacagctgggggctaggatcagagcttattcaaaggtccaagagccttatcctccgagaaaattcctccgacgacaaggctgggggctagagagagtgtacgactcaaacggctaactaaagtcgtgaactgagaacgcactcttacacacaacatccagagtaagaaacatttgttaatgatagatttcttttctatttcacaaaatacttcttacagtttttacacaaatcttttgctacattacacctttttcctaagatatctgtcacagggtacgaatactagcaagaaggccaacgccagtccatagactggaagatcttctcggccaacggcgacatcgatctcgccagatggtctatctccgccgaagtcctccgagaacgagcaaaaccctcacggagaaattcgaggtctaagcgcgggcgatgatctcgtaggcaagccaacaattgccctccggcgtatcggctcgatcgacaacactcctgcttcaaggcctcgtcaatacgcttgccaatgccatcgagttgagcacaggccccgttcagccacgagatgtacacggccgccaactcctcaggatctccgtggaccactcgaagttctctacagactctggccatggatgtgcagcaactcttcaagtacgagttaaaccacacctcacaaccttggagcgtttccacagcctgctctttcttcactgccagcatggttctctcaagttccgctacttcaaacttcgtcttccagtattggatacgacgatcttggccagcaaaggcaccctcgagatctgcttaatgtgataacaactaagtcaagcggtacacctcttttcgagaacacagttgatctagtcgggagggcgtcaaggggtgaatggactactaacctgaggaagtcgtcgccatctccgtctccgtaacaagggtctggtccacattgtcgggcgacacgtgtggttcaaactcgagaaccggaattatcgccggtgactcgggctgcccgcgctgctggacatcctcgtcatcagcatctctacaaaggacaaaagttcccgaggtcaacatacaaaagtaaaatgataattgcacgcacgaaggtggtcagaattcaaatgttacacatcatgtcttggaagtacaagaagtcctactcttcaaatagggggagaatagactctcccagatcaccgacttcttccatcacctccttacgcgtgttgcaggccgccccctgatccaagatctcgcgtagatcgtgttcaggacgcgacagcttcacacacgcgaggacatggcacgccccggtgtaaatccagttcgacgtctcctccacgatcctggccgcatgcttggaggggatctcccccatcaccgtcgccagttccgcaagggaggatgttagcgataactcgtcaagattcaccaggatggtagacttgatgccgcactccccgacgagctagtgcaggccagtgtaggtgacccgcagcgaaccccagatttccgacaggttgttcccgagttccgacatgcggtccttgagcccctgccgttgtcgctcgttgccggccaccaattccctcatcttcgtgaggtcttcacgggcttcagccaactcgcgcaccagccggtcagcacgcgcgttcgccagcactgcttccgaccacgcctctgcaatgtcgcggccgatgtcgcaagcaccagcttcgaggaggcgccccatctcgacttggagctcctcccaggtgaggacggcagctggtggatcacgacctgccgcgggatcgctgactgggccgttgggcgtcgcctcccggctgcgagcacgacatccgtcgaggccgcgcctccgtcacgacatccgtcgttcaggcgatgcgctggaagtccctccgacttgtcttgggcagcctttgcccgcgcctccctatgggatgaccacgaatcagacaatgcttgaatagaatcacggaaacctaaaaattcacctacttacttctcgctaaccgtcacaagacgttgtcgtcgtggaggcaggggagacgcgtccgaggcctgaaagacaaccaatgcggagtaaggcagaatccttctggctgcaggatctgacgacaggataacttaccgagggggtcgacgccttgcgacgatgtccgcttacagaggagaacttcctcccctttgtcggaacattgccaccgctagtggtggcagcagcagcatcagacgcctccttggctaccttctcttttagagacgccgccacctgatggtccgcgagcggcccgatgatgtcagtcagaggaagagcctacgcttaatcaagtcataaggtgatctcgaagggaaaatgcaggatgccaatcgagtacacttacgttgatagcgtcattgcgttcagctgcccccttctcacaaaggggcacggggatgtcactcgctgttgtcggaccactgatcatcacctagccgacacggcgctccatggcttcgctgttcagacctgtgaatcgagaaccaaatttcgataaatcaagaggaacgcgaacataaacatgccaggataaatgcgagaaagataccccgaggagaaacccgggtcgcgtcctccggtccggaatagttaaaggttggatgggcccgagcctgcagcgactggatccgcctaccaacgaagtctgcaatgacttcataccccgacaagccccgtactcggagatcgtcaatgatgttgataaacgactgaagagaggaggtcaaagggggctttgcggtccaagacgaaatcttgtctggttgctctttgggaacaacgaagacagggtccaagtctttgatctcaagatagaaccacctattccgccacttgctgcgagaagaagggcactggaaggggatataacgtgacttcaggccatcccgaagtcggaacccgacgcaaccagataccctgttggactccatccaacgcagctcgtagtagaagcgaaagagatcaaggaaaggctctaccccaatataggcctcgcaaagatgagcaaagatgctaagaaaggcgataaaattggggttcaaatggagaagagaaagaccatagaagttcaaaactaggagaataaattcgaaaggcggagggagaaaaccgcagagaatatagtcttcgatcgcaaccatgtgacctaagacgggctggggattagtacatcctgcttccctctccatggttccaagaccaggaggggcgtcgtcttcctgaagcttcttcagcgacgcactggtggaagatgatttgccgaggtccatcgctgatcgaagatcgctagagaaagggcctaggttgatgaactagggtttcttgtggcggcgaagaaggcgaagagcgcttacaggcggaatgttttcagcacggtgggcggacttgaagatggacccccaaaattcctttaaataggcgcactaccgacggtgcgaattccaaggaatagagagagatgcccgccggaaatttctgggtccgttacgcgcggcagttttttggacttcaatttaaattcgctcgtgaccattgggcttcaaatggcgtgctcgactacggcctgtctccgcggtcctcgcaccgggaacgacaacagtctcgacacccgaagtcgcgaatggttacgcgagctcattttaagcagatgtcgagggctactgtcagggttatggttaggcataccctttacacttcgatatacgtcacatatcagtatggtatacccacgcgcatacggatacttccttcgtattccaaggaaatccttcacggaatctacggatgggaagaatcctactcggacaagactgggtcgttgatgtatcgtatagggtctgatatctccgagttctacttggagacctccagatctgcaatataaaagggaccccccgggaagggcttaaggcatcgaatatcagagccaacacaacccacacagcctatgaagtcggagcatgcaaggagccaagccatcgggatctagtcgaaccaactcgactacgatcttgccggatccgacaagttccattgtcccctttgtaacctgtgttttccaccatataatcccacatcaactggattagggctattacctatcaaggggcctgaaccagtataatcctcgtcttttgtttacttgatgtcgtattacgtagatccttgtaccaacgtaccccaataccctctatatccggtctacgggtaccacctgtcgacaacactaatgattggtctaagtaattggtccaccaatttaataaaaatcagatctaatctaatgatctaaaatagtgggtccaccaattaaataaaaatcgattgtgagattaaatagtgccacgtggcggcataggagtgtttagagtgccacgtggcggcttgagagcgtttttaggatgtttaatggacttttagtatataatggaagatagatagatagatagatagatagatagataatagataatagatttttctcggcttgtgttttagagaaactgatgtataagcaaaccgaagaaaccgacccgagtaaccaagtaaaccgaacgcccaccccttagtacatcgatctacgactgaatgaatatttgatacatgctaaattcagtagtgcagataattggtattgtacgtattttcaggaatacgtggcattgtatgttctgagataatataaaccgagtaaattgcattgaagatacaagaacataacttgataggtgggtgcagtttaatgcataaacttgaaaactgagtaattggtacaccaaacttggttagatggtgcgcttttggtcaaagtgattgccacatggaatctttttccaggtttgcaagacacgtcgtcatttttgttacatgtttctactggttccttggatcggaacagcagtagactgaaggtccatttcagcaaatatccccggtttaatgttaacaacatcaaatcaaaagcactaaaaatctagatttagcaatgatacagggcaccgtgatctctttgatcgatacatgaaccaattcatagttatactgtcaattgaacaatgaagctagatggcgtctaagaaaagcagcatgaatgcatgatctacattcagaagctttatagttgaccaaaagcaatggatcaacctaggaagcacgagttcctgataaattgaaggaagccaacattaaatatacatcatgcggaacaaagagaacataaaaagtggtaggaagtctgtttcaaatttattggaatgcgagagaagcgatcttgtgcacctgatgtcccctgctaatgtggcaaaagaataataatgtgatattcactttgcctaaaatgcactataaagctaagttaatgcaccaatatgcttaaatttcaagttcttatactagaacgcacccaccctgacaagttcttatatcgtgagtgcaatttactcatataaaccagtacaaggtttatgacgcgtggagcgatgttgggagcagctaactatccgaaaggatgctgtgtatgcaacgttccttttgtttggctagtttggctctatgcaatggtggtggcaacagccagcacagcacagtcgagtgcacacctgtgctcgacgcgtggtccggcgttcgtggcggaagcttgtgctcatcatcgccgtcctctgtttcgggcatggccacggccgtcgagctccaggtttgacggaggcaggacaagccatgtacattggcagcgtaccactgatggtggagtgactgatgtgaggatgtctggtgagcatggcgcacaagaggcggcaagcgggtatccgctgcccgctggacgctggtggccatgaacgaccgattggcgtgtcatccgcagcgagtcagaacaaagcagagtggcgccgagcgcgtgccaattgccaattgttcggtcggcgcgcggtctcggttcagcaggtcaacaggaaggaacgaggcttgggcgcagtggaggggaaggactacggcgatgtgttcaaacggtgtctcacacgcacgagaggtttgatcggtggcggctacaaggcaagtagaacagtggtcatggactcacggctgatcttggtcttgggcaaatttttcttcatgacaccgtgaagtggtgtggtcatggactcacggcttgtcatggttaatgataagggataccttctatcctacaacttagagaatatacaagtatggtatatattcacgtacacgggttgtttccttatgtgttgtaggaatccatcacgaattatggaaaatatctttacgggtcgaatgatttacaaagtcctacccggtatggatagagtttctattgtatcgtacgggatccaatgtctccgagtattacttgaagatcaagatgatccactgtataaaagggaccccctgggggtgcaaggcatcgaatatcatcgcatacacacccaccacagtttacgaagccagagcatacggagccaagtcaccgggagatttcgtcgagtctattgactacgatctcgtcggtatcgtcagatctatctactctcattgtattacgtggttcctccatattaatcccatataaactggactaggactattacctgataaggggccagaaccagtataatccttgtcttctgtttgcttgatatcgtattatgtagatccttgtacctacgtaccctaatacccaactcgttcggtctaagagtatcactcgtcgacacggcggaccttagtcttcagcaaattttgctacaggacaccgtgacttttacggttttagctgtacgacacgacacaaaataacttttgggagaaaacactcctaaaagttggatatttgctgatagataccgcaccattaaaataataattttcggttgaggatgaaagagaaatcgtgtgaaatgtcaaaaatgtcccagggtccacatgtcaactctctctctatcccctccttctcttctctccctatcccacatgttagcgacgacggcggcaggcaaggtccggtggcggtgggagggctaaggcggagcggccgcgacgatccgtggccgagggtgaggtccagcagcggcggcggcaggagggcgagggcggagcatccgctgtgccggccagacagcatatgaggttcggcggtggcaactgcgagtggaggagcggcggcgcggctggacagcgatggcagcggcgcgcggagtgaggaggcgtcccacgccggagcgcagaatgtggaggagccggcgtgtggagtgaaaaggcctccagcgctgtcgccgcggccgctccgtactagccctcctgccactgctggacctcgcctgccgccgccttcgcggacatatgggatagagagagaagagaaggggatagagagaagagagatagaagagctgacatgtgggtcaaaggacatttttaacatttcacacaatttctctctcatcctcaaccggaaattattattttaatgggtgcgatgcacactagcaaatatccaacttttgtgagtgtttccccccaaaagtttttcgtgtcgtgtcctatagctaaaaccgcgaagtcacggtgtattatagcaaaatttgtgtagtcttaatattgcgccgtctttggcctcctatggcatcaagacggaatgggccgaggtttaggggggccacacgtcgctcgacttgcggtgtgatgatacgagatttaagcgtgccaagtgtttaacaagtggcaccaccgcgaggttggattgatgctgatgggctcatagtggccaacgcgagctaagagaaggtataatagtgggctataagaaggctgaatgctgaggtggatgggagaaaagaggagagagatgagaagcgggctgtaagtttacaaccggcttaggcacaggaaccaagaaaatctgtgagacagacatgtggaccatatatttatagtaaagagttaaccactatatgagtgagctgatagataggctataagtaagcagctggctgtattattatcctcgctctaacggctgggctggaagcctgaaacgaggttgcgaggtggcacgacaccagtggttaaccagtgcaaggatggcgtcgaagtcgcgggtcggcgaggacgcacagtgccactgtggaggagctgcgctgtggcgtgtggctgacgcggtcacaatgcgtctgttggtggcgagtgtcgtagtgtgcgtcagcggtggcgcacgattggcacacggacacgggtgtggcgcgatcgcgcgactgtatcgctcgttcagacacagcggtgcgtgcgagatagtgagaggggccgaagcacggtttggcgccatttggcatgctggcggcatggacgtcggtggtatacaatacaagaggtgcactgtgcacggccgatacacaacgctgcgcgcgtggagcgtgcttgtcgggttgactggttgcatgcaagatgaaatggatcgatcagtgcgacctccgtgtggtgtggcaacacgacgcggccgcctggccagttcggcctattgagcagctggcgccgcttggcgcttggctggtcctggtctgctcggtttggctgcagttggaggttacctcgtgtaggtgttacttggttggtccaggcctgtatcgagcaggctcggctagcctcccatccagcaatccagcttgtggactgatacatgaagaacaatgccggctgggatttacacggaaaaaagaggattttttatattttattaaaatatctaaagatatattttaaagaacttttacaaataaatacccccaatgctttagtgggacaacttttatgacttgttaaatagccattggcgcgagctctggctattttactagcgaccccttgcagccctaccaaaaataacgcctgcccattttacaggacctttgcatgcaaaactagaagataaccctctaaggccatgtacaatgggatgcttaagtagacgcttagagaaaaaaaccgggtttttttttaccaggccggcgctacgcgagtcgcccgtcgccacgcgaagcggtcgtcgcttgggagcacttgcgcgaaaaaaggaggagcgtagcaagccctggcgctcagtaccaactaactaatcttgttttaggcatatggatcacacatggaagtattttagtacatcacctttgtcataaagatgacaataaaattaaaaattggttgacaatgagatagtaaaataaaaaaaattggtagactcattcactaccattgtagcacctagatgcttagatagactcttaaataactaagcatctgtggaatggattctcttcattggagattaaggctcttcaacagatgcttacatacttttttttctaagcatgtatctaagcatctggaccattgtacatgccctaagaggatggcaaaatgaccagctctcgccattagcacacgtcgatgattgtttgctacatcatagaaaacgccataagaaaatatgttttttttaaaaaaaacgtcctccaagaaacgtgagggatatagatttgtaaaggttttaaaaatatatattttgcaaatatcttaatgtaaaaatataaaaataaaaagaaatcgaaaaagagaagaagtaaaaggccaaaagagtgtgtttgatccctgcataccgtccagcctggttcgtatcgttcgattgagcctgctcagaatgtgcaatctcaatgggaataagtttatctgaggtcccttaacatctcgacgaatccgattttcgtctttcaaccaaaaaaaccaaatataacgggtccctcaactattaaaaccagtgcaaaataaatccaaaggcggtttcagctaacatggcgcctacgtggctaatttgatatggtcttcatctaacgtggcattgacgtggcacatgaatcaaaatttaacaacttaaaaaataaaacaaaatatgtggacccactgttgatgaaaaaacacactagcctgggagatctgcttagctctagtgcaggtctaaatcttgatgagatgcgggcgtgccagtcagtttgatcctgcaattgacaagatatgcaaatagtagatcaatgagccgatcggcggacaagccaatggagtagttctagccgatgccgataccagccgataacgatagggttttgagccatcggctatatgtccaatgtagataatgatataaaggcaatcggctgatgatagtatagtataacaatataatcgagtagaaaccaatcggctagcagtatgatataatagaattagcactgatccgaaggttaaagcatacatcaactggagatccgatatcataaaatccacaatattagataacaataaagtctttgttgtcatcggctaaatattatatatatatatgtatatatatacaatccttaaaagccgatgcaacgtccagataacttatcggctagcaccccgataaaacattagcatgaacctatcggcttaacatgatttatattatcaacaacaatctagtaggtcgaacctaaccgatgcagcacgagattgtatatgataatataatactcgatgagccgatagatctgtctaacgtgatggatatgacagatctatttacaacagcattgtgattgtagagagatatcggctaagatagaagatcagacctaaccgagacagttccaactaaaccgatgcgtctccaaacacaacacaattagagatagaattgagatatcaggtaggcaaatatatcaaccaaaccagagcgatccaagagatcgaagcgatgcagccttgaacaacactaacgtatccaatagattcaccaaggccggcggaatgtaggacttattccttcaccggagatagaactgaaccgatgcagccccgcgtcaggtgccaaattccaccagatgataagtaaaaacctaaggaaagagggtggcgattcgccgagagtagttgtattgatcgagagatatcttacaatgaccccgggtgtaaatatttatactcatggggagatactagtccttatagaacaagaatgaaactttcctaaagataaaaagaaaacataaagtccttacatgacactaaacacactttcctaaagataaaaggaactaacaaattattcctaattaatatataaacttgccatgccgcatccttcttgaactcgaactcttctgcataaatttcctttaattaatccgactccaccaagaacacaactgctggcgatttgacgactcccatcggccgattccaagactctaaagccggtactaactctaggcaaataataacttcgggcttaccaaattttggcattaacacccacatgtgattcaattaataaaataaaaaaaatagtaggacccacatgtcattgggccccacttactccacctcatcccctctcttctctatctcctcccctgctccttctcctctgtttcccttcttccctagattgtggaatttggacacctgcaggatgtcgcaacaacactccacaccaccgtcaatctccgccaccgcaggccacggcgccgtcccccttggtgggccacgacgctgtcctcctccgccaccgcgggcaacgacgttgtcctccctcgccgctgcgggaggctgcgggccacagtgtcgttctcctccgccactgcaggccacggcgccgtcctcctctgccaccaaccatgccgtcgtcctcttccgacgccaacctcgtcgatttctccctcggcgctgtcttcctccaccgccgcgagacacaccgccgccccttctctgtcatcctcctaagccaccggtcacgtcgccgtcctcttcctccaccgccaccggtggcagagccctgggatggtggtcgtgtcagctcgtgtattccacgatgggatgagggggggagatagagaagagagaggatgagttggaggaagtgggtctcattatttttaattttattatttgactgacatgtgggcccacatattttgttttatttttaaaattgttaaatttggcttcatatgccacgtcagatgaagaccgagtcaaattagccacgtaggcatcacgccagctgaaaccgtcgtccaaaccgccttgggacttgttttgcaccagttttaacaattgagagacccattgtatatgattttccagttgaatgatgaaaatcggattgatcgacaagataagggacctcatatgaacttattccatctttgtttggttatctgcacggagatttttgggtcctaaccagttagcagaccaaggctttcccagccaaccaaagcatcaaaatcctgcaagcccaatgacctcttttgcaggcaaccaaatggctgcttttgagtttaaattaaattcggaatttaattgtggaacttcccttttattcagaaaattgaaaattcaaaatattaaatgaatatggactttcaaatttcatttaaaacgaaattcttttatttagacgatttgttgatttttttttcttgaactcgtaacctggaatttgataactgaactaaaattttattgttttagtggagtattagttactcctactgcatgtttcagaacaaaaataattactcctactgcatattaatgatatttattgcactacaaatcattttttccctcctaagtggtatcagttttatttacaatcgtattgatacagggctcgagttcatgcatttcattattatttaggagcttgtgaattaaataaaaatttcattcccatttaacatttcttgtttgtatcagatacactcttgatccatgaattgtactatggtgtactagataccaacttattatttttcttttcacatatattgagtttgctttagctgagattaataaattggatttatgaattgctttaattacagtttgatgttcttatatttcagaacatatataaggaatgacgccatccttcatcctaaaaattttcagcactgaatacaatcggtttatagatttcaaggagaaaagaagaaaactcttggggtagcaagccagacacaaagggatgactgagccggtggtaatgggccaacaccattagcctatggggccgatctataagatgcaaattctctgtagtactgctgatacagtagcagtggctgacatatgggtccgggcccacacgtcggtgactgctactgcatcagtagtactgcaggcaatcccaactggttgagctgaatttcacacatttattttactttagctaacaaagattgagtgggcaacgaaaggatccgtgagttgtggcccattactgttgagttgtgatccaaattcatttgcacttaataaaggccagcttctgcctatatatatacctcatcatcccttttagggttccactatatatatacctcttgtaagccgccgtgcggcgatgtaacctcacctcagatatagtgaagatattttgctggctggcgcccgtggttttttctctcctgttttgggagggttttccatgttaaatctcgtgtcttttgtgattgatctattgttctttatcgtttgttcgcctatcgtttcctaacaagtggtatcagagctggttcccagattagggtttcgcgatggcgtcgatgaagtatgatctaccgctgctagactacaagacgagattctcgctgtggcaagtcaagatgcgagctgttctagctcaaacttcggatcttgatgaggcgctggaaagtttcgggaagaagaaaacgactgagtggaccactggggagaagcggaaagatcgtaaggctctgtcgctaatccaacttcatctatctaatgatattttgcaagaagtgttgcaggaaaagactgctgcagaactttggctcaaactggaatcgatctgcatgtctaaagatctaaccagtaagatgcatatcaagatgaaattgttctcgcacaagttgcaggagagtggttctgtgttgaaccacatatcggtcttcaaggagatcgttgccgacctagtgtcgatggaggtacagtttgatgatgaagatttaggtcttttactgttatgctcactgcctagttcatatgaaaattttcgtgacaccatacttttaagccgtgatgaactaaccctagcggaagtttatgaggcgctccaaaacagggagaagatgaaaggtatggttcagtctgatgcgtcgtcctctaagggcgaagcattgcaggtcaaaggcagatctgagcagagaacctacaacgacagcaatgatcgtgacaagagtaagagtagaggccgttctaaatctagaggtaaaaagttctgtaagtattgcaaaaagaaaattcacttcattaaagaatgttggaagctgcagaataaggagaaaaggaaatctgatggtaaggcctctgttgttaccagtgctaaaaactctgattcaggagattgtcttgttgtttttgctggttgtgttgctagtcatgatgaatggatacttgatactgcatgttcgtttcatatctacattaacagagattggtttagttcttacaagtctgtgcagaatggagatgttgtgcgcatgggaaatgataacccacgtgagatcgtgggcattggctccgttcagatcaagactcatgatggcataacacgcacgctgaaagatgtgagacacataccagggatggcgagaaatctcatctctctcagcacacttgatgcagaaggatacaaatactccggttcaggtggagttgtaaaggtatcgaaaggttctcttgtttacatgattggtgatatgaattctgcaaacttatatgtccttagaggaagtacattacatggttctgttaccgctgctgctgttactaaagatgaacctaataagactaacctgtggcacatgcgtcttggacatatgagtgaacttggtatggcagaattgatgaagaggaacctgctggatggctgcactcagggtaacatgaagttctgtgagcgctgtgtttttggtaagcacaagagggtaaaattcaatacctcagttcatcgcaccaaaggtatacttgattatgtacatgctgatttgtgggggccttctcgtaagccctctctcggtggtgctcgttatatgcttaccattattgatgattactctagaaaagtgtggccttattttctgaaacataaagatgatacatttgctgcttttaaggagtggaaagttatgatagaaaggcaaactgaaaaggaggtaaaagtacttcgcactgacaatgctggtgaattttgttcggatgcttttgatgattactgcaggaaggaaggcatcgttaggcatcacaccatcccgtacactccacagcagaatggtgtagctgagcgcatgaatagaaccatcatctccaaggctcgttgcatgctgtccaacgctcgcatgaacaagcgtttttgggcagaggctgctaacaccgcctgctacttgatcaacaggtcgccttctatcccacttaataagaaaactcccattgagatatggtctggtatgcctgctgattattcacagttgagagtttttggatgcactgcttatgctcatgttgataatgaaaaattagagcctagagctattaagtgtctatttcttggttatggtttaggagtaaaaggatataagttatggaatcctgaaactaacaagaccttcatgagcaggagtgttgttttcaatgaatctgttatgtttaatgacagcttgcccacagatgtcataccaggtggttcagatgaggagcagcaatatgttagcgtgcaggtagagcacgtggatgatcaggaaactgaaattgttggtaatgatgttaatgatactgttcagcactcacctcctgttttgcagccacaagatgaacctattgcccatcgcagaacaaagaggagttgtggagctccagtccgtcttattgaggaatgtgatatggtttattatgcttttagttgtgctgaacaggtggagaatactcttgagccagccacatacactgaagctgttgtttctggagaccgtgagaagtggatctcagctatgcaggaggagatgcagtctcttgagaagaatggcacatgggagcttgtgcacttgccaaaacagaagaagcctgttcgttgtaaatggatcttcaagagaaaggagggtttatctcctagcgagcctccgaggtttaaggcaaggttagtagcaaaaggtttcagtcaaattgttggtgttgattataatgatgtgttctctccagttgtaaagcatagttcaattcgcacattcttcagtattgttgctatgcatgatcttgagcttgagcagttagatgtgaagacagcatttttacatggagagcttgaggaggagatatacatggaccaaccagaagggttcatagtacctggtaaggaggattatgtttgcaagttgaaaagatctttgtatggtttgaaacagtctcctcgtcaatggtataaaaggtttgattcatttatgttgtcacatggctttaagaggtctgaatttgatagctgtgtgtatattaaatttgttaatggatcacctatatacttgctgttatatgttgatgatatactgattgctgccaagagcaaggaacaaattactacattgaagaaacagttgagtagtgagtttgatatgaaggatcttggtgctgctaagaaaattctaggcatggaaatcactagagacaaaaattctggtttgttatttcttagtcagcaaagctacattaagaaggttcttcagtgttttaacatgcatgatgcaaagcctgttagcactcctattgcacctcattttaaattatcagctttacaatgtgctaatactgatgaggatgtagaatacatgtctagagttccatattctagtgctgttggttctttgatgtatgccatggtttgctcccggccagatttatctcatgctatgagtttggttagtagatacatgactaatcctggtaaagaacactggaaagctgttcagtggattttcaggtacctcagaggcacagctgatgcttgcttgaagtttggcaggactgataaggggcttattggatatgtggattctgattttgctgcagatttggataagagaaggtcactcacaggttatgtgtttaccattggtagttgtgctgtgagttggaaggcaacattgcagcctgttgttgcctagtctaccactgaatcagaatacatggctattgctgaaacatgtaaagaatcagtttggctgaaaggattgtttgctgagctttgtggagttgattcttgcattaacttgttttgtgatagtcaaagtgctatatgcctcaccaaagatcagatgtttcatgagaggacaaagcacattgatatcaagtaccattatgttcgcgatgtagtcgcgcaaggtaagctaaaggtatgcaagataagtactcatgataatcctgctgatatgatgacaaagcctgttcctgttgctaagtttgagctttgctcaagcttagttggtatagtggtttagcccgagaggctatttgacgccgaaagtgtttttttttgtctttgttgtgttcaggatgaaggattgattcacgctacaagaaggaatttgtctcaaggtggagtttgttgagttgtgatccaaattcatttgcacttaataaaggccagctcctaataatgtacggatcatcatcccttttaggttccactatatatacctcttgtaagccgtcgtgcggcgatgtaacctcacctcagatatagtgaagatattttgctggctggcgcctgtggttttttctctcctgttttgggagggttttccacgttaaatctcgtgtcttttgtgattgatctattgttttttatcgtttgttcgcctatcgtttcctaacaattaccaccccaaagttggtggtgctacacgttcttcgcggtgggcttgttcgccttctccttctcacctgcagagttggaggaggagccatcgattttcttaccagacttggaggaggagtcgtcgatgtgctcggagttggagcaatgggacccgatcccccttctattggtagggaagatcatgaagacgaagcttgacggcaccgccatccccagcggcaggttcttgagcagctccttgtcgttcttgccggtgttcgggaagaagcatttctggaggccgacgtcgctgaagacgacggagaggaagacgacagccgagaggaaggcgtgcacgaagtcgacgtagccgaggtcccgctaatcgagctcgggctctaggtccttgaacagcttctgctcttctttcttgttcaggttgaagaggttgagcctagtcggcagggcgaagccatagtagaccttccccttgtagaggacgctgtcggtgaaggcgaagaagacgcaggcggcggagaggaagacgacgaggccgaggcttagccaccggttggcccggaagcactccccctggttggtgaaggacgccgacagcgactggtatgccagcaccgtccccgtcggcagaagccgcgccaagttcgccaacaccgcaccttgtcggttgccacattggcagcgtgtgccctcgcctcatcgctctcgctgattggcagttttggatcaatattggcggccgatgctttgtcttccttgttctgcggcgccatcgttgctggccgtaagcccttacttacctacgttctccgatagtgtgtgtcactgtgtgtaatattgtatagtaggtgtttgcatgcagatgcagctccaagagctttgtgtgtgtagtgtgtgtgcatgtgtgtatgtatatatatagaggtataagctgtacagtggtcagtggggcgtcactactgcgagcacgcaaagggcaaattcacgtaatattttgctttataccttcagcctggaaagttaaaaaaatggatacgtacgcacgtttctttagttgtgcgatttgtttattcaatttgaaggaggtttgacgttctgttcggggtaacaatgattaagatatatgcacactggagaaaccatctttggtcggtcgaccaaatttcacaatagtcccggttgcaataaaaatcgggactaaagatcagaaggaggtttgatgttctgttcggggtaacaatgattaagatatatgcacactggagaaacgtcggtcgaccaaattccacaatagtcccggttgcaataaaaaccgggactaaagatgatatttagtcctggttaaaaaaatttaccaaccgggactaaagattatttttagtcccggttcaaagaagttggtgggtacagttaagctccaattatctttagtcccggttggtataaacaaccgggactaaagatctatttttagtcccggttgtttatatctaccgggaccaaaataaactgccgatatctcctcggtatcccctccccttttttctctccttaaaaacaactgagacttagtctcggtatccgcctcctccccttcttccttcttcctctccccttcctcccccttccagccttcccttttcctccgatcccc

SEQ ID NO: 74034 - DNA, 965 bp, Oryza sativa
ccttcatgtacctcgcctattgcaaccttggcttgatcggcactcaaacatttaagcaacactccatcaatcgtccgataatgcaactcatcatccaacaaggtgtacttcaaagccttacagcgcaatttctgagaagccgattgagatggattctgcaaataatgatacacatcatacctccaatcatcggctgttatcgtggcaacttctattttgacatccttcatcatcgggttgtaacccaatgccccttgagccaagtcattagctttgatattttgttcttgaaatacatgcttcaaagtcaccagctgaaatcctttcattaactctcggcacttctcattgtagacgatcaatgtatcattcttgcactcatattcccctgccaattggctaatcacctacaaggaatcgcccataatcttgatagcatcggcttcaacttccttaagtaattgcaaccctttgagaaccgcttcgtactcaacctgattattggttgcatagggcttaattgtcgtaggctctccggaccttccattatatttgagagatgaagtgaataattcaagtcatcaaacaagcataatgaaacatccgacacctcgagagaggaatattggagacattgctgggcccttagcctgccagtcaacttcagcctgagatgtgcccgtcaaaccactcgaaggcggcgaccagatgtgttacacattcaggagacttgacaaaaatggctaaagatctacaacctctcaaatattcctaactcatactcatgtgaatctagttcccaggatgtgcactagattcacactttcatcttaagcatgattatacatagcaaacacaactaagatgaaagaaacttaagacttacaacaacttaataattacataggccgaccggccaaatagacttattagagaacaacggaagcttgactacccaatcacaa

SEQ ID NO: 74035 - DNA, 2089 bp, Oryza sativa
ttaacgcaggacttcaaaaatgaattgagagctgtttcattactaagttttacttgccaagttcctttggttaaaacttaatgtatatcacttacaggtacactcttaactgattagccactaggaaaaactgaatgtctctgaacgtaatgctagaacatattacgaggagaatcttatctagtgatagcaaacaagttgtcaataggtgtattcaataatgatcttaaggttttcctatagattggaattgtgatagcttgacaacactgttatttatcattctacttacccgcatattcacttaagttaaaaatatctaaatagtaaccaccaactcatctagaaatcactcatctatcctccttgattagaaatcactgtaataaacttctacagtagtagccttttcttttgtcaatcttctgaaacaatatgacttgaaggaaaatttcgtttagcctgtgacaccccaattgactccccaagacgttagaaacatcatgtacttttggtttcctatcatggcttcttgcttgaaatgagaatgacatgaatatgttttttttttaattctaattcacattttctccatacatctgagttctcgctgtgtttcttgcatacttactttacagggtgacaaattgcggaagcgtgaaagatgggagatctggttgcttccaaaacaaggttattctgctggaaattcttctggttcgctgtcccctgtgacatccaacattgattcactggcatctcagtttcaatctgttggacttgagggggcaggctaccatgcaagtcaaggaatgcccggtgaagctctccttactaggtcagcaacttcagttagtctaggttatcaggcaccccccttgggagggttatacagcaacgggagtggaccactttttgggcagaagtctgcaagaagtttactccggagcgataccttttgaggttttacacaagaaagattacaacggcatgccgagttttctctggttacggcacgcgtacctcatctactggggtgaggagtgaggactaaaatccagttgatttggaagaaaacaaccaaaaaaaggaaataaaacatacaaaaaagagagatagaaatacccaaaaaaatataaaaatataaaaaccaaaaaaatcgaaaaacttaaaaacaagaggaaaaaacatagtaggtagtattatgtgcaggacttatgtattttgtggttgtgctcttgctgggacgtgagtacgtgacattacctgttaagtactcgtttgattgttgctcttttgcagactgagttgttatggatgttgtcagtcggaagctgttaaagacgagacaaacttatttcaaaaaactgatgacattattatcagttgtgcatcttctgctgcccaaattgtgcatatgcattgtatttcttttgaaaatcgtattcatgttatgtatactttatgctgatttggtcgaacgtggacatcgatctgccgctatgaaacatctgccttcttcggcaaaattgctgttatgtgcttctggcacagagatccttcctatttacttgggggaaaaaatcttattcatctctatagttgtgctcaagagtataacaaagttgtgggcaggccattgtatggtctgcaattggtattatctgtgaatgatacgttttattagtaataatgtcccttacgaaactttggtgatatcaaattatgtcattatcaaattttaggaaagtaagacggacatgtgtggtgttaggtttgagacattctggtaaggtttcaacagtagaaactactgaaaatgccacaacttgataagattgtgttgacttggtattgatctagtgaactagtggtagtatgtgttaccttgccaaattttaaatgtcaaaatttaaaattaacatgaaagagaacaagcccgaagatagatcacttctaaccattctatcagtagcaatttattttttaaaaaaaagaaggctaaagttttgcctcgtatatattgatagagcaggaggaaaaaccaaacaaccaaataagttatttacatgtccctgccgtaaaaaaa

SEQ ID NO: 74036 - DNA, 1151 bp, Oryza sativa
gccccaccacctcctcctgctccacgtaacccgtcaccgtcaccttgttctgcttcgcgtccacctccacgctgctcacgcccttcatctcctccactgctttccggaccttcctctcgcacccttcgcagtccatccgaaccttcacctccaccttctgtgtaccattttttttttctagttaacaccccgttccatttcataaaatcataatgtaggaatttatgtgattttacaacttacgcagttgcatttatcgttcaacccaaaaaaaaaaaaaaagctgacgaggaaagatgaaagatcgtagttcaaaaggcgttgtacctggaactgcttgggcttcttcttgagaaggatcttggccggcagcacgcgcagctcggcgatgatgtcgtccacgcccattctctccgatggcggttgttggtatcagtagctcagcacttggaccaatgaaactagccaggatttgggctctcacaatgcctttctttcacaggagggtttaccggtttataggctttccaaacgaagggtatctgatgatcgatgatgccacctttcccaggtacttataccgatagagatggctgtgaaaaggataaacttgagacgcttcttgtgcttctgacgaaaaaacagtgtactgaaaatacaagcagaatgggctgagcgcacgcatctcgcgagtgtaccgtggtagagaatagtaacatggatggacgagtctggattgctctgcatgcttcccaaatcccaactcattagttggaaatggagctctgtccggttgcttctatttggatgtttccacgcgtgataggctttcttttgtgaatcaccttttcgcgaaccttctacgctcctttgctgttttggtcgggccgtgctgtgcatcttttttgtgagatttcattcagttccaccaagcattgtctagacagagagaagaaaaagatctctgttgtgaatcttcctgcatgaagaagccttatacgattcaggctgtgatatatacactacactcgccttcaatgtactatagcacgtctgaaatagctgaatgattttgcgaacaatatagagaaattcacatatataaagttttttgcgaaaatcgcactgttaattcaccattttattcactg

SEQ ID NO: 74037 - DNA, 4877 bp, Oryza sativa
ttggagcaagcaagtgacgtaataatataaatgattgttatatttgtaatgcaattaattaagattattagacctgtaattagacttatcatataagattgtgtagtgttctaatattatttgagttttaatataagattattttattgcaaattagacttagtatgacattattgactacggaattggtgcgactcctaggaattgactattgtagtcttaattagacttagcatatacgcacgaaacacttagcatacattactattttagtcttagcatgtaatattatttgagttttaatataatattactttatttgtaattagacttggtatgtaattattgactacggaattggtgcgacaagtagcaattgactattgtagtcttaattagacttagcatatacgcacgaaacacttagcatatacatgactattttagtattagcatgtaatattatttgagttttaatataagattattttatttgtaattagacttagtatataattatttactagctagggttgtataatatacgtcacctagacttagcttatatcacgatttgtaattagacttagcacgtaaggttgtgtagggttctaatgtacgacatttacacttagcatacatgacttagattgttaaaacataaatgtctcgtgacttagcagatgtttcttgtatcaacagatggctgaccgcgatgaggaacagatattgtacgatacaatcgcggagggaagcagccagtactggaatgaagaagaggggaacgaggatccaaaccagtacttgaacgaggaagggaacgtggagagggatgcggaggggaaccagcaggggcacgtggaaagggatgtggaggggaaccaggaggaggaggctagtggtagtcaaccctccgttggacagaagagggcacgcgggcaacgaggtgcagcgaagaagcttgagggtcggcacatcataacggaagtggaagaagatggacgtcctagtgccccggccgaagccgccaagaactatgtacgtcacagcggttgggttgtgcgggataacgtgcctgtcagtacggtgtactggcgaagaacaagggcacgcggagatcatgagagctttgtcccagattcgagaaagagatgctgtggaccacaatgctcgagacattcacccttcctgcgggtacagaggacaaagtgaaaaggtggactctgaagaaaatggcagaacaatttcagagcttcaagggagatctgtaccagaagtatatactgaaggggcagacaccgaacttcgacacattcccaaagctaagggatcactgggacgagttcgttgcatataagacaggtgaacaagggaaggcgatgatggaaagaaacaaagaaaatgccgccaagaagaagtaccatcaccacttggggtcaggaggctatagcgtcgcgatgccgaagtgggagcagatggaggctagcttgattgagaggggtatcgaaccggcaacagccaattggccggaacgatcgaagttctggtactatgctcacggtggaacgctcaacccagctgatggctcactggtcttcggctatcagatacaagaggctgcgcgacgactaacagatgcagtggaagcctcctctcagggcacgttccgaccagacagagatagggacgagctgacactcgccctgcagactccagagcatccaggacgaactcgagggaaaggggtgattccttggaagattggtttcaaggaggacatccacacgtacaggagtcggatgaggagcaagagagataccgaggcgaagattgcagacctagagttccgggtatcgagctacgaactcaacatgcaagaggaggtggcaaggaaggttgatgaacgcatggccgcacatcggtcccatgatccccagccgaccattcctcctgcaatggtgagcacgtcaggaaaccgtagcagctgcgcctcaacggggcaggtaggatcacagagcatggacgccatgcaaacacaggacgaatcgacctgtcccgttgatgacatcactcagcggacaccatgtgagctgcatattcctttgaagaacttatcaataaaggtaagatttagccattccgctagttgctgcttatatatgttgattactaataaataatctctcacaacatgaaggtggcgtcgggcatggccatcccaacggacccttcaggtacttaccactgcaggccgattccagcaggatactccaaggtcgaagttgagttggtcgaaggcgcgtacgaggacctcgagctggattaccctggaggagacggtgagacgcatctacgagacacatgccatgccattattctatggcgcaggcggtacatcatcctccctgggcgacaagcggcgtctcgtgcaccatctcctccggctccgccatctcctcctcaggatcctgcaccgtctcctcctcatgctccgccagcaccgtctccacctcaggctccagcatcgactcctcaggatcctgcaccgactcctcctcgtgctcctacacctactcccccgcaagctcctcttccggcaccttcaaagtcaagggcccccctagctccaccgcttgcccacacaagggcaacaaagaaggcgaaagttgacgccgccaagatcaaggacccggggtacgattgcacgcaagaggagcttgacgcttacgttgcatcagaagtcaagagacaattcaagcctcgaagtccagaaaagaagattcctatagaccccagtgtcaggaacttcttcaggggtatgtctgcatctgtcaaggaggccatcaagctatcggactatgagcgaacgctgaagaaagcatcttctggaaagtccaaaccagtccctcagcttggagagcaaccaaaccaggagatcgagccgttggtgactggtaaagaaatgacgatagaacaatttattactgacaccggtctaactacggatcaattgctaggagtcgcaccaatcgaaaaggcggaagtgaaatacatgtacgaactcggtaaaccgcttgtcaagcctgagctgctgcagtccctacccacacaaatgtacaagttccatcagctgtacatggagatgagcgccaccggtagagagatgatcggagcgaggatcagggacacggacttcttgcaaggagatgacattctctggatcaatttcaggggaatctacgaactataccagctggacgccctcgacgtctctattatgagttgctggattttataagtatatcgttcagttagatttcttactatacgtctcctttaattaattaggtccttgtatataagtagaccatagaaaataatatactcccttttatcgttgtagaatggagattcaaagggcccgacggcggagggttttcgatactggattcatcgaccctcggaaagtaaacgtcgcaatgctcgaccaatatccacaagaaacagaggacaatctcgtccatctcctgaaggcgcagcattacaagacgttcatactgttgccatacaacacagagttagtttaattttactgtcttcctacataccaaatttcattcccgtacgaacttgctaagtgtttcatatgtaatgcatcccacgcacattgcagattccactgggtgcttttactcatcgacctggaggcctgcaccgtcaacgtatatgactcaatggataaaaaagagtctacgtttgacaaggttttcgaacttatagacaggtaccgtcataagttcctttgttaattaagaaaatcttgttatgttaattgctactacgaatcatagctttaaactccatgtagggcttggtatcggttccgtcatttggtccgcggcaaatggagagaaagacttaggcggaagttcaaatttcctgtgagtacacatgctctacatttatatttctccgattcaaatacatacaagtgtatattaattagatctctcgttgtttgtcatttatttgtagtgcgcaaagcaaaagcagggaactaacttgtgcggctattacgtgtgcgagtattgccactgccttgcagaccaaatcatcaccacaagagagctcgatgtacgtacaaataaattcaaaatttcattacgtagcgatttcttgtttaattactaatcaatttcatacattcatatagtttattcgcatgagggataacctgaccacacacaaggaatttatcgcggcggttcaagaacaactcatgggattcatcaacgaagaaatccttgatcccaagggtgaattctactacgacggaaacacaattcaccggtccttagcttctgagctaacagcgagtactactacgtcgaaatcgtagctagctaggacatataatggattgtaattaatacatgactacatatgttctatatgcatgtgtacacattttctataatgtaaatatattttgttcatatatatatctatatacatatgcatttgcataacatatatatgtataaatacatatatatatgtatgcatatatatgtattgaaacatatatatgaaacatatatatatataataatatatatatatatatatatatatatatataaccatgcagcaacaggggcatgcaaaaaaaaaaaaaggtcagctctatctttagtcccgggtggtaacaccaaccgggactaaagatcgatctttactcccggttatttcacccgggactaaagatagcgatctttagtaccggattggtactcccggtttggaaaccgggactaaaggggggttacgaaccgggactacaaagggtttctccaccagtgtcattttggacttgg

SEQ ID NO: 74038 - DNA, 1096 bp, Oryza sativa
cttccctggcgtcctgcaacatctgaccaagatcatccgcaacgtcgttaccatcagcagctatttcctcctcgcccgtttgatttcctttaaatccaacatactgagcaaagtccggaatattgtcgtcttccacttcatcttcttccatttcaacaccttgctctccgtgggatgtccaacaattatagcttggcatgaaccccgactcaaacaagtggaaatgaatagtcctggatgcagaatactccttctgattcttacacttattgcatggacaacaaataaaacccctttgcctgttagcttcggccactctcaaaaaatagtgcacgccgtcaataaactctttggaccggcggtcagcgtacatccattgccgatccatctacatgagtcaaaaaaaccgcacacaaataattattcttacaataatgacagtcatacaataattataagatatctttattcatacaaaaatcataaaatattacaccaaataattcttaaaaactatttgtaaagttttaaactaattttaatgtgtttaacttctttaatttttattttaggttggtttctattatttaatattaactttcactagagttttccttctcaactattatataaaccttgtttagcacatgaactaaatttctatatattctttcttccccacacacattttctctctcatcaacttacaactaaattttggagacaaaaaaagtgtgcaaaacataggtgcatatgtagtatgacaaaaaaaacattggaggatgaagttgcaaaccttttaggcacctccgatttgtatgtaatcaccaaaataaattcaatagaaattttggcatgacctcccctcttttttgaagaaattttgaagcttgctcgggtagctggaggaggaagaagacatatatataggggtgggactttagtcccggttggtagcaccaaccggggctaaagatcaccgggatcattagtcccggttggtattaccaaccgggactaaagttaagatctttagtctcggttggtagcaccaaccggggctaaagatcaccgggatctttagccccggatggtg

SEQ ID NO: 74039 - DNA, 2477 bp, Oryza sativa
  unsure (1)..(2477): unsure at all n locations
ttcctgcagccccggcgccctcgcccagccgcatgcagcacgagagcgaggcgagctcccccgacgccaccaccccatgccagtgtgccaccgcccgacctcgccggctagggcaggaggcgtgaacggcaccagcgagcccccctctcccttggccctccgactggcttcgccccccctcccccctctctgtccactcctcctgaagtcggtgacaacaaggtgatcttccttgtttctatcgactccctaccactggatccaccaccattagccactagcccactacctcttaactagtcgctttgttttggccccgcagccaatgccagcccaccgccctccttcatccccacggtttcgggggcgctactttgttgcccgcccaattccaccacctactaccagtcttccgccgatcacggccatctctgtaaagctggcggactccccctcttccccctcttcccacccctatcaccccaaccccaatccggatcctaaacagttaggatcgtcgttgttgtccgctagagttcaacaaggtcgttagagttggctaactggagcacggatggcgaagcagatatgaaggttagaagtttgtaagattttacctcctttttttcctatcgaatgtcgaatgtggtttagtaattcaacttattaaaattgtagcagctggaattaccggtttaaccatataaagcttggaattgataggaagtgaaactggagaccagccggtagagggtcgcatccgcgaaaacactgaaacgaggcaccggaaaacacacacagatcacacatgttatgcaagttgtcaaagaaatgttcgcaaaaacaagttgtcaaagaaaggccgaagagatttcttgaaaatgaaatggtttaattggcttgtttgagtgtcacacgggtttgggttgaaccaccgaaggcctacatgcgtagttgggtgagcaagcccaaggatggaaatttggttttgggttgaaccaccgaagcccgaaggcctacatgcgtagttgcgtgagcaagcccaaaggatgaaaatttgcagctcaatcagacgcacacacaaacattttttttttgaaaagaaaagaaaacacacacacaaacagatgaaaatttgcagctcaatcagacacacacacacaaacagtaaggtagcgtaacaggtccggatttagttttcttccatgcatattgctctagtactccctccgtctcattttaagggcaaccataagtttccgcgcctaattttaatcgtccgtcttatttaaaatttgtttataattagtatttttattgctatgagatgataaaacataaataatactttacttgtgacttatatttttaatttttttcaaaatttttcaaataagacaaacggttaaagttggacgcggaaaaccatggcgacggagagagagtagcatatagagagcaccacgcttttaaagcgatctcatacttctagaatcagtaagatggtactaaattttacgtgcatttttttgggcctttgagattttttttcagaaattattgtctaactacatgggcttgcccatataattccaacagtcaaagggtggtgtctagatgaaagagagtacattaattaaatgtatattaagacgcatcaacaatgcatagtacaaagagatatatttgtatagtatccatgatgaagaaactactactagctagcacgtacacatttcatgatatacgggaatactcgtggaatgcaatcttcagtagcaatttcatatcatttaataatgattgccttggatatattgcaacttaatttacatccatcaattagcaactgaacaatcaaatgaattaatgatcccaataaacaatgctcgatcttagagcgctctagcttaattacaaatgaaaacgaagtatgaatgctcgatcgatcagacattcacatttcagacgacgatcttgatgttcctgatgtctgaacatatatagcttagtagtcgaactgctggtaggtgctgaaggtttgcccgaacgaccaccccgccggcacgacgctgtcgaagacgatggtctggccgccggtggaggtgacggtgaaactgagcgcctgaccagccagtccggcgagacactgccaattggcgccccaattcctcgacatctgaatccaccccgtgcttgagcccttcaccgacatgctcgcgatcgacccgctcccggccatgttcgtcaccaacaccagctcgaagtagttcaacccggtgatggtgaatctcactcccccacttctccagcacttcacccttcaatataatccatcacaccacaacgtgttaactatttcatgatatcatgcatatatatatatatatatatatatatatatatatatatatatatatatatatatacacacacacacacacacacacaacttnttcgttttagagtgcttttac

SEQ ID NO: 74040 - DNA, 2958 bp, Oryza sativa
ttgcagatgatgaggtagcattgcccgcacgacgccccgttgttgaacagtggcgtgctcagcgccgcgttgttgatgccgtagccctggcgtacagattcccgtacccgcacgcaccacctgtttgcacacatatgcacatcagcggttaatcccatcgagaccatcccatatgcacttgttccaacatatatattccatcagattgtgtcttgcattatgcatgatgatgcattgccgtgcaatggttgacacaatgcgatgcgagaggaaatggagtagacgacgacgacgtacccatggtgccggagccgtcggcgccgccgtagaacgtggcggtgccctggagccagccggacctcgccggtgcaatgcagagtgcaagaatcgcgagcagctgcaggacaatgttccccatgatttcctgtagctatagctaggtctcctgcgcaggtgcagctagatattgttgggaagaatggatttggaggtgagggatgtgtgcggcattggtggtgcttaaatagtagtaataagatctaggaggtctgaactctgcagagaggcatggattgcataccaattaattaagctagggaatgattgtcgttatgcattattgaagcatgcgaacactgttccaacgatcgcatgcacatggctctgcaaacgccgagagattgactaacgcgtaatgatgcatgattggtttgctggtctaagctctactgtcgtcagaaactgtaagtcgtaccttgaaactgaagtttccaatcgagtagttaaaactgaacagaagtagttgtgacttgtccgcggggaataacagaaatgttccgaacagcagaaatgctcttgatcatttacgcacgcgaatgtcgtttctgctagccatcacgcaagctatagctgaattgaatgttagccatagagtctttctaattacatgtcatgttcacactgtttccgctggctgaggtaacaaactataatacacccttattttataatacatagcgccgttacttttcatataacgtttgatcgtacgtcttattaaaatattatactaaaattagttattttgtggtaacttattttatcatcaaataaatttaatcttaacttaaaattttacatatttatattaaatttttttgaataagacgaatagtcaaatattataaaaaagtcaatgacatgatacatttaaaaaaggagatagtatttccattttctacagatcggaaatgaaatcctcaatcagaaatatttcacgccaaaaagatgcatccgctcatttactggctacctaaattcttttcttgatttttttattagtaccggatattttaagttcttaattggataagcaagtagatggaatggaaagaaagtaggaatatttcatttcttaattaattgttctttcagtgctgtctaattaactacaggctcaactcccttgaacccttttacaaccgcagcttctttttcctcttccaagttccaactactcattatctaaaaaaaagttccaactactggcgagacattgaaatagtcaaataatttgcatcatcttgttcagtgctcgaggtcaaccaacaagaaccgtatgatcaatatagtaaaatacaacattctttatgaatttcttgttctgatgagttctagtgcaactagtaattaaacggcatacgctgtgagcacaaattctgcacatactcggaaataccggttggtatgttataccttgcttcgttgagtacataactaaccattttgttcattatgggtatccgattcacatctgcacccgccattgcaatcataattatttgagtaatatagcacaatgtttatcatttttttgcataatcaatttataccacatttgctccaaatataagcacttccgtgtgtttcctaaaatatatctgaaggaggacgtctagtttttttaaaaaaaaaacgcatagaaatagttatattttggaacaggcaacaagtattaaaccatcgattaatacactttcaaggttgatagtacttatcgtctttgacaagaacatgatctcaaaaaataatcctgaccatttttttctatataatatacataaaaatatcaacaaatatatgattttattgatgtacatttgaagtctaatttacacttatggtctctatatttttaagacaaatattttagttctggtatgttggcaattgtggaaggaacgaaactccatgtttactctctcttcggtactagtggttctagagtctatggtcgttaactggtgttgtttcttttggggttttcttgatagggtagtgtaacgctccgcttttcgtgagacattaaaaactaattcggcaaaatcctaattgcgaaaattttcgttttttgagtgagagtctaagtcgtgccatggatctcaattcaatcccgttgttccctctcatcgaaatcaaaatcctctgcctcaaatttcctcttccaattcaagtctccgaaatctaattccgaaagtcaatcccttcctttgaatcctcgtcaaatacatttccgaatcccaaaatatccaaactcctgttttgtttccttccttgactccttgaacccttgtgtacaaagtatcaaatttagattcaaaacccaaactccaaatctctccaaatcaaaatctttcagcaaaagtctatgcctcccttgtcgatgggcggattcctctctctcccggcccatcccctcctctcggcccagctctcacgcacgtgcgtcgcacgtgttcgggagtgagagacagcgccgactcctttctctctctctctcgacgtcgcttcccgccgacgccaccccaaaattctggccgcgtcgccgtttcccgcgcgctcgcgcatggccgaccggcaaggacgccgctcccaccgccttcgcccttcccgcgcagg

SEQ ID NO: 74041 - DNA, 7237 bp, Oryza sativa
ttttattctatgcatgttaagcaggtgtttgcctaatattcagtctcagctttaaaaagaatttgcaggggaaaactggctcccatgacttttcactaagaagaaacctcagccaaagccagccgagaaaggccacgaaccctggccccttgacacgtggatccacaccccatggttcaggccttaacaaatgctttgaggcccctgccccatacacgagggcccacccaccataggtcgtttcttaacaagtgtttaaaccaaggggccagcgtgtgatgtttcttaaaccaactctgaaaattcgctcccgagtagagtcgaacccagacactggttggtgctagtagagtgctgcaaccactaggctatagacccgttcgttatccattcttagtttcacatttgcacatatgtatttcattgtggttcagacttagaagaccttttacctttattgtttgtataaagttggtagtatgtctgtatgtgagaaaatcatatttttaattcccatggtataggaggaggttattaaagtggtccaacattggtcatgaagtggctgggattagtttttagcataagtgggtgataactgagaaggcccaatagcagaatgggagattccttggatgtcgtcagttttcataaacaagcactcgtctttcgtcaaagggtggtagcgttaatgcctagtgttgatttcatatgtatcagcatgacatgctaaaatttgataaattttgttcctatatgttcagagtgactatctgaggaggctttctctcagaatgctcaagttggagactgagcctattcaactagggcatcagcaggcagttgatcaatcttccgagtccaaagttggtcagtacccaacctcaatgcttcaacaacagaccagttgtgatcagcagagtctatgcattcaggtagataccaagctccaggagatgccaccgaacggtaagttacatttgaatttctagtttatagggaccatttgatccataagaaatagaagtaatatctaacctaaagaaactaacgatcccaagataagcacattgatgtgttggaaggaaactcaccaaacatgaatagtacttgtggtagataataccgtgctgcgtgcacataacacaaggttgttgttctgtttatattgtctgattgcataaagaaacataaatctggctaaggttaataattgatcatttggagtcctttatatttattgttattgaagccacaaccatctaataactggctggtatggttgtagtattatcgctggaatgtatatttacatagggaatcacatatacccagataacaggttaagacctaatattggcataacatctaattgctttagtcttttatcctgaaaattgaacacttgttcttactgaaaacagaactttgatggatgtctttattgcagaacacttgctcgaccaagttcctccacgaagccagaagaagctctgcatggatgacaggctaagtgaccttcctgatacaattctacaccatattatgtctctcttatcagcacaggaggttgcacgtacgtgtatcctgtccaagagatggaaggagctttcggcctcagcaccatgccttgatatctgtgtagataagtttggaatggacagggtgcggttcagtgagtttgtagcacatttgctgctatcccgggctcctaattcactgcatacatttcgtcttcactcttttgcaatcgaccatgccagctcttggatcaatcgtgcaattgagctcaaggcacaagtgcttgaattcaccgaatatataagatgggaatctttttacttggatccacagcttatggcttttgcatctcaatacctgaaatgtttgaagctcaccaatgttactctagactccaatgcgtttgaaccgctaaaccatgcatgcccagctttggaaaaccttcagttgtcacagtgcttccttgaggtgcctgagatttgttcagcttcattgaagaagttggatattatggagtgttctcttttgatgaatcttcaaattcagacccctcgcttggtctctttacgcttcaggtgtcttcaatacaaatgttcttcatgcagtaggtatcctgtaattacagcagcagtgactctatgtgatcttccgaatgccgagaacatagacttgtcatgttctgggagacaggtatgattgtgatggtgttttcaccctctttacattcttttcgcctgaattatatccgtgaaaactgcatttatctgttgtatattttttgtatgtttgcaaggttacatttggcagagaaattcaaaagttcccgatgtatggcaaattaacaagcatctctcttggtgaatggtgtctttctgacaagttctctcgattattttgcctccttcgacactcacctgaacttaaggagcttactcttaagcttgaggtgaacaatatcatagatgtatagttctggctataagatacttttctcttagcacattacgcaaagtcttggtgaaatgtttttaagtagcacttttccgaacttcaggtggaacgtcaagaccacaatggagaggatgagattcgcttgatggtgggaagatcattttcagccgaaaatcttaagaaggtaacaatctgttgcgcggaaggtgatgcaagggccgccatgttgggaaatatgttccgtgcgaatgcaacatctctcaaggaaatgcatatcaaacactattagatgctgaacaacgcttgccttgtatctgttggatttgatttgccagtggagacctaaaaatttagggacaattactcatttgatcctgttttgaagtctaactaccaatgacactactttaggtttgctcatttgaatatcaaaattgaccttatattgtgaaaaccaaatgatagtgttaactaaggggcgaattgtccttttttttgccccacctcatttgatcatgttatatcaacacttttttttattaagagcattttgaaatgtttgtaatgaatttggcatagctttgataattttgaataagtttaacggaattgtcttcaatttgacaagtttgattcaatttaacatattttttttttacaaaatttgaccacatattatccaacagcaaattcaagtctaaacggatgcccaacagcatgtgacaacaccgataaatccaacagaagagagctctgtccagcggtagtgatggtgcacacagagcagcaaccatcgccgcttctcctttctccatgtgccgcagccatcgccatcccacccttctcgctcgctggcgccgtcgatcctccgcgcgcagcaaccgccggtccggcgctgtcccctccgagcgtcgacgctcctctgtgcgctggccagccgcgttgccgcaggcccgcagccattgccgtccctcccttcgcgcgtcgatcggcgccgccgctcctccgtacgtagcagccgcgcgtatccccttcaagcgtcgctgctgccaccgctcctccacgcggagcagctggcaccgtcccttccaagcgccaccgctcctctctgcgcggcgcggccgcgtcgccgatttatatgtttggatagggttcgtataaccataggtattttggtcagttcacgctagcaatttggtcagacggcggtttcaattttgaaaaacgtggttaaatgagaaaacaaaaaaaaaaggtaaattaattattagatctcaaaacagagtcaaataagtaattgccaccaaaatttatcctcatacttatacagtatcgtgctgctttgctgctttgcatccacgcactttttgcgactaagctgaggaacaaaaaggattctctaccaatgatgaacaaaaatgtaacaagatctgcatatctaccatgcaagagttgtccagaaagatcgctaggagacagagttggggaatgctctcacgcttcaacaagaaggataccgcagtctcgacgatcaccatgcctcaagaggtaaaaccagaggtaagtggttttgtctcgatcttgaacgaaaaattgctcatacgatagatgcatccgtcaacgctggtgtagccaataaatttgatgcttttagcaagcattttgaacatatgatggagaggccacaaagtgagacaaaacctacattacatgatccctatgcatccatcacatctctatttcaaaacctttttttttaaaaaaaatcaacgcgctaaaaaaatccaccctaaaaccctaaattgtatattcctatagaatttatttagaggagaaaattttcggattgaaatttataatcaattatatatatttgatggtaaaagaacaaatgattggagtatatatctaccactttaaaaacacagtcattctccttccatccttttatcaccatcaccaccgtgtgctaacaactgtaggatcctactttcttcttagtctacacaactaattcctagtaatatgggcttagcccgtgatctatggacacattgtgggtgcaggcaatggcgtatttggttgcctgcacgcccatccgatctaggtccagcttgtgcaaatcacacctcgaagccaggcttggaggaaacacggaaattggcttaggctagagtatgttaagtcatgcatgtgaacaactagttgattgtctaacaaaggggttacatcctagtgaaattcagtcaatatgtaataaaatggacatgattgatatcttttgcccatcttgagagggagtgttgatgtaaatatgtgatgtgtctaggacctatttgtaaaatgttcagagaatagaatagagaagaagggggtgtgcaggagaagcaacccaccctgaaaaatcccccaatcgagcaagaccaatgatgcaactatttttctgaatccactctggcaggaagtaagagtgataatatatctggcctaaagaaattttctgaatatagcaatttacccaatccgatcgatgtactggctttgatatgttagaaattctaagtaattttccttgcaaacaaaagccactaccttgcaaatatttgggacttcctttgagatgttaattgacataataggagaaaagactagcagactgggaagaaaactaactttgtttgatcaggtcttgcgaactgctatctgaagctggctgctcaattctgtgccatataagcgttgccaacataatgtaggaacgctaaataactggaattaattggaatggtcactgtgctagaacatggtttgttgtccaaaagatctaggcgatctggacattgccaatccgaagttttcagtagagccttgcaacttagatggtagtggtttgaattttcagaacccagaagacaccatgggtggggtcccggtgcccatgtgatgcaatttgatagttccttgtaacaagttacttgttctctgcaagcactagcatcacaaattcataattcgaaatggtgaacatgcatatgcttttggacagacagatggattcaagaatgtcaatcaccaaatgaactagaaccaaacttgtctcttctttcatgtaggaagaagcgaactgttagagaggcaatttacaaggaacaaatggataaggagatcatatagaagtaacaaatgtttggtgatttcctggcaatcttccattgtggacaaaattgcaaaacataagtttcatgggtcatttggcatcatctgggatttatatgctagtctgtttcgcaaacatgcctatctactgtctgcaagctaaaaacagagcaaatatgcaagttctttgtggctattattgcaggagaaaatattaacagccgatgaactacaagctagaggatggctgaatggtgatatttattctgtgatcaagtacaggaaactacataaatatttgcttcttcaattcaatgactattctctccaaacaagtatagctcaagatatatgattcaagtggtaataacctgacatcctgatggaatgaatcaacggtatgcaaaaatagaagcaatagagacatttgttgaggttttttggaacggaaaagcggcacaagatagtgccttttcattgaataaaacaggagaaaatacaacccctaagggtaaaaaagaaaagctgttacacgtaatatgtacactatacaagatgtggggcgaactctcgtagacgcttggcccctgccagaacccataggccaacctcatctttgatttttgttagcagggagctcgttgccatctctttatggtcaaagatcctctgattcctctctttccaaatctcccagacaactaacaggataagggatctgagtcccttacatttgttgaggttttaactcttagctatataggtcttctttcattttgtttctacttgtaataaactttcttccagctatatggaattatggattgcatagccatctttagaatggttggtttaaactttaaaatcgactgaaaatagtagaaaaatgtgctgccatatgcatagatagttccataaaatagacgtgacatgtacctttactatacctgcatgtcttccccgcttaatgatatctaatttgtcatctaggagttaagaaaacaagaatcacagtaaattaaagtagttatttctctcacttattttttataaattcagaaaagatcattaaattattactgcagattgaaatactaacatacttcatatcgttgtacgtgtgatcaactgaccatgcaatgtgtctggccttttcactactgaaaaaaatgacagtttatccggccccttttttcaaaatatatcaaaaaaaagttacttcatttgttttaaaatatataatgttgttaacttttaaaactgacttttatcattcattttataaaaaaaataactatatgtaagtattccttccatcctaaaatatttagctatccttctagttcaaatttgattattcgtcttataaatgtagctatattttgagttggagggaatatcatttatctgtgtttctacaatagttgaaagtggtaaatttaccttaatctatctaagtttttgcatgaacagagtttgtctgttcgtacccatctcagccgtcagtctttttttcttttttcttctgatgattcgggcccattatatttcgacgaggacgacgacgagcctgtgtcgcttcatagcttcaccattcccaggcacgcat

SEQ ID NO: 74042 - DNA, 2832 bp, Oryza sativa
tcatcggtctgtatgcatcataaaatgtgtatgtgctagtggtttcttcggccccgtttggcacagctctagctcccaactccaacttacctagagttagagctgtgccaaacggtacagatcctccattttttgagtggagctagttgagctactcatagaaaatgaactacgggggttaggggtggacagaaaaagaccgaaccgaaaagaccgaaaccgaaaaattcggtcctaggtagtgaaagaccgaattttgttcggtcaatttggttagtctcctcggttaaccgaatagaccgaaatatcaaaaaattctaaatgcaacctacaatccactatatttaataggattaaactctaattttcacatccctacttcttctaggcatgcaacctaataaaagtctttactcataagtgcttaacgaatttttttgtgatttttgtgttgaaaatttccattttttctttgcatatatgaaaatattgttgaatttcggtcaggagcgagaccgagaccgaatttatcggtcctgactttttgcgctgaaattcggttttcatttttcaaagaccgaaaagaacgaaagaccgaagaccaagaccgaaattttcggttagaccgaatgcccacccctaacggggatggagctggatttttgctgctccacagctccactctaccccaaaagacccactaccctttaattttttagtctatttatacaaaaatgccactcaactgctctttcagtcctcctctcctcccccatcttcctcccgatccaaaccgagctgcatgcggggagcggtggcgtcggtgggtagcggcgacaggccgaaggcgcgcggaagacgacatgcggccggcggcggccggcgcgcctggggacggcgcacggccggcgggccggcggcggatgcggaggaggatgacagagcggcggtcttcttcaacccaggcatgggctctgggcgcaagggtggccggttgtttgtgcctgggtgtcacgccccgaactagtcccgaccggaactagcccgtgacgctccaaattaacctgttaatcgataccagtcccaggaaacagtgttggtatcacagggagacagaatatcacagcaacagaggtctctttattatagagtaggagtacagtcatgttgggctgcggacagatcccgagctcacaactgcattacaaaagggaaagcggaaaccaagacttgggccaaacatcacaggcgcgacttgggaactaggtcgaaaccctaaaactcatcgtagccgacttgctcctagaagaactcctcgtcagcgggggccacatcatcttcttcagcaactggggggggttatttatatagagcaagggtgagtacatgagtactcagctagccatgggaattaagtgtttaatgcaggcttcaaaggaaaggctattgtttttgcaattgattttatttaaactcttttttgaaacgactaggtgagtgcttctcaaatgacacggatgagacagtgcgtctcgtccggtcggagtatgtgcaatgtatcagtctttgaattgatcaaggttagcacccggccaacagctttcaaacggccacccgggcctggctgatcccatcagccgccgattttccaaacatcgaacccattccacagcagtaatttcacaagcagtagtcaaacaaaactacgctaggaatcacctcacatccgcccatgactgtgagcacggctgttcgaacagtttgttaacctctgcagagggggtacaccttacccacacgacgttactagccttggtcacccagcccgtgcataacagccacgtctggtgactttggggctttcacgacaaggcatttcgaaagccgacacaggttcaccgtatgccaacgagaggggtcccagactaacaccagattaggtcccagaccatactgtgccaggaagcccgggggttctccccgacaccaccccgttgaatccacatgtctcttggcatcaaggctcccccgattagcaatttactcagctaggggtgtcccatttcacccatgtggtcgcacttgtcttatgttcggatgtaattccaaggaaacggtccttaagtgcaagagcgggaaaccgtactcccggtacgttccccggtccgcgaatttgaaaattcatttagttcgcaagagccgacccaggtgtcgggtttttccaagtcttttgtaaaacccaagttttacccatcattggatatttttaaatttgaggagaggtgtcccgatgcgcgtgcttgaaggcccgtgcatcgaagcacaacagtcgacaaagggggtttaagtgttcaataattcaaggagggtaattgcagcaattaggattggggggccggcaggttatctcgcaagccacggccgaattacttgtgtaaatcctattcatgcattatttgcggaaaagaaatacttagatttaaattataggtgcaagatgatcaaaggtgacttgccttgctcgagatcttgagcttgatcctcaaaatcctcgcactgcgggtcttcgggctccgaaactacacgagaaatgggacaacacaacaaacggcgaaaataaagccctactattgacctctaggcgtgccattagatagatctcgagatttaaggaattttggaagttgaacggagtcaaacgggcttacggttgggaagatattgaatttctaagattattggattttttgtctaaaggaaaaggatttatttaaatcctttttgaaaaaaaaaggaaaagaaaagaaagagggagggaaattagacttcgca

SEQ ID NO: 74043 - DNA, 6879 bp, Oryza sativa
  unsure (1)..(6879): unsure at all n locations
atttcgacgaggacgacgacgagcctgtgtcgctccatagcttcaccatccccaggcacgcatcctcttctaacatattccgcggcgccgccgacacctcgtgcattggcgccaccacgcccacgggccgcctccgccgacgacgaggacgacgacgtcgacgcccttactacatgctcctccttgccgttgctcttctccttcttcgggttggccggcggcgctttgccttggtattcttcctcctcctcctcctcgttgtcgttgtcgttgtcgccgcggccgcggctcccgttctcgtggtgcagcacgatgaagccgatggggccgtcggggtggtcggactgctcggcgcctctggccagcctccgcgaccggaacgccagcagcttgacgacgacgtcccgtgtccatctctggctgtcggagatggccatgccgttggtctcgacgaacttgccccacccctcgatgaaccggtagccgccattggactcgaggtacctgcaggtcatcccgtactcgttgccgccctggtcgaacaccgtcaccttcagccccagcttctccctgatctgcttctcttcctcctttttaatctccttcttcttctcatcctttttgatcttcttcttcttcttcttctccactgcgatctcgtccttcttgtggacgatttgcgtctccttgtcggtgaagagatgggtgatcgggcattggtcgaggtcctccttgcgcttgcaggagaagagcagccggttctggttgcggtggacgtcgctcatacgcagcgtcttctcgcagacgaactccggctccgtcgcgtcgagctccgagaggcgcctgcgtagttgcgcgctgcaggtgcctaggttgcggaaccggtcgtcccgccgcgtcttcttcctctccggcggtgctgccgcggtgaccatgtagctgatgatcctcctcgtcgncggtgatctgggtggtggtncgncgncgncgncggcacgaatcccgtcgtgcatgagcttctttcgcggcggttcggtggtcgccgttgatgcttcaccggagactttctgcttcccaagcttgatgttgcaccgacgtaattccctttccagggtaggcccgtcaagacgtggtggttgcggtggtgctgccgtattactactacctgctgcggccggagctccgccgccgtcttccattggagtttctgagacgggaacggcactgttggtttggtcggaagcgccgccgccgccatgtcggagatccggcggaggcagagtatctcgggacgacatcatcgtgtctcgtacctgccaaaattttgaatcgtcaggattccatgtgtagagagggagacgatgagacagagacagagtagaaaaggcgagacagagatagagaaggcgaattaggtaaatcctgtaaaagtggattaaagcgatgccctttgcctcgggtcgccctgcgtgttatataggacaggaacagcccctaccgtggcttgttacaacagaatccaaagattacaaggataggattagatcagaacaaataaactacatcgcaacaaccttatcaggtcacatgcgataacaaccaaaacaaccaaaaccaattctatctttaacaccccacctcaatcacaacttacccaagttgagattgttcttaaacatctcaagccgtcgaacaggaagagcctttgtgaagccgtcggcgacttgatcatcagttgaaataaaccgaatgtctagcaacttttgtgcaacctgttctctcacaaagtgaaaatctatctctatatgtttagtccttgcatgaaagactggattagcagacagataggtggcaccaagattatcacaccataatcttgcggcatttggttgttttattccaatttcatctaacaattttcttatccatattacctcagccgtggcatttgcaagtgccttgtactcagcctctgtgctagacctagacaccgtcgcttgttttctggcgctccaggaaaccaagttagaccctaaaaacactgcaaagcctccggtggatctcctgtcatcaacacaccctgcccagtctgcgtcgaaaaaagcactgatcaaagtacttgctgatctgttgatctttagtccaagacttaccgttccttgtatataccggagtatcctctttacagcactccagtgatccaccgtaggttgctgtaaatattggcatactttattgacagaaaaggaaatgtcaggccgggttagtgttaaatattgtaaagcacccacaatactccgatattgtgtggcatcattctgtcccagaacagctccttgagttgatgacaacttttctgaggttgataaaggagtgttggttggcttgcacttggccatgccaactcgcttcagaacttctgtagcatatctctcttgggacaacactagcccttgggagtttttcttaacttcaatccccaagaagtaatggagatcacccaaatccttgagagcaaaatccttctcaagatccttaagtaaagctttagtagcctgaggagatgagcttgcaacaataatatcatcaacataaactagtacaaacattgtataggtaccacggctatagaaaaatagtgatgtgttagctttggaaggtacaaagcctaaatcctgtaatttcttactcaggcgagaataccaagctcgcggagcttgttttaaaccatataatgccttgtccaatttacagagataatgtgggtgtaccttatcttcttatcctgggggttgcctcatgtagacttcttcttccaaataaccatgcaaaaaggcattctgtacatctaattgtctgagactccaaccattagaaacagcaatagatagaataagtctgacagtagcagctttaactaccggactaaatgtgtcctcatagtcaatcccataacgttgcttaaatccttttgcaactagtcttgccttatatctatctattgacccatcagattttcttttaatcttgtatacccacttacaatcaatcatatttttttcttgtactggtggaactagatgccaggttttattatgcatgagagctgtaaattctttatccatagcaaccttccaatttctattactaacaacttcttgcaaattgacaggttcacctgtttctatcaaaaaaccatacctgacagttccattagtgtactccttgcgtttccggatccctctctgtgcacgagttactggcccaactggtgcagtgacagcagtctcttcaggtactgcaaacgcctcagtgctagtctctgggtcctgtgtactatctccagaattggttgccgcagacgatccaggggctggctctccggtcggcgtgccagagccatgtgacgaagacagctcgggctccaattcctgcatctgcccttcaccaaccggagaggctgcttcatgaaggtcagcgcctgctgcacctgctgttggctgacgtgcatctgctgcctgctgacatgacggagactgctgatgtgatggatccatgctgccttgtgcgctagaagctggctgtgcatcctgcatgaaatattgcccgtttgaccttgtttctgcacctttgaagctgaaattttgtgctgcatttgcatcaccatctcccgagttgattacagctgcactaatctcatcattttggttagtgtcagggttaggattattaaccagtggttcaaccaacaattcgcccccggaaccaaaggatgaggagggttgcaagtgagatggaagcagaaggatttcagctctaagtttggcgccagcattagtgtgaagagaagcaaacggataaacctgttcatcgaaagtaacatcacgcgagatatatactcgtcctgaagatggatcgagacacttaaaccctttgtggagagtactgtaaccaaggaagacacatcgttttgatcgaaaggagagtttatgggtgttgtagggtctgaggttgggccagcaggcacaaccaaacacgcgcaaagcagcatagttgggtttgacatgaaggagacgctcaagaggtgtagtatagtcgataactttgctgggtgttcgatttatgagataggttgcagttacaaacgcctcatcccagaatttaagaggcatggaagcctgggctaataaggagagacctacctctactatgtggcggtgttttctctcggcggctccgttctgttgatgggtgtgtgggcaggaaacatggtgctctatgccaatgcgctgaaagaaggtgttaagccgctggtactcacccccccaatcggtctgaacaaccttgatcttgcgttcaagcagccgttctaccaggttctgaaagtcacgaaatttttcaaaaacttcagatttgtatttgaggagatatagccatacatgcttactataatcgtcaatgaagctcacatagtaacttttattaccaactgaattgggtgctgggccccaaacatctgaataaactaaatctaagggaccagcagaaacactggtcgacttctgaaaagggagctgatgacactttccctgttgacacgcatcacaaaccgatgcttgactagaatcaggaattacagggagattattctgactaatgactctattaacgacagcaaaagaagggtggccaaggcggtgatgccacctcgccgttgaaggcttgacgacactgtgagcttgcttattcatggaggtagagtggctggatggaagtggataaaggcctcctctacatcggccttgaagaaggagcttcctcgttgccagatccttgataaagaagacatggggataagtttccataaaggcatgattatctctaaggaaatgatgaacataaactaggttcttctgcgcagttggtatatgtaagatatttcgaaggagaagatttctgtttgaggagcgaattgtagtatgacccacacagttaatatccatacctgtgccattcgcagtgtgcacttgatcattgccgttgtacttctccttcaccgagagcttctcgagctccccggtgatgtgatctgtggcgcctgtgtccaggtaccagttggtgtcgactccgtaggaggtagctgcgccggccaccttctcttctccagtgaaagaggtatcaaacctcttccagcacttgatgacggtgtggccgatcttgccacacagctgacaggttgggcggtttccattgttcttgttgtcgttgccgcggccaaaaccgccacggcctccattgccacctccgcgtccgcgaccgcgtccatcacgccctccgccgccgccgcgccctccacgcaacatggagttagctgaggactatgtgtcgccttgaaggagttccatgcgctgctcaaagctcaggagcaacgcatagagttcagccaccatcagaggttccactcgtgttgccacagaggaaacaagtgggttgtagtcgtagtcgaggccggcaaggatgtaggagaccagatcttcttcatcaagaggttttcctgtagtagctatttcatcagcaagagatttcattttacttacatactcggcaacactcttgttgcccttcttggtggtggagagcgccatgcgggtgttcaggacccgcgccctggactgcgacgagaagattgcatctatggcttcccacacctcagaagccttggtgagagttgcgacttgaacgagtatgtcgcgcgagagcgacgacaacaggtaactgaggacctgttgctcttgtgcaacccaggttgcatacgctggattggccaccttctcggtgacttccttcccgtccttgtccttgcttgccaccaccagagttgtcgccggagcgacggcagtgccatcaagaaatcccgccatctgagctcctctcagtgtggcgagaacctgtgctttccacagcacatgattggacttggagagtttctccgatactgactgcccatggagagagggagcaggaacggaggacgacgaggccatagattgaaactgggtggagggagaatggctctgataccatgtaaaagtggattaaagcgatgccctttgcctcgggtcgccctgcgtgttatataggacaggaacagcccctgccgtggcttgttacaacagaatccaaagattacaaggataggattagatcagaacaaataaactacatcgcaacaaccttatcaggtcacatgcgataacaaccaaaacaaccaaaaccaattctatctttaacaaatccctgttccgtacgtatcatccgcggggacgaacctccgcacggccgaagaggcaatccgacaccagggttgtgggattcaattgcagagaaatcttgggcctcatctaaatggacgcgaagagacggcgcggtggcgcatcgacgtcgacggcgacggcgacctcttcccatcctacgtccgcgctctccgctgccttctcgccgttaacacatcgttttcttcctttctctctccggcgctagggtttgcatcggcgctaggctagggttcttcgtgaaggagctccgggagcggagggggaggggaagaagaagaaggagcaggcgctggcgccgctcgccgccgcgctcgaggcggcgctcgcgctgctccggctcggccgcgaggggagccgaacattaggtttctttttttttttgcggggaaacattaggtttcttgatttcttgattaggtgaatttctgatggttgacagcgggtgtcctaggtgaactcggttcttgatttctagggatttttctctcttaccaatttcgtaacttaaaacttataatacgattgaacaccctgagtttatggg

SEQ ID NO: 74044 - DNA, 891 bp, Oryza sativa
gggtttcttgatttcttgattaggtgaatttctgatggttgacagcgggtgtcctaggtgaactcggttcttgatttctagggatttttctctcttaccaatttcgtaacttaaaacttataatacgattgaacaccctgagtttatggggtctgctggaccatacttgtttgttggtcgccaccgccgccgccgcaagcagcaccgccaccactagcaacggcagcatccggtggcacatcatctctaatggcagatcgatcgatctgagctctaagctgagctgagctccttgtcttgaagatgaaggggacctcacctcacctcaccctgctctgtcactctggttgtctctgctctgtgtttgtctgcaatgataggagctgtatgtatatatactccatatctcttgagatctcatctcagctaaagcctcagcatcagtaaaaggcagtaacttcactgtcaaaggttggatggccagctgccgctggtagatttacagctttgttgttgaaaattttgtacacatatgcaaacagccatactttgtctgaagaatagaatgagacaaattcactgcctatttttattcgggggtaattaacttcagtttggtgatgatgtacagtgagacaaatgcactggttttttatcaggggggtaaattatcttcagtttcatgatgctgctactcatttgtaactgtattagttatcaattatcatagcttgcatcaaagaattgctttaatcacaaaaagttgctctgctaatgcatttctgaaactaggctgactcacatggagagatgccctctatcagtttattttcatattatcatgcttcaataataagtactacctccgttttttaatagatgacgccattg

SEQ ID NO: 74045 - DNA, 3551 bp, Oryza sativa
gcaagggtgaccggttgtttgtgcctgggtgtcacgccccgaactagtcccgcccggaactagcccgtgacgctccaaatttaacctgttaatcgatgccagtcccaggaaacagtgttggtatcacagggagacagaatatcacagcaacagaggtctctttattatagagtaggagtacagtcatgttgggctgcggacagatcccgagctcacaactgcattacaaaagggaaacggaagccaggacttggaccaatcaacacaggcgcgacttgggaactaggccgaaaccctaaaactcatcgtagccggcttgctcctggaagaactcctcatcagcaggatccgcttcatcttcttcagcaactgggggggaattatttatatagagcaagggtgagtacgggggtactcagcaagccaggggaaataagtgtttaatgcaggcttcaaggagaggctgttgtttttgcaattgattttatttgaactccttttttctaaaaacgactaagtgagtgcttctcaaacgacacggatgagacagtgcgtctcgtccggtcggagtatgtgcaatgtatcaatctttagatcttgaaacaaggttggctcccggccaacagcttttcaaacggccacccgggccaacaacttttcaaacggccacccgggccaacaacatttcaaacggccacccgggcctagctgatcccgtcagctgctgatttttcaaacatcgaacccattttctcaacagcaatttcacaagcggtagtcaaacaaaactacgctaggaatcacctcacatccgcccatgaccgtgggcatggctgttcgaatagtttgttaacctctgcagagggggtacactttacccacacgacattactaacccggatcacccagcccgtggggatcagccacgtcgggagacctccaagctttcatgacaaggcatttcgaaagccgatacaggtttaccatatgccgacgagaggggtcccagaccaacaacaggttaggtcccagaccatactgtgccaggaagcccaggggtcctccccgacaccaccccggcgaatccacatgtctctcggcatcaaggctcccctgataagctagttactcagccaagggtgtcccattccacccatgtggtcgtacttgtcttatgtttggatgaaattccaaggaaacggtccttaagtgcaagagcgggaaaccgtacacctggtacgttccccggtccgcggttttggaaattcatttagttcacaagcaccgacccaggtgtcgggttttccaagtcttttgtaaaactcccgttttacccaaattgttactcagattttaagtttgaaggcgaccgtcgatactcgcacagagtgcacgaatatcgaggcgcaactgggtggttacaaggggacatggtatggcaattaacaatcgaaggatcaaatgcaacaagtcaggtaggtccaccaatctgccttgcagatgggacaaaagattaagtgcggtcctatcaatacataatatttttcaagcaatataattaaatttcaattataggctcaagatgttcaaaggtggcttgccttgctcgagatctggagcttgatcctcgaaatcctcgcactgcgggtcttcgggctctgaaactacacgcgaaacggaacaactcaacaaacggcgaaaaaataaagccctattaatgacctctaagcgtgccattagatagatctcgagatttgaggaattttggaagttgaacggagtcaaacggatttacggttgggaagatattgaatttctaagattattggatttttggtctaaaggaaaaaggatttaattaaatcctttttggaaaagaaaaagaaaagaagggagaggggggaatatagacttttctcgggcggctagggtgcggcccaagagatttggggcggctcggccgagcttaacgggccggccggcccaagacggcccaagcgcgcgcgcgcgggagggaggagagagagtccggtggaccgggctcaccacgcgtggccccgggtgggacccgcttgtcagcggctcggctcaccgtgcggagggagcacgcggcgcacgcgcgcgggcggggaggaacgcggtgcacgcgcgcggtccgcggcggacgcaggtgcggcgggcccacgcgcagcctcacggcttgcggtggaatgcgcgcacgcggagggaccgaccggggtcggcccgacccggtctgggctgagctggcgccgacgtggcgcctacgtggccgccacgcggaccggcgggaggtagacgacgatccggccgcgaatggacggcgggcggcggcggcgagcggcggagcgaaccacggtgatacgggcaaaagcgagcacaccgggcggttacacgagacgaggggagacgaaccaacggctcggatttgccgggggttgctcgacggcggcggattgcggcgtcggcaaccggcggcgggagaagagggaaacggcgacgaggccacgagaggtcgattcccggcggtgagagcatctatgcggcttcgggaactcgacgctagcgtcggattgggcggaactacgccgagcgaggccggcgacgagcgggtgctacggagctcgggcggcgacggcggcgagcacacggcgagcgacggcaacggtcggggcggcgccggctaactacgggaaggctactcaagctactaccgaaagctaggggaaggagatggagcgaggaggaagaacggagagagacatcaccgagaagaggaggggcgctgtgatgagaggccgacggcgcgggagtaatctctccggcctcgggccggggaagaggaaggagagggtgcggccggagtcctcttccgcgtccttgctcgtgccggctcctccgacacgcgcaacgacgatcggcgacggcgaaacagagggcggcaatggcgcggaggcgaaaaatgagggagtttggagggggagggcttgggcttaaatggacggcaatgtcggtttgggagaggggaaccggcattgaacggtcaaggcgcgagctggcgctcggcgcttgcagccaaagcggcggcaggaggatgacgccggcgaggagaaagaaaaggggaaaaaagagggggagaaaggggcttgcccctttgccgattcgggaaaaagggggggagcgggagcatcgcggcagaggtaggaggggctcggctccgtcccttggcggcttgcgcgcggagtggcgggggccgggcgatgacgacggtgatgacgggggggacggcttggagcggagcggcgacaccggcgacaggcgcgcgcagaggctgacggtggcggcgaccgggcggtcgaccactcggctcgcgcgcgcggcttgcaacgggcggcgtccgcgcgggcgcgcgcacgcgaacacggcgcgcgggaagcggctttgcgagcagggagctcgcgcgaggggagggggcgcccggcgcgggcgactcccccgcacgcgcgagcagcgtgcgggcgaggctgagcggg

SEQ ID NO: 74046 - DNA, 3293 bp, Oryza sativa
attcctgcagccccacttgtattcctgtgagaatcctatgtttttcctattccttcgtttttttcattcctatgatttaaagggggctaagtgttggaattatatgtgctaaatccatgtagttagacaatagtttctaaaagaaaaaaaatcaaggcccatcacatgaaaggatgcacgtgaactttagtatcagcttactaattctatgaatatgagatcactttttttaaagtgcggtgctctctatgttactagagcaatatggatgagagataactttaagaaaagcgcaccttaaccactcacttcacggagttttgtcatgttgtcttagagtggctagaaattcaaaccgggtatgctaccttattcttttctgcttaatggatagattgattaacgatacgtttgctaaactgctaaacgatacaatgtttgtccctttttgcatgttaacatgtgagggaggatgttcatatggaccagaggatccaattgcctacgtacatgtccttttattgggcaattgactatatgtgatttatggactatgagtccatgattaacgacacgttcggcttaactctcgggcccaggcatgctggtaggccttcgatggttcggcccaaatccgtgcgacactcaaacaagttaagccatttcattttcaagaaatctcttcggtctttctgacagtttttttttcttttgcgaacatttctttgacaatttgctaacgtgtgtgatctgtatgtgttttccagtgcctcgttgcagtgttttcgcggatgcggctccatgagatgctaccggctggtctccgatctccactccttatcatttcactcagtcaatttcaagtttctgtacgaaacctttatatggttaaactggtaaatctaacagctacaattttcataaatcttttcttagatgtatcaggtactcttttataattcgatcggcctaaccaagctattctgtctaaagaaacttgcaaaaattaaaacaaaccaaaaacatgtcaaacgatataatgcttgaggttaatcattctgttccaggaatattgtgctcaacttccatacgaaaaggaacttaaatatatacagggtgaattgctgttctgcacatgtctgaaaaaaaacttgcactataatcggtttgccgttgcatgattatcgttagagcagctgcttcagttgaaacttgatactaaacgacttacatggtggtgtactatattaattaatctattactataatctatcgatcgggcaaacaatgagtattactcaattaattatgactgcaatagagcaatggcggatacagatgtgaattgaatatgccccctgaatgaacagaacggttagttatgtgttcaaagaagcaaggtataaaattattgctattgtacgtgcaatgaagagtgcagaccttgcgctcccactaatcgtagtggaattcatcagcaaaataaataaatcatatagaaatagagtttttttactattttcatcatacgattcttgttggttgacctcaagcactgaacaagataatgcaaattatttggctatttcaatgtctggctcgccagtagttggaacttgggagagaaaaaaataagcagcggctgcaaagggttcaagggagttgagcctgttgtagttaggtggtactgaaaggataattgattcagaaaagtgaaatactccaacgtcctttccattccaacttctcgcttgtccaattaagaactttgaaaaattccgtactaattaagaatttcacggaacgaatttaggtagccaataaatgagcagatgcatatttttttattacaaattaaaactgattgagaatttctcgttgagaaatctgtgtgtgaaatatttctgatttagaatttcatctctggctggtaaaactgatatattacagtttggcacatcaggaagtatatttaattttttttaagatgatggatagaaatccgatcctatattcacacacatacttaaagattacatgggtacttaaggcacattctaaagagataattgagcttaactactactcgttttctattagcatgttttttaaactattaaacgatgtatttcgtgcaaaactttctatattaaaaatactaccttttcaaaataaaataatttgatttatattttttaataattaatacttaattaattatatgctaataaagtttttattttgcgtgtcgctaaataagacaaaacgttaagctggaaagaacgtgtcctaacactccaaatcccataactgacacaaaagaggaaaaacaacaataagaaagataaattttacagttcctaagatgtactgtatcaaaacttttaatgcaaacttagctcctctcggtacctacttaactactataaaatcactaaaagaaaaggtaaacacgatatgtagttagaaagattgtatggctaacattcagtttagctatgcatgcttgactagcatagaaacattcgcaagcatgcatgttcagagcatttctgttcttgctgcgaaaacgcaacgacttgtgttcagattgaactgaataatgctaatatacgacttatcatttctgatggaggaaacggtacgtagagcttagaccagcaaaccaattaatcatcatttcgcataagtcaatttctggacgttgcagagccatcagccatgtgcaacgatcgttggaacagtgatcgcatttttcaataatgcctacgacaatcattcccttgcaatatgtaatccacgcctctgcatgcaggcctcctagatcatagtactatataagcaccaccattgccgcatacatccctcacctccaaatccattcatcacaacaatatctagctagctagttatctagcttaattactctcgatcgactgcacaggctcaacctagctaagaggaaatggggaacattttcctgcagctgctcgccgttgttgcactctgcattgcaccggcgaggtcggactggctcccgggcaccgccacgttctacggcggcgccgacggctccggcaccatgggtacgtatacgtcgtctactccacatacggcccaaatgtccgactcacgtacgactgaatttgatttatttgattgccatggattaaccggatgcatgtgcgtatgtgtgcatacaggtggtgcgtgcgggtacgggaacctgtacgaccaggggtacggcatcaacaacgcagcgctgagcacgccgctgttcaacgacggcgcgt

SEQ ID NO: 74047 - DNA, 54743 bp, Oryza sativa
ttgtgaaagagatccgtattctcgggcctatgtaccttcacaacatgtttccttttgagaggacatgggcgttctgaagaagtatgttcgtaaccgtgctcgaccagaggcaagcatcaccaaggggtatggaacagaggaggtcatcgaattttgcgttcaatttatcgaagaccttcgcccaatcggggtacctgaatcacgccatgaagggagactacggggaaagggaactctcggaaggaaagcaataatgacggtagacaacaatttattccgtaaagcccatttcactgttctgcaacactcttcattggtagctccttacatcgaggagcacttggctctagttcgcgccaggaacatcggtaagtccgatgcatggattacacggcatcacattgatactttccccgcgtggctacgacaacatctcatgggtaacgagtcgatcaaccaacaacttgccttcctggcgaggggaccgtctgggtcgatcgcgacattctagggatatgagatcaatgggtacacattctacacgagagcccaagacatgaagagcacgaaccaaaacagcgctgttcgtgtcgatgccatgggacacgatggaacaactgccacgtattacggtgccatcgaggacatatgggaacttgactatggtcctctcaaggttcctctgttccggtgccaatgggttaggttgactggtggaggcgtaatgattgatgacagtgggatgacaactgttgatcttaacaaggttggatactcggaagaaccttttgtccttgccaatgatgtaacgcaagtctttttcgtgaaggacatgtctagcaaaggaaagaagggcagagggcctgatgagcctaagcgtcaagtggttctcccaggcaaaagaaaaatcgtcggagttgaggacaagactgacgaggattacgatcagttggatgggcaaccccctttcacggtgacgattgaccctagcatcctcctatcaaatgaagacaccccttactcacgcagcgatcacaaggagggaacaatagtgaggagaaagtacgtgcggtcaaccgtcaccgccgatgtaatgccgtaattattgtgtacacgatgtaaactattttggatgtattgattatccatataaatcaattgatgtatggcatatgttaattacgcacgattattagaggtttcaacaagtttaaatcatgtatatgctagttatatgtgatacttacaatttttaaaagttgtaaatcacacaggtggcaatttcatatgtatgttaattagagtttttaacatttaatttactagcattcatatgctaattataattgactagaggatttttaaaagttttaaatcacgcaagtggcaatttcatatgttaattagaatttttaacatttaatttactatcattcatatgctaattataattgactggagaatttttaaaagtattaaatttaatatatttttaaaactatcattcatatattagagtttttcacaatttaatttactatctttcatatgctacttatatatgactattcgaatttttaaaaggtttaaatcatgcatgtggcatttacatatgttaattagagtttttagcatttaatttaatataattcctacgctaagtatatatgatgattacaatttttattaattttaaatcatgcagtatgtacatacatatcttaattagagtttttaccaatataataatatcattcatatatatgctaagtatatatatatatatattggaatttttattaattataagtcatatatttgcttattacgatttatccacttaatttattacagacaaaaataatttttcgaagtaattgtcattaatctttgtactttaaataatgttaatgcattaacttctattttataaacacatatgtaagcgaaaatcatatgcagtgctataatctttagtcccggttcttaaccctaaccgggtttaaaaagaatttcgaaatagcgggaaaagatatttactcccggttgttctcaacaaccgcgactaaagatatctttagtcccggttgttctcaacaaccgggagtaaagatctttaggtatatatattcccggtgcgccctcgtcttcttcacaaacacttagacgttttcggccgatcgatctctctcggcctctctccttcgccgccactgcctagggcaaatccccgcgccgacgccgtcgtatctcgccgtcgtctcgagctcgtcgtcctcgccgccgcctccgcctcctccgctgccgccgcatctctgggctgagagccgccgccgccagatctaccttcatctcgatctctccgatctcgatcgctctccgtcgcgccgcccgccacgagacgccgcgccacgacgacgacgcgccatgccgacgccgcgccaagccgccgccggcacgccacgccgccgtcttcgccgccgcgcgcgcaatgccgccgccggcacgccacgccgccgccttcgccggcgcgcgcgcaatgccgccgccggcacgccacgccgccaccttcgcccccgcgcaacgccgccgccgcatgccaacgccacgccgccgccgccgtgccacgccgccgccgccttcgccgccgcgcgcgcaatgccgccgccgccacgccacgccgccgccgccacggccccgcaacgccacgccaccgccgccgtcgccacgctgccgccgccgccgccacgccgccgcgccaaccgccgccccgatgccgccacaccgccgttaacgaacgagaacgagaaggatcgaacgaagacaagcgagaacgagggaacgaacgtgaaggagaacaagcgaacgaacgtgaacgagctagggaacgtgaacgagcgaacgaacgaggacgaacgttaacgtgaaatgcaatatatatatatatatatatatatatatatgttacttcgcatttatcctaatacatctttttgtatcttgcagaaaagacgtgttgtcggagtgtcgttcgtcaagcctgagtggaagagctagccctagaagtaattggagcaggcaagtgacgtaataatataaatgattgttatatttgtaatgcaattaattaagattattagacctgtaattagacttatcatataagattgtgtagtggtctaatattatttgagtttaatataagattattttattgcaaattagacttagtatgacattattgactacggaattggtgcgactcctagcaattgactattgtagtcttaattagacttagcatatacgcacgaaacacttagcatacatgactattttagtcttagcatgtaatattatttgagttttaatataagattactttatttgtaattagacttagtatgtaattattgactgcggaagtggtgcgacaagtagcaattgactattgtagtcttaattagacttagcatatacgcacgaaacacttagcatacatgactattctagtcttagcatgtaatattatttgagttttaatataagattactttatttgtaattagacttagtatgtaattattgactacggaattggtgcgacatttacacttagcatacatgacttagattgttaaaacataaatgtctcgtgacttagcagatgtttcttgtatcaacagatggctgaccgcgatgaggaacagatattgtacgatacaatcgcggagggaagcagccagtactggaatgaagaagaggggaacgaggatccaaaccagtacttgaacgaggaagggaacgtggagagggatgcggaggggaaccagcaggggcacgtggaaagggatgtggaggggaaccaggaggaggaggctagtggtagtcaaccctccgttggacagaagagggcacgtgggcaacgaggtgcaacgaagaagcttgagggtcggcacatcataacggaagtggaagaagatggacgtcctagtgccccggccgaagccgccaagaactatgtacgtcatagcggttgggttgtgcgggataacgtgcctgtcagtacggtgtactggcgaagaacaagggcacgcagagatcatgagagctttgtcccagattcggagaaagagatgctgtggaccacaatgctcgagacattcacccttcctgtgggtacagaggacaaagtgaaaaggtggactctgaagaaaatggcagaacagtttcagagcttcaagggagatctgtaccagaagtatatactgaaggggcagacaccgaacttcgacacattcccaaagctaagggatcactgggacgagctcgttgcatataagacaggtgaacaagggcaggcgatgatggaaagaaacaaagaaaatgccgccaagaagaagtaccatcaccacttggggtcaggaggctatagcgtcgcgatgccgaagtgggagcagatggaggctagcttgattgagaggggtatcgaaccggcaacagctaattggccggaacgatcgaagttctggtactatgctcacggtggaacgctcaacccagctgatggctcactggtcttcggcgatcagatacgagaggctgcgcgacgactaacagatgcagtggaagcctcctctcagggcacgttccgaccagacagagatagggacgagctgacactcgcactgcagactccagagcatccaggacgaacacgagggaaaggggtgattccttggaagattggtttcaaggaggacatccacacgtacaggagtcggatgaggagcaagagagataccgaggcgaagattgcagacctagagttccgggtatctcgctacgaactcaacatgcaagaggagatggcaaggaaggttgatgaacgcatggccgcacatcggtcccatgatccccagccgaccattcctcctgcaatggtgagcccgtcaggaaaccgtagcagctgcgcctcaacggggcaggtagtgtcacagagcatggacgccatgcaaacacaggacgaatcgacctgtcccgttgatgacatcactcagcggacaccatgtgagctgcatattcctttcaagaacttatcaataaaggtaagatttagccattccgctagttgctgcttatatatgttgattactaataaataatctctcacaacatgaaggtggcgtcgggcatggccatcccaacggaccctttaggtacttaccactgcaggccgattccagcaggatactcgaaggtcgaagttgagttggtcgaaggcgcgtacgaggacctcgagctggattaccctggaggagacggtgagatgcatctacgagacacatgccatgccattattctatcgcgcaggcggtacatcatcctccctgggcgacaagcggcgtctcgtgcaccatctcctccggctccgccatctcctcctcaggatcctgcaccgtctcctcctcatgctccgccagcaccgtctccacctcaggctccagcatcgactcctcctcaggatcctgcaccgactcctcctcgtgctcctacacctactcccccgcaagctcctcttccggcaccttcaaagtcaagggcccccccagctccaccgcctgcccacacaaggacccgaggtacgattgcacgcaagaggagcttgacgcttacgttgcatcagaagtcaagagacaattcaagcctcgaagtccagaaaagaagattcctatagaccccagtgtcagaaacttctttaggggtatgtctgcatctgtcaaggaggccatcaagctatcggactatgagcgaatgctgaagaaagcatcttctggaaagtccaaaccagtccctcagcttggagagcaaccaaaccaggagatcgagcagttggtgaccggtaaagaaatgacgatagaacaatttattactgacaccggtctaactacggatcaattgctaggagtcgcaccaatcgaaaaggcggaagtgaaatacatgtacgaactcggtaaaccgcttgtcaagcctgagctgctgcagtccctacccacacaaatgtacaagttccatcagctgtacatggacatgagcgccaccggtagagagatgatcgaagcgaggatcagggacacggacttcttgcaaggagatgacattctctggatcaatttcaggggaatctacgaactataccagctggacgccctcgacgtctctattatgagttgctggattttgtaagtatatcgttcagttagatttcttactatacgtctcctttaattaattaggtccttgtatataagtagactatagaaaataatatactcccttttatcgttgtagaaaggagattcaaagggcccgacggcggagggttttcgatactggattcatcgaccctcggaaagtaaacgtcgcaatgctcgaccaatatccacaagaaacagaggacaatctcgtccatctcctgaaggcgcagcattacaagacgttcatactgttgccatacaacatagagttagtttaattttacagtcttcctacataccaaatttcattcccgtacgaacttgctaagtgtttcatatgtaatgcatcccacgcacattgcagattccactgggtgcttttactcttcgacctggaggcctgcaccgtcaacgtatatgactcaatggataaaaaagagtctacgtttgacaaggttttcgaacttatagacaggtaccgtcataagttcctttgttaattaagaaaatcttgttatgttaattgctactacgaatcatagctttaaactccatgtagggcttggtatcggttccatcatttggtccgcggcaaatggagagaaagacttaggcggaagttcaaatttcctgtgagtacacatgctctacatttatatttctccgattcaaatacatacaagtgtatattaatttgatctctcgttgtttgtcatttatttgtagtgcgcaaagcaaaagcagggaactaacttgtgcggcttttacgtgtgcgagtattgccactgccttgcagaccaaatcatcaccacaagagagctcgatgtacgtacaaataaatttaaaatttcattacgtagcgatttcttgtttaattactaatcaatttcatacattcatatagtttattcgcatgagggataacctgaccacacacaaggaatttatcgcggcggttcaagaacaactcatgggattcatcaacaaagaaatccttgatcccaagggtgaattctactacgacggaaacacaattcaccggtccttagcttctgagctagcagcgactactactacgtcgaaatcgtagctagctaggacatataatggattgtaattaatacatgactacatatgtttctatatacatgtgtacacattttctataatgtaaatatattttggtcatatatatatctatatacatatgcatttgcatatcatatatatgtataaatacatatatattatgcatgtatatacatataatataatatatatatatacatatatatatatatatatgtatgcatatatatgtattgaaacatatatatgcatggtttatatataaaccatgcagcaaaagggccatgcaaaaaaaaaaggtcagctcgatctttagtcccggttggtaatggctcagccggccacgtggctaagccatctttagtcccggttggtagatcgatctttactcccggttatttcacccgggactaaagatagcgatctttagtcccggattggtactcccggtttggaaaccgggactaaaggggggttacgaaccgggactacaaagggtttctccaccagtgatacttttccaatctcaagccatcaaacatgataattttcttttgaagtgaagcaaaataataacaaataatatgataagaagattttatagtgagaataattttatttgattcttgagactttaaagcgtacaacaggttctgttatttaattatattgcaacacgtgagcattcacctatttattttataggaaggaagaaataagccatatatcccattgtggatgagaagttggagatgatcgaacacgatggataagagggtggtttttgaccatcaccgaccagtgacgaggcctacgacctagctatggacacacacggcgcggcactgtaacgaatcacgtaacctaaagcaaaactccacagtatgtatgcatggagccccattcgtccgtccctgcagctgcagcagcatttaccttttttcctttctctgttcctgatgaattagttcaagatggataggaaattaggagtaggacagggcaaaatctttcttgcctcccctagctacctagctagtggaccgggcctagttccttttagcaaagtaatcgatccacttttctctacaatgcaggggtgacctgatttcctaaactgccggtaaccacgtagttaccgcgcttactgtggatatgataaaagaaaaccacacttactgtggatatggtaaaagaaaaccatagtaacctccttaaattcaaataaatttaaaaataatttaaaattttaataaattttatattgtttcgtacagcttctcatggttaccgcgcgataactgtgcttactgctggggcccagtaaccccggctccggtggtttgggtaaccctcttcttgcacgttcagtgtgacagtgtcaacaaagtcatcacaagagagactgtatttttgaggcactaggtaaatagaagaagctcgctgttcacacaggcatgtttattgcaacgggaagaaaaggcaaaaaaaaatgaggaaaagttaagaaagattcacattatacaattaattaaaatacaaatttcccaaaatacttgggtgtgtataattaaattaatttacaagtaaaataagtgtgggaaataaaataacatggctggattttatttttattaaattatccgtgattaattgcactctctaaattttctcaaaattttcagagcttaatagctagtctattaacttaataaagtaatagaaaaaaaagccaccatgttcattctcgcggtctagatattatcacgttaatcgaagaaaaaaacaaaaaaaacaaatggacatgtattcttttggaaatgtgacataccagaaacacactcatgcattgtataggtttaggaaactgatcacaactcttactcggatgaaaattagaagaaaaaacaaacggacatgattctttttggaaatgtgatataacaataaatacttgtggagattatggatatcccatatctatacggcgatgatatttggattgaatataggataccgagtatagatagaatatcttatgtgtatcctgggtttgtttcctaacttgtatatcaaggaaacaccttgagacttagtcggtcacgactgtattcagttagggacatagattatcttttgtaatccggactccttcctatatataaggggggtccgggtgcctttaggggcagatgttgattttctctaaatcatacaatcaataatacactcggcggattcatccccggacaggagtagggtattacttcttttataagaaggcctgaacctgtataaatcctttgtctccaaacccatacacttttccagcttgatagccacccccttttattattgccgaaatctagtttcgacagttggcgcgccaggtaggggccgcgtcaagcttttcgccgatcagtgcaatgggttccacctccggcatcgacgacctcgtcttcccgcccaggcagacgtttcggttcggcagcctcgacttcgtcaccaacaacttcggcaagatttctctcctcgactcggaatcagaccagtcgggagagaaccgaatttcggtcccgtttggattcccgaacgcggctgaaagctacttcaagaccatctcaaccgagtcggcttcaaaccacccggccgagatcgcatcttctctaacgacaccagatcaagatgatggggcttacccaccagtcctgatgaagctccccgacgatttagcggccgtctccaccacgactgcggcttcatcccgtaggcctaggcggaagtcggcttcaacaccgatttcgcctagcttcagggaagtcggcgtcatcctccaaccactcggcacggtttcgacggatcagctggatgactacaacagctctcccaccgtcgactcacgtcctactgatatcgtggagtacgacgaatttagttctcgctacaacgacttcgacgacttcgacggaagcctagatgacaactacacccctctctactttggcgttttcatggccaataatgagacggaggagcaacgccaagcccgggagaccgaagaacgtcgccgactggaggaggagcatcaagcacaagaacaagaacggctacggcgtgagcagcaggaccgtgagcagaccgcgaaggaggctgaggatcgacgtcagcgagctttggaagcagggcgccgagcgcgtgatctcatcggccagcaagatgtcgaagggacaccggttttccgcacccctcaacagaatgcggttgccgcgatcacccttctcgacatcctcctcaaccaaaacgagctcaatcgatccgaccacgtcgtcaacatcttgaaccagacgaagaccatgattgcggcttcggtcccagttaactccgaaagcgtccacacaccgactggcagccgagttccccacttccgatctcatgactaccgtcatccaagcctcagcatcaccggcgcaggatccaaccgcaggagcaggggtcacgacgagcggtctgttcactcacctcccgaccttcatagggagcgccgagtggaacggcctcgctcaccacctcgtcgccgccccatcgatcttcgcgacacaatcatacagcgccgagcagctcgaggctaccatcactcgccagaccgccacgacgacgaccttgacggagtagcagccttcaccgacgacctgcgtcgagtggattggccagccggcttcaaaccgactggaatagagaagtatgacggcaccactaaccccgaatcgtggcttaccgtctacggtctcgcaatccgcgcagcaggaggagacaacaaggccatggcgaactatttaccagtggctttagcggattccgcccgatcttggctccatggattgccccgtggtacaattggatcttgggccgaactacgcgaccacttcatcgccaacttccaaggcaccttcgagcgtcccggcacacaatatgatctctacaacgtcattcagaagtccagagaatcccttcgagattacatccggcgattttctgaacaacgtaacaagatctccgacatcaccgacgacgtcatcatcgccgcgttcaccaaagggattcgccacgaagaactagtcggcaagtttgggcgtaagcctcccaggacagtcaagctcatgtttgaaaaagccaacgagtatgccaaagctgaagacgccgtcaccgcatcaaagcagtcgggtcccagttggaagcaaaacaagggtacgccggctacgggaggaggtggaagtaacaatcataaggaccgcaagcgtaagcctgcggaacttgttgcaaccgccagtcactcttcccgacagcgttcgcgcgtcaacacgttcgataagatcatgaactcccaatgcccgcaccatcctaactccaaccacatggccaaagattgtttcgtctataagcaattcgcggatcaatacaccaagactgcacggaagaactccgacgaagaacaaagcacgtcgaggaagaaggacgacggcgacgccccggcaggatttcaagaccaccgcaaggagctcaaccatatcttcggcggccccttggcttatgagtctaaacggaagcaaaagttgactgaacgggagatcaatgctgttcagcccgacacgccccaatatcttcgatggtcagagattgcaatcaagtttgaccgctcggatcatcctgaccgagtggtccacccggggcggtaccccctggtactagacccagtggtccgtaatgtcaagcttcgcagaaccctcatcgacggtggcagtgcactcaatatcctcttcgccaagaccttggatgatatgcagattcctcgctccgagctaaaaccaagcaatgcgccttttcacggagtaattccaggactatccgcaactccactcggccagatcaccctcccggtcacttttggtactcgggaaaactttcgcacagagaacatcagcttcgaagtcgccgatttcgagacagcataccatgccatacttggacgcccggcgttagccaagttcatggccgtcccacactacacttacatgatgatgaagatgcctggtccccgaggagtcctatccctacggagtgacatcaagcaagccgtcacatgcgacaaggagagttgcgacatggctcaaacccgcgagatggcgtccgcccgagaggatatccgactggctgcagccacggcgagcgaaggagaagtgcccgctaccaagatttcaaagagtggggaaagcgaagccaagactaagaagattcccctagatccctctgatcctactaaaactgctgtaataggcgccgagttagattgtaaataggaaagcgcgctcatcacctttcttcagaacaataaagatatctttgcgtggaaaccatctgatatgcccggtattcctagagaggtgattgagcactccttacacgtcaaagaagatgccaagcctatcaaacaacgactccgccgattcgcacaagacaggaaggacgcgatcaaggaggaattaaccaagctgttagcagcaggcttcatcaaagaagtccttcatcccgactggctggcaaacccagttctagttcggaagaaaacagggcaatggcgcatgtgtgttgattataccgacctcaacaagtcttgtcccaaagatccttttgggttgcctcgcattgaccaggtagttgactcaaccgccggctgtgagcttctcagttttctggattgctactcggggtatcatcagatccgactgaaggaatccgactgcttgaagacttcattcatcacgccctttggagcttattgctatgtcaccatgccgttcggactaaaaaacgcaggagcaacttatcaacgtatgatccaaagatgcttctcaacgcagatcggccgcaacgttgaagcctatgtggatgatgtagtcgtcaagaccaagcaaaaggatgatttgatctcggatctagaagaaaccttcgtgagcatccgtgctttcaggatgaaattgaaccctgaaaagtgcaccttcggagtaccgtcagggaagctgcttggctttatggtgtctcataggggcatccaagccaacccggagaaagttactgctatcctcaacatgaaaccgccaagtacccagaaagatgttcagaagctgactggatgcatggcggcgctcagccgatttgtttcaagacttggcgagcgggggatgcccttctttaagctgctgaagaaaacagataacttccagtggggacccgaagcacagaaggccttcgaagatttcaagaaacttctcaccgagccaccagtcttagcctcaccacacccgcaggagccgttgttgctgtacgtatcagctacctcccaggttgtgagcacagtcttggtcgttgagcgcgaggaagaaggccatgtccaaaaagtccagcgaccgatttattttgtcagcgaggtcctagccgattccaaaacgaggtaccctcaggttcagaagctgttatatggtattctaattactaccaggaagctatctcactactttcaaggtcactcggtaacggtggtcacatcatttccactcggtgatatactgcacaaccgcgaagcaaacggacgtattgctaagtgggctttggagttgatgtctttggacatatcatttaagccccgaatttcaatcaagtcccaagcgttagctgattttgtcgccgaatggaccgagtgccaggaggatacccccgcgaagaacatggagcactggaccatgcattttgacggatccaaacgactttcgggcactggagcaggagtggttttgatttccccaactggagaaagattgagctatgtgctttggatacatttttcggcgtcccacaacgttgccgagtatgaggccctccttcatggactacggattgcaatttccttagggataaagcgtctgattgttcgaggcgattcacagttggttgtcaatcaagttatgaaagagtggtcctgtattgacgacaatatgatggcatatcgacaagaggtgcgcaaattggaagacaagttcgaaggactcgagctcagtcacgttcttcgacacaacaatgaagccgccgacagacttgccaattttggatccaagcgcgaggcggcgccctcagatgttttcgtcgaacacctttatacaccgaccgtacctcataaagatactactcaagatgcggacactcatgacgtagctatggttgaagccgactggcgagagcccttcatacgatttttaacttctcaagagctccctcaagataaaaatgaagccgagcggatttcaaggcggagcaaactttatgttatgcatgaatctgagttatacaagaaaagcccttcaggaattctgcaacgctgcgtatctttagaggaagggagacaattgctgaaagacatacattctgggatatgcggaaaccatgctgctgcacgcaccattgtcggcaaagcttaccggcagggttttttctggcctactgcagtgtccgacgccgacaaaattgtgcgcacatgtgaaggttgccaatttttcgccagacaaattcatctaccagctcaagagttgcaaactatcccgctgtcttggccgtttgcggtttgggggctcgacatggttggcccgtttaaaaaggcagttggctgttacacgcatctctttgtggccattgacaaattctccaagtggattgaggccaaaccggttgtcacaatcacagcagataatgctcgagacttcttcatcaacattgtgcatagatttggagtgcccaatcggataatcactgataatggcacacaattcactggcggagtttttaaagacttttgtgaggacttcggaattaagatttgctacgcctcagtggcacaccccatgagcaatggacaggtggagcgagctaatggcatgatacttcaagggattaaagcgcgtgtctttgaccggctaaaaccctatgccggcaaatgggtgcaacaactgccatcggtactttggtctttgcgaactacacccagtcgggccacaggccagtcaccttttttccttgtctatggggcagaagcaatgttgccgagtgaagtcgaatttgagtctttgcgctttcgtaattttcgtgaagaacgctacgaggaagaccgagtagatgacttgcaccaattggaagaagcccgcgaagcagctttgattcggtcggctcgatatttacaagggttgcggcgctatcataatcgcaatgttcggtctcgtgcctttttagtcggtgacctggttttgaggaaaattcaaactacacgagatcggcacaagttatctcctctatgggaagggacatttattatctttgaagtcacccggccaggttcttatcgactcaagcgcgaagacggtactcttgtcgacaactcttggaacattgaacatcttcgtcgtttctacgcttaagtttatcattgcacttccctatcttgactgtcaacatcaagttttcttcttgccgttgtcagtcgggggctatcatcataataatggagtgtgattttttatcaatttaatttgcttacttggtctatcattaccttgtttgattttttctacttagtctgcgaggactgaaagtttttaatagcttctttgggttttaggctcaacaaagcttgataaaagcttttaagaaatcaaagacttggttagaactatcaagcacagcataaatacaccagcattgtacaaattaagcctccatttgctacatttacactcagtcagaatcagtcttttcatcatcagagttattattgctcggctgaaggtcgttgttgcggaattgctctacaacatcacttgcaatcttgtcagctgcattttgagcattactgataagatcaagagcagcttcttcgcttgtcccgtctgcaaagccatcaatggcgtcaatttcaatcctcgggtacaaggatttggtcatcgccaatgccatactagctcccatacttccagctttcttgatattcttgaagtatacatccggtgctactctcagcttgtcaaagatttcggttgcgtcaagtgcactcggaccactgtcattaaggaacatagcttggacaagtggtgtagcgacattggcgacttcgtctcttgctccttcaagcttcttgatcttaccaaccaggacatcaaactgagcttgagatttgattttacggtctacaaaacacatttataataagaatttgctgcattaaagagaggaaagttcaaattgtcagctggcagtaccttcaacctccttcaaggctgagtccctttgcacagctagttctactttgtctcttttcaaggcttcaatctgtttctccatttgtgccatcctggtagcttgtgctgtttgaaatccaaatatttgaggatacagttatgacagcataaatcaatggaatagatctggaaggttaccttttgatgaaccacttagctcgaagtttgaatcctggagctgggcaattcggtcccttaactccttctctgtctttttagcatactccttggcctcatgcagctggtccctaactgcttcaagagctcccaaatgaggaaccagcttttccaaagttgtagtcttggcctcattgcgaagatggattctctgcatgatggatcatgattcagttctgctaaaagagagaacaaagttattaaaggcagtcacccggaagatttacattcacaatgcgagtggcttctccaagtactttcttcagctggcatacttcctcattttctttttgacgatttataacgatgccggcaacttgcgagttctcgtcccaccatttgagcaagataggaggacgggagtcattagccgcctttatgcgaggaattgcttcttcgtcatcgcctagtgttcctgatgtatttccaagacattggacgagtaagctgaagttatttaaatcggcatcacttgagaagatgtgttacctgaggatgttcctggctgaacatgaggtggtccttgttctgtatttagagacccaatcattgagtctttaccagcctctggtccttgggaagttgtcgtttgcgcttcaacttcagggatttcttcatcgggacctacatccgactggtttccagtcgggggctcttgtgttgttgcagtttcagctgttcccgactggtctccagttggcggctggtcactcggatcggctctatcatccgaagcatgggcgccagtcggctggctttcggcagtcggccggctttcggcagtcggttggttttcggcagacggctcagcgtctttggataaatttggctctgtcacagccggatcaggatcttttccagttggatctatgtcggacggtttcctgcaaagtgtcctttcgatattcagtataatttctatgagagaagcatatcaaagggagacggtaccgagaagtttatacctggaagatgttctaatctttggcatttgacggccagccagttttttcctgggcatggtatgctttgggagtttgttgggcgtgcccttgtccccagatttgttgctgtcatcgccctcgtcgtcattaagcaccagctttctcttacgaggacctgtctgaccagctggtttggaggtttgaggttgtgggtctgacctgtttgtcggccctccgcttccctgaatggtgtgctggcgaggagatcggcgctgagcaattgggggatcagatttcatcaatacgtattcctgaatgagatgcctccatggttagttaactcaacatgaagacaagatactattttggtcataagttgaagatttcagatacatacctgcggaggcggattgaatgcattatacggcacaactggcagctggtgtgagtagctgacgacaatggcatttgagaagattttatacattctctccttcatgattttgaaatccagagagtctggttcttcgcgattaggatcatgtttgccgtcaaactcaaaagctgtacgggatctttctttaattggcgccagtcggcatttgatgaagtgccgagtgatctgctctccttgcaagccttgttctttgagttttaacatgcgatccaacaattccaaggcttgggcagcttcatctccgattggaagagagttccaagtgtcttggtacaccgggggaagacaagagtattcgggaagagcaggctcaagattctgaacataaaaccagttcgcatgccatcctttgtttgaagtcttgaagggcattgagaagtatttctggctcagagttcccctcagctgaaatccggcccctccgactacacatggcttactcttgtttggttggggtttgagaaagaagattcggcggaacagggcgaagtgaggtttaattcctaagaaggcttcacagacatggatgaaattggcaatgtggactatagaattcgggtttaggtgatgcaagctgattccatagaagcttaatatcccgcggaaaaatctcgaggtcggaagagcgaagccgccatagaagaaatgcgagaagactacgatctcatgtgtatcaggggtcggaaaagcctcaccgcacgctggccgccatccgatgatctccttggctgggagaacgccgtgcgccaccatctccttcaggttctcttccgttacgtcggacggcgcccattggccttcgaagctttccttctcttccgccatcgattctatccgaatgcgctgatttgattcgagggatggctagggagaaatgagggattaaggcggtggatcacgggaaggattttgatgcatttttcgaaggtggatttgagtggagtggtgaaccctagttcgccggcgcagttctgcactgtagcaaggagtggggaaaatggcgagagttccggcggggaagacgaagcgtcgcttggatctcgggatttcttgttaagggtatcggaggtgcgaatgggcctaggcctgaacagtacttcggcccaatacttttaacagcgtggcccattgtgttccttagggacttaggcatattttgctttggcaatattatgcgcacaatagtgttgcccaatgctgataaaatcctttttatgcggtcatataattctttggaattattgcaatgcaaattaaaaggtgcccgacagaaaggtgttatactgctttttgttagttttattaggctacaaaagctgtctgggttaatttggaatgacttgtttttatcatagtcacttccttggtatgttatatacctattttcattatggtaaatagtcatagcctaggctattagacttattcattaccataatttttataatacttggtgggtaatctttagagttttaaattcggatgcctgtccagtgtgttcattcgtgaacctttttagagtgtaaactactcggactcttttcattatggctaaaaagcggtcggctagcatgcctatttaggcgctgtgtgtgcttttgtcatatgatgcacgatcgtgctattatttggtctctcaactatatgtttagttcgttaactaatcacatagttgggggctacacctaattaggtgcatctattcgatgcaccatatttttatcttttcgccctttacagtctttgtcttcgctactcggcaggccttggcacgaaaagtttgaagcactcggattattatttttgagaaggctacgacgattgactgcaaaggtctcgggggctactgtggagattatggatatcccatatctatacggcgatgatatttggattgaatataggataccgagtatagatagaatatcttatgtgtatcctgggtttgtttcctaacttgtatatcaaggaaacaccttgagacttagtcggtcacgactgtattcagttagggacatagattatcttttgtaatccggactccttcctatatataaggggggtccgggtgcctttaggggcagatgttgattttctctaaatcatacaatcaataatacactcggcggattcatccccggacaggagtagggtattacttcttttataagaaggcctgaacctgtataaatcctttgtctccaaacccatacacttttccagcttgatagccacccccttttattattgccgaaatctagtttcgacaatactcatgtatggttatagtgtaggaaacggacaacagttaacaaaccaatcgtaattagattcatacatggaattagcatccatgttggtattagtttatacgcttctgaattatacacgattcatatagtaataaatagatcgatactcttagcaatgaaagcaaaacacaaagcacaaatatccagccatacatcttttagccacaatcagctttgccaccaaattagcaagacagaagttttgccgccagaatccacttcattaacaaattggcacccgagaatgtcggaatcttatagcaaaggatcgtctaacaaataaatttgtgtgtagcaaattaacatattagattggtaataaaaggaacctccatgttcgttcaaattatctaggaaaacaaacattaattaaaaaaaataaaagatagaaatatgtctattgatttattaaagtaataagaaaaaaaggctccacaatcactctcacgacctacaaattctcatattaatcaattcgaaattaaaaattaagacatattaaaagaaaagtctagagtctatattgaactaattaaaattccgaataaaaattaaaaataaggaatattggaagaagagtctagagtctatatatgaatttagagctaattgaaagacgaatttgaaaaataagaaaaattaaaagtaacgtttagagtccatataaaaatatatttagaaatagctgaaattcataaaaaaattaaaaaaagaagattgaaaaagagtctagggtccaaatagggatataatttagaaataactataatttgaaataaaaaaataaaatattggacgaagaatcttgagtccatataggaatacaatttataaataacataaactcataattaaaaataagaaatattggaagaacaatctattgttcatataggaatacaatttaaaaataacagaaatatgaaattaacaaataagaaatattaaaaaaggagtataaattatatataaatacaatttagaaataattaaaataaaaaataattactttcatgcacatgcattacagtatgaatattgcgtattggttagttttatcaagttagtacataatttaaaattatgtttttatttcaatctatttcaataataaaatgtaaaaatatatatgatattgtatgggaaaaaattataacgatgatagccgcacaatctgcgtgggccaccatgctagtttttataatacaaacatcatttcagcatttatttaaataaaaatcctcctttttatctagactatttttagttcattttcttctttcgctgttcaatgctgcctgaagcccctccgtgaaattcggctgcacccttggaggtatttcaaaattgatcaaggggttttttatccttatctgctcttttcatttttctaagaatcggagcaaacccacatcgtattatgctcggaattaaaatctatcctaaacaagtaaaccctaaagtttagcccgtttcgcttgaaaaaaatcacatagaatgcgatgacaacaacaaacgaaaattatccccaatgccttatgtattttttaattagatacatagatatctaattaattaagtattcttacgaaaattatcactggtcactggaggcgagcgcttacccggacaagcagccatcaacaaagcatcaagctttaggacctttgtattgttattagcttaggatttacgagtgcgtggcaaaagcgattgttggtcagttggtggcttggagcgaatgatcggtagcagccggacgatgttaattttgacgtgcgacgcagcaccagccgtctcgctggcgtcgccgccggccgtcggcgattttccccgtgagccgcgtaattcccacgcgcccgagcagccggccgagggccgaccaactgctcgtgtgtacgtcctatcctacgcgcgtgtgtgcatgcgtgtcgttggcgtaagttaattaattagccaccgcttgttgagagcaaggctaacagaagcgctcgctgcttaatccagtaattgccacatctgctatagccatggtaaaaaattaatacatacaacaagtagtctatccatctttctttagttgcaatagtctattatttatttattctatcttttctctcattctacgtcacatctttattctatatggtgtactccctccgtctaaaaaagaaccagttcctggctatgagattcataaccaggaattggttctttttggaacggagggagtagaaagcatgcaacgggtcccacattttttggagagtgtgatgctagcgcttaattagtcgcctgccgatcctctctctatcattagctttttgaccaactcagcctttggatttgttatcgccggctcttcagccccctattatacttgctgagagcaggtacaatagcaggctataagccagctataaccatatatcgagaagaaaaaagaagagagagaaaaaagcgggctacagatttgtagccggctgcaacacggattctaagatgttatgtgtgtataagaggtgggaccgggtattaatggtgtagtatatttttatagttaactattgtatgaatgaactattagattggctatagatattttggagtcaatagttggctatattattggccttgctctgaggaagttaattaagttggagagtgcagaggggggcgggggggaggagggagggggggacacggccgtcgatagagatacacgagttttcattgtttgacccatcaccggcaggccagtcacaaacacgtactgttacacttacgatgccagcacggtaacgaatcacccgaccctgtctatatatatcattcgacacaggtactaatttgtgaatcacgataaaggcttttgcagcgatatatttgaaaagagaattaatgtccatctagtaacaatttataaattaatgtccatctagtaacaatagattaggttgagcgtttcctctgtttcaaaatataataagctattactgaattagatactagactggtacatttagaaggcataaagtgagaatttatatacaaaaatttgtgaacttctttttgttatgtctttcctttgctgttccgggttcaaggtagataggaaattaggtataggtgacagcagctagccgctggccaaaaccattaattcttgcctgccctagggtttagaaccaggacgtgctgggtccagggtttctcaaactgtcgggaccggggttaccgtgtccggcaataagtacggttaccgcgtagtaaccgtaagaaatcatacaaaatcatgtaaaacttatcaaaattttaaattatttttaaaatttatttgaatttaagaagattaccgtggttttcttttcaccgtacccccacggtaagcacggttacctgcggttttgtaaaccccgtgggcctagctatatgatctcccattctccccttttttttcaagtcgcaagcttgagcgacctgtccagccaatgtcaccgaagacaagacaagagcttgcagttgcgaattgtgaggcactaataggttcataagcaacgtccaatggaaaaacatgagaccattattgatgtgcgcctgcctttctccaagtgatcgatggatcaattggaaaggagaaggccgtttttgaccctaacccatatgagatccatggttcctgcaactctgcacgagattgttttcctgttccctacacatatgcatcgacactaactggctacagtttttctgatccatagccttttcttttcagactagcctatttaggagagttcgctataaacttaatctgaaaaaactaggtttttcaggtccatagtttattttattttggattatattgctatagataatcataatatggatgagaatatacattatctacgagagatggagattttgagagtagttacagctcctataagattctcaaacactggctaaaagaaattggggaggagaccagcactaatttttctgctacgtataagagtcaatccaatatatcttctttaagaatcatgttaatgggggagacaaatattgtagtttctgctatgcaaaaaagacaatatccaatatctttatttcagcgtcatgttcttagatttttttttgagatgcatgtttttttcttttaatatctctccatcccataatgccaaatatttttgttaattggcttaaaggtgtaactagtctataaaaaagattattctaattggagtgttttatgttagtcaatttgtgttgccttaatgataaagttcttttttatcttcatgtctttctgttagctttattttttatgtactatgctagtacaggggaacaagaaacactctgaaaataagtagtcaaaggtctcttatttcactgtaaatagcgtagttccattagaattactagctaaaaaaaatatatggtttagcactaccatgtactaataaaagagacttaaggatttgtcccatcaccgtatgtcttatttttctttttcttttattcttcttttaacaaacttgtggttgcgtgtcttataacagaaattgaagatgtaaactattttcattattaaaaaaaatatgttcacaaaaagggccttagccataaattgagctagcctacagtaaataaatcatattatctctattttataatatatgatgccattgatttttacatcaagtttgaccgttcgtcttattaaaaaatttaagtaaatatcttttattttgttgtggcttgatttatcactaaagaaacttttaagatttgcataaaatttttaaataaaatgaataataatgttgtaaaaaaataaaataacgtcatgtattaaaaatgaagggagtttatgttctcattcctcgtcagctccaatcaccaactttttttctctcttcctctcatcagctaatttatgtcactggtcactggagatgaccacaaagcaacacgctatacatctcgatcggtctgaaagagatgatgactgcaaaacctatccacgaaaccaattgcttgagagagacgacgacgtctctaactacagaatggtttttttagataatgaactccagaatggttaacgtacggattgaattgacgaataattcgtaataataatttgaggataaaaaataaattaactattctaaagttgaaaaatgggtttaaaacagtatgtatgatttacatacacaaatatatatatatataggtaaattatatagatatatatatagagagagagagaattattgtaaagaaaacttatttttaggagatcgagaaacgtgtgcattcatcaatgtattcatttgttaagcacgaaagaacaggagggaataatttggtgctacacgcatggacagggtgaccaggcggatttccaagacagatcgaaaaacctgacggagggaatggaaaaggagtggctggtctgattggagcattggagggatggggacgcctcggaaaaagggctacgctacattctcaacgaagtgttttcttttcctcagctgaaagagaaaacctttttttcacatcaggtccatacctatacaggtaggatgttaaggtccatgaacagtactagctacagtatagcgaggtagtacaaattgatggttagtttcggtttacctgtttgcaaattgcaatattgttaaagcgagaacggttattcgctcccgttaattccaaatctaaggccgctttcggaagtgagggttgggcctggcacgaaaaacaaagcagcgattagtgcatgattaattaagtatttgctaatttttaaaaaaaatggattaatatgattttttaagcaactttcgtatataaatttttttgcaaaaaacgcaacgttcagctatttgaaatgcgtgcgcgtggaaaacgagggaaggaagttgggaacctttgatatcgaaagcagcttaaggtggtgtttggattcagggatttaactttagtctttatatttagacactaatttagagtattaaatatagactacttacaaaactaattacataaatgaaagctaatatgcgagacaaattttttaagcctaattaatccataattagataatatttactgtagcatcacataggctaatcatagattaattaggctcaatagattcatctcgcgaatcagtccaagattatgcatgggttttattaatagtctacgtttaatatttataattagtgtccaaacatccgatgtaatagggacttaaaaatttttgtcccatctaaacagggtctaagagcaagtttaatagtatggcccgctactagcttcaattcatctatagctaatgtaatagttaattcatacaatagttgcttactatactattaatacctggtcacacatgtcatacacacattgcgtcttggagtccgtgctgcagctggctatatatttgtagcccgtagctcttctctctcatcttttatctcattaaaatatgtttatagctggctaatagtctgctattgtacatgctctaatagagagcacgaatgactttgttgtatggtttactgtcctagcgttaagaaaggtaaccacaaactgtgaaaacccgggtaaagtttataaaaattcagattaatttttattttttgaaaaaaaattgatggagttaagcaaagttaccattgctgtacctcgatggtaagcccaattaccatgtctatgaatggatgctggctatgtacgcatggttctacctacatcactactacatggtgccgtactaatttgggccggtagaaaggaaagatgatttgggcccgtaggaaagaaaagaaggaatgggctgaagagagcggggtatttggcccataatgaatagtggtgtttctcaataaaaataagttcactataggtccctcctgtgtcgctgagtctaaaattcatctctgaaccaaaataccacatatgacgtgtccttcaattcccaaaactagtgcaaataaggtctcaaggcagtttggatagcggtttcggcagatgtggcgcttaaagtcagaatgaaccgtgggacccacatgttaatgagtgtttggttaaaaataacaaaaatgcagtgggacccatgtcatcacctctctctctttttttttctcctctcccttcctcttttctctctttgtcggtgaggggcaggtaatgacgatgaccaggatctggtaggacgctgaggcggtcagcgacctagggtcctccagtgccaggaacgaccggaccggcgatggaaggcggtacctctggtggaggagtagcacagtgcatgacgaacgcgatgccccatccttcctatgaggagaccaagaaaggggacgaggtggaggactccgcgtcgcgcttggctggcgggctcgacacgcatgtcgccgccgttgccaccgccgcagtggcgtgctgcagcttcgccacgccgctgttggtttgacgcgagtttgttggattggctcggctacaactgcgagagaggtggcactggcaacgatgccgcctcgagcgcctcgcggtgggagaacaatggagaggtagaggttgagggagctgttgcgctcgaagacgaagaggatgaagtcggaggtaggaccgaagtttccgttgtagttgaggaagacaccattggtgaggcggagctcagaagcggggttatgagacggtgcgaggggagggagcagataaaggtctggtgcatggctggcgcacgacgcctcaccatcgcttccacctcactgccaccggctttaggacaaggtggcctccccggacccatccctagccatcgccgagctccgtcaggctatcgcgatgcttgcacacgcgagagagaagagagaaagagagaataaggaaaggagagaagagaggaaagagagaataatgaaactagagaagtggggagagagagttaggggtggcagaggggcgaggcggggttaggttggacaacgggtggaaaacctcacccgccctcacccccacaggggacccagcgggtgagcgggcccctgcaccacccggatggccaacaactgcgatgcacctattgtggctgctggaggtggcgtgccgcgacgaggtgacggttgaggacggtgacaaggtgtctacggctgaggacggtggccactaggcggcgccggcctggggcggcgtcagctaggagtagcacgctacaaggaggcgacgctggccgggggcagtggaccatgaggaggcggcggcagttggtggcagcatgctgtgacgaggcggcggcgaagaggcgatgccgtgtcggggcggtgacagctaggaatggcgtgcgaagaggcaggctggttgggacggcgcactaggagggagagacgtgagagtcagagaggagagagtggtggcttggtagggatttgggaaaaattagggttttgccgatatagtccttcacctaatgggtcgtttgggccttagaatgtactatcttttgatttgtaactcatatctttggagcgccgcgggtcaactcccatccccgcccccacccccgcatttttgtggggcctcagccccactcatcacccgtggtgagaatttcccctcacccccagccccatatggctggtccctgccggctccccggccccaacggggaaattgccacccctagatagagtgatgatgtgggttccattgtaatgcttttatttttttaccaaatactcactgacatgtgggtcccatgtttttttttttactctaagcgcgatgtaggcaccacatcagcgaaaaccgtcatctaaactgtgttgggaccttatttgcactagtttggagagttgagggacacgtcatatatggtattacgactcagtcaaactcgacaacagttgagcgacctaaagtgaacttattccttctagattttagatcctatagagcccatccaggatgtgaggcccacgtgtggccatctggccctagcaatataatgtgggctagaggatggaggtgcccaagggggcaagaagctgtgggcttgagccccgggccctatggcacatgatcaatttttggctcaatttacggtcgtctcaccgcaagagatcgctgtgctctttttttttcttttttttttttaaccatagattgctgtactcttttttactccctcccaccctagctggcttttctcatcagcctccattcttccatcggtggcatctcaactcctaaccgagctatatactactatacggcaagtcctaggtaaagtcccctttgaagcggagcagtggcccagctagtatacaaagagtggtgcataggacaccaatgacatccatattaatctaggtatcctcctaattttccaatgaatggcactagtaaatcttgctttgttacaccagcgtgtgaataattttacactttcgttagacaagttagcttatgtggacatggataacttgacaacacagcaataaattaactactagcaaactataatttatagttatttgaccatgcacaacggctaattcaacgagactatgcataatggctaaataaagttcatgcattataagttttcttgagtgattaggtgaacatatgctgagcaaccactattgtgaggaattttttgtattttccatatgtattattgtttcatttaaaccgtggtcatcaattagagttgacgaatgataccaccgacctaaaatcctggctccgctcctgaagcggaggagttttataggattttctaattatttaaactaaattctgtggaaagcttataaaattcatgcacaagcagcccgaaccttgggtgcaagattactgtcggatcagatgatcagatggttcttgctaagttagtttctaccaatagcctgtatcgataagagaaatgacatcatatcatcttccgctgcattggtagaaaacttacactgaattctatcgacaaggatcaaactctctgagttttagcattttatcaatagtgtatcagtataatcattatgcagtcatataaacttgacacgtactggatactattcactaccaaatttaaccggccgcgcgcttggtctcttttttctttggaaaaatattactaatatcttaaaaatattttattattaaagtgtctagcatgctacatataactatactacttgcattcaccaaaacatcgtctattaaaaaaattattagtctaaataaaattacactggtcagcactgaagtacgtgggggagtatatctttgtccttgggattcccctgcagaatgatgcttatatacgctctttaattctcaagatcacaatataaaatgtaatgtataaatttattactatcgtgcaatcaaccatttcttatataaatgggatgttttttttttctcatttttcctcatttttataggctactatggttgactgttttatgttggtgaggcttgtcatcacttgtgtgttttgaaacttcatctatcacatcctggcgcttttcctacaattagtactacaagccgaagactggaagactactgctatacatccgaccctgttgttcgacttctgtccgacgctgccgtatctgccaatcaatttactccaacgagccagcttctctccatgtgggtcagagcaaggagcaggtaagtactggtcagatgctaagtcgtacaccccagtcggatgtgtagcaatttccagactagaaatcttagttttggtaagaatggcagctgctgcatattactgttgaatatatagcatatactatattatttcaaggtcggagccaaggcccggccaccatgggcaagtgcctgggctccgcccgctgtgctagcacgtaccctgcttaattaacaatgcaattagcaaagtagttaaggctaatgcaaaagaatatactagtctctcatgctacattaatcgatataacctttcacgttgattttagtctactcaattacaaattaaattttatatatatatatatatatatatattgtatagattttatatgtatgcttatatcttattagatttgtctaggtaaaaaaaaatttctagatccgccactgtattatttaatattgagagtatgaacgatttagttgtgatacatgaatactctgtgtcattttgttctcgaagtactcctaccggtttagttttaaaaaaaactgttgttgattctcgcccttgcaaattaactaatataattacaacaaactgattaattatcattgttaaaactttttctttccattttaaattatctgcaaagtaagaaagtaacactcccaagttacaacagcacaccatccatatatccatgcaggcagcctgtttgtgcccttgtgcagatgcatttcatttatacaagtagaaggcactcaaatcagccaccacatgaacacacacatgttccatcatcgatcgatctacacatgcatcacccggtcatgcacttacaaacaaaagatctacttgaagaagtacgggaggtcgagcacgtagaggaggaagtaggcccagaggacgccggagatgccgccgaagaagaagccgccggtgaacttggcccagccgtcggcggtctgcagcttgtcggcctccttcttgcggccggtgagcgtcagcgtcggcgccgtggacggctcgccctcgccgaaggaggcgacgccgtacatggtgaggcagacgctgaggatggcgacgaggcctgcggcgccgagggcgccggcctggccgtgcaccggcgtgttgcggagcgggccggtgagcgcgaagggcccgacgaggaggtagccgtgggcgaggccgacctcgatgccgcggagcagcgggctgacggcggtgcggtacgccgggaggttggagaggtaccaggcgaccagcgggctggaggtcaccggcgtctccaggctgccgatgaaggggtcgccattgatgggctgcaccacctggtacgttggctgtgtacaacgccacaagaatcacacatatcagatactccctctgtcccaatttattctttaggattcatactccctctgtctcaaaatggttatcataaagaattattacttgtcccatcaatcacttctaattcaaatttctatcttttctacccttaaccatcctcctacatccaactatacaatatttaattaggagtattatattttttttcctcaaaccttaatctatgctaaattatctaaaacgacaggtaatatgagacgaagagagtaaatgtttcatttatcgttccatagaagtagacacgtgtaaatacacaccaccatatatatttcttttagataatactatatttcaattcggcttctgcgtcaagatgtatccggcctacagacgccgatatagtcacgctcacacaaataaagctatttaattaagctctagaaaacgtatgctcttgtttcttgcatatattatggacttatggtttacacttatcatatagctagaacttatacaaagttaactataaattaatgcatccaattttggctaaatttgtgtaactatatcttctaaaatcgtcatgctaataatccaaccctctctcccaaaaaggggatttgtgatcgaaataacgatggcaaaaagtttaaggatgtactatgcaggcaaacttattactcccttcatctttgaaatttttcacatttcatagtactacgatgcgtctaatctacagagggattacaacaattcaatattatattgctaattgaggaaataaactagtgaacagagcaataaaaatacaacaaaatgaaaaacgattatgtctgaaatctaccatctgattttaattaacagagcttgttcttgagaaacatgcaagttttacactagctttgatgaagcgaaatgggaaatctctcaatgctctttagcagtctagctagctctactgaccttctcagactggatggccttgactgtgaagcggggcctccttgtcagcgaagcaccagacagccccctcggcttggagcacaccaagctgctcttcatcagctggctcgccatgggagcataagcagtggccatctctctcctctcgtctcttcctttctctccctagctagatgctctctctcccggccaaaaaaaatggatgtgaaacagccttcttggcaactgccctagaaattaaagtttgtgatctttacaagctgcaggagagaaaatctggagtatgtgtttgggtgggtccctgaagatgagatatggttgagagctgtgtggcgttcattggatggaggatgccagcaaccctatcccttatctgaattcctggagatccccctccttacgttggacgcctagctggcggtgccgcccgtcgcgccaagtggaaaacagaatctgcagcctgcagggcttgtggttggggcaaggttgctgaatcaatatatctggagatggcataacagaatggtcgcagactcggagtttggtcaaaaagattacttttggatatttttgaggaaatattttttcgaagtttggtcaaaaaggattacttttggatatttttgagaaaatgtttttcaaaaattagtaaatttcatgggcatgtgtttcaacggaatctcatcagtacaattaaacacatcttgcataagaaagagcagagcaaacgaactggcaatttataggttctcaacttctctagtgatccgcggggagactatcacaacatctaatgtgatccgcggggagagtatcacgagaaagtactccctccgtttcaaaatgtttgacaccgtcgactttttagtacgtgtttaaccatttgtcttatttaaaaaatttaagtaattatttattcttttcatatcatttgattcattgttaaatatactttcatgtacacatataattttacatattttataaatttttttaataagacaaacggtcacacatgtgctaaaaagttaacggtgtcaaatattttgaaacgggagtatatattaagaccgcgtgattaattaattgccagggatctacttctcgaagaatgtaaggactggcaaacaggtgtttggttgttatatgaggatgcgcactaccatagcaatacaccacacttaataatcataaacttgcttagacttatatttagggtggtgaaattaacgtcaaagaccatgctcaaagaatatatatatatattataaaaagaaccaaggcatgaagatataaaaaaagaatcaacagatgcccggtaactcgagtctttgtgttacaactccgaccaattcccctccaaaaaggaaaaatagtccgaccaattcttctccagggatatactcatgacacaggagatagtttccacagtagtttatctctcgctgtatgccaggcgcttgcttttctgaaggcaaccatggtagtggtagatgagcctgagcaggcaatccgtcatgcagttgacatcaaatgattcgataaacttcagatctgacaaccgtgactttccagcagcataccgatggtactcttcaaagactgatgagagacaccaattctgcagctttctgaagcagcccacaagacatccagtacggtgctgcggtcgaaacagataaaatatcaagaacatgtggtgtggacaaaaacaattatggattttgaacagatgagtgctttttggtacctttcctcttttgcaatggattagaactgggtgattccttacatctgaaaccaagaatcagtactagtaagtcaaaattattagcttgatggtcatcagagagttttagtatacagcaaagataaacaggacagaagaagcctaattcagtaccaagtatgaccctaagagcccccatgatggcatccacaggaatggacacgttagggtcctgcagatgcaaacatttaagagatactgaacttcttcatatatgtaatcaagaatgaagaaacaagcaaacatcaagggttattttatccaaaagcaatgatagaacagagtaacaagcacaagcacttggtgaatcacgacaatgtctattggagtgtctgacagaactaaaaaaaacttacttcttcacctgtagtaagacacaactaacaacagtggaaaggtataatgagcaaacatcaaagtgaagggagtgactactgatcgacaagaaaatgcaggtgctcttccaacattaggagtacctaactggatactaccacaaaaggaacagaggcggttctaatcattcattcagcacaaaaaatcggtagtttgtacttgcaaccgtaaaatcatgctaaagttgtaaacgttaattagacattgaacattggtcgccaaatttttatttcagagcaagtaaaaagactaggaaaatgagcctcaacttttgatttaaacttttttttcaaacaatttctagaccatgcctcacctatacttccaagaaagaaaatgtggaaaaatccattttagtcaagccttttaggccaaagtacaagaaagtatgtaacatgaggcttcttgtacatcagcaactaaactatcaaataactaaggaacaaaaaaaaactatcaaatggtcagcaaaaaacaaatacttctttttaaaatagcattgcatcctgaatagaagagggaaggaaaaaaaaatctaaatcacgtttactggcttaggctatttccatgagaaatggaaaaaaatagattgtactttcttctgacaaaaatgttggacacaactactccctctgtttcaaattatttgtcgttctaggtttgtcctaagtcaaacatgtctattttttaccattagtttttaaaaatccatgcagttcatcatgtgaattatttattatgaaagtatttctcatcgcaaatccaaaaatataaaccttatgatgttaaactatatgagtttatagaaattgatggtcaaattaaaatgcttgacttaagaaaaacatagaacgacaagtaatttgaaacaaagggagtattggacataaaatttcacataaccctatgtaataatggaagcaactttgtattcaattcatgtttaaatataaaaaaaggcatattgaaaatttaataatgcatgttttgcaggggcataattgaaggaaaaatgaatacaaatgaaggaccatgaaaaaggctgcgatgtcaaaaaataacggatgtccaactatctgtccttgctgagtatagaaagttatgttaaaaattcattctacagaccatgtatgactgaagaaatttccttacaagaaacattccggatgcattatgaaactgcctaatattagcagttacaatggtgaaaatgacactgatcaacttcaattcaataactgaaaaggcatctcctaattaagcatcaaccagtataaattgcaacagagaaattctaaatcaacttccttttgaagtttgtggattgttactacaaacatcacttgacactaaacatttaattgttctatagttatcatttatcaaggcaaccttcaatcatcaaattagcaccaatttccagaaatgcctgtaaattctatgatccctacgatttgacaaggaaagcttaggaccccacactctctggaataagtacttagtgtacagattttatgacacataattacttaatcatgcattaggttgtgaggtttaaaatcaatattcgatgtgttccaactctgattggggaatgttgttgtatatttaaagaacaaaaacacgcccttctcagcatattgcatcaggattccacacccatcagagcacaatcgcacctaaacaacatgcatctattaaacatagaagttaacaaacctaaagagaaaattcccacaaatatcacacacaaacatgaattaggaagaaaataaataaaggaacagcgtgatcaccttgttcccctcaatcccaaattgccacaaatatcacacaaacatgaattaggaagaaaataaataaaggaacagcatgatcaccttgttcccctgaatcccaaattgccacatatatcacacaaacatgaattaggaagaaaataaataaaggaacagcgtgatcaccttgttcccctcaatcccaaattggaagaggcggatcccctccgccttcaagaactcggcattcgtctccatgtaaggttcagggcacagatacctaaatccagatgaaatccaccacatgagcacatacaccgaaggaataataccaacagcaatccaatccaatctaaacgaacccaaccccccgagaaccgctcacacgacagatcggaggccgaggcccctgaggaaaccgaagctggcagggtccgggaaccccgaccggtacacccccgtgtccaccatcccgaagttggacggcggcgccaccaccatcgccgcatccgctttctccgccgccgactcgtcgaactgctccaagatcatggctgacccggcccggattccgcggatccgaggccggattcggcggcgatttgcccgcggggtggggggatcgagatcggtgggggtggcggcgagggcgcggcggcggcggcggcggaaactagggctcggcggagtcgcaacacgcggacgcaacggtcggctcgtcggcgaactccgtttcgtggaggcgggtggggcaacttgtactgggcgcgatcttaacgggctaacgggtgagcggtttcggttggtggatttggtggttggtctcgtagataggttggtcttcgggtttggtggtttaagtacggagggcatttcagtcacgtggagaaaaagaatatagattatgaatcagattaggcatgcaaagggataaagaaaaatcagttatactgctctcccaaactatttcgtcagaaaataccatagtgagattaagtcagtatttttctaaacaataatctgcagcattattagcacctgtaacgatactaaaataaaaacaaaatcagcaaagttgtgaatgggaaatgatcggtgacactaaggctcagttctattcttcaacttccttatttttcgttagcacgattttcaaacggttaaatagtgtattttttttcaaaaaaagtttatatatacaagttgttttaaaaaaagcaaataattcaattttcaaatttatgatcgttaatatttaattaatcatgtgctaatgaggtttctcattttgcgtgcaacaaaaatccaactcccaaaagagagatcaaacggggcctaagttaattaagtagtgtgaattggaaggtgattgagtgaagatcaagagagggtttccctcccgttataattaaggagataggtaggctgtcaaggcaatgagatagtaatggcaacgtccagctctgtaaataaaactaaggaagaaaagtgcgtggtaataaagaagtacagtgagaagaaggcaaagttttcttacgaagcaatgatatacctaaattatagtcgttgtagataaaacaggagtatgggctggcatcaaaattattgtgctgaacttgatagacttacatgaaggtttgtatctttccatcacgaaataggcagattctctttatatcgttatatgtaaaatttctttttaagtatggttctgctgttgatcatttatattggacaatataccatggagtatttatgttttaggtgaaaatttcttactgatttgtggttttgattttttaggaaaaaaacttttctatcataatgcaaaaaagttagggatgcaagtgggcagacttgtggcccactaagccggagtttgaaaatgggtttgcatgttgctaccgctcgtttaccatatgcatgtttcccaaactaataagcgttgccatttttttttcaaaaaaagaaaaataaacttttttttcaagtttggaataatcaatatccaattaatcatgtgcgagtgactcgtcttattttgtgtgccactaaaaatctaagccaaacttcactttcaaagttaattttagccatatttttacatcgattttatagtgatgggtacaaaataaactagcacgtgggctcttgtacgcctgtacggcatggtgcaaaataaactagcacgtttgaatgtgtagtgaaagtcgtttcttcgtcttacatttctagactagttttctcctacgaaagattatgtttgtaggtgagtttttcatgcattttttttaatttatactactaagtaaaggcttagtatggattttgttttatgtgttacgattatgaggtgttctaattttcaattgacacaaagattctcatgtttatgtaccttaatttatatagacaattcataggtttatttattttggttttgggtgaataagcacaaaacaagaaactagttcctcatattccaaatttcatcttgtccatgtttgagcctagcttacgtagaaaagtgatcggctaaaagtctaaaactatcatgcttctttttttatataattgcggcacattattgattaaggagcatcagaacaacgtactttccagaacaagagttagactcgacatagcgagctattaagtatatatgtgccgcaacattagacaactgactaacatggataataaaggaacaaagtaggaactcagacgcgagcttctttatgtagcctatcacacaaacgatgttagatcgatctcggatcatcttttggacctactgtatgacagaaaggcagtctaatgccaaaatcagcttcaggaagcctttttcttttgcgcgttgcagggtgcactggatcgcgagggcttcagcaagctctgggttgacaatcatgggtatatgctcattgctggtaaaaatacaactgtcattatggtaacaaataattagacctgcactcatgcgacgagaaccatgaaaaattatagcatcaacattgaaaagaattgttcctgcagacggtggaatccatcattgaacaacataagagatacagcttggtgcattcataggtttaaagcagtgctgctggattatatcatgtaagtcgtgaatatcatagccacccaatgaggacgccataagtcattgttgttctttgcctcattccttgcttcccaaatgtgctagaaaattacaacaagagccatttttttgatgcgcaagcttttgttcatgaaatcaaatatccaatgcctcatatctataagatttcttttgcacatctcgaagccaaacttttgcttgagtactccccaaatttatttggcaaaggggcaggtcaaaaggacattttctatttgatcatcttggttgcaaaacacacaaccgttgattgcagggatgtgtggtgtcatcatagctggaagcccgtcagaaggcaatgatgtgccgccctccgaacatttattttcgtcttccctggcgtcgtagtcttccaaagatccttccagaccgcggtatcaacttcccatactaaagatagcccccttccatttgtgctttgagcaaataggaaccgctcaaatttcaccaagtcttaggctgaacgaacagtgtatgacccaaatttatcatggggccaagatgcatagtcatccaaaccttggtggctaattgaaacttgcaggatcgagtttgcaatctcttcctgcaagacctttcactaactctgtgccctacctactgccattcctcatctcggttggcatgccaagataggagtcttgaaggatctcattagagacttgtagacttgctttcactctctctttggtgtcagattggcaatgcttgccaaagaagatcgatgattattggagaatgaccttctattctgagtcatcacaataggtcttgatggaggacttgagtgtatggactctcctggcatcactcttggcaaataacatagcactttgtggaaatccccacaacaaaaacatgggccgatccattaacgatggagacggcgaacaaggttcaaaacacatgtctcaattcctgctttggttccctatagacaatggccccttccgttgaaactgatgatcaaaacaggacaagctccctggtgaggctattatattgcagctgaaggcaaaagagcttgagaatcctaaggaccacatcatgtttcttgctttgttatcgtcttagggtgtgtttgccattcctagttcccaaccggaacagtacgcacggaaaacagagcggtccattagcacgtgattaattaagtattagctatttttttttcaaaaatggattaaattgaattttttaagcaactttcgtatagaaacttttttgcaaaatacgcaccgtttaacagtttgaaaaacgtgcgtatggaaaacgaggagaggggttggaaaaaaggggtgccgaacatcggcttagagagaaagatgaggagggtgagtcttcaccagccagcgaagctcactcactatcacacctgaccccagcccacaacagttatagcacaagatactcattgagtctggcgagactactccacaaccaccgcttgatccgctgatcaaggttgaagcactctcgcttcttgttcgagtcgatttcacctgtatcctccgcccacagcttgagaggggaggtttgttgcccggtggtaccaaagccaagctgacaacttccaatgccccaacagcctaatcatccctcggcgagataactttactagatttcttgttctaacttgagaccaccagcaatgtcccttggtctgggaacagatctctcccttaagccattggcccgtcccctggccctgccccctggcagccctatcggtccccctgcttccgcccctcatcaatccctcgtggtttgaatcctacccctcggtttctcgaagcagccagtcggacaggtcctccggaggagccttgggaatcaaaaccggaggcattgacacctgacaaggaagacacattgtctgatttggcactacctgttttctgctctactcttgaggcacacgtggcctcttcgctgcatatggaaaatccccatcttcatctcgttccgccggggttgggcagaccaagaaggaactagtagctagatgaattactgtacatactatggtattatggagtcatataaaatctactacatatatacgagtctatcagtttgcaatactgctgtttatatcagccgtgaatatcattgggttttatgctcatgtttagttgtgccttttagcattcaacgttcttttcactcgtagtgaagcacacgcattttgctagttatatcatatatattagatgaagtttagtctcccttgtatcacatcttacagtttcccaatcccaatacattgcagcttacgcctgtacgcgtgtatccaactatccatattgtaccaaaccagcgttgataacaaaactgaaaccgtctccgcttgctcctgcccaccggccatggcggcccggccggtcagccgctcgcgtcgcgcagcaagcaatccgtccgctgtccggaaaggacggcggcgagctcagacgctgacgagcttcttgccgaggatcatgtcgtcggtggtgaagtcggccgccttcctgaacgtgccgcggccgaagtcgaggttgtacgagtcggtgaggccctccaccaggtcgtactccggcttccacccgagctccaaggtcgccttctcgattgacgcgaagaaatgctgcagttgttgcaatcacatcgaattcagaacactagcagcagcagcagcagcaaatttttcttcagatttagcagagaagccattgctggatataatatataacctggtctctgaaggggaaggccttcttcttcccgaaatcgaagtccttggggttgtagtggacgatctccggctcggggaatcctccagcctgcatgatcaaatttcaaacacaccaagattcatggcaatcctgccggaaagtcccatgtcatttcttggccgctacagcttcgttgatgccacgtaccttggcgcacgcccgtgctagaccgtcgaaggtgacgtacttggcgccggagatgttgaacacctgcttgctcgccttcgggttgccgagcgccagcacgaacgccgtcgccaagtcctgcaaaaaccaccacaaagattcagagtttcaggtcgacacccaaatacacactctgaattctctgaataatgatcactgatcgaattgaccttgacatggccgagctgggtgatttggttgccggcaccggggacagggatggggcggccagccttgagccggtggaagaaccactcctccacggggttgtagttgagcgggccgtagatgtacaccggcctgatcgacgtccagttcacgtcccgggtctccagcaggctctccgtctccagcttccccttgtgccggctcttcgggtcgacggcgtcggtctgccagacacacaaaagctcggcatgatcaatggcattccatcagtggtgatcattagttagcatgagtggaaaatgcggtggcgtacctcgaagtgcgggagcaggtctgatttcaggtacactcctgctgatgagcagtagatgtacctgaagatgacacatatgggaaaattcagacattggaaatttggtttgttcagaaatgctgtaatttgggctatggtcagatggtgtagttaggcttactgttcaaggttcggcaatgcgtctaggattggggctacctcaacagcttctctccctgtaaaaccatgagccgatatgcgtgaaaaatcgcgtgatagtactatatttgatggaagattgaaggtgatagtttcagttggtgggatggaagattgctgttttttgaagttgctaggctggtttacagtgaccattagcattgacatgttttatgatctatgcagggctactatggtggtttttttggctttgaagtgttaccgtttatgtcgtaaacaacatcgaagccctttgccgcaaggcttgtcttaacgaaatcaaagtcttgcctgtcacctttcaagtgcaacacctacagaaaaaaccatcccaaattaacgccatctcactgaacttaaatgataattgttgagaacaagatattcattcagttaggcctttatactgtcctaattcctaaataatcctacattagaaattttataataccttgtgtatacattagcatctctactgcagtattatttatcacactgcaaatggacaatcctcttttacatggtatacacaggaataagataggaggaaacagcacacctttgaagagaactctgcatactctgcatctgactctcctggcaactgctgggtaatgggggcctttcctctagtgaacaatgtgacctaacaaatacagtttttcaattaacttacttctccaaaacacagaaaatattgtacttacaggggaaaaaatatcacactacacaactgacatacctggtgcccctccttgacaaggagcctggacaagaagacaccaatgaacctggttccccccatcacaagaatgttcttggagtctgcagctgctgctacctgcatccttgccccccttggctgccatgacctcctcctagcctgtcgataaagaattcacaaccatctcttagcttttctgccatgcttgaacctcatggaactgaaagtttcatgtttttctgttcttcagattacctgggttgagatggagagtgctgcactactgaagtcagagataggagatggtagcaggaggctgctcttcagggaggctgttgctgccatctctctctcttttttttcttgtttactctcctcaaccctcctctccctgtgcttgagctgttataaaaaaaaacaaggtacaaacaagaggaggggctttgtttgttcaggatggtagtatatcccttgtctgaaacttgtggttcagtcttgtgtgctaatggaacaaagcaagagagaaaaaaaaaagaggtgctgggactgttttggcttgtgtggatggggcagccagccctatcctgtgatggatcctctcctctcattctttcttctgtccacttggcagcattctgatcaaatgatggggacatctaactcttttttttattgcttttgtacataaaccctgtaaatattatatttattaatataatacagtagtagcctctcctattgtttcccgtaaaaaaaaagtacacaaagtgaggctatggtgtccacaggcattttcatcaatatatacttttttttaattggtaaaatagataaagaactagaagtttgttatacttaagaatgtaatcttattgcaatgggtataaaagttatctaatcatcttgtaactgatactctagtatcaacctgtattgtagttctttttcacctaagagatcgatgggtttccgtatggcatcaaattcattctgaacatttaaaaaggttgcaacttggttttcctcatcactgtacactccatttggttaaaaaaaaatcctagaatctttaatagttcttttaagaacatatctatgttggtggatgatatcaaagaccgcatgtactcaatcgaggctgggtggagcaaagtgcattggctagatctttagatagcctcccaggatgttgttttctttaaccattattagatcattttaatgtttgtaaaagcttgaccagttaaggggcaatggattttttttcttctattcaagtgggacacagagctcctgtgtgttaaaaaaaactgtagttctttccaaagtttaaaatttgaagttaaaaaacattggaaaacacaaatatgggcaattcaagccaaaaattgaaatctgcctctcttatcaccagtatatatagatgtcctgaatctattaaactaaaatcatccttgcttgcaaaatctgaagtacaaaaagtagaatactagaagtacaaaatctgaagaagttctcaactagtacaagacatcttattattcatacaaccaaaactagcataacaaaaaagcactccagcagctgccaacagtgataataatccaactcaaacctcactttttatcatcttcctgaaccaacgtgttgagtctttagggtaccgtgtgaaagtgctccggtctacatagacgattccgaattttgaagtgaacccgagccgccactcgaagttgtcaagcagggaccaagcaaaatacccagtgacccttgcaccatccttgatcgccctcttaagctcatggaggtactgatcaaaatattgtatcctgaagaagtcatacagtgcaccaggtagggtctcattgcctggctggtcaatgcctgcaaaaggttcttgttagattttgctcctagattcattctgcagagcacttttatagttgtactgttcactgtccgaaaattgaaagggtctccagtattatctttatttaccattttctccgatgattataatggggtccttgtacttctccttgacatgcatgacagctttgtagatcccccaaggaacaacataaagccagttcgagtacgcctgcatagatgtttaaaaaccagaatttagttcatgatctaccattcttttcaacctttcttgtaaattgttgcttacctgtttcccaattggcacaccgttacgctcatctgaatagaggaccaaaatgtgttagctaggaaggcaaagaattgaaaaggtacaaatatttctggtctaatactgtgtgatttgaaagtgtcatacatgaaattttcacatcccaatcattgagatagctgatggatgtcttgttgacgtggtgactgacataataagttgtgtaatggttgatcgcaatataatccgctgatccttttatcatctcagactgctcacgtgtgaaattgggcagcctttccttaacagcattctgcatagtttctgggtaatgaccatatgtaatcgggtgcaggtacctagcaaaagtttcaagtggaagttcagttcaaccttcatgcggacaccgtgtaagagcaatgattgatgaacagtgtaagatgtatcaccagccaagggtaaactccctggctctatgtgcagctgcgtgatcctcttctttgtcggtgagtggctcataccatacaaaatcgagaaggatgccaatcttccccttctgaatagcctgaaaatcgcaaggtatcatgaacatgagctgatacattggagattttaagaaatgttgaattggatagtaggggcatggatatcattcactagcctggtacttgtcacgatatgtcctgacagcagcggcatgtgaaaggagaaggttatgggctgcgatgtaaggctcggtggcggaattcccaccgggttggcagccggtgcatctgccaggggggaagaagccgtcaccgtagccatgatttgccatcatcctaggttcgttaatggtaaaccagttcttcaccttatgaccatatgtcttgaagcagaagtctgcaaatctcacaaaatctctcctgcaaaatgaagtcgcagacatgaatcacacattaattcaagaaaaagggagtaaggaacgtaagaaagggaggatacagattgtctgggtttgatatttgtgtatgtcggatatgctacagtgaaacctattttggttaaacacctgcagaactttcactgtcaggatttcgcagttagagagctatgggtttcataatttagcacaaaatcttcagaggtgcttctgtagtttgtcaaacaatttaaagggtatttaattttaagttttacagccaaacagatggctttgatcacgaacacttacacaattctggggtgtagccatcccttgtattgatcatggagcacctgtggaaggtcgtagtggtagagcacaacatatggaataatgtctgatgtgcaaatcaaaccaaaaaaaaacctattaattcgagatcatgaaatccgaaatgggcaagaactagaagaaatgccaagaccaacgtactgttagcaagcatgtaatcaatgagcctgtggtaataatccacgccgtctttgttaatcttcccaagtccacctacaacacgcagaagaaaaaccatcaatgaaaggaatatcccatgatctcatcactgtgcctgaccatgtttcagccggtaacttactggggaaaatgcgagaccaggagatcgagaagcgatacgcgtcgaagcccactctcaccatgttgtccacatcatcctgcaaagaagatcatcagaggagccacataagctacaaatcaagagtcatacagaggaacagaaacccattagaacaggcactgaaacacatgagactttcactgaccatgtagcggtggtactcgtcgacggtcacattcgcggtcgaattatcaggagttacacctatccaaaggaacaatcagagccaaatcaacaaccagtcatacatccactagagacgtacaaaatgcaacgcgccgtaatgcaacaacatttcaatatcaggctatgtaattctttttagattgttgttgtcatattctctttttaggtggatcgtcccaacacattgttaattccattatttgaaaaatgcgacaaactgtttatgatctgtatatttagataccacattgctagttttgcctgaacatgtatcatcgatctcaccaggttgcatcaggaaggtgtcccagatgcagggccctcggccatactggagggcgttcccctccacctggtacgccgacgacgcggtgccgaagacgaagcccgcggggaacgtctcccgcgtgaggtcggtctgctccccgttgccatgggagagggagacgacgacgatggcgatgaggagtagcaatggcatattcatgttggagaggaagagagagcggcggtgagagtgtctgatctgctgcaaactgcgtatatatggagaggcaggtgaagtggtcagggcggggcgatgcatgcatgcagcaggggaacagcgattttctctggcacgaatggtggcagcggcaaggaggactccttccaccctgcctttgtggagcagtgtggcttgcactggtcctgagccactagaattttttttatttttttctatttctgtttttaccctgtttttttttcttcttttaatcaggtgatgggttaaacaccgtctggactagtgggcatgacagtgagcttatcgcctttaaatttggaaactgcatggtacgtacctcagtctgaaaatataacaatttctgagatccccaaatacacagtaaaaaaatgttatattttgagatacagatagtatatcatatttaaaaaaactcccctttaaatatgacaagttttttaccaccggattaagatccaactgctgtccatgtcctgctatcttccaccagtcctccactggcccaccctcaacccactcatatgagcgtctcctctatgccacagcttccaccgccaccgtcttttcatcactatttctgttctacgtgccaccacttgtctatctcgctacgaccgttaaagacccactagagatgttgtttggctagccccaacaccgtctccttctgctctggcactctggctcaattaattcttcccattacctgtatatattctttgtctctaaagccccacactaccttaatttctctgatgtttcctttgtattccgccataggatgtgccattgtcgtcacctaaccactggtttcttgatgcccccatttgcctccaccgtcctattacgtcttcgtggtgtgtcgcccgtctcacctccctcacgatgtcgtggtctaccatcaagtcgccgccacctcgacattcatctaaatcgaagaactcccccttcccccctcctcccatcttgattctgactctgagatcttagttgttttggtaaatttgaaaaaagaagggtaaatttgatcgtgccattatggaaacgttgtattggaaaaataccactactaaagccgaaactaggtgggtgtcactgaattatcataaaattagaaatgtgccatcgccataaatatttccgtcaaagaggaaacatgcatcatttttcttcctctccaagcaaccaccggcggatggtcaagagggcaagaccggctctataatttcaagagccccttgattctataggccctaaacctttttatttgcaatatatactctataaaccatgttttttttataaagtgatattaataaacattactaacatgataaaaagtaaattaatgataaacagtaaagtaagtagtgcaaattaagatatggtattttattctcgataaatattgctgatagtactgtaataaaaaactaaaaggactgtagaaacaaaatagtatgattatgaataccttaaatacgagaccacaaatatacaatatatctgatataaaatcttgatgacaatggcatggtaaatttatagaagtatgagtggcatccacccgattttggttttcatagtggtatttttccaatttaacattttcgtaagggcatgggccaatatattaaaaaaaaactcactatggattgcaaagaccggttgttgaatcaaaactagacccaactataaatcgggtacccgatgtgccccttcccaacatgcaagttacttttctctccatagcacctctgcatgcatacctcatttctctctcttccactctttctacgcgcatgcaagctctctcctccacacgctctctctctcctatacactttttttttcgacacctcctggtatcgatcacctctctctctctcctcctatatactttttttccaacacctcctgtacttaactaggtgattccccgcgttttgctatgaaaattactaagtaagttttaatatgtttttttaataattgagctaagagtgaaaagtatattggttgttaacaataaataaaactgatttgtcaaactatgttcgatgagaaataaatttagtagactctgtaggagattatacatgaaatatgatatcctgcattttgattatatgaaaattcaaatgcaaaaataagatcaaattgtgattctaagatgcattcctaataaaacaaaacatgtgttttctccaaatggcagcaagcacgctcggctgagcaaaaaaaaaaaagaaaaaacgagtgatgactaagcagaaaaaaaggtctggacgacgcagcataggattaatagagaaaaaaagaatccaattctcatgaaattcacgcaaacctgcagctcctcagtaattaaattagagatacatattgttagaaaaatagagaataaaaagtaagttattattcacatgaataataccgatgaaactatagctcttcatcatcaatcacacatttatcccagttttcggacccttaacttattcctacccacgaatcaccatccatagcacacactaattgagctaatccctctttctatatagttgagacccaaagctgatctgtgattaagccacgtcaccactaaaacctcagccgttcgatctgatctggacggtcgcacacaggtgaagcccagcccacttctttccaggatttttcggtttctcctaacccatccgcatcgcgcagaggctatgccgccgccggatgcggcgcttcctctcccttctccttcaccctcgcgccgcttctcctcccccgtgcgcgcgcgcgcgagctgcgccgcgggcccgcctctgatgcggtcgcttcccatccccgcgtcgcactgcctccccccatccccacgcgtcagccacgccacgcgcctgtagccctagggaggacgaccgtcgcgtcccgcaacagctccttccaccgcctcccctcccctcggtgcttcctctccattacttgatgccagaagggagcacgcccatcgtgctgaccacccagcggcgcctccccagccatgctcacacccgtcgtggcggcggcggcggcggcgccggcgcggtcccggtggccaagctggaggacgccgccacgctcatcgactccgtcgagacgttcatatttgactgcgacggtgagatggcacgctggtcgctcgatggttgattggttgtgattttgttatgaattgtcgcgttctttttgttgcgtagcagcgtaggtgtgatttggaagggcgagaagctgatcgacggagtgctagagacgctcgacatgctagatcaaaggtccgtcgcaaactgcaatggtcttctcgaactccgattccaacttagcattatcaatctgttggagttgaagctgatggggttgtggtgttgcagggcaagaggctggtattcgtgacgaacaactcgaccaagtcgaggaagcagtacgggaagaagtttgagacgctaggactaaacgtcaatgaggtaggattcatgccatgaactaccaaattttctttgtgcaaccaatctggtctgatgagcctggaacgctctatgcaggaagagatcttcgcttcgtcgttcgcatatgtggcgtacctgcagtccatcgatttccccaaagacaagaaggtaggagtatctaatttatatcaccatcttcagaagttaacatgttttggtacgaagatacgtgcacaacgttaccatttatactgttcatgttcagcgattttggcaaataatgtgtgcatgtttaacattttaattgttcaggtttatgtgattggagaggacgggattctgaaggagctggagctggctggatttcagtatcttggcgggccagtaagtaataaaatttctgaacccatgttcagtgctgcattcctgggacagactaacacacataacaatcatcttgcagtctgatggagacaagaagatagaactgaagcctggattttacatggagcatgacaaagatgtaactacgatccctactagcactcgccacctatttcatatgtatagaatggtagttggtgattccgtatctacagcttcttctgtatgttgcgctactcctgttgatcttcaatccgcaaaaagaaggccgatgtgtaccattttcctttatacattgattttggacatggccaagtcaggagtggagtttgaggctgcccttttttattctgatggttgaaatcgttgtcttcttgcctcgacaactactgatccattttagagcttctgctgcttgccctagatcaacttattgtccaaaagtatgaatctgcaccagctggacagcagtgacattgtcctctcactacaggtaagccgatattatcttttatatttctcatccattcattcttgttatcacttgctagccattgtcctctcactccagcttaatctttctctcttttcccctaaacagaaagccaggggtttgtttggaagatttagtatactccgtaagctgaggtgctcaaagataccttctacctggatggttcctcgaggaagtttggcctccccttatatgctaccactatctctctaccttcctatttcatttgttcgtcactaaagaatattataacgttgctttcagaagattcaaggatttgctctatcttccatttctttcagctcaatatcattccttttcatcgtaatgatataataacatcaagtgatttgatcaagcataagaaagactgcaactgataaccatttgcaacagcgcactgttatatatttgatatttggcatgttcagaacttcttttaatcgatttctattttctcagaattttcttaccatcattcactgagcatggttattgttcttgatgaataccttatgagaaagaacatgtattatgctatgtggattggccctttaccttactgattttatgcatcaaagattgcatatttttttgggttcatcgaagagatataagctctaccaggatattttcatctgttcagccgatggatattttcatctgttcagctgatgaagtgtgcaatactgcagtatgagttaaatggatgtttcagtggatttgaatactgaatttcacttccttttgctaaaatgtaatt

SEQ ID NO: 74048 - DNA, 1052 bp, Oryza sativa
ctcgggtttgggggcaatgtttcctctagacgaagagtggctaacaccccgtcactccaacctcatgcatggctggagtaacgtacgtaaccatgcatgaacgaacaccaaatcactcgaggttgaagacaactagctagccacctaagaaacgagaaacgagaaacgagaaacgagaaagatgaccttagcggcaaccgcacaacggctcaaaccaacccagcaaccaatcctcctctccaaaaccccccacttccttcctctcctcctcacggcctcacagcaagcagccaagcacacgaccgatcgcgatcccaccaccaccggctgccggcgggaagaaagctagctagcaaaccaaaccaaactaaagccatatatatggcggaggaggcccgcggcggtcagcgcgtcgtcgtggacgacgatcgcgaggacgcgtcgtcggtggcgtcgtcgacggagcgggcgttcgagggggagccgctgccgtcgctgggggagacggtgacggcgcggtcggcggcggtgagcggggtgctcggggcggtggtgagcgtggtggcgataaggctgaacctcacgtcgggcctccttccgtcgctgggcgtccccgcggggctcctgggcttcttcctggcgagggtgtggatccgggcgctggacgtggtgggggtgtcgcacctgcccttcacccgccaggagaacaccctcatccagatcgccgtcgtctcctgctccaccatcgccttcagcggtattccctccatttcatataactacgagagtaattttgacttttttctatagtcgtttaagtaaatttatagaaaaatttagcaacgtatgtagcaccaaattaatttcattaaaatcaatatttaatatattttaataatatgtttattttatatttaaaatgttgttatattttcatacaaactagcatggtggcccgtgcagattgcgcggctagcatcattaaattttctctcatataatagcatatatgtttactcattatattactcaaatatattaaaatgacaaca

SEQ ID NO: 74049 - DNA, 655 bp, Oryza sativa
cttcaacgatctagatgaaaatacaccctaaacagatctgttttaactggggaaattgaattatgaactggccactaaaacgtgaccatgcatgctgtcaggccttggaatgggtggcgcgacgggcaccgtggcctgggcctctagccccgaagggctgttttggtttaaaaccagaacttgtgttaccaaatcattgatgtttttgaatagtacttttgaaatgattcttcactgacatatcgaccaatgtcgtcaaaatattagcaatgtcaaaaattgtctaggttttgacattataaatattttaatataatagcaaatcaaactggaagccactacgaatcgggcacccgatctgggagaaaaaaaatcgggcgcccgtccgagccgtccgatccagcaccctaatctcgtccgtctgcgtgcattaaacaggagtttcaatcagtcggcgcctactgcaacaaatcgcggggcttgttccacggcgctgtccaggcgcgagccaccgccggcgcacgtgaggggagagttccgccggagcagccaccaccgccaccgctgatctcctccgaagatgctcctcccggccgtgctgggcgtcgccgccgtgcctcagatctccaatgacaattggcgccgccgcaagccg

SEQ ID NO: 74050 - DNA, 31462 bp, Oryza sativa
ttcctgcagccccttcttgtgtcgctgccactcgtcgccgttggccaggacgagccccctgccgaacagcttgagcagcatcggtgtcgtcacgttcttggggaacagccctgtcctgtccgagagcacctgcttcgccacctcgacgtcggccacgcacatgtccggcgtccatccaaaccagtacaagaacactcgccctgcacacaaaaagaatcaataacatcacataggattcagacgaagacgatagctagctgcagctctgattgttatgttaccgtagagagggatccattggcggaactgaggctggacgaaggggatgaagtcgtgggaggcgacgtcgagcgccgcggcgccgccggcgccggcggcgtccgcgcggagcttgttgatgtcgccgaggctcccgacgagcagcctgtacccggggccgcgcacgccctgccgccgcagcgccgcggccacggcgcgcggccgccacacgaggcgcgacagcgcgtcgagcaggcaccacgtcgccagcacggcggcgagcgcccatccgtaacccatttgcgcgcacgcggggcgagtgtgagatagatcgatgctgctgttcccgattagggccggaaatcgagaggaagaagatgcgtacaggaagcgtacgacgacgagctgtatgcctgtatgctaggagtaattgatttttatggaacactgcaacacatcacatctgatccgtggatttttcataaacacgttactacatttcattttctgctttaaccgtgcgtcagcgtcattttccttttctatcgtgtggcttgcgcgctcccacgcggaacgctatcctggagggcccatgggccttgttgggccatgcatttttgtagtttcaactttttagtgatcttctgtgttcggctccacagtttcccaactcctctttctcgtcttccgcgcacacgcttttcaaactgctaaacaatgttttttttaaagtttctataagaaagttgcttaaaaaaatcatattgatccatttttgaaaaaaaaatagctagtacttaactaatcatgtgctaatggaccgctctattttccgtgcacaggagttaggttgccatctcccccaaacgagcaaagctagtgatgtatacggtggaccgacggtgcttaaacttgtgtgtgtgcgccatttaggtcctaaactcttatgtgtaaagtttctatggctgatacttatatgtacaattttttacgtttctataaatataaaatcaatatgctgaatatttttatgacacaaagtttttatatgtgccaaaatgtatatgtatatgaagtttttaaggtataaatgagtgttgttaggctgcgttcgttctcctgagttgggaacacattccctccgctccgcacgaaaaacaaagcgatgcattttcttatgattaattgaatatttattttttttaaaaatagattagtatgattttttaaagcaactttcatatatatatatatatatatatatatatatatatatatatatatatatacacacacacacactagcaaaatatatccctttgcacgttagacacacgacacaaaaacaacggtatgctaatatgctacttctatctagtgcggttcttgatgcaagggatcattacaaagctttgcttgcttgctttgcttttacgggtccgtccctctctcggactccgatcgattgatcaagcgagctaaccaacgccgtctcgggaaagatagttaaccaacacatgtacagaaaaaagaattaagccgtcaccttcccttttaacgttgcttccttgatacagctttaactaacttgccccacccatctcatgccattgccatgcacacgtacgaacgaactacacacatcacccaccccgacctccagctgctaaaaaaatattgggtaattggggattttttttggctcctgctgtctctcgcgatatgatctcccgtggccgcgacgcccaaacgaattcgtgaggctttttaggtgcgtcgtctctgctttcgtttggcggcgacggcaaccgggatcaggtcggctagcttacacacatgtgctcggcgatccaaatcaatcagattagttatggacttgtttgttggtacgtgcgagtgaagacatgcacgcacgcgatggcgagcgcactgatgtgcaggttggacctgaaattaattcaaggggatatgcattagtatttcttttcaatgttattttgtttttcaagttccctggattggtagtgtactattgtccctctgctcaaattaagcatggttatttggacatcgatttcgtgccgaagatttcaaatcatgcacttgaaacgggtaattatgtggcagtacgatgtacggatatgtccatgagaaacttgttggagctgaaccatcactgtagcgtgccagaggctttgttatgggcctggcctgcttacgtgggctggtcgatgtcaatcgtgggccacgaccagagccacagcgatacggcataggaaaaagtacaccgaaggtccctcaacttgttatcgaattacaaaatcgtcccccaaccgtaaaaccagatatatgacatctcttaacttacaaaaccgttcattttacatccttcggtggtttttacccggttttattcgacgtggtgggtgagtcagcgtaggacccatgtgggtcccacatgtcaagacaccacgtcatcaggctatctcttccccctcctctcccttcctctctctctctcactcatctccctaggcaggctggccggcagaaagatttacaaaaaatagaccctgcggctctccatttgggcggcaagctgacgtggcacacggcgtcgtgatgtgccgtgtgcgcattttgagcttagacccttggggctaaatgtaatttttgccttgctaaaaaaaattgactagttctttttacatctgggccccttgctgcccttgcgaattttgcacggaggctccttgccgcccagacagagggcggcaagggggccacgtgcaaaaaatcgcagccccccaaaacgaccgtcctgcaccgtgtgccacgtcagcttttcgctgatataatatttttataaatattaaaaaataaatctaaaaataaaaaaaatcagtgttcaacatctactctgaaacagtgccaaatatttcttgtagtgccaaatatttcctgcatccttcgtacggcccatagttaaatatattttctccgctacaaaatgttggtacctagaatgaaatttagataacgaatatggataaacttttatccaaatttattgtcgagtctgtatataatttctatccagattaattgttctagtatggattaaatctcattttagattacaacattttaagacgatggtaccttcagaatagacaaaatgccaggtaaacctcaataatataaaactcgaaaatgtaaatgaagtctgctctgccttgtgaggctaggctgtccagggaagcaggaaccaagtcaagcatggactgtaacatatccatcgtggcatccaaaaagcatgaatgaacaggacaatctgcagagtgcagttatcaaagatacagggtatctcaactccccaatgttgagatgcattgcaactctgcaagttcagtaaaatttaaaagaagcttagcatgaagatttattatcacatattggcagaaaaggtgtcaactgtaaggcctttgttgtatttctgcataatctgacctttaaggctgtcataaatagaacagtatctcagtgccttataattaatggagagctcataagataatcacacctcacaatccatgcacgtaaactcggttcatacaagtgaaactctcatccatcagaaatgtctaaaactattatcccatttacaagtgggtcctattattattattattattattattattattattattattattattattattattattattattattattattggtggttgttctttcgtgtaaacaccatatagtataaagactaggttaatgtaccacatgagtaaataccaaccttaatactgttccgtgagtcgttatacacaatttttttacgactagtagcatgcccgtgctaacgctacggtaacatgtcgtaaaacatattaaatagtcaaaataagatgtggtaacaactaactatagaatgagataggttggcataggaaatatcatttttgttaaagtaaggacttgtggtagcaaaccaatttcacccaaaaggaagctcagtcagttctggtacaacttttttacagactttcttacaccttttataaaaaagaactgattcattcagcaccaaacacagcccttggatctgccattagggaatatccacatatatatataactaacctgaagaattatcttcagccgtggttagtgctggttcgtgccactatgtgtaggtagaaaatagtactaactggtagcgccaattaaatttaggaagaattaactggatacaattacaagaatgttgattccattatggagcagcatatgctctcaggcggcataaatagtgcacccgcaccctaccgtcgaggaaaaaaacataattttgcaatcaatcggattagaattaaattagggttcaactcaataaatatgttccacggtgcttgcaccaactaagtgatgctgacctgtagttagaaatataacaaaacataataacccatgataaaactgaaagcatcttgttattaaaatcgatagttgagttagttctctgacagtttttgtagagtaaatacatctgaaaataaagctccagatttaccagggtgattcacacgatctagcagctttgctccaacacaaattgaacccatatgcaaatgtctgaaataaagtacagttagctattttatctcatcgaaggaaataaagtgcgaatgctttttcatcctaatcctttgtaaatataactccatcaaaatgcagtgtatgcagagaaatcctatcattttgaaccatttgaaatcctatcattttcaaccattttctttaacatcaaagtcgattttcagcatcaccctatcatcaaagtccattttccacatcgtcctctcatcaaagtccattttcttaacgtcgagcttcattttcagtctccctcccctgtgccttcctctcatcttatgcagagtatgctcaacttcatagatttacagtaaaagatccaaatcaaatttggcaataaaatctttattaacttgtttgaggatctaggaacagaggatacattgccttaacctgcatactcagctgctccttgatcaacaaattgcagcaccaaggctgcagagtcccctaacctgcgagatgctcaatttttcagcctgctacgcagaagcaaaaaaacaatctgcagtccgcttatccacttggcaatctgccatacttcccagtacttctacagctaaaaatgttgccacaatcaagcaaatgctataaagggaggtcaaatttgcaagtaagatatattgattgtattgtttcagtctacccgcttctctaaataaccactatttgatgtaaacttaggatagaacttggttttaaatccagcgactattctgcatcagattaaccgtactatatatactgaaggtctgaaacatgcaaaatcatgcctaaatttgaccaatttgtcaacggatatgctagacggaggaattcaggaatcataacaccatttaataatgggatacatgtggacacaaatatgcaggccaaaattaaggcagcaagaagagaacattcttatcttttcaaaatactgtaagagtgtgattcatttcttgcaataaagatactacattacgctattctgcatcttaaaaaatggcattgaaatgggaccgttttccatatattccaacagattgcagtaaaaaaaatgaaacccatgccacaaataactcagggatatcacattggtgcaatcaaagaatcaatgaaacacttttagcatgtttaaactccacagcacaagcctgatacacaaaaacacaaatttgtttggtcagcgagctagatattagttagtaacctgattgcgacagcatggatcacatcggtcccctgcaccactgcagccacccctaatgatttcttattcttacaaagatggcaaaacaggagctgaagaaagcaaattaaagagaaaaataagagatcgggtagcttacttggtgcagcgtaggcttgatgtcttgcctggatgccgacgacgccgccagatcggagcttcggagctggtgctgatgcagtgagctagtacatgtgggattttgtccgtgggtatctaaaccatacatcaggggcaaatgacggcacctggcgagaggacggccagcttcaagacggcggcggatgtggttttggcaccgcgcgaggctgttccagggatcaggcacgctgggcggagatggccgtcgacgacggtgctcggattttcgttgaggctgttccccgaagactccaggcgacggcgatctggcggcacggaggcgggcatacaaagatcggtggcgtcgcgaacgagagtaagggtagagcggcgggcatcggtgtcacggcggcggagaggcgaggagccggcggcgacgagttgtgagcgacggcggcgaatcgtgggcagcgctcgcagaggagaccggcgtggtggagaggcgaggggcggcggcgcggtgtggggacggcgacggattgggggttggcgtgacgcggggagagagagggagcggcgatggcggtgcggtagattggagagggcggcggtgatcgcgggtctggtgatgaggcgacgcggcggcggggcaaggaggcgacgcagggaggagggcgaaggacgcggcgtggggagggagaggagatcgatccgagagaaggggagaggagcgatgcgcggtggggaggagatcgaggccgttggatatggcaatcggatggttgagattacgtgtgtctgtcaaatgcgtctgctgtgttaggaatcaagaccaccactaccgattttttaagtagtagatatatatatatatattaaaaaaaacaccgtttagcagtttgggaagcgtgtgcatggaaaataaggtggagggagttaggaaacaggcacacagctggaatgaacgcagccttaatgcatatatgaatgggctgcaggtacgctcatgggccaaaattgaaagggccaattagagtgggtacaatagcatagtataagctagctataaacacatcgagatgataaattatgagagagaagggcagtggtctacatatttgtagccagctgcagcacagattataagacacaatatatttatttcaggtcagaccatatattactaatgtattgtatgtttataggtaactatttaatgaattggctattaaatcgactataaatgatttgaagctaatagttggctatgctattaaacttgctcttaagacgtctgctgcaccaagaatacaaacgacgagtaaaaaactcccatatattacaattagaacgtttgtacgcacgcggaaacaagtaaaaatctggcgagcctggccggcgttggatgatgaccaaatcaacttgctacgtgggataagaccatcgtccagaccgcttagtggtaaaacgaagtaggagtaggttctattactctctccattccactgaataagacgcggttaaaattggtacggtatctaaaactattctttaactataaaactttccgtatattacaatgtttttagtaacaagattataataataggaaagaaaattcaaatatcaatccaatattttttttcataaaataaagtttaatttataataaaataaatagctaaattttaaaacacgtgcatatactttatttagtggagtaggatgaagggagtagttgacaagcatctgtacctggtttatggtcgggagaacaaaatcgggatcatggtttttgtatgaggggttctatatggacttttatgtttttctctactcctcagctaggcccatctgtggtccatcaggcctcggctgagagaggagacggcctggcacggccaaccccacgccggccgccgccgccgcgacgatgtaccttgcaaatctccgtttccatcgtgtcggaggggttcggagtttgaaacaacgagcctctctatcttttttaatttttgttttattttttacttttgctggttgaattgtcgtattagagcatatacaatagctgactataaaccagctataaacatattttaaagagataaaagatgagagagaaaagcaacgggccacagatctggagccacctgcaccacggactctaagacgtaatatgtgtgacaagtgaaaccatatattaatagtatagtaagtaactattatatgaattgactattaaattcgctatatatgaattatagctaataattggtcatactattaaacttcttttatcagagggagaaagaagagagattactttacgctggttggcaaagagatggtgcaggacaaagtcaactgacgtactaaaaccctgaacgctggttcagtgaacgagccgcgttcatcatggttaattaaattgacgcgtctaagtagttactctctttatcccataatatagcagtctaatattaaataagaacattaaaaaaacataggataatatatatcatagtattataaatctgtaaaaaatattctagtactacgttcgggagagtctctctatccaaattcgttatacgaggaaccatttagtagggagtagaacaatagctactatatttatttcaaaacattttgggatggaggaaaaatagcagggcccatcatttatattattcggggaataagccaaagcatatttataaacgaaaaataatttgtatacgtgttcttagcgatttaaaagtaaaggctaaaaataaattttgataaaaaatcctcttaaaatcaactttaaatttaaagttgaaaaatttaaatttggactgataagtataagcataaacgaaaagacgaggctgtgagcttcctcttcacgcggcactcaatcgtggccgttgggagtgcacactgattatacaaactcaacgtatatgatagttcttcgagctacttagatggatgacatagtatgctagaacttcttttgtttactccctttctcttctccttgtagtaatttgttatcttctgcaagtggttcccctagtcaactggacatcatttgcatttgttttgttgttttgactcggcccggatccacgtacgtattcatattgctctagtcaatatcttggctgatgagctaggaaacaccaaaagttctgatatccaaccaacggtcaaagcagagaaatctgcacctgaatttcgtacaaagggaatatatatcatacaagtatgataaaagaataacaaaaccgatctgaagtgtgtaacatttggaatgccaaacaagtaaacaaccgccatatccgaatcaacacgcttataacgtcacatacaaaggcagcgtaaatacatacatttcttccacatattcaggctcttttttggggagaaaaggcattacacatttctacatcttcagacattttgtggattaggctttcgttttgttttatcacttgcatccaaatcttttataaactattatatgtttcagacccagctatcattaattattacaagtaatgtctactgtctgacctagagcactaattcagatgatgaacacgtgattttgcatacaaacgatgcatatttgcataatatatacacatctccttacacatctgattaactaatcttcaggctacttgatgaataagatagtgacatcttatatggttcttacgtttaatttaaagacttgctccgtttctctgcatatatatatctgttttcttgtcttgactgaagcatatgaccttgtcaacgataatttcgtcttttgtttttgtatctccgatccatactgctcaggccaagagtaatatactagtagtaccttggttgatgagatagaagtacccaaaacttcttaaatccaatcaacaagcaaactagatatatttacaccccaatttcgtacaaaatggaatcaatgcattacacacagtaacatcatcagtaggagcaaatgctcatgaacaaaaactaatctcgtgtacaacaaagaagtactaaaataaccccctcctaatgaacaacttctacaccttgagactcttgaggatcataggcagcccatactttggccgaagcgtgatcacgtcggttggcacgtggacgtacttgggtgatagagtaaaggagaacctctgtaggatcattgcaattacggccttggcctcgatcatggcgaagttctgcccaatgcatgccctcggcccactggagaaggagagcaacgcgttgggatattttcccgcctttgacaccccattcttgaacctctccggcttgaatatgtcggcgtcctcgccccacacctccttatcgcggtggattgttgcaatcggaatcgataggacagtgccctcagggaccgtgatgccgccgagttctagctcggcgttgaccctcctctgtatgaatgcaacagggccatacaacctcagggtctcgaggaggaacatgttgactagcttcagcttgttgagcatgtcaccggtgggcaccttgccgtcacactccgttgccacctcctccctgagcttctcctgccactccggatgtgtgctcaataggaacatggtccatgtgagaaggtgtgaggtggtgtcgtgccctgcaaagaagaatgtcttgcactcggcgatgatctcgtccatactaagttgtggctggctctccccgtgctccggtgcacatgcctccagcattaatccgagcaggtcgttcccgtatcctgcgacatctttgttgttgagccggctcttgatgatgtccgtgagcatgcttctcaccttcttgtccactgaccatgtctttaggttcttcttggtcgggaggtagctggaccccgggatttggatgctaaggaaggtggagaaggcaagaaattgaagctctctttgtgccaagaacacttgcttcccctccttatagctgctcccgaatgctgtgtgcgagatcacatcagcggtaagctcctcgaatcgtcggctcagctcgatctccactatatcgccctttgtccccaactcggattcccactcggaaatcatagattgggcacaatcggacatagtcacagtcatcatcttgagcttgtccatgttaaatgccgggtggactactttgcggtggcgcttccactcatcgccgtcggtgagcacaagccccttgccgagtagtcgtgcgaagtatgggttcgacacgttcttagggtacatccccgtccggtccgataacacctgcctcaccatgctcacgtctgccaagcaaatggtaggccgcgctccgaaccaatacatgaatgtcttccctgcagcacgtaaataaatacgaaaaatacacatatatcataaactagcactaggatatatatatatatatatatgatacttacaacatctgattttgtaagaatcaaaagaaaactccttatcggtgaagtcacggagagcgtaccatagagggggatccatttgcggaagtgcggctgcacgatggggacgaagtcatgggaggagacgtcgagcacgacgccggcgccctcgtcgcggagacgcctgatctcgccgaggttgccggagaagaaccggtatcccggcccgccgacgccctgcgcccgcagccgcctggtgatggcgcggggcctccacaccagcttcaccaccgcgtcgaacgcccacgacgccaccaccgccgccaccgccgccgccaccatccaccccagattacccatggctactagacgtacgccgcgagatcacctgaaccagtcgccggagtacgtacgcctatactgtagctctgcttctgcttcgatcggctggttggtgagaccttgagagagatcgaagagctaccggagctatggcttagttcgtcgttgctgtttgtgtggtgagatatcgatcgatggacttggtggctgccggaggctgtgattttatacgttcgacgccgcgcggccatgggccatggccggtttgacctccgggtggctatagcttggtgtgaacgcgcggcgacgatgacgcgtacatgccatgtcggaaagagaccgtgacatcagccgtgatgccagcagttttggcttcgctggcgatcacgtgccgtttccgggctcgctctcccgtgcggacgacagtattttttacaggacaccgacgtacacgtatacgattaatacgtacacgtacagcagtagttgtatcgatttatttatctgtttattattactccgtcggtttcgtattatatgtcgttttgaaatttttttcataatcaattttctttatattgatcatgtttctaggaaaaaaaggtaatattttgaacacgaaacaaacatattatcaaaatatattcaattttatgtttaataaattaatttggtgttacaaatgttgttaaatttgtccatacacttggttaaatttaaagaagtttgactaggaaaaatataaaatgacttagagtacatttgaccatttgttttatttgaaaaattagtataaatataaaaaagaataagttatatttaaagtacaatatatatatacgtgtcgttggccatgtacaaaatactgtactgtaatacgtacgtgtggaagaagagcacgttttagcaaagcctgagaagaaaacaggagataatgagagattgatgattaattggccataggagtagagaacaatcagtgctaacctactgacctcaacacggtgtctgagttgtcaatttggcatttgcagagcaaactttggcgcgttagtcaccaaatccctaatgattaatgaacatactggtccaaggattgggaggttcccattgacttgtcctggatttcatttcttgtcaatcaaggtcggagagatattcagataacgtttctagaaggacaaataaatgagaaaaacaatgggcagcacgtaagatgatttatatactccatactataaactgcatcactgcagctagcgtcccactcaagagacaatagcattactaacccgtagtaagaaacagtggcgaactcagaaatgggccccatcgtttagcttattggcgaaataagcgaaacggcatattcacaaacgaaaaataatttgtgaataaaacttttatatacgtgtttttagcgatctaaaagtaaaggctgaaaaataaacttcgatgaaaaaataccacaatcaattctaaatttaaggttaaaaaattaaaattttagctgataagtataagcataaacgaaggttgccttattagagttttggtccaataaaatcttacatgctgaaatttcgaagtgctccgcgagtcttttgtcttgggcctcgggcatgcatggcccgtgtaatttagggtgtaagtcctccctgaactcataaataaagtatattttataacaaaagtaattttttcttatcaataagcagatcggaaataaaatcattgttttaaaatctttttggacggaggaggttgttagctaggcctgtttggctggcccaggctgcggctgcaccacagtcaaccggaatagtgccgctagagtacagggatgaaactggttcggatagtttccgtccgtccggaccattttttggattcggatagtttcggtcggaattatccagaaattcagaatcgaaaacgaatacagttagggtactatccgtcggaatcgaaaaacagtcggaaactatccagaatttttttttcagatatccgcagacattgagcaaattatataaaaaacacgtatatatacataactttttcatatagaatcagatgaagacaaactttatatcaacattgtagagctcgatgagatctacaactttattattgactattttattatttgaggtcatttataggtctaaatattcattataatataccatattaatttttataaaatctcagatctacaattcaacgacatctgatggagatgtgttccatatcaaagttgtagagctcaatgggatctaccactttgtagtttataacatttgtatttgaaaggatttaaagtataatacaaacataacaagtttcgaagatgtgaagtaaaataaataaaatcttcaatttatacaatggtaagtaagttatacatatagtaggtcttgggaatagaaaatgataatcatatttgcatatggatctcttagagaaacagccgtaaaaatcgattttcacatacggttgtgagaccgtctgtaaaattgacgatataaatattggagatgttgaactaaaataataagtgatatatcttccttgatcaagaaactcaatttgaggggttttttatataccggtaaatactcgctaccgtattcgttccgtctcgtattcgctccgtatctgtattcgataatattcgatttcatttccgtattcgagttttcgattctgattccgattccgaaaaaaatatgaaaacgaatatgataaagctagtttccgtccgtttccgatccgttttcatctctactagagcatacatcaccattaaagttgtgtctgttttgatgattgcaattaggccgtatttagttcaaccccaactttcaactttccatcacatcacatcacatccaaaatttttctacacacatgaacttctaacttttttttctaaattttcaactttttctaaacttgtaactttttttttaggaactaaacacagccatagtgacactactgctgaacactgatgacacggtgttcaggcaaacgttctttttacgcagtatatgtgcctttgattgaggcaattactgtaccgtgatcatcgtctttgccttgtgtcctggcatcgattttactacattagtttcagatactgtcattcggtttacaggtttagatatacgacgaaaacgcttttcggcaaaagacctcaaaagtcaaaacacgaacatgatggtgggaaacgttgcccactgtcacggaaaacggtacagttcattagcgcgtgattaattaagtattaaaaaacttgaaaaatggatcgatacgatttttataaaagcaactttcccataaatttttttttaaaaaatatcacaccgtttagccgtttgaaaactgtgcgcgagaaaaactagggatgagagttgggaactctcagcgctgaactcaaacttaatgaccaagtgaacactcgggagaatatataggtagcccgctagcagtaaattcatggaaaatagcaacttatgtagcgccaaattattaatattttaaactgaacttcttatttatcacaagtgaatgaacatgttgaacatagaaacccataactatatttaaaatgagacggatgtagtaaatgcgacggtttggtttgaagccaatatgttgataaaaaaatgtttaatttggtatagttctaaaactttcttcactataataaaaaatttgaattccaaataacatcgagccaaacacactttttctttattaacctgctaaaatattggtagtcagaacttatgaaaatactgatactatcaaaaaatattttgatagggtactaagtcacaaaagccctacatcttctgagattggccattgcgacttgcaagtcaagactgaagtaaccgattatacaactgagcatatgaagtatttgtttcttcgagctatttaaggaataacatattaaacttttttttaaacatggtctccctttctctcctagtagctagtcattataaacttctctgtttaaacatggaccttataaacttttctatttacgccgagtttagatccaaactatttcttcaaacttctaactttttcatcacatcaaaactttcctacacacacaaacttctaacttttccgttacatcgtacaattttaaccaaatttctaattttagcgtgaactaaacacacccttaaacattgcctccctttccttgtaacctgactttaatatcttacgcatgtgattcgttcagtcaactggaggaacgcgagattttagacaagcactaaatatttaaatagtatgaccattcgtgttatttacaaaattacataattgttatttatattttacctattttataactaaaggttttttttaatgagatgaattgtcaaatgatatttacaaattgatagcgtcatatgcattaagaaagtgagtaatcatctactccctctatttccctctatttcatattataagtcactttgatttttttcctaataatattttgtaagtttgattaagtttataaacaaatatagcaacattttcaacacataaaaaaacacattatcaaatatattcaatgtgatatttaataaaactaaattgatgttctagatattggtaaactattttcgctacaaacctaaagaagtttgactagggaaaaagtcaaatagactttttggtggggttgagaactcacctcctacgcacgtaaaacggacagactcattagcgcatgattgattaagtatttgatatttcttttgaaaaataaattaatatgattttttaaaaacatctttcgtatataaactttttgtaaaatacacactgtttaatagtttaaaaagcgtgtgcgcagaaaacgagggtggggagtagagaactctctcaaaagaacgcatcgttatcctatacatgaaccagagggagtaactagctctttaatgaataatatattgtaattttaagtggttagttgttacatttgtttcaagacttgctccgtttatctacatgtatattctattttcagtgttgactgacaagcatataacattgtcgacaaccatttggcctgattggaaccacagagtatcatatttatcgactcaagaaacttattggttgatatgctagaaatacgaaaacttcttatctccaatcaacaagcaaactagaaaaatttacatcccaattctgtagaaccgaaatatatcagtacattacacgataacattattagggagcaaattcttgtgaacaagactactcgtgtacaacaaagcagtgctaaaaaagaagtgtaagtaagatattccttggatcttacctatctctctttaccttgaggctcctaaggatcattggaagaccatacttaggccttagcgtgatcacactgattggcgtgtggacgtacttaggggacaacgtgaaggagaacctttgcaggatcatggcgatgatggtcctggcctcgatcatggcaaagttttgcccgatgcacgaccttagcccgatagagaaggagagtagtgcgctggggtgcttcgctgcattcaacactccattctcggacctctctggcttgaactcatcggcgtcctccccccacacttccttgtcacggtggattgttgcgatcgggatcgttaggatggtgcccttaggaaccttgatgctaccaagcttgacgtcggtaccagctctcctcgttacgagtgagacagggccatacaaccttagggtctcgagaaggaacatgttgaccaatttcaacttgttgagcatgtctccggtgggcacctcgtcattgcacaccatcctaacctcctttctgagtttctccatccaatgttggtgtgtgctaagcaagaacatggtccaagtgagcaattgcgaggtggtgtcatgcccagcgaagaagaaggtcttgcactcagcgatgatatcgtccatgctgagttgtggctggctcccgccatgctctggcacgcatgcctctaacatcaatccaagcaggtcattcccatatcccatggtttctttgttagtgagtcgactcttgataatgttcatgagcatgctcctcaccttcttgtctagtgaccatgtcttcagattctttttggtcaggaggtagctgaaccctgggatttggatggtgagaaacacggagaaggcaagaaattggagcttcctctgtgctaggaagacctgcttcccctccctgtagctgctcccaaatgccgtacgcgaaatcacatcagcagtgagctcctcaaaccaccggctcagttcaatctccgtgcttccgcccttcatccccaactccgattcccactcaaacatcattgattgggcgtagtcggatatggtctccgtcatcatcttgagcttgtccatgtcgaaggctgggtgaaccaccttgtagtggcgtttccactcatcgtcgtcggtgagcacgagccccttaccaagcaggcgtgcgaactgcatgttatctatgtacttggggaacatccctgtacggtccgacaacacctgcctcaccatgttcatatctgccaagcatatgtttggccgtgtcccgaaccaatacaagaacgtcttccctacatcacataaacacgcaaacatatacagggatatgtttatatgctgtagatgatttcaaatatcagaaaaaaagctcagaaacatggcgtaccgtagaggggaatccatttgcggatgtgtggctgcacgatggggacgaagtcatgggaggagacgtcgagcacaaggttggcgccctcggcgcggagacgcctgatctcgctgaggttgccggagaagaacctgtatcccggcccggcgacgccctgcgcccccagccgcctggtgatggcgcggggctaccacaccagcttcaccaccaccgcgatgaacgcccacgacgccgccaccgccgccgcggccgtcgccaccgtccactcgaaacccatggccagcagatcgaacaagttctgaatttcttcgcctgaatcaatcaaccgttcgtgttctgcttgcttggtacagctggttgctgtcttgctgagagagtgatagatcgaacaagcaaagctaagcttgagacttctttgggagtcgctagctggtgtttgtgtggttgagacactggtcgtcagtcgtaaccggaggctgtgatttaattatacgaaagaattgcatgtcaatatcgtaatcggcgactaagcggccatatctttttcgcgagcgcgcaaaaaatttacatgtcaatatattaaaaaagaaaagaacctttttttacatatcacaattgaccagacatgcctaggctagggggaagaaaaaaggtaaaaaaaaaactaaagctgcagctagggaaagaaggggaaaaactactgcgaagaaaagctactctaatcaacaaggaggtggagacggagaaacactaaaaaaaaaaaaccctgagatcccatccatatcaaaacactgcttccttcgttacaaaatataacaatttttaaccttaaaatctattaaaaatataacaacttattcatcaatgttctcttcgcaaccaatcataacttttcaccattcaattttcccacccaacttcacttctcatccaattacaatattccccaatttaatttacctattttttaatatcagcctaagcttatctctaaaaatccttatattctggaacgaagatagtagtcatatttacaacagtatctgggaaacttgttttaatttgatttggaaactgtttttcaatttttctacctattttatttggttggtcagttttttaggtgcacctgtttctctttttgcggagcatttattttatacgtgagggtaggatagacaggaagtgaaggagggcgagtaaatcaaagagatagccatttctcggttgggggcaagataaaaagaattcaataggtcagttgaaggggcaggcagtagtctacaaaatacagttccttttaaatagcaggattgagaaaatagaagaaaaaaaaaataaaacatgatgaatagaagtgtaaaacagagaattacaaaatatataaaaaaagagagtaattttcatataactacatgtactttaatcaaattatcataaaactacatatttaacactaaatttgtcacaaaacaacacatttaaagcgaaatatcacgaaagtacagatttaataacaaaattatcacaaaactacatgtttaatgataatttaatcacaaaacttgaacaattaaatgactggatcgaccggatagcgtttctaggggaactactagtgaacagcaattatattatttgaattttgacgttgacaagtgtacgattcgtagtacaattgtacaagtgttttcttctgttctccttttctttttcgttagttaacctccgttatgtcttttattttcttttcctcctcctacgcaatgtactgccaatacaaacgctttgggttcaggcaattgaaccatgatctttgcctttgcatgccctggcatttttacattgtaattcagttctcggatctaaaattgacatcaagttcttgtttgatccaccgctattatcacaatatccgtccggtcagagctatcaacgatgaatcgataatttactatccatttttagctttttgaatggaagaaaagtaatgaaacctacaatggctattgaataacctcctttccatttttttatacgaaaccgtttggccattttttcttcgtctgccaaattttctttagttctacccaaactcagttttgtctcaatctttattgaagaagaaacggttttccagccgctaaatccaggtatcccacaaaatcattaaacctggctgttatttcggtaaaatacgctaaatcacaaattaatgaccaagtgaagactcgtgagaatatgaagcgtgctagtggcaaattcatggaaagtagtagcaacttatgtagtgccaactatttgaatgatttttttaagaaaaaaaaggacacagggatggggatggggtagtaatatacggaatgcagcccaagtcaacatcaggaagcaattcccagtctacaagccaacatcacaaatttacatccagttttgtagaaatgaaataaaaccgatctcgtgaacaacaaagcagtgcataaaaaaaggaagcataagtcagacattccttagttcttacatatctctcttacatcttgtaagatcaacgtgtgttttgattcttattctgtgatgaacaattggcatctgtgattattggttttgatatttggagattacagttgaagttgttttggagataattgattttcaagtgatgaacagggtttgctgttttgttgggaccggtcagaccggacggtagttgccggtcagaccggcttgtgttgagcggtcagaccggccggcccgcggtctgaccggccgacgctgtgtcggttttggtttcgggttgtttctttggatatccgtgattgtttcatggttatggcttctagatggatactatacgtatgtaatactgttgtttgctaacaatgagtcaagttggtgatagcttggtctcggaatatggtttctttgtttgtttcatgtgtaggtgattcgatgcctcgggagagtatttgcggtgatggaccgggagtcggcttggtggtaagacgatgtccgtggtggtcagatatcatgcgggatacttatgctagagttgatgcacgtggttggtgaagattccatatggcatatgatggaggtattgtgtgcgtgtgagatgcggagtcgaatttggaaggagtccaaatttggtatgattggttatgtaaagtttgtttcttatactatagggtttcctaaggtgtttaggacttctagtatgagtttggttcgtggctttaggctgcctacctcatgtataaatagagggggagagtgaagcttcccggtatcgcttttgagagcaattgagttgctagtttagttagggtttcaagtttagtcgagatttttgtaaggagtgctgttgatgcactttgtaaacatagatagaagcaataaagttgtcatctactttaagagttcttcgatttgtgtttaatcgggttcggcggtctaaccggtgatataccggcggtcagaccggcggcaggcggcggtcagaccgacggaggagaggcggtcagactgacggaggagagacggtcagaccggcagcgacttcaggcgtggcagacgatcttcaggcggttgtaccgagtgatcaacaccggttagaccggcggcacgagcgcggtcagaccggcggatcaacctcggttagaccgatctacatcgaatttgagggtaacttttatttccactaaaagtttaggtttttgggtataccaaccattcacccccctctggttggcttagttcttgtgattccatcctacacatcttgaggctcctgaggatctttgggagaccatacttgggccacagtgtgatcaaactggttggtgcgtggacatacttgggggatagtgtaaagaagaacctttgcaagatcatggtgatgacagccttcgcctccaacatggcgaagttctgcccgatgcacgacctcggcccgctagagaaggagagcaacgcattagggttcttcgcttctttggacactccattcggcaaaagacctcaaaacacgaattaatgagcaagtgaaaactcaggagaatatataggtagcgtgttcacggaaaatagaaacttatgtagcgccaaactaatatttgaaactgaacaactttcttttttatctgaagtgtacgctatctgaagtgtacgcgtttggaggacacaaagatggaggcctcatcttttcgtttatgcttattcttatctggacacaaagatggaggcctcatcttttcgcttatgcttatgcttatctgccaaaatttaaattttcaaccttaaatttagagcagattttgtggttttttatcgaagtttattttttagcctcttagatcgctaagaacacgtatatagaagttttatttacaaattattttttgtttgtaaatatgtcgtacttattccataaattacttttcggggcttaggagtagtaattgttgtaaaacaaatctcgccgccggcggcttgtacgaatggctcgactgggccgtttttgagaggatgtgccgatccgaatgggatggcatgggcttcttctggtgctctttcgctgactcccgcatgtattgggcctcctttaagcccactgtcaaacgaccgtgttgagccaatcgctaaaaaaggtacaccaggtcatttcggattgatgctaaaacatgtctaccaaaatatattttgatagtttgaatagtaaatgagatagtttggtttgaatccaataagttggtaataaaaatgtttaatttggcatagttattaaacttccttcactactatacaaaatttgacttctaaataacatcaatccaaacacaccttttctttataacgtgttaaaacttatcaagattttaacactattattattttaatagggcactaaaccaaataagctctacctcttttgagatgtggctgttgcgagttgcaagtcaacactgaagtcaccggttatacaaactgagcatatgaagtatttgtttctttgagctatttaatgaataacatattaaacatttttttaaaaaaaaacattgtctccctttctctcctagtagctggaccttataaactttttatttaaatagtctccctttctctcctagtagctggatcttataaactcttctattgaaacagtgtctccctttctctcctagtaggtgaaccttataaacttttctatttactccctccatctatttttgatagtcatatttacaaatctaaaaaatttatttttgataggcatatttcaatccaacaatctatcctcttaatgactttcttggatttaatgcgtgactctctattcttacacacaagattggctacctgggcatcgagaaatgtaaatattaatgaatcgcttgtttacgaggaataactagtagcatgtttaaatgataagtagaattacttatccttgatctgtgtgccaagatgaaatatgactatatggagggagtattatttaaacattgtttcccttcgtctcattgtaacctggccttaattgtcttctgcatgtgactttcccgatcaactagaggaacacctgattttagataagagctacatatttgaatagtaccattcgtgttatttacaaaattacataattattatttattttgttgcgacctattttataactaaaggttaattttttaatgagatgaattgtggaacaatgtttaaaagttgatggcgtcatatgtatcaagaaagtgaataatcttctactccctccattttatattataaatcactttgatttttttagtaaaacttttttaagtttgatcaagtttatgaaaatataactatattttcaacacaaaacaaacatattatcaaaatatattcaatgcgtcagtgttatgtacaaggcatacccaatagttttgggttgagctcggcgaagcctaccatatactaagttttatacaaaatcatgcatcatatatggaaggtattccggataaggaaggagaaacagagctctacatggaaactacaatgactagtcggatcatatccatattagtcttcctatttctacttagataatgggacatctataggtataaatacaagactccctagggggggactaagacaagcctagctagaatagacacgctcagtcagaatagacaccaatagacgccaccaaacatcgacgttggagataaacctagacagacccaatctagtgcctcagagtccgacaagaggtatctagcgctatctctgatctcgccgtgttcgtattcgaggaggaagactacctcgtcattgactacatgtggtgttccataccgccaagtcgttgacgactagattggttatcccaaatattgtgcttgtgtgattctgataaataagagcaacaccggcttcggccaataggactagggctattaccttagagataaggggcccaaacctatataaaaatcattgtttccgtctcttttaactcaatctcgcgtataccctggtaccaacgatcctcatactctgcaaataccgtagtcgtgatctactccgtcgacacaataatatatttaacgaaactaatttgatgttgtagatatcgttaaactatgctataaacttagctaaacctaaaaaaagtttgactagaggaaaagtcaaatcgacttatagtatacacaaacgggagggagttgctctttagttaataatatattgattttttaggtggttaatttttacatttctttcaagacttgctccttttttctacatgtatattctattttccgtcttgattgacaagtaaatgacattgtcgacaaccatttggcctgattggactcacaaagtatcatattgctcgactgaagagactaattggttgatatgctagaaatacagaaacttcttatatccaatcaacaagcaaactagagaaatttacatcccaattttgtataactgaaatatatatatcaatacattacacgataacattatcaggaagcaactcgtgtacaacaaagcggtgctaaaaaagcagtgtaagtaaaacattccttggatcttacagatctctttttaccttgaggctcctaaggatcattggaagaccgtacttaggccttagcgtgatcacactaattggcgtgtggacgtacttaggggacaacgtgaaggagaacctctgcaggatcatggtgatgacggctttggcctcaatcatggcgaaattctgcccgatgcatgacctcggcccgttagagaaggagagtagtgcgttggggtgcttcgctgccttggacactccattctcgaacctcgccggcttgaactcgtcggcgtcctcaccccacacttccttgtcacgatggattgttgcgattgggatccttaggatggtgccctcaggcaccttgatgccaccgaatttggcattggtgccagtcctcctcgatatgagtgagacagggctgtacaaccttagagtctcgagaaggaacatgttgagtaagttcatcttgttgagcatgtcaccagtgggcacttcgtcaccgcacatagttgtcacctccttcctgatcttcctcatccactccggatgtgtgctcagcaagaacatggtccaagtgagcaggtgcgaggtagtgtcatgcccgccgaagaagaaggtcttgcactcggcaatgatctcgtccatgctcaactgctggctttcgtcatgctctggcgcgcacgtctccaacatcaatccaagcaagtcgttcccatatcccatggtgtccttgttagcgagccggatcttgatgatgttcctgagcatgctcctcaccttcttgtctagtgaccatatctttaggttttttttagttggaaggtagcggaaccctgggatttggatggtgagaaacatggagaaggcaagaaactggagtttcctttgtgccaggaagacctgcttcccctcactatagctgctcccaaacgccgtgcgcgagatcacgtcagcagtgagctcttgaaaccgctgactcagttcaatctccgcgcttccacctttcatccccaactcagactcccactcagacatcattgacccggtgcagtcagatatggtcaccgtcatcatcttgagcttgtccatgtcgaaggctgggtggaccaccttgtagtggcgtttccactcgtcgccatcgatgagcacaagccctttgccaagtaggtgtgcgaagtatgggttagttaagtccttagggtacatccccgtacggtccgacaacacctgcctcacaatgtttatatccgccaagcatatgttcggttgtgccccgaaccagaacaagaacgtcttccctacaacacataataagcacacaattatatatatatatatataagctaacaaattaaaataattggtactcatggcattttaaaatatcgaaaaactaaacctcagaaaacatggcataccgtagagggaaacccatttgcggaagtgcggctgcacgatggggacgaagtcatgggaggagacgtcgagcacgacgccggcgccctcggcgcggagacgcctgatctcgccgaggttgccggagaagaacctgtatcccggcccgccgacggcctgcgcccgcagccgcctgctgatggcgcggggcctccacaccagcttcaccaccaccgcgatgaacgcccacgacgccaccgccgccgccgccgccgccaccatccacacgaaattacccatcgccactggatcgaacaagttggctcttcgcctgaatcaatcaacagtacgtgttctgctttcttggttcagctggttgctgtcttgctgagacaatgatagatcgagcaagctaagcttgagactttttgggggtcgctagctggtgtttgtgtggttgatacactggtcgttagtcgtaacccgaggctgtgtcttaaatactgctccctatgtcttaaaatatactctctctgttttgttttaaaatatttgacaccgttgactttttaacacatgtttaaccgttcgtcttattaaaaaaatttgtaaaatatataaaactatatgtgtacatgaaagtatatttaacaataaatcaaataatatgcaaagaataaataattacttaatttttttaaataagacgaaatcaaccaattacaatccttcatcatttaatttttctacccaccttcacttcttatcaaatcacaatattccactatttaatttatctactttttaataaccgtgttcaacctttaaaaacccttatatgataggatggaggtattagtcacatttacaacgggatctaggaaaattttttaaaatttatttggaaaatgttttttttaattttctccctattttatttggttggtcagttttttaggtgcacctgtttttcttttctggagcatttgttatatacgtgagggtaggatagagaggaagtgaaggagggtgactaagctttttaaaatcaaagagatagagaaagaattcagtagggcagttgaagggacaagcagcagtttacaaaatactcttcctttaaatagcaggattgagaaaatagaggaaaaaataaaataggattttgacatgaatagaagtgcaaaacagagaattacaaaatatagaaaaagacatgaataaccattcatttgattagaagacatgaaaaacacaggaatttaataagagataaaaaacacataggaagctttcacgaggtgatcctcatactgaaattcagccaaaacttctatggattcattaggaatttcgtaggattcagttatatccaattctttgtttaaaggaaaaaaatatcatgtacgattgaaatcctacaattttttatattttccttcaaatcaaaggagccttacaattttattataaatagcaaagtagccgtacgttgcaatggaaataaataaataaaaatacgatgaacatcaatttattagggtttaattttcctaattcaggacccgagtaaatttgcaatcctaattaaccatgttaatttgtatatcagttaataattagataattaataggtattgaactcctggtaacttttttctggtatctcgagatatgttggtctagcctactcttttcgaggtgccatagagtagggtgtacgtgtatgtgtttatagaagagtgggtgtgtttttaaacagaaaactacatatttttcataccaccattttatgcaaatctataataaaaatcattgaaaaaaatgcaacagaaattatgtatgaatctaaaaagcataccgaaattgtaaacattcaaaactgccagaggaagaaggtgccgattgcttttataacctctatagctaccatattgtcacaacgccgcacgagcacgacacaaccagcgcccaagcgttcttgtgttgatgggtttaattaaccggatggttgctcccgtgttcgagttgatcacggaattacatatataacttccgcgtgacgttgcgcgcacctcgcccgcgtatcggatgatggacggaagaattttgaatacaggatcacctataaattttacaatatgtaaagattttaaatactaaaattaactatattttggaattgacgagtacctgccctgttggaaagagactgcgtagttgcagacttgcagtgacatcaacggtgattctagcagttttggcaacgagttacggagttatcgatctggctgagaaaaggctttgttctaaactctcaactggtgatcacacggaatcactgacataatcagaattgacaccaaattccaataattttgctgccaatcagaccggatcgaccggatagcgtttctagaagaacaagtgaagagcaattatatggcttgaattttgacattgacatgtattttcttctgttttctttttctttttcgttagttaacctccgttatgtcttttattttctattcatcctacgcaatgcaaacgcttttgattcaggcaattggaccgtgatctttgtcttttgccctggcattatatattacattgtaatatattcagttctcggatctaagatcgacatcaagttcttgtttgatccaccgctattatcacaatatccctccggttagagctatcaacgatgaatcgataatttactatccttttctttggctttttgaatggaagaaaagaatgaaacctactatggctattgaataacctcctttcttttttttttctatacgaaaccgtttggccatttttttctccgtctgccaaattttgttcagttctacccaatctcagttttgtctcaatctttattgaagaaacggttttccagccgctacatccaggtatcccacaaaatcattaaacctggttgttattttggcgatagcactcttcagtagatgatgccccacgctttactgcgggatatatgttagataatggagaaatgatgaaatgatttgaattgaaatattataaaaatgatttgataatgatgatttagcatgtgtatatttagttttagaatgaaataaattgtagatataattactatatgcttgcatgttgagttttgtgtgcttaatgggttgatgtggcatacctgcatgtaggttttaggagtgctaataaatattatacttgcatattgagttttatatttttagtgggcattagctttatataaagaagagatacgctaaagcacaaattaatgaccaagtgaagactcgtgagaatatgaagcgtgctagtggcaaattcgtggaaagtagtaacaacttatgtagtgtcaaatatttgaaagaaaaaaaaagacacaaaggatggggtagtaatgagtgatggcttttaactaattttgtttgagttactgatgctctgtttatttcaatttaagattattgtaatcctgattattgagttagattgctataaattggattactcaaatctgtatttccacgggtgtattctttcagttccaggatgtacatatatacaccgagcctgagaagaagggaggagaagatgaaggaaaaagtacacggaaggtccctcaacttgtcatcgagttacaaaatcatcacctaaccacaaaaccagatatatcacattcctcaacttacaaaaccattcaaggtaatgcggtcgtctgccttacctcctcctcctccgcgtgccgtgcggcgccattgctgtggccacgcgttgtcgtcggggtgaggcggcgacgcacggtggtgcgaccggcgcggccagcggctggtgagggaggagcgcagcggggaggatgttaacgaacctgaggactagacgcagaggagtcaaatctgaactggttgaagaaaatgaaagagcaggcccatcagcgaggatgacaaggaggagtttgagaagctctaaagctgaagcagttgaggctgctcaagaggtgccatctgcagcaggaccttcgcagtcaaccaggccatctaagagaagaaagaagtgatgagattgatctgtgcttgctagtgagattttcaggggcaccgcgccgatcgagccgcttcctctactcctccgtgaagctcacgcctcctccggtcaacgccgtcgagaacaccatcacgttcctcggcgcctggtggaacgcgggccacgg

SEQ ID NO: 74051 - DNA, 19195 bp, Oryza sativa
ataagatataaatcacacttaaagtactataagtgataaaacaactcataaaaaaataaattataattacgtaaattttttgaataagacgaatggtcaaacatgtgagaaaaagtcaacgacgtcatctattaaaaaacggagggagtaattattttctgaaactaggctgacccttacatttttcttttgctattctgttcatacatttgtcaactagggggcctcacatgtacagatgccatctgtccagttcttctcatatctgcactttgatactaataagcaattatttgaaattatacttgtctggcacatgaattttttgcctttaggtaacattgttgcaaacttagtaccttgcatcaaagtattgcttgtttctactcctatgcctgaataaatgaatgcttacttactacatattcagagaccgaatacttcagaaaagttacaaatggtgccaaacaggaaggaatcaattaggccccgtttagttcgctaattttttttttccaaaaacatcacatcgaatctttgaacacatacatgaagcattagatgtaaataaatgaaaaaactaattacacagttagggaggaaatcgcgagacgaatcttttgagtctaattagtccatgattagctataagtgctacagtaactcacatgtgctaatgacgggttaattaggctcaaaagattcgtctcgcggtttccaggcgagttatgaaattagttttttcattcgtgtccaaaaacccctcccgacatctggtcaaacgtccgatgtgacacacaaaaattttcatttcctcaactaaacacacccttaggccttagctaggaattgaatcatctatacggattattttagttgtactatattttctaaaaaaaatattttagttgactattggaagactataattcttgacctatatatgctagatactggcctcatgcatgcatatgctaacattcctaggcaggtctgtatttccctctaggtcattataatgtgattaggtcaaaataaagtgacatcgtgtctatttttctttgctaaaggggtatttcataggtttgtcttagtatcgtgtttatactgtcgtattgaatgatccgagtcgattgctttcggtgcatataatgcacacagctctagttttctggttgggttggctcgatggctttatacgaattagcggtttttgatccctctaatcctgttctggatccaatgtggagacaaggtatgtttgtcattccttttatgactcgtttaggaataaccaattcgtggggtggttggagtgtttcagaaggaactgcaacgaatccaggtatttagagttatgaaggtgtggcaggggcgcatattgtgttttctggcttgggtttcttggtagctatctggcattgggtatattgggacctcaaaatattttgtgatgagcggacgggaaagccttctttggatttgcccaagatctttggaattcatttatttcttgcaggggtggcttgctttggctttggcgcatttcatgtaacgggtttgtatggtcttgggatacgggtttgataattttttttcccaactgatggttgtcttccaatgtgatcacattggtgtgtttttactgaaatagcaccactacctacatattgatatcccaaattttactgactggtgcaggaaagcgacgataactggaacatcagaagctattcaggcagcagagtctatgataacgcagaggatggagattgtcaagttaggagaaaagaagtctgatgccaaattaagagaggatggagattgtcttttctagttttagcactatccgcaaaaaaaagcttgagagaaaatttaagatatctattgttccttattgagtctgattgtgttagtaactggagtagtcagtcaatcagctgttctatttattccttatttttgttgggaataggattatatttcatattttttgatgactgaaatattaatgtttgatcaacaatagcagcaggaaattttatgatattattgttatgatacatgatgaacaaattgagtcaatatgtgactactaggaggcgttgctgctgctgttgttgaactgctgttgctgctcctggtaggattcaatcctggccgctgttgttgaactgctgttgctgctcctggtaggatgcaatcctggccggatcaatccacaggtggtttgattagtgactccacctggatccattcaatcctggcctggatcaattcctagcctggatcagtgcctaccctgccgaacaaggcctaaatcaaagaccgctcggaagctgcctgcgctggtcgtgacgtgctcgtgcggcattgcggcaggagggactgaatcaaggtgctagaggcattgaccgaacggtcaagctatatcagcagccggtacagaagagttctgtcagattcatatattgattagtactatcgcatttttcattgatttttatagatttgtacaagatggtgtacgcgcagtaagtagggaattattttcaatgctacaagtggtaatttcatgtataaatgccaacggttcacatcttttgccatatggcttacatgcaagctgctgcaaaaaaatgaattttagcactaaattctgaagctgatttgattttttttgtcaaagtttatttttcagcacttaaatattatatcggtaagaatatataaaagttgtatctataactttttattgttaacgagcttgacttattttcagcattaggccaaccaatgaggccttagggcatcctcaatgtttgtggtgtagtataaaattatttttccattctatgaatagtgagccattgttaaagccatatccataatgctatggttagaatttagccacaagatgggctcacatagaatggaaaaataattgtttcatctcttgttcatgaagtgaatgagagagaaaaaatattttctttttgcttgtggtagaccttaaacataaggtgcaccctaagctaatgctactttccacaatgtatatggctcactttacaagtgcaatcattgccttaaggtcatctttttttacaagtgcaatcattgccttaaggtcatctttttcatacattgtggttgcccttaaaggctcgggtggattttaatctggatgatttcatcgtgataaggaaaacaccaaaataaaccatccattttagccaaaagttttgtgtaagttattttcacaagcaacccaagtttagtcctccgttcaccactatccacatgtacacttttggtccacacgcatattggttatgagcaaaaataagtgaaaacctgtgcgcgtaggattcgaatgtggttttccttgacaatgagcaaaaattgaaatgtttttgcccgtattttggtacgttatatatgtttgagtcagtttttaagttcgtccgcttttgaaaatacaaatccgtatgtgagttggattttaagtttgtttgcttttggaaatacaagaggagtcatataagaaatatctttaaaaaaattcgtatgctaactgagatgaaatacgaactcctgattgcagtccatgattttctttaaaagaatattcatgtgaattcccataatgaattttaccctaactaaaccatataacaataataaaattaaaatagtatttacccgttgcaatgcacgggtattttttctagtccattaacaggttcataatagtggtggacacaggattttggtgacgggggtacagagtttgtgaagcataatccaatgacaaaataaatgaagtgctaatatgtgttattagtgtgaataaaaatcatcactatacaaaattgtacaatggctaagaaaaaatgaaaatacccttgaaaagggatgattttgtgcttaagagcagctgttttttctttgtccgatggcgcaggcccgctgcaatttttttttgtggggaagagcagctgttttaacatagctgatcgtgcacacacaaactatacatgttaaatcacatttgtttgttgaaaatggggaacaattgtattgtcgactggctgtacccgcctacggtatttgtagagtaagagaatcgttggcgttaggtatatgagagattgagtaaaaagggacaagagacaaaggatttttatagaggttcatgcccccttgttaacgggtaatagcccactcatattagccgaagccgatgttgcctttatatatcaatatctcacgagtacaatatttggaatgacctaatctactctctgcccatctagcgatatgaatctctaacatgtggtcgacggctagcgtagtctactttttcgaatatgaactcggcaagattggagttggcttgatctgtattggtttgtattccatgtcccctctcctcttggagtgctgtatttgtgtccttaggtggtcttttgtctaagtagaaccagagaggcaaattctacgtccatcgaggtttcctctggtggcacgatgacaaaactattgttgtggtcggaaggagtgccgccaccgtcatgttggagatccaacaaaggtagagtcgtatcaccggatatatgacgacatcgcatcgtacgcagatgccaaaattttgaatcatagggaagagtaaaactcgaattatatgtgtggtgttggagagggagacaatcagatgagacggaggccgagatggacatgacgagtcggccaaattccttataaaacctatatataatataactgtttgcaccaatacgtgttgttgccgcagcggctggtcctactggcatcgtccatggtgatggacctccacatggaaggcgaggccatccgatggccaacacaacacatgcgcttcacgtcatagccgtcgcgcaggtcggcaggtcctcgctggcaactcggccccaataagtcactttagctcgccgccaacctcaagtggcgcgtgtccttcgaacttcataccatagcttgatcaaagattcatttcctctgtacccctaggtgggcaggttggaaggggtcgttattcattaggagctcccagccgagccaatatgcgcgcccgttgctgacatgaagggagctacccaatgcttcaaatctcaggctaagccttatagttacagttaagccatttaatggcaaaatttactacaagatatccacaaaaagtgtaattagctagaaaacaatgcaagaatgcatatctattgtggaacacaaaaaaactgataattaactgttggacactcacggtattattttattatatctagagcaaatagagagaaaaatagccgcggaagtacgattttgcggctcgcatatagctccgacatcgcggtggccacaacatttccggcaccggtgtggtcctcatgttgcagcaacgacaagcatgggaacgatgcggagccacaggcccaggtgcgtgggccctcttgaacccctagagagctgcctcgccaaacaacggcagcggcagcggtggcggcgtcggagctgtatgcgagctggacttggtaggcaggggcaaaattgtatttttgcgactgtttctctctccatttgcttttggatattatgaaatagggaaattttgctacaggacacttcgactgcgtggttttagccataggacaccgcccgaactcacttttgggggaaaacactccataaacatggtaatttaccaatggacaccgcgtcgataaaataataatttccggttaaagaggagagagaaatcgcgtgaaagttctaaaatacccgtgggcccacttgtcatatcttccatctctcttcaacggaaagcgtcgtcgtccgtggagtggagcgccaggagcatcggcagtcttgtgtgtgcatgatcagctgttttaacatagctgatcatgaacacacaaactatacttgttaaatcacattcgtttgttgaaaatggggtacaattgtattgtcgacgggctatacctgtctacggtatttgttcaggtattggctaactctggattccaagtgtagtttgtgagagggagacgatcatacagagatagagatagagacggcgagaccgaaatagaagcgatgagttgggtaaatccctatgaatgttccatacaaatacgtgtcatccgtggggacatacctccgcacggccagagaggccatccgacaccagggttctgggattcaattgcatagaaatcttgggcctcatctaaatggacaaaatttggaaattccgaagatcgaatgcagtccttttctttcaaaatcaggaaacaatgggtaaaatcatcagaggatctcatataaatatcaacacacacaatccattaacaggttccatacagtggtggacgcatgattttggtgtcggggatacatagttagtgaagcataatccaatgagaaaaaaatgaagtgctaatatctgttattagtgtgaataaaaatcatcactacacaaattgtaaaatggttatgaaagaaaatgaaaatacacttgaaaagggatgatttacttaagagcagctgttttgacatagctgatcgtgcacacacaaactatacatgttaaatcacatttgtttgttgaaaatgggggacaattgtactgtcgacgggctatacccgcctattggctaactcaggatttcatgtgtagtgtttgagagggagacgatcagacaaagatagagatagagatgtcgagaccgagatagaaacgacgagttgggtaaatgatgaggacatcccagctacacttgacgtaaacaagggtgatggtttacgtcataagtcacatgaagaaaatgaagatgacgtaaaccaagttgatggattacgtctcagcaagaacgatccagcatatcatggtcaattacgtgcaaccgtgctaggaagatataacaagaggtgaactcgctctttgctcaacttaacccaaattttaataagaattttataccacctaaatgctctacctttgtattgctagttttacgcccgaggacatcatcactatgccaagaaggatgggttacgttgaggacgacaagggttacgtcaaggaggaatcagcccatgcccaacgagcagccgtctacgccaacaagaagatgatttacactgcaaaggctcaatttccaaggcttgtgcgacccatccagtcatgggatggctgcatggcatacatggttggaaagagggacaagtttagattccaacgcatcaaaccctacctaaatattattttccaagaagaagttatggcacttttactgaaccttgcgcaggagctaaagggctgtgcgcgaacccaagaaaactgtttgcattctcatttatgttaggcttgaccaccaaaacgtggcttcttatgttcacacctcatctagaagggatgttcctattataaatagccccctactgcattcattagacaatttttgttcaattgaaaacctcatgtatgagaaattgctgaagattgtataagtgtcttacctctttattcttgtgagttcttttggacttgtgagaaggcaactttggtgccccctagttcgtgctctatggcttccagttcggctgcaccgtattgtgtggattattctcggattatggttctgtgattgctcggtttgacaggtcagagtccaggaggcttcggatcgttatgaatttggaaattccaaagattgaacttagtcctttttttttcaaaatctggaaacaattggtaaaatcattagaggatttcatacaaatatcaacacacacaatccattaacaggttcataacagtggtggatgcaggattttggtgacaggggtatagagttagtgaagcataatccaatgagaaaataaataaagtgctaatatgtgttattagtgtgaataaaaaccatcactacacaaaattgtaaaatggctaagaaaaaaatgaaaatagtcttgaaaagggataatttgcttaagagcagctgttttaacatagctgatcgtgcacacacaaactatgcatgttaaatcaaattagtttgttcaaaatgggggtacaattgtattgtcgacgggctatacccgcctacggtatttgttcaggtattgtcacgcccataaattcactagtaatttccggacttatttgtgcataaaatcctgatccaggaatcagccgaggtacacaaactgacaatttaatatacaaattcatcaaattaactaaaacgataaatacttacttaagaggcacttagtcctcaccatgaagaaaactgcagcagaaaataaaatctagcgaagctccggctccactcccataggcagctcaactggggtataagccaaacgtcttctccttcgcaatttgtcttcaactgaagtttgattgattattgcaaggtgagcatatgacatactcatcaagccacacagcaaatatgcaagtgcataaggataccaaaggatggcataatatagggctcacttgcaaaagcagcatttagcaaacaattgagaattgtaaaacagtagagtaattaatcatcagtattaatcaacactgaacagcacacccatgctgcccaggcccaaccattctgaacaaccatacctggctgcacagatctatctccaaaccaggaatataccattctaaaccaggagctaatcaaattattaccagttatagcatcatttattatggtaagaagtgtgagactaatcacgaaagacattgttagacctgcccatgaccgcgggcacggctattcaaatagttttactctggccagaggtgtaccactgtacccacaagacacaacccaccagcatgttaccgtgtccgcgcagacacgtcaccatgttgagtgattgtgacaagacccctcgcataactcaactcaaagcagtgcaccattcctggatcataatcacccccttataaacaaggcatggactccccagcgacccccgtgggcttatctccgccacttctcagtctagtgctccgtaatgagccttgttatacaaagtgtccagccgttgcccattctggcttgtggttggcacggttaatgtttcacaaccgaaaatcgtgaaccggtccttaattgtcatgagcactaccatcaaaaccatgtgctcacaacccaccattatcaagttttagttggcacattaattaattaaccaatcacgattgaccatcgtgagctatcattaaatatccatcattaagtaatagtgaaacattagttatcccaatcgtgtgctaatgtttctaagcatggctaagcaattatgtctaacatctagctgaaccaatatataaagctcaactagtcaaattataataacccaaggtatcaaggaatagagtaatcaatgcaaacaggccataacaaaggaacaggttcacaccacccagtgacattcaaaaataaatgcacagttgaaataaatagagaatttaaatataggatcaacatgctcaaaggaactgtgtttgggatctgtgtgacttgccttgcaatattcggtcttcaattaatcttcttgaatacttccaacgcactcgcggaccttcgaaacgacggaaacaacaagctaaaacgcaaaacgaggaaaacgactaagaaactccaaataaacaatacatataaagtaaacaaacatgtagatcataattttagatgaattatgagacttgaacggcctcactctgacttcatatgaatttattacgaattttacaagatttaacttaattaaagcccatttaaaaaggattaaataaatttaattcaatttatggataattttaatatgtagatctttattttatacaactttagagacttgaaccaactaaatccgagctaagatgaattaattatgaattttcaaagattaaataggattaaaacatttatatggattttaattgaattatgacgcaataaagaattatttttgaaaaggaaaagaggattattacgtcagcgggctcggctcacggtggaccgggtgcacagcggcggtctacggaacggacggccgagatctaccctatccaaaacgaacggccgagatcaacttgatctaccgcggttcacgggacatgggcaacgatgacgtcagcgatgacgtcatcatcgacggcggctcggcctcgcgtgctcgctggcgaatgatagcgcggcggcgcgaacgaaggacacctacgggttgcgggcaacgcggcgaactcaccggtgaccaaaacagcggcagaaggtcaacggacggcgacggcgacgaggaagaagcggcggcgaccttctgtttgacgacgacggcggggctccggcgatctacagcgacgaaggaggggcagacaaggtcggcgactgtcacgcccggaaatttactagtaatttccgaacttatttgtgcataaaatcctcgtccaggaatcagccgaggtacacaaactgacaatttaatatacagattcatcaataactaaagcaaataaatacttacttaagaggcacttagtcctcaacatgaagaaaactgcagcggaaaaataaaatctagcgaagctccagctccactcccacaggcagctcaactggggtataagccaaacgtcttctccttctggattctttttcttcaactgaggttgattgattattgcagggtgagcatatgacatactcagcaagccacacagcaatatgcaagtgcacaaggataccaaaggatggcattatatcggctaattgcaaaagcagcatttagcaaaacatttaagagaagtaaacagtgagtattaaatcagaatttttaacaacactgacagcacacccatgctgcacaggcccaaccattctgaacaaccatacccggctgaacagatctaactccaaaccaggagctaagcaaattattacccagtataacatccatagctattgtgagaggtgtgggactaatcacgaaaaacattgctcaactcgcccataaccgcgggcacggctattcgaatagttttactctgatcagaggtgtaccactgtacccacaagacacagccccacatcatgtcaccatgtgcctcagtaccaccacggtacctcggaaaggggctgtgacagtaccccttgcataacacaatccaccgcagcgcaccattcctggatcataatcacccccttataaaacaaggcatggactccccagcgacccccgtgggcttatctccgccacttctcagtctggtgccccgcaatgaaccatgctatacaaaagataaaaccgttgcccacgctggcttgtggttggcacggttaatgtttcacaacagtagctcgcgaaccggtccttaattgtcatgagcacgactctcaaaaccatgtgctcacaacccaccattatcaagttttagttggcaagtaattaattaaccaatcacgattgaccatcgtgagctaccattaaatataaccataagtgatagtgaaacattagttatcccaaatgtgtgctaatgtttctaagcatggctaagcaattatatctaatatctagttgaaccaatatatataaagctcaactagtccaattataataacccaaagtatcaaggaatagaataatcaatgcaaacaggccataacaaaggaataggttcacaccacccagtgacattcgaaaataaatgcacagttgaaataaatagagaatttaaatataggatcaacatgctcaaaggattgtgtttaggatctgtgtgacttgccttgcaataatcggtcttcaattaatcttcttgaatacttccggcgcactcgcgaaccttcgcaacgacggaaacgacaagctatcacgcaaaacgaggaaaaagactaataaaaaccaaataaacaatacataaaaagtaaacaaacatgtagatcatatttttagatgaattatgagacttgaacggcctcattctgacttcaaatgaattaattatgaattttacaagattaaatctatttaaagcccatttaaaaagaattaaataaatttaattcaatttatggacaattttaatatgtagatctttattttacacaacttttgcaacttgaaccacattaaactgagttaagatgaattagatatgaatttttaaagattaaatcggattaaaacctttaaactgattttaattgaattatgacgcaataatgaattatttttgaaaaggaaaagaaggattattgcgtcagcggctagggtttggtggaccgggcgcacgggcggcggttcacgcgaacggacggccgagatttaaccgatccaagatggacggccgagatcgatcgggtccacggcggcttacggcggacgaccccgatgacgtcagcggtgacgtcaccgacagcggcggcggctcggcggagaagacggctcgaacggcgcacgctcgccggcgaacggcggcactaggacgcaaacggagggcaccaagacgtagaggacaacacggcgaactcaccggtgaccaaaggaacggcggaagaccaacggacggcggcggcgacgaggaggaagcggcgaagctcttcgggtcgacgacggcgacggcgctccggcggtcttcggcggcggcgaagcggcggacggggacggcggcgacttggcgatcccgacggtggccttcccgagtgacgacgacgaccgtagcgacggcggcgcacggctggacgaacggcggcgacggcggcgcaaaagctcccgaggctagggcgctacacacgacggcgggcgaaggcgaggaggcgacgggtagaggagagcttgggggtccttataaaggggctagcgagcggcgacggaggcccacggcgaccggcggcgagaaggaaactttagggtttgggagagagaggaatccgattcgatctcgattccatcgagtttccaaaccgaattgaccagagattccaaaagagaaaaggaagaggagatcgagaagatcatttcccctctaaagatttcaccggagaaggaaagaatcgagcggatttggaaggagaaggcggcggcggcgcgctagggtttgcgggcggcggcggccgaaggaggacgaagaacctgacaagcggggcccacctgtcagcggcggagagagagagaggagagcggcggctcggcagactgggccggctgggccgagggaaagagagagagagagagggttttgggccggctttcggcccaaagccaaaagaagacttttaaaacctttttcaatttaaattatttcttaaatgcaattccatttactaaaaatacttccttagctcaaataaatcccagaaaaatctaggaattatagatttaagcaaagtatttaacaaaattttatctagcccaattttatgttgagatttaacaaattaaacttagatcttctcttataagcttttaaaatcatttctaataattccttttaaacaacaatttataatttaaggatttttaaacaagaaaagctcttaacaattatacttagatcattaatgatcaaataattactgaactgttctttgtattatttaagaatttagctctgaaaaatccgagaaaatttcagagagttgatttaaacatggagaatttaataaaaattaaatccatccatgccttatatttaggaaattttatttcccacattttacttcacttgtaaattaaagaacatttaatataaattctattaataatttattaaataatttataaatcctgaaacaaaaatcaggatgtgacagcgacgtcttgacgatcacgacaatggctttcccgagcgacgacgacgaccggagcgacggcggtgcatggctggacgaacggcgtcgacggcggcgcaagagctcacggggctagggcgctacagacggcggcgggcgaaggcgagagtggctgtgggtagaggggagctcgggggtccttttatagtggctagggggcggcggcgaaggcccacggtgaccggcagcgcgaaggaaagtctagggttcggggagagagacgaatccgattcgagatcgaatccacggatttccaaacgattttagccgacgattccaaaatagaaaaggtagagtggatctcggggatcattttccctctatcaatttcaccggatcgggaaagggatgaacgaatttggaagggcggcggcggcgcgactcggctagggttcggccgggcgatggctggaggttgacgacggccctgacaggtgggccccacttgtcagcgggcggacgcgcgcgcgcgagcggcgctcggctgcaggctgaccgggccggggagagagagagagagctttttgggccgactttcagcccaaagccaaaagagaactttttaaacctttttcaatttaaattattcatgaaatgcaattccatttattaaaaatacttccttatctcaaataaatcccagaaaaatctaggaactatagatttaagcaaagtatttagtaaaattttatctggccccattttatattgaaatttattatttaaaattagatcttctcttttaggattttaagatcatttctaataattccttttagacaacaatttataatttaaggatttttaaacaagaaaagcacttaacataattataattagatcattaattgattaactaattactgaattgttctttgtatcaattaggaattgagctctgaaaaaatccgagaaaatttaagagagtatacttaatcatagagaatttaataaaaattaaattcatccatcctttatatttaggaaattttatttcccacatttaacttcacttgtaaattaatgaacatttaatataaattctattaataatttattagataatttataaatcctgaaacaaaaatcagactgtgacaggtattggctaactcaggattccaagtgtagtgtttgagagggagacgatcagacagagatagagatagagacggcgagaccgagatagaaacgacgagttgggtaaatccctatgaccgttctgtaccaatacgtgtcatccatggggacagacctccgcacgtcggagaggccatccgacaatagggttttgggattcaattgcagagaaatcttgggcctcatctaaatggatgaaatttggaaattccgaagatcgaacttagtcctttttttttttcaaaatcaggaaacaatgggtaaaatcatcagaggatctcatacaaatatcgacacacataatccattaacaggttcataacagtggtggacgcaggattttggtgacggggtacaaagttagtgaatcataatccaatgagaaaataaatgaagtgctaatatgtgttattagtgtgaataaaaatcatcactacacaaaattgtaaaatggctaagaaaaaaaaggaaaatactcttgaaaagggatgatttgcttaagagcaactgttttaacattgctgatcgtgcacacacaaactatacatgttaaatcacatttgtgtagatgtgaaaacacgaggcctggaagatctgcttaacttcagtgcaggtccaaaaaatcttgcctttaggttcgtgagcgtgccagttgatttgatcctacaatcaacaagaaataaagacaaagaaaccgcggttaaatccataaacgatagccgatcggctagttgccgatgatatatcatttatctccaagccgatgtcatatgtgaattgatcggcaatcatgaataaaatgaaaaagaactaaatctactctatcggctgtagatattaacaatatgtagtccttatgtcgatatatacttaaatcaaatgattgggatatatcggtcgccacgccgagacagtataaatcactcagatcgaaatatatactaacaatgagactatatatgttcatagcatagccgatcagatagatccagtatgtatcggctaatactccgataccactctatattaagatattaaagcaagtaaaatatatcaaacagaagcgtaatatatctagatgtaacaagatcataacataaagggcagatctagcatatcaattaagtacatgaaatataaggctaaatcagataagatcgcctgaaactctgatactactataaccggcaaccaaaagcaggctagagattgagattctaagtacgacttataagatcaaactcaactgatgcagctataagtatgaaaagaaggacaatatctagaccatcaagccgctgattgtttcatagggtggtagatatcctatataatctaagtcaacgttggtatttaacctaatcggctgccttctagcaacagatgttagccgactggaggttagataacaatattgccaaagattatatagaatatacgataactcgacaaattacataaacaagattagagtatcataaagatggaagcactaatcccaggaacgcaagccgccataagaagttttacctctagttgaagatcgaaaccgatgcagctcaacccgaaagcaagagctcgtcgaaacaaaacgaaagtaaaagggtggcgatgcgccgagattgtattgaacgtgtgttgttgtattacatggggctcggggtctatttatacccgagattacaaaatatgtccatgtcggacacggcttttatctttaacaaactctaagatacctttgcgatagacttttgcccaaacatatctctatggaaattacataaaatatcctaattaatagatacaattgccttctcaggactcaatccgtgcatgacaatcctcatgaagcaaattaactcaacctgacaacgtgtactgcgtcacattgtcggactcggctcaatcggctaaccttgtccaactcggattttaccgatcccggtcacaactgattcggactttagccgatccttgctctgtttttggaacgatttccatgttgaattccgtttcagttttatctccacctccgatgttgaaattaccaaatttggtcgttaacatatgcccccccaagtccagaatatttggtaatgtttcggattttccatattcgtgtctccgagagtatcgctcattgccgtttttccgaccgttaccgcatcgctttaaatactaactgtcgtccccaagaaatttcacaccgttagctccgttttcaccgcttaagccaactttgtcttctctctctccggcgatccccttggcgcaccttacgaccccaaggcgatatcccctccgaccaaatcttccgcccgcggagatgtcgtcctccgccagtccgtccgtggcgccatcggccgaatacgtagaggtaagtatccatcggctagatcctctcttttcacaatagattggttcttccttgccttatcttattttcttcttctctgttcttgtttacatctgtagcacttgtccaatctggtcgtgatccttgtcacatgagcaccactattttcttggtccgatcggcaatcttgatcccactgagttcatcatcgccaaaaccaataggatcccttttagattggccaatccaaatctaggccactgaaagaataccctcaaatcttggccttctcttgagaaaacttctcctgagaaaagttgtgctgtgtggtataagccccgtatcggctagcaagcaggtccattgggatgaaccaggaatcggccaagcgcttgctcttactttggcaaattcggctaaggatgaacccctgatggcctctgccgcttatttttggtccaataccctcaatgcttttctgttaaaccaagggccgatgaccccaactctgatcgacatcactatgattaccggattagatgtaatttcatcggctaaccccatgagcttgaacaacaagaaccagtttgactttaggaccaaaagcatagggggctggtctggctatgtagcaacatacatgggcaagggatctgtcacccctcgagaacacactacctttctcatgatgtggctcgagaagtttctcttttatggatcgagctatggtccgactaccaactggcaattcttagccgaagcccttgaaactaagaggcaacttcctttgggcaaaatcctcctcgactatctgtatcagatgttgagtaatgcatcggccaagatagccaccggttcagtagtgggtgcgggtggaccatggtggttgttgcaaacatggctcaatctcattgttatgagagttgtgaattggccacccctgacagaagctgaattcccgaggctggaacccactactaatgatgatggggaagaggtcacccaccgccgatgcatatcatatggagaagctgcatcgacaccaaccgattctggagcaaagctatcggccgaactgctcaaagattagttctgcagtttctatgaaggcttccagagagatgcttgagtttggttcccttatgaggactcagtgaattttgatcacccggcagacttcaggtttgaggatatcaactctgaaaagtataaaaaatccacagaagtcttctcggctgccattagtccatgcattcttcctattggcatccaccaagggagaaatatacacgtgtcctatgagttctatcatccgatgagctcagctaggcaatttggaatgggacagatgccaattagcttattctttgccgataaaatccaatgcagaggggagatctcatccacactaatgatggatcggctgctcaatatcccaggaccctctctgggtagcattgataacatagagttggcaaggtttaggagcagaaactttgacagatggtggggtgaatggaagcaacatatattccattagccggcctctacgtacatgacagttctgtttcctgatgttgtccctcaggtacatctttactttgtcaattctgcttgaataattgtcagccgacttgaatcttgactaccttctctctttaccttgcagacaacataatctccccctcctcgcaagagtaacagtggaagggacatagaatatgctctaggacttttaccaaatggaggtggattagctcctccggtcctcgtctatcat

SEQ ID NO: 74052 - DNA, 6346 bp, Oryza sativa
tgccgccggccgcctcgacgccgacgtcatcacgacatgacgccgcggcacgacgccgcggcggcccgatacgacgagacgccacgacgccgccgtggcacggcatcggcgccgcgccgccaagccgccacgccgccgccgcgcaacgccggcgccgtgccgtgcgcttcgccaccgccgcacaacgtcgccaccgggccgcgcgccacgtcgccaccgtgccgcgcgccgcacggcgccgccgccgcgccacgccgatgccgcgcgtgccgccacgcggccgctgcaccgtcccgccgccgtccgctgctgccacaccgccgtcccgctgccgccacaccgccgctccgctgccgccacggcatcgaacaaaataacgtgaactaacgtgaacgagcgaacgaacgtgaacaagaacgagcgaacgaacgtgaacgagaacatgaacgagcgaacgaatgtgaacgagaattgaacgtgaaagaatgaacgaacgtgaatgaacgagcatgaacgaacgtcaacgaacgtgaacgtgaactaacgaacatgaacgaacgttaacgaatgtgaacgtgaatgaacgtgaacgtgaaatgcaatataggcaggtgaatgaatgtgaacgaacgaacgtacgtgaatgaaacgtgaccttaacgagaacgcgaacgtgaacgatcgtgaacgaaacgtgaacgtaaaatgcaatatatgttacttcgcgtttatcctaatacatctttttgtatcttgcagaaaagacgttgttggagtcgtccctcaagccggagtggtagctagccctcgaaggaattcgcgcagacaagtgacgtaattatatatatgattgttatatttgtaatgcaattaagactattagatttaatatacgacacttagacttagttttaatataagattattatagtttgtaattagactttagtatataatttattgactagctagggtcctataatatacgtcacctagacttagcatatatcactatttgagttttaatataagattattagatttgtaattagacttagcatataagattgtgtagggttctaatatacgacagttacacttagcatacatgactatttgagttttagtataagattatttacgttttaatataagattattatagtttgtaattatactttagtatataatttattgactagctagggtcctataatatacgtctcctagacttagcatatatcactatgtgagttttagtataagattattagatttgtaattagacttagcatataaggttgtgtagggttctaatatacgacagttacacttagcatatatgactatttgagttttagtataagattatttgagttttaatataagattattagatttgtaattagacttagcatataagattgtgtagggttctaatatacgatagttacacttagcatacatgactatttgagttttagtataagattatttacgttttaatataagattattatatttgtaattagacttagtatataactattgactagctagggtcctataatatacgtcacctagacttagcatttatcactatttgagttttagtataagattatttaagttttaatataagattattagatttgtaattagacttactatataatttattgactagctagggtcctgtaatatacgtcacctagacttagcatatgattgttagcatataagattgttaaaacataaatgtctcatgacttagcagctgtttcatgtatgaacagatggctgatcgcgatgaggaacagatattgtatgatacaatcgcggagggaagcagccagtactggaacgaagaagaggggaacgaggatccaaaccagtatttgaacgaggaagtgcagagggatgcagaggggaaccaagaggggcacgttgaaagggatgtggaggggaaccaggaggaggaggatagtgcaagtcaaccctccgctggacagaagagggcacgcgggcaacgaggtgccgcgaagaagcttgagggtcggcacaacataacggaagtggacgaagacggccgacctagtgccccggcagaagccgccaagaactatgtacgtcatagcggttgggttgtgcgggataacgtgcctgtcagtacggtatactggcgcagaacaagggcacgcggagatcatgagagctttgtcccagattcgaagaaagagatgctgtggaccacaatgctcgagacattcacccttcccgcgggtacagaggacaaagtgaaaaggtggattctgaagaaaatggcagaacagtttcagagcttcaagggagatctgtaccagaaatatatcctgaaggggcagacaccgaacttcgacacattcccaaagctaagggatcactgggacgagttcgttgcatataagacatgtgaacaagggcaggcgatgatggaaagaaacaaagaaaatgccaccaagaagaagtaccatcaccacttggggtcaggcggctatagcgtcgcgatgccgaagtgggaggagatggaggctagcttgcttgagtggggtatcgaaccggccaccgctaattggccggaccgatcgaagttctggtactatgctcatggtggaacgctcaacctagctgatggctccctggtcttcggcgatcagatacgcgaggctgcgcatcgactaacagaagcagtggaagcctcttctcagggcacgttccgaccggacagagagaaggacgagctgtcactcgccctgcaaactctagagcatccaggacgaacacgagggaaatgggtgattccttggaagattgggttcaaggaggacatccacacgtacaggagtcggatgaggagcaagagagataccgaggcgaagattgcagatctagagttcagggtatcgagctacgagctcagcatgcaacaggaggtggcaaggaaggttgatgaacgcatggccgcacatcggtcccatgatccctagccgaccattcctcctgcaatggtgagcccgtcaggaaaccgtagcagctgcgcctcaacgaggcaggtaggatcacagagcatggacgccatgcaaacccagcacgaaaccacctgccccgttgatgacatcactcagcggacaccatgtgagctgcatattcccttcaagaacttatcaataaaggtaagctcgtagtttatagattttagatttggccattccgctagttgctgcttatatatgttgtttactaataaataacctctcaccacatgaaggtggcgtcgggcatggccatcccaacggacccttcaggtacttaccactgcaggccgattccagcaggatactccaaggtcgaagttgagttggtcgaaggcgcgtacgaggacctcgaggtggattaccctggaggagatggtgagacgcatctacgcgacacaagccacgccattatactatggcgcaagcgctacatcatcctccctgggcaacaagcggcgtctcatgcaccatcccctccggctcctgcaccgtctcctcctcaggctcctgcaccgtctcctcctcatcagtctcctgtaccgtctcctcctcaggctcctacaccgtctcctccttatcagtctcctgtaccgactcctcctcaggatcctgcacagactcctcctcctgcacagactcctcctcaggctcctgcgtcgtgtcctccagcaccttccaagtcaagaactcaccaagcaccaccgcctgcccgcacaagggcaacgaagaaggcgaaagttgacgccgccgagaacaaggagccaccgtacgattgcacgcaacaggagcttgacgcttacgtggaagcagaagtgaagagacaattgaagcctcggggtccagaaaagaagattcctatagacccgagtgccaagaagttcttcaggagtatgtcggcaccagccaaggaggccataaagctaacggattatgagcgaacacttaagaaagcatcttctggaaagtccaaaccagtccctcagcttggagagcaaccaaaccaggagatcgagccgttggtgaccggcgaatattttggaatacaagaatttattaatgacaccgggctaactacggatcaattgctaggagacgcaccaatcaaaaaggcggaagtgaaatacatgtacgaactcggtaaatcgcttgtcaagcctgagctgctgcagtccctacccacacaaatgtacaagttccatcagctgtacatggagatgagcgcaaccggtagagagatgatcggagtgaggattagggacacggacttcttgcaaggagatgacattctctggatcaatttcaggggaatctacgaactataccagctggacgcccttgatgtctctattatgagttgctggattttgtaagtatatcgttcagttagatttcttactacgtctcctttaattaattaggtccttgtatataagtagactatatataatatataatcccttttatcgttgtagaatggagattcaaaggggcccgacggcggggggttttcgatactggattcatcgaccctcggaaagtaaacgtcgcaatgctcgaccaatacccgcaagccacagaggacaatctcgtccatctcttgaaggcgcagcattacaagacgttcatactgttgttgtacaacacagagttagtttaattttactgtcttcctataccaaatttcattctcgtacgaacattctaagtgtttcatatgtaatgcatcccacgcatattgcagattccactgggtgcttttactcttcgacctggaggcctacaccgtcaacatatatgactcaatggataaaaaagagtctacgttcgacaaggttttcgaacttatagacaggtactgtcataagttcctatgtgttaattaagaatcttgttatagttaattgctactacgaatcatagctttaaactccatgtagggcttggtatcggttccgtcatttggtccgcggcaaatggatagaaagacttaggcggaagttcaattttcctgtgagtacacatgctctacatttatatttctccgattcaaatacatacaagtgtatattaattagatctctcgtcgtttgtcatttatttatagtgcgcaaagcaaaagaagggaactaacttgtgcggctactacgtgtgcgagtattgccactgccttgcaaaccaaatcatcaccacaagagagctcgacgtacgtacaaataaattcaaattttcattacgtatcgatttgttgtttaattactaatcaatttcatacattcatatagtttattcgcatgagggataacctgatcacacacaaggaattcatcgcggcggttcaagaacaactcatgggattcatcaacgaacaaatccttgatcccaagggtgaattctactacgacggaaacacaattcataggtccttagcttctgagctagcgactactactacgtcgaaatcgtagctagctaggacatataatggattgtaattaatacatgactacatatgtttctatatgcatgtgtacacattttctataatgtaaatatatatatatatacacacacacacacatattatatatattatatatatatatatattatgcatgtacatatgtattgaaacatatatatgcatggtttatatatatatatatatatatatatatatatatatatatatatatatatataaaccatgcagcaacagggccatgaaaaaaaaggtcagctcgatctttagtcccggttggtaacaccaaccgggagtaaagatgactcagttgatgttaccaaccgggactaaagatcgatctttagcctcggttatttcacccgggattaaagatagcgatctttagtcccgaattggtagtcccggtttggaaaccgggactaaaggggggttacgaaccgggactacaaatgctttctccaccagtgggtgaatttagtctcacgtttgtaattttaaaattttgtatataagctgttagaattagtaaaattaaaacaaaatattttttatttcttgctaccgattgctttaccttttgttaaaagattgtttaacattttctataatataggatattaacatggttaagttacatgtttccagttttaaccaatcacacttagcactaagggcgtgaataatggtacgatcaccatgtaggagagaatgccacacaatatatttttttgttgtggaagtgagtgagatgagagagaatgcttttgtctataaataggcagacatatat

SEQ ID NO: 74053 - DNA, 943 bp, Oryza sativa
tttgataatgccaaaattttatcatgatttcttatatagttaccaaaatttagcagcaaactaaatgtagccactttttttaacaactttaccaaaatttggtaatattaaaaatgacatcaaatgaacaggccctgaatgaatgaatgagagagttgtcctcctttctttcgcctcacttcctggctcctgctataagaaacacttctcttcccgtaaaaaccgattaaagaaaccaatcatgatacataaaaccaatcaacctattctgttcaaatactttcactaaactgaataaagaaacgttacgacagacgggcctataaccagtaacaagttgaaaaacagtttggcacgaggcaaaatatactccctccgtcatataaaaaaccaatttaatattaaatatacgttttctagtacaatgtatctagacattagtatgtctagatttgttgtattaggaaacgtctaatccaatacgaggttaagttttttttaacgggagagtagacggtaatcataaagagggcttaatcaccttcttttttttttaagcacgcacataggaaaaacatcagggtatgcgggtatgcaggcgttcaacacttcaacgtactacgagacaaggacgccaaaaaaatacttcagccgaccgctccgacgtgtaactgtcaccgggcccaataattcgtgggccccacacgccatccacataataactccctcacccccacagcccattgacctccttcctcctacacccacccacccaacccaagccgtcgtcgcgttcacacacgcgcaccctctctgcccccacaatccatcccgtcctctcctcctccctcgcccgacgcgcatcgccttcgccatggacgccgcgagccgcacctggccgcccccgaccccctccccgccgcccttctcctcccgcccccgc

SEQ ID NO: 74054 - DNA, 23017 bp, Oryza sativa
atatgttaatgagtctagatatatatatatatatatatatatatgaatgtgggcaatgctagaaagtcttataatatgaaacggaggaagtatttgtgtttatactgtgatcgtctaaaaggtatatcctttcttcatgtaatcatgtttcagataaaaagcaggggaagatgtttatttctaccacatatcaagtaagggcagctgttgctacgtccataggtgtagctgctgcccgtgctaaaatgcttgcagaccaggaagaacgggaaatggagctcctaatggcgtccataatagaaactcaggttaaatctcttgacctattcttatttacatctgcgggtatagtttaagttcgtagttctaacactgtttattcatctgaaagttacatatctgacacatcatgtacattcctgcaaaccatttcagttcatgacttcactacctgaacactaccataattcaatctcctagctgtttttatgttctaaaaaacatgatattgtttagagagggatgatatcgcaaacatcgtgcttaaacggttggggaataaatatgcagcatgttcttctacatcaaatggcagagcggagggacataactctttttttagttctgttgtgcgagccatttcctttctatctgtgtgacatattgtaatgtggctaaagggaagaggtccgtctagttaagtctgttcacctagatatcatttttaacttcgttctggatcctgcaaaacctgatgaatcatgattcaagttatgggtttgatttctgctgctagctgaactcctaccatggtggcacagcacatgccccttcctttcacagggctcaaagaaatgaaattcttattgctacaaattcacaaccttattcttacactattactgctgtcttgatgattgtctgactgttttgtttcgaaacgaaataaactctgacagaccttatctatactttctgaatgtatttccttaatgaccgactgctgtctactttatgttgaccagctaaaaaagatccaatacaagatcaaacactttgaggagctagagttgatcatggatcaggaatacgctactctacagcaaatgaagtcttcccttgtcgatgaatggcaaaaggtcctcaagcgagcatttgagactggagtaccaatatcgagggatgaagtgcttataaagttgttccaaaacaagccaaatctgtagagaaattgaccaaagtcggttagatctccatgagggagcattggaggttgggatatctgtactgagggatgtgctgttcgagtaacatccctattccttagagaagttgactggagtcgattatccctcctctgatctgcctctccatagagcagtcatctagcagtttaacattgtggtgtcagagcgtggctgtaaatgtgctgattgagctttgggttgatctcaaaattttgcgtttgagatcacatcgatcctctgtagtttgtatcatcctatgcgattgcacgtgattgctccgttatactatccaactaggttagacaagtagtgttgctaatagcttcctgtacctgtctacatttcgttgatttcatttgttgggatgtgcaaatcttcctccagctgggagtttctgtatgttctatcacattgtctgattggttactttgataaattgatagccattgtatctagagtaaatttcatgtaacctaaggtgttgagtttgtcacacaaaatcatgtgttttaacatctgatatattactctcggttgtacccagactttaacaaaaccacactatgaaacaattattctttgacccacaataattatgagttctaaaatcgaatcttaattttttgacattattgatctattctataaaaagttttatccaagttaacctttttcttaaaaaaatctctacctatataaccataataagcggggtactgggttgtggttttagttttattttgaaagttcataacacccatacccaggttttataaaatttactccatgacagttctgcacctctaaactgtgaaagtttaataaaggagaattctttctttatctgcgcagcaaagccagcaattcggtgtttggagaattggagccatcctgaaccgtttagggtttgatcggacggctggtatggaatctcacagaagggcaccaccatttttccccaacgcggagcggcggaggcggcagccaaaaacccctccctcctcccctcctggactctcggtttcccctaacctcgcgcgccacctctcctctcctcgtcctccgcctccggacgcgcagttcacgggcgccctaatggcgaaaaagggcaaggcggcggcggcggaggccgcggcgcccgacgcgggggtatcgagcccgcagggcggcggcggggagaaggagggcagcttcctgctgggctcgccgacctgggaggacgccgggggcgggcggtggcggtgcaaggagacggggcacgagctgccggagcgggagaaggaggcgtacgggcggtcccgcgcgtgcaggctcgcgctcatcgaccaagccgtcgcgcgcaagaagccgccgctcaacgccttcaagcctcaccccgagcacaagtgcgtactagtaccggaatccgcccccatcttgtgccgcgctacccatctattattgcctttgctctcgcgttacgcaccaaggcgtatcccacgtatcgtgctcggaatttgtttatgcttaatcttggtttaattggttattttgctgtttaatacgagggttctaaattctagtgtccaacgtttgatcgtattttgtgaaataaagttggaaaaaaatctatgttctttttaggatgcagtcgagatgttgaatcgagtatgttatgttgtaggtcgaagcttatatgcaatattactggggacattataaacaagtcggaggaacacatctggaagcacatcaatgggaagaggttcctcaacaaactaggtaaataatcctgtagcgttatcttatatgcaatgccatgtgtgccaacggcctattgaactttgaactgagctctgcctttttatatatcgaactactaatttaagaacccatgaggttgactatttccatgcggctatcattttcttcatgctgtattcttctataggcatgtgatttatcatctactagtatgaattttcatcaacaatgattctgagagagaaaaatagtgattgacattggatgagtagttggtacattttctcagaacaattatgaacggatttcatcgttaatgcttattcaagtggatgatgtgccttgctttgcaatggttatttgaactttcttatatttgttttccattgttctggaaataatatcttccaaagcaatttgcatggaattcttttttcccacacagatagcctttccattgcattggaatgtttggttgctcctatatttaacatgtctattactcctatttaatagaaaaactagaagaaaagatggcatcaggtgaaatggccgaaggtgaagctgaacagtcaaatgaaggggaaaataaaaccaagtcaaggaagaagaaggacaagaagaaagctgctgttgttaacccttctttgccacgagaacctaaaccagagattgatgattcagataattctgatgatccagatttctgggtgcctcctgttggaagtcgttgggatgatgatgatggaaaagaccgatggacctcctctccagtgaaggataaggatgatgcagcagaggatgaaggtgaacttggcaagctttgcttttgttttatttaactgctttaacctaacaagccttaaagccatgatcataactcttagcacatgcgggagatattgttgctgctttgcttgagatagtattggtctaatactttgtatttatatatactgagttctttagaatatgagaaacagattcgtatgcagttgtatgaatgcatgcgaggttcgagagtggttacatttgatctgctcaatactttcagtggaaatcttccgcttctgaattttgtgattagcttattatagtcttttgctattatagatattgaaatttgaactatatgatctggtatgttccatgtctaatttggaatatgatagatggtgatgacgatggtgatgacatggctgacaaggatgacaaggagacaagagaaattgcttcaaggtactctcgaacatttctttcaatatttcaatagtgcatacaacatagttaagagatattttttaatatagcaggacaaagcgactgtcagtagaagcagttggcccaagtagcttcgcttcaaggaagaaaaaaaccaaaaaggagcagtaaaggttggtccacagcttatcatcgagttcaatgaagaacttatttgatctttctgtgtggacgaacaaagtccatctttgattcctcttggctggctagtcaggtgcgggttttgtattaattggtttgcttttagttagtgcttctctgtgtagccctatcgctgcacctttcagtggtatactattgcatgacaattctctatacttgcattagttaattcctgtgattttgatgtgagaatgaactgtgctacttgtcctatatttattcttgctatataacttcatatgtttcttttgtattacttgtgcatttgagtacgtttgatggtaacataaaatcgtttagactcctcgtaactattggctttgtttaaatttataaggcatgcctggttaaaataaaacgatatcgacaggatgggcacctgacattaagcctgctaatggattggatggaaatggattaattgggttggatttttatttggttagctttggattggagggaaatgggctcgtgcggtaaatggattggtgcgggttgggtgcacatactgttgggatacgcgtaggctacgatagcataaatcaaaattttctatcccgtaaatcaggaaccatgcaagtattagatcatagatcgttaccactcgacgtgctgcgcagcagaagaagacgctgagaagtcgaaggaactctcgcgaagtagcgcgcgtcgatgtagaggaagtagtcgatcgcaccggctcgaccttctcctcgtgcgttctcctcaccgtacttccacgccgatcagcaccgcaaaccagcggcgcctctaccggtatccacacgcatagggacggaacgccacgcgtagatgtgctagcatgcacgcgcggctagggttttgctcgggaagggaagtgacggctagggtttctcacgtgatgcaatgcctccgccggtcacacccctcacgaatatataggatccatcactcgggcctctaaggcccgtaggactcctattcggatccctatccgaattaagctcatattgggtctctatccaatccccttattccggcccattaagcttgcgaccctgtaggttcatatatactcggttgtaacctaaaaactcattttcggtccacgcgtcaacagcggcccctagcagaacgtattgacccaccgggtatacataaagatcatatcggctgaacctctagtgtatacttgtatgaacccctttgcctcacgatatcgattgagctcaaggctaaatatgtgacattctctaatagctcaatcattcactcgaacttgttgatagattatataacttgtgattgactcctcaatcacctttggcatggccatgcacttccataatctacaacatcgaggagcccagagatatctctccataagaggggcaaatcccatcttgattattcatatcccactacatgtttcatagcatacccgaaaactacttttataactacccaattacggagtagcgtttagcagtccctaagtaagctactacatatgttgagaaccatgataatctcaggtctaaggattcaacaccaacactcaatgagatcactgataacacaacacatatggctcttgcagtgtctcatgttgggtctatccaacaacatgttcaccaacatgtgtccacattattaatttggtatctctataccatgatccatgagacatgatcatcaattaatacatgtgctgttcatataaacatatttattctacatataatatttgatcagggatcctttagaaatagtaacaaacaacataaagagtcttatgaaagaatcacatattcattaaccaataaggagttatctatttcaaggaacaatgtcggataaatatgtaaacatagtatataatataatcatctctatgattgtctctagggtatatcactaacacataccaattggtttggagtggtttggttttggatgtaaaatattggggcaaaaatgggttgcgtccatgggttcaaatggattctaggcaatagcttcgatccaaatcagttcagaacacacgggcagtctccaccttcctctctcctgttcgtcctcatgcaaccatccatacctccatgctgcatcaagcacttgagtatctgcagcctgacgaggatgaaatcgtagccgacggcgagacggcgccgaatagcaggttgacgacgacgacgacgccgccgccaccgcccatcatcatgaggcgcgccgcctcggcaacggtggccgggtggcggcctgctcgcccgtacgtcgtcgtcactgtcaccgccgcgtgctctggcggctgtgccctgcgctgcacgcctactggccgacccgtccacgtgccgccgccgcagctgctggtacaccatctgctgctactgcatcgccgccgccgcagccgcggggtggtagccgtggcggcggcggcggtggtcttctcactctcgcctcgccatcttgctcctccagtttcacggcacaacggcgacgacgagatcgtggcggtggagggggatagcgccagcacgggggatgtggggctaggcgcgccgcgcgagttagcacggggcactgcagccatggtctccgccacctccacggcttgatacgaagtggcgaagcctgcaagtcttgcaccgcacacgacgcacacgatttgggttgagtccatggattggaaatgggttgagaccatttgacaataatggattgggttggtttggtcctacatcttgcgcgggttggattggtttggattttagatgtgatgaagtagactgaactggtttggtgaactgtgtataatggagatggggtgggttggatttggattggatttctgcccattagcaggctgtgacaagtcgattgactggacgaggaatagtaaccctgcacattgtgaagttcagatgatgttgcgagggtccattttcagcttataggtttatgttagcagaccagaccatgtcgcactgaattgccatttggcttacaaaaagtgggcaatgattaattatctattagtaatgtgttaaccaggatagaatctcattatggtgttggctttatatctttggtcgaaaaaaaaggggatataatctcatatttttctttttcataccatattgagttttgcaagggttttgtgcaccgaggattagtttagattaccagaaatcaaattaatgagaggataatttagaactccatagaattcatctgaaaatcatgcaaatttcatgtaaaacttgtgttccaaattgaccttgagccccgctcacacacgccctgccgtgcacgtcgtgatacctgtttttacctgtcaaaccattcactttcctgtcatttcggcctatatcggcctctatggtttccaaattccaagtctcctgccataaccaaatagcccccgattggccaatcatttagtgatcgtctatgttggttgacttgactcggtacaaggtaagctggaaacacatgaacagtagtgcaaggtaggagcacgaaacacccagcctcgcggttgcggtctccggcgagtctagtattcgggagtctagttttggggtgaattcaattgaggttgctacagtttaatttgtttattttatcaattgacgtgttcatgcaatccacaattgataaaacaaacaattgacatgtagggattgcatgaacacgccattgccggcttccgccatcaccagacaccagcttgcagcctggcactcgcacgcacacctttcttcttctacatggagagattacatacgagccgtaaccacgtctatggcttcatcatcatcctcctcctcctcgtacaagctacggccgcggccacctcgcggtgcccggcgcaacaggccgccgcgctgctccggctcaaacgatccttccaccaccaccaccagccgctcctcctgccgtcgtggcgcgccgccacggactgctgcctctgggagggcgtgtcgtgcgacgcggcctccggcgtcgtcgtcaccgcgctcgacctcggtggccacggggtacatagccccggcggcctggacggcgccgccctcttccagctcacgtcgctccggcggctcagcctcgcggggaacgacttcggcggcgcggggctcccggcgtccgggctcgaggggctcgccgagctcacccacctcaacctctccaacgccggcttcgccggccagatacccatcggcgtcggcagcctgagggagctcgtgtccctcgacctctcctccatgccactctccttcaagcaaccgagcttcagagctgtaatggccaacctgacgaagctgagggagctccggctggacggggtggacatgtcggcggcggcggcggcggcggccggagactggtgcgacgtgctcgcggaatccgcccccaagctccagctcctcaccttgcagtcctgcaagctctccggcgccatacgctcctccttctcgcgcctcgggtccctcgccgtcatcgacctgtcatacaaccagggcttctccgacgcgtccggcgagcccttcgccttgtcgggtgagatccccggcttcttcgccgagctcagctcactggcgattctcaacctctccaacaatggcttcaacggctcgtttcctcaaggagtgttccacctggagaggctcagggtgctagacgtgtcgtcgaacaccaacctctccggcagcttgccggagttcccggccgccggggaagcctccctggaggtgctggacctgagcgagaccaatttttccggccaaattccgggctccatcggaaacctgaagcgtctgaagatgctggacatcagtggcagcaacggccgcttctctggtgctcttcctgattcgatcagtgagcttacatccttgagcttcttggacctgagcagcagcgggttccaactcggggaattgcctgcttccatcggcaggatgcggtcactgtccacgcttcggctgagtgagtgtgccatctccggcgagataccgtcgtccgttgggaatctcacacgcttgagagagttggatctctcacagaacaatctcacaggtcagtttcaactttcttgtcgtacacaaagcacacaaaactgctatcttggaactcctttttagatagtttttgggttatgttatttgcagggccaataacctccatcaacaggaaaggggcattcctgaacctagagatattgcagctatgttgtaactccctgtcagggccagttccagccttcttattctcacttccacgattggagttcatatcgctcatgtcaaacaatctagcaggtcccctccaagaattcgacaatccttctccgtccctaacatctgtttacctgaattacaaccagttgaatggatcaatacccaggtctttctttcagctcatgggcttacagacactagatctctctaggaacggcttgagtggggaagtacaacttagttacatttggagactcacaaatctaagtaacctatgcctgtcagcaaacagactgacagtgatagctgatgatgaacacatctacaacagctcttcctctgcatcactccttcaacttaactccctggggttagcatgctgcaacatgaccaagatccctgccatactaaggtcagttgtggtgaatgaccttgatctctcgtgcaaccaacttgatgggcctatacccgattggatatgggcaaatcagaacgagaacatagatgtcttcaagttcaatctttcgcgcaatagatttactaacatggagctccctctggctaatgccagcgtatactatcttgatcttagtttcaactatcttcaagggcctctacctgtcccctcatctccacagttcttggattactccaacaacctattctcatcaatcccggagaacttgatgtcaaggttgagcagttctttctttctgaacttggccaacaattcactgcaggggggcatcccacctatcatttgcaatgcaagtgacctcaaattccttgacctgtcttacaaccatttcagtggtcgtgttccaccttgtctactagatggacatctgaccatattgaagctgagacaaaacaaatttgaggggaccttgcctgatgacaccaaaggaggatgtgtttctcagacaatagacctgaatggaaatcaattgggggggaagctacctagatcactcactaactgcaatgacctagaaatccttgatgtgggcaacaacaatttcgtggactccttcccaagctggacaggggagctaccaaagcttagggttcttgttctacgatccaacaaattcttcggcgcagtggggggaattcctgtcgacaacggtgatcgaaacagaacacaattctctagtttgcagatcatcgatcttgcctcaaacaacttctctggcagtttgcagccgcaatggttcgatagcctcaaagcaatgatggttacaagagagggtgacgtgcgaaaggccctggagaacaacctctcggggaaattctaccgtgacacagtcgtggtcacgtacaagggcgcggccacgacattcatcagggtcctgatcgccttcacgatgatcgacttctccgacaacgcgttcaccggcaacattcctgaatccattggaaggctcacctcgctaagaggtctcaacctgtcgcataatgccttcaccggaacaatcccttctcagctcagtggattggcgcagcttgaatcgctcgatctctctttgaaccagcttagtggggagatcccagaggtgttggtgtctttaacttctgtcggctggttgaacttgtcctacaatcgtttggagggtgctattccgcagggaggtcaatttcagacgtttggaagtagctcatttgaagggaatgccgccctatgcggcaaaccgctgtctattcggtgcaatggttcgaatgcagggcccccttcgttggagcacagtgagagctgggaggcccggacagagaccattgtactgtatatttccgttggatcagggttcggtttgggatttgcaatggccttcttgttccaagtgttccgcggaaagtgaaaaatgaagcttggtggtcaataataaatagagggaaacaacaatatgacatgccttaccttttagtatacacccatgataagtaatgtacatataagcctattctttctatatttttaaagaactgtcgagataaacttgctacacttccgttttaactgagttactctaaatagttagactaccatgaataaaagttctaattttatggttgatgcaatacaatttgataacatggcatccacatatttaagtatttctaatttttcaagaaagaccgagaggtcaaaacttgaggatgaatagctgcaatgtcagttttttttttaaaaaaaaagagataggagtacagtgttttattctctatcactaagttaaagttcatgaaaccttgtacaatttatttggcatgcatataaccccatcggtaacgacctatacttgtcggtaccaatctcagagatactcggtggcaccaagccttatgccgatcggtgcaagatcgatacccaaataacaagcttagcacctacaagatcaggggcatcccggccaaattagtcctcgtgcgaaatgttaaaatggggccctagtagccctagtgcccctgctcggtggtgtcctggtgaactgtgaagtttttttggcagccaattttctctggaagcttcaccttctctgtattgctatccttatttacatatacatgactagatgggccctctagcagatgggccagcacataaaacacacacatactgttgtatttacagcccaacactccccctcaagatgggtgatagatatctatcatacccatcttgtcacatgaactattacactctttaacacctaaaccctttgtgaaacaatcagcaacttgtccaccagacattacaaattctaattccaaaactccctcatccagtttttccttgataaagaaacgatccaactccacatgctttgttcgatcatgttgaactgggttgttagcaatgctgattgctgacttgttgtcacaccacaatttcattggagtatccaccggcaacatcaactcagaaagaagattccttagccataacaactcactcaaactcactgacattgcccgatattctgcctcagcggttgagcgagacaccaccggttgcttcttgctcctccaagatactagattgccaccaacaaacacacaatagcctgaagttgatcttctatcatcaggacaacttgcccaatctgcatcacaatagccttcaacctccaagtgtccatttttcttaaaccataggcctttacctgggcttcctttcaaatatctcaagatcctatagacagcatccatatgcccactccttggatcatgcatatatcgactcaccatactgacagcataagttatgtcaggtcgtgtatgacataaatatatcagtctcccaaccagcctttggtatctttccttattcactggatttccagactctgcacataacttatgattttgatcaactggtgtagaggctgggcgacatccaagcatacctgtgtcactgagcaagtccaatgcatatttccgctgtgaaagaactatccctctaggagatcttgcaatttcaatacccagaaaatatttcaactggcctaggtccttaacttcaaattctttgcttagattttgtttcagcctagttatctccgagcaatcatttccagtgataatcatatcatcaacataaacagcaagaatggttatatgatctccactatgatgatagaaaactgtgtgatctccattacattgtttatagcccatagcacacattgcacgcctaaatcgatcaaaccatgctcttggcgactgtttgagaccatataaggatttcttcagtctcaatactttacctttagtttgcaaagtagcaaatccaggtggaatttccatatatacctcctcttgaagatcgccatgtagaaaagcattcttgacatccaattgatgtaatggccaatcaaagttaactgcacaagatattatagttcttaccgtactcatttttgcaaccggtgcaaacgtttcatcataatcaattccatatgtctggctatatcccttagccacaagtcttgctttgtacctctccacttttccatccggattttgtttcactgcatatacccacttacagtttaccactttctttccattgggataggatacaagatcccatgttttgttcttctcaagagcttctagttcatctagcattgcttgatgccaccttgggtcttgctttgcctctttccaatccttaggaattatagctgaatttagagatgccacaaaggccttgtatgtcgatgacaaggaagtgtaagatacataattggctatatcattctcatcaccactttcatctccaatttcaaaaccatatctttgtggaggtttgcctgcattgcttctcatcccctttcttatggcaattggcaagtttgattcttcttctctaatttctatttgttctccccctgactccgaagacacttgcacatgagtaagatcatctgatacttgatcatcaacttcaacttgttgagttgttggaagtctcattctccttgtgtaaacttgaagattttcctcttcatgtggctttctccattcttgttcttgtacaggatcacctatagcacatggaatttcaccaaccacaatctttccctttgattgttcattctccttgagacccaagatttcaccttccttttgttgatcatggtcacctctagttaaatcatcaagatcaacaaataaagagcttatatctgttttctcaccatagaatggacagattccctaaacgtaacatccatacttacaaatgtccgccgttctgatggactccaacacttataccccttctggctggatgaatagcctataaagatgcatttaacagctcgaggatcaagtttcccaatagatggtctatgatctctaacaaaacaagtgcagccaaacaccctcggtggaaccacaaattcattcttcccaaatatcatctcatatggtgtcttcattccaagtattcttgatggtgtgcggttgatgagataagctgccgtcattactgcctcactccatagaaatttaggtacattcatagtatacattagtgaccgagctatctccaaaagatggcgattttttctttcagccactccattctgtggaggagtatcaggacaagaagtctgatgtaatattccttccaaagaaagaaagtgaccgaattcactattcatatactcccctccattatcagttctaataaattgaacccgagcattaaaatgatttttaatatatgcataaaagttttggaagcatttaagcacttcatccttatgtctcatgagatataaccatgtcatgcgggaatagcaatcaataaaggtgacaaaatatttcattccactcatagaaaccacaggcgacgtccacacatctgagtggattagcataaagggcaaaatactgcgaagtcctctactcacatatgatgttctagtatgcttcccatactcacatgcatcacatatcagcatatgtttatccactttactaaactctaccgggaacattttactcataatttcaaaagatatatgtcctagtcgacaatgcaaaagtaatacctcagtcacttctttacttgttgaagccattagtgcacacacatcctcatttgtccctcttctgtccaagtaccaaagtccatcacgcatgataccaatcccaagtttcttccctgttcttctctcctgaattaaacaattctcacgatcaaggaaaacccgacaatccatattatcaacaagagaacttattgaaattaaattcactggaaaagaagggacatataacactgatgacaaagtaatggatggagtacattgcactatgccctcccccttaacctgacatgatgtgccatcagcagtttgaatggtctctttgtgtgcaaatgaatatggtttatatgatgtaaattctccactcatgccagtgacatgcctggatgcacctgagtctaatatccaacttgaatgagaagtgttcatagacataaatgcttgattaaaactacctggagtagaatgagcaaagttggcaacattgtcaggtgtagtcccggaagaaccctcttctagagtaactgcattagccttgtaatcacctctatatccataacctcttcctctattgctcctaccagcatagcctcttccacctcttgttccacctctatcaacacctcttcctctcccataagtaggcttgcgtggagcatgacaatcacgcataaggtgtcccatttcaccacaattgaagcactctctagtctctttaccttgtacaattgcataggtgggacttggtgaacatggtgcggcactaggcaatactttcttcttaagctcctcctgtgccatagctgcaatggcctcatctaaggtaggaagagtggtttggtgaaacattgcatctcttcttccttcgaactctggatttagacccttcaagaactcaataacccttctacgctcaacccatttcttcatttttgctatgcaatcagagtgctctaatccaagaggatcataatgatctaaatcggaccacaaactcttcaactctgcgacatattctgccacagagcgctccccctgtctcaaagcacttatcttctcttgtgcctccaccattagcatcacattaccttctcctgagtatagtttagtaagagttttccacatctcactcgcactagagatagtctcaacagttgtagcaatagctgggattaatgaagtcaacaaccatgccaccactaaagagttggtagtgctccaagtcttccattctacacttgatgtgttctcaggctccttcacttctcctgtgacatatccttctaacccctttgtttttagtattagtaatgccctccttgaccaactcaaataatttttgacacccaacttgatttcgttttgcattaactcaatcttcagtattgattcagtatgagggataattgcattgcttgtagttgaggcctcactaaattttttcgctagcatgtccaccaatttacccatcacttgttctattccttgattttctgccataatgcaaattctgaaactgcaaaccagtagaaacccaactagcagatctgagccccctgttctacctttcccttcctatagattgctcaaatagtcaatatcacaaaagcagtagctgtgcttttacctcggtttccttgccaatcacacacccacaagagatgcaaagtcttcactgtgctgtgaccccgccactacagagcaagagccacttcttcctgaggagcaccaacaccagctgtttaccagcactttctttcttgcctcagcccaaagcagctctgcacctgcgagctcagccccaagcagcagcagcagctccgcacctgcagctgctcgggttcttcctctcgacgcgccgcgctagccccgctcttccgcgccgctgctgatgcgcactctctaccctgctcaagcctccacgcctacggccaggtagggtttagccgtcgcctgccgccggacggtcggctctgataccatgaagtttttttggcagccaattttctctggaagcttcaccttctctgtattgctatccttatttacatatacatgactagatgggccctctagcagatgggccagcacataaaacacacacatactgttgtatttacagcccaacaaactggcatgtgaagcagcgcggaggctggaggggactgaggagaggagacttcggagacgcggatggctgtacaatggaaattggaagatggatcgtttaccttctgcattattttgggccttagttttactactatttaggctgcaaattaacaaaattaaagcctctaatatctattatattattaaaggaatagaaaaaggagcctccacgttcgctctcatggcctagaaattctcacattaatcggagaaaaagaaaaaacagagtccatatagaaatacaatttagaaatagttgaaattcggaattaaaaataaggaatattagaagtagagtatagagtccatatagaaatacaattaggatataactgaaattcggaattaaaaataaggaatattaaaagtagagtatatagtacatatagaaatacaattaggaaataactaaaattcagaattaaaaaataaggaatattagaagaggagactagagtccatatagaaatacaattagaaaataactgaaattcagaattaaaaataaggaatattagaagtaaagtatggagtatatatagaaatacaattagaaaataactgaaattcgaaattaaagataaggaaaattagaagtagagtatagagtccatatagaaatacaattaggaaataatagaaatttggaattaaaaataaggaatattagaagtagagtgtagagtccatatagaaatacaattaagaaaaaaaaatagaaattcggaattaaaaataaggaatattagaagtagagtatagagtctatatagaaatgcaattatgaaataatagaaattcagaattaaaaataagaaatattcgaagtagagtatagaatccatatagaaatacaattaggaaataataggaatttaaaactaactaaaatttggaataaacgtaataaaattaaaagtagagtttagagtccgtataaaaatacaatttataaataactaaaattcgaaattaagaaaaacatgggaagaagagtttaaagtcaatatagaaatacaatttagaagtaactaaaatttgaaattaaaaattaaagaatattaaaagatgagtttagagtccttatagaaatacaaccagaaataataaaaattcagaaataaaaataaataatattggaagaagagcatagagtctatatagaaatacaatttacagaaaattcggaattaaatataattaataactgacacgtatataaaatacaatatgaatattacatatttgtattttcgtaaagctattgcaaaatttaaaattatgatgtaattttaatatttttgaataatataatgagaaaacatatatgctattatataaaagaaaatataatgatgctagccgcgcaatctgcacgggccaccatgctagttattatatattgggtatacttaataggggcccttaagatttggggccctgtttagtcgcacagtccgcactggtacaagacgccctgacaagatacaatgcctctaatcctcatcctctttcaccttcacattaccaattcatgcacttctctcaccaccaaagacgcacgtactcattttttttcctactcctccaaggaaaaaaacaaaaaaagaataaagatagtgattgaattgatgaatatgtggacggacgacaataccgccatgatggagacctttgcctctgcagacctttacgtggaggtagcttccatgccgccgcagcagcagcaggtggtgccaacagcgctcgcacccacggtgacgttcaaccaggacatgctattacaactcctccaattcatcatcaaggtcctattaagaatatacgtaaaacatttttttaaaattttctatgataattgtatacacgtaaaagacttatgtgtataggatacattcccgtgcaacccatggcaattatcaaccgaaccaattaaccattcgattattttgagggcgacccatgcattcgcgccccgtggccggcctgcgttgtctgatctcgatcgcgatggcccgtgacgcgaggcttccgtgacccggtttgtccaagtttactccgtacgtagtagtatatttgttgccgttgccaatggaacggtactcaggcgggggcggccggctagttccacacgctgccaccgctttgccgaacccgcgcgtcgatcgttcgtgcacgcgtctcgcatgcatcctccacaaactccggccgtattctgcacgttgatgttggcctctggcggtccaacaacagcgctgccccaagccatccagatacggccatacgggaaaaccaatggcgatcggcgaccgggacgaccatccgtttatctgtaccttgaaggtgacccgtgcgcacgacgctcgccgccgcttcctgtactgtctttacccaatcctgcaccggaaacaggagagagagagagagagagagagagagagagagctagtaggaaccggattaacttcacgacggcttccatatgctccccgttctagctggccctctctgtaatgtactaccagtagtactgtcatttctcaccaggacggctacacagctactgcgtttatctgagctggaagtaggaaattcgggaacccaccgagcttaaatttttacagtatcacttttgataactagatatatactccatagtaatgatactccgtaagttacatgcctgcatcgtcaatgagcatctctgttactcttgctcttggtggcgatgagcacgagagggttcttcttgcgcaccgccagcccgttctcctcctccacgtccacctcgcgccccggcagcgcgcgccagtcgaagcagaagagaaggttggccagcagcagctccgccgccgccgccgcgaagtgcacgccggggcagctcctccgcccgatcccgaacggcaccagcgcgaacccgtcgtgctcgtgctgctgctcgccgtcggcgtcgtgggcgcggtggcgctcgggcaagaaccgctccgcgttagggccccagacgccggggtccgtgtgtatcgccatcgcgttgatgacgacgcgcgtcctggccggtatctcgacgccgtgcgccgtgcggaacggctccgtcgtctcccgttgcaccagcggcgacgccgggtggagccggagtgtctccttgatgaccagccgcaggtagtggagctccgggaggtcggcttcccgcaccatggcgccgtccttgtcgccgccgccgccgccggcgatgacgcggcgcacctcgtgctgcgccttggcgagcacgtccgggttcctgacgagctccgtcatcgcccactgcaccgtcaccgccgacgtgtcgctcccggcaatgaacatatcctgcaagaccacacaattcggtttcgatcgatcaacatgtccaggaaaactgggaagcaccagcggcgtggtgttggagtcctgggtgcatgactccagttcatccactcaagttcaaatcctaatgctcacacgaattttacacagacgtagaggggaaattgttttaaacactcgggtagacgtccacccgtttcttgtatggcatttaaatggttatgaaaaattttcaaaagaaatgacatgataggttaatatgtaatatatcatctcataaatatgcaagttcaaatttggcgtctacaaattataataaaaataacaaatttaactgtgaatatacgtatactagttagagtttaatttgttgtttttgttacaactcgtagtagtcgaatttgaacttacatgtttgtgagatgatatattacatgttaacctatcttataattttttttcgaattttttcataattatttaggcggcatgcaagaaacgggtggacgtccacccgagagaatagggcagtcccaacccatagtgtctataagtagtgtctatgatgtcatgtcaataagacatcacaatagaaactatactctacaacccatggttttttaaagtgggacattaataaatacatcatctttcttctctactaatcatatttactcttcatctattatgaagacactattctctcccaatgcaaaacttgatagtgtctattgcatagattctcgtgttgaagctgtgtcttgcatgagacccagtttcttcctctcttcactctctctcttaattaatatagtgtcacataagcaacaagttttacatggtaatgtagttaatgctatagacaccataggtttcgataaaaatttaatgagatgtgaaatgtgtagctagtttccgtctacgagttaggagacatatccgcgcggtgtgaaagtggtgcgcgcgcgcatatcgcgtcttccctatgtccaggaaaacgtatatcacagcgtgctatgctcttgtccaggtacgtaatatgtacacgtaccgtgagaatgcctttgatgtgggtgcggctgccgaacatgctccggtgagccggatcgccgtggaggcggaggagcacgtcgaccaagtcgtcttcctcgtcggatgcatgcttgcgcttgttgatgtggtcgtcgatgacgcgctcgtagaatgcgtcgagctggcggaaccgccgctccagccgccacctcttgccgctgagggtgtccacccaccggagccacggcacgtagtcggcgacccagagaccaccaagaagagactgggtctcgtcgaggacagccttgacgtccatgctctcgtcgccgtcgccgtcgccgaaggcgacgcgccgcacgatcctgctgctggtggcagcgaccatgtcgctcaggttgacgggggaggcgccggcggccgccacggccgcgatgagcgcggcggcctcacgctccctggcgtcgcggagctcgcacacccgcggcgccccgaggagcgccgacatgcacgcgcggcgcgcggcgcgccagtacgcgccgtcgggcgcgaaggagatgttcttctggccgtaggagagcctggtggccgcgtacagcgccgggcgccccgacagcgcgcggtcgttgtcccggaacagcgcccgcgccgcgtcggcggtggagacgacgagcgtcggcacggagccgaggcggagcagcatgagcggcgccgcatgcctggcggcgagcgcggcgagggagcggtgcgggagcgcgccgacctggtggaggttgccgatgagagggaggcccttcgggcgtggcagcgacggtgaggcggcgcgcttcttggacgacggcgcgagaagctgcttgaagaggagaatggtggcgaggaggaggaggcatgacgcaaggaactcaggagcttggagagacgccatggacattgctgtcttggttgttctctagcttgtctctagggcggctgagtttatctatctatatatatgtcatgtcaggaggagatatcttagggcatcaacaatgtatccttaccaagtagtaagtaagtaaggttggaccaaccaaaagcagcaagcaggtaattgttattcaaggtgggtcccacatgtatataaatataaatataaagacgtagtgacgacgacgacgccgtcaccagcagcagtcgccgctgcccacggccgtgctggcccgcgtcccccttgaggaagggaccgacttctccgctgccgtcgcacgcaagggct

SEQ ID NO: 74055 - DNA, 30802 bp, Oryza sativa
tacagataattatgaaatatattctttaaaaatgacattggtaccatgtgtattttactccataactttccagttaaaactcaatctacagtcaagaaaaaaaattgtatgtgcagaccaggggcttgtttagagtgctctcataaaataaatgctttccgtttcacttaaaaaagagagcggagcatgttatagtattctcataaaatgaactatagagatcctactctataacttcacgcaaaacctagctagctttttagttaaatttaggggttggagtaataacaaacattgcccaagtttggatttcaatatttgtgaagcaactttcgtgttactaattttatacagcgatatatgtcatagcgatatgcatttgaaaatgatttgtctagacacgttttttccccctccgttctttacaagtgggaatagttacttcagagcatgttcttaaaaaacaaaaattaaaaattaagagcatgtataatagtagggatgatcgatactttgactttgttcatgtcatctatttattaactaaaatcacggcatggtcataatggtcataagtaggttaaaactcttataatcgcctagacaccttagcttagctcacgttccctattggtgtgtgaataattcaaaacttgatgaactttgctttaaaatgataggaagagccaacatcaaaggataaaaaaagcaacgtacctatcaacattgtggtaacttttttgacatcttcaaatatatgtccgtatatccgatatgacacaccaaaactttacacccttggatctaaacacaaccttaacttcaattcttcacgatgaacgttgtggtatcttttctgacacaacttcaaactctaaaggtaaaggattgattatgccacttttcacggtttgtatttgtactggaaatcaaaacaagcttttacctttttgtttcacacgacatatttgtgctcgttgaaaacatattaggacacttgcgttacctctcctggtgcaaataagtgaataacatacggaagaatgaggaaacgtagcggaataggtgtggtggactctaaaatgttcgtggaccctacatctcttggcccacatgtaagagaaacaggttctccttgatcaaatctagattatggtggttctcgacattctgtaacagaagtagacccggtccaacagcattggtaaaatttagaaagaacagagaaactcccggtacaaattcaagaaaagcttatcaagttaaagatacctcaactcacgcattctaaccgaagcaagtacataaatctcgtcagaaatcaatcgcttcatctgcgcgaactacttttggactgtagctttcttgcttaagaggccttctaagttgaggttattgatcttcgcagcaaggatgaaatcattgtcagttaagcctcctgcaaccatagcagtggaatcacatcattataaactagagtgatggactgatggtgatttctgttctgttactgtgcttatgttgcttcagtacggcttcctaaatcctaacccaattctcaacaaccaaatactgtgattatgtgccttcagctacagttgctatgtctggtccctatttcttgacttatctccttttaagcatacaaatattttacatggaaaaggcaaatcaccaacagactaaacatccaaggctccaagcatgtaaccttttttccataatccatagaaattcggttaggtttcaactaatagagggcaagaatttctcaaataaacatctgaattttgatattgtccaaataaagagcataaattatgccattatggccatcttgtttttcttgcaaagtgaaaacttagtcaagtcaatcagagttcctaaaatagtgtattgactaatagccatcattcattaaggtttaggaaagagccattttgacctttcagtcctagagattgaaaaggttaaacaaagttaaacaggaacaacagtgatccctttatttcattcagcagcattggcttcaacattcactgctaaatgtaatgagtcaagtgttttcaggtttggaaggaactttgactaaagaacaaaccaaaatactgagagatatgaggtttgattcttttaaatgatcacatcaaaacaaattggcaaaacgaatgatatgcaaatcacttactgacagagtgagtccaaacatcaattttcacattgttccaaccgacaagatgaagatcagggtggtggcctgcgaaaggacatcaaacatacttcactggcactgttatttaaaacaaaaatgagatccaaaaaatgtgaacagtttagaagtgtttttcatgcaacatgtaaataaactcccagcatactaaatataattgtagcatgctatgacaacaaatgtaatgcataggtagaaaaatgtgagaaaactaataatttgattctgatcaccatgactacactatatcaaatgtaatgcaatctttctattcttcatcaatagccataacaattataagatattttcccaagttcaacaggagctagcttactagctctcctctctatcttatctcatccagacaataagcgtagaattacatgcagccacgaagtactgcatatgaaatagtactagcttgcagtagctccacttggaacacttgctctgcatcatattgtttaacctttttatggtacgtttggtgtctcaaaagaggtatgtaaaactgtgaacctccaaatcaactagtactgtaagagaagttagctaatcattgctgacttaatttaactaaggaaacatgtggtggaaatagaccatatagattatgccagtatgtataaaaagaaacaaaagaacaggaaaccttcttcctcagcaacagcagcaacaagctgaaggaattcaagcccttttacaaaattcttcaccttccatgctctgtgcaatttcagaatgtcaccttcggttgctaattcccaaccacccacctgttttcaagagtcagttgatgaagtgccaataaccttaatcagactcttgactacaaaatcatacaagaataaaacctgttctagcatcttcttagcagaatcttctggcatggcatgtatatccttagaattgcatggaacacaaatcttctttgccagctctgaaataataggagaagcagatctgtgagattatacagtaaatgacagtatggattaacaaggcaagagaaagtcaagaacagaagaatggggatcgatattgctactggagaaccacaatatggtgatgggagtatcacagctcctgtactgcatgctatcaagacatcactattccctcaaataagatgataagaatagtattctgaatatcattcaaaaagctagaggagcaaaccaggggttcctgaatcctgactagtgactacatggttaagatatcctttatttggttattcctagttctttttatccttcttacttaggtggattgctttctttctacctgttgctgtccatttcttttacattataaaaaaaatcaaataagaacaacatgttcatatatttgaatacccagctaaaattttaaaagattggctcatgccattgcacccgtagcaaagttttgcaaaatatcaacagaaaggtcgaatgtaaagtattactgcaaacgcataaattctggagaatagaatcgacatcacgttttccattcaccaaatctgccggtgtccgtttaaatgagagaagttttttcctcctggccttctttcaccccaactacgggtatgggcagacgattcatacgattgcagcaagatggtgttgacagagcacccacggccacggcatcaagcaagacattagagcgccgccgatgacaactcaagcaggaggggaggagaaggacaccatggacacatggccgcggtctggtgcgcgacgacgacccgtacgcatggtgcgacgggaagagattagaggacgggggggaggggggggggaacaattaaaggcggtcgaaagatgacctggatcgccgatcgcagccgtagacgacgacatcccgacgacggcgcggctcagacgatctttctctgcctggtgcggtgccaccgctcgagggctcgggctcgactcctccgccgcggcgcaactcacagcgccgttgtccgccggttccgcctacctcgtcaagctcctcggctgcgtgatgccagagacaggaatgggcgaatggctagtgtagattgtagaagagtttgtgctttgtagatggaatgagtgaatgacaggtagtacagagtttaacaagaaaaggcaaagaagaagaacagagtgagaatgaaatgtaacggatacgcaatcttccaaaaatgccctacttttgtgataatagtatgtttccatttatgcacgttagctgcattactactccatgcctcaaacatgtaatagtttccatttaaaaaacaaccagttgagatgaaactctaggtgtgaattgtacgtgggtgcactaatacatggacagatgaaccggatgagttcaaatgaatatcctcaaacatttctaagaaactttcaggaggctggtgtcttacaagactaccttgattgtcaggagaaccatggcaccatcttctacttgacattttaatctcgtcttgacttgcatacatcggatgatgagaactgcatcatagacaatggtatttctccactcagttatccatgagaccatcagctaaagctcactatagcataaaggccataagcccatacaagacgtcatacgatctcatttatcaacggaacttgtatcgaacccagaatttgagtgttttttggtcattagccatgatttaaatggagttctacactgtgtcctctatgactgttcccaacaggaaacttgcccggacaaaaggtttgcaagttccaattataaaaatgaacaaaggaatcgtcttcctattaaatgcatatgcttgcatatacttgtaccaaaatgccacgaaaatttatcagaagcttcctttcagaaaaaaaaaaactgtttccaaaagcatatcaaccatgttgtaatgcttccaaaccaaaattaaaagtgcatgaccgctacagcaacaatagaattcgccgtacacctaacaggctagagaactcttatttttcatgttaaacaacagtacttgatccttacttccgtgcatctttcaagttttttatggtgttctcatatacatccttattggtagtatatattaggcaaagatgtgcagaaatactctgattctgaaactacaacactaagtgatctgaaacatatgctaaaatcgaaccacatagcatattaatctgtcatgcaacagataattagtgatcatctgtgcccaaaggatctgcaattaacgatataattacagattaacatgcataaccacctctcccacccctttcaaaaacaacagcacgtacaacaatccagaccccgacaaacccacccacggtataaaatttcgagcacgattcaagaaagaggttactcgtaccgtccatggcccagcagcggaaggttcttggatacggtaggccaactgggggccgccatcgcctgcacaggcaacagaaaagaggcgggttagtggcgcacgggaggtgttcgacggtatgcttacacggcgttggtggggggctgggcggtgagttcttcgtccccgcgtttggcatacgtagtagcgcgccaggaggagcctcgcgtgcgccatagcgacgccgcgggtcatcggcgacggtgggacggcggcggcgctcgccgtgggcttgcgacgcggttgggggaagaagagcggaggcggcgggaaggcggcgtgtgggtttgcctggcgtgtggtagcgcgtgtacccgctgtttacaaatagtactactagtagccttcgaggcttcgacgggtcactgacaggtggtcccaaaattgtcctgaagttattttctctaacagattatttttgacaacttctacacgctcgtgtatttgcattttgatatttttgactcagcttattagctacttcatctgtcttatattgtaagatattttaatttttttctaagtcaaaattttttaagtttgatcaaatttatagaaaagtatagtaatattttttaacacaagacaaacattctatgaaaatatattcaatgttggatttaataaaattaattagttttttaagtattgctatatattttttataaatttgatcaaatataaagaagtttgacttataaaaaaataaaaaaagttaaagcgtcctataatataaaacgaaagaagtagcttatataaaaaaggaaaaaatccaaatgctcccctaaactgtagagtctgtctagcaccttaaactttaaaatcggacatccagccccctaaactttgtaaaaccgttcatattaccctctaaggtggttttgtatggtggtttttatctaatttgtatataaatttaatgagtttgatcacgtgacatacacattgaacatatatattaaaatctttagttaaatttttatttgtactactttttagctctcacttacggacaactatcgacataataatagtatggtatcattgtataaatataaattgatgatttacaactgtttatatgcaaatatgttatataagttatttaatgttgttcgtttaagcatccaaaatatgcaaaaccaccttaggaggtaatatgaacaattttccaaagttcagggggttaaatgtttggttttaaagttcaaggtgctagatggacttttatccaaagtttacggggggtatttagactttttcctataaaaaatcgatacgcttggtcatcgcccattattacccttggtgatacacaggctaaaatgggagtgacacttaatcgtttcatgttgatatgataatattttagaactatttacttcctccgtttcatattataagactttctagcattgcccatattcatatatatgctaataaatctagacatatatgtgtgcctagaatcattaacatctatatgaatgtgggcaatgctagaaagtcttataacctgaagtggaggtagtatttatttattcaatcaggttggcttttaatatgtatctatcaaaatatcgtgctagtaatgtgaatatagccaacgaactttcaactctggaataaaaaaatagcattattcactttggcttttatatgtaaggaagtttaccgcccatcaaatctactcttgactccttgtttgtttatatttaggtcccttattggctcaaactttgtgggggtttgacacttttaagttgaatacataaatcaattcaacccaaaaatttaaaccaataaaaaaagcagggcaattcgcttacacttacattaaggcacgtgttcttaccccatgtttcccaactcattcccatcgttttctgtgtgcacatttttcaaactgctaaacaatgtgttttttacaaaaaaaaaaagtttctatacgaaagttgcttaaaaaatcttattgatctattttttaaaaaataattatctaatacttaattaatcacgtgctaatggactgttccgttttccgtgcgcgctgttctggttgggaacaggctcgtgcgaacacatcctaagtttctaatgaacattacccgcatactcaattttcctgctcaatatccacatcaatttaatgctttgtctacgctctaagctaatactacctccgtcctaaaatgtagctacctagtatagaatgtgatattacctagtactacgaatcgagacagcctagtacattccaaattagtagtaataggtaatgtcacatcctgtactaggtagctatattttgggacggaggaagtagtgattataacacaaagctattgaaacatttgataggagaaatgcctaccagagttgaaagtaacacatgaacaagtactaaccaactagccttgcgagttgtagttcttagcttgcctagaactttgtgtgatcatagcaacacgccaacaaccattcctgactctgagctcacatggtaggcaacatatcctatgcacacaagccctcacgtgtacacacgtgcacaccaactaaaaaatgtcaccaaaaaatctagaaaaaatcatacatatactttcaattgtattacacctagggttaaaatcttaacgtcaaattcattatattttagccgtaacaaaaaaaaacaaaaaatctaacagttttaaggttacaattttgtcataattttatcttttttgttattctctatgtagaatgaatttgaagatgcgattttgcacgtagatgtaatactattgaaagtacatgtataaatttttctagaattttttgtgataatttttagttggtgtacacggtgtgtacacgtgagggcctgtgtgcataggatacgctccccacatggtaatgtcacactattttccttgtggaaacaccaagcgacgaagatgaccacaaggcgtgaccatttttttctaaaaagaagcctgaaaatgtggatgtagctcactgcattttttcttcgtttcgtcttgatattccgattagatcaggatttcacgtaatcacagttattttcttcgcaacaacaagaatgatgatggcatgacgaaaatgctagcggagttttgtaccttttctaccatgaattgagcatttctccaccccatttttatgtcatgccttgcgacctgtaggaaccgtatggcacacacgagcaaaagacttttaaaaaatccatctactccttttgtcattattgtcctctaatttcgttttgcactcgctttccaccgctacgctaccgcaaaagtaaaccaagccaaactgatcaagcccaggcatgcaatccggcgtgacatttttccaggtgcattctcgcgtgagcttagcaaagaaatatctcgtggcacctgtcacccctccgctgccgatccgacggctcgtacgacgccgttggtaggatcggacggcaaggggtggctccagagtccgctgcttccgctataaattggccccaagtgggggctccacgctacagagcagcagtctcgtctggagaagtggactagtggagtgtcgtgagttcttcgcttttgcttggctaaaatcgccgttagaaacttgtggaatcgagcaggtttaagaatttttctagtatccactctagatttgctttgttgtatgcttgaatcaaatttttttcgcttgatgatcaatttgagccaaaaacatgccgtttttctggtgattttttttctagcaactgctttgaaatttgtttcctgtttttttttctcaccaaagcaaatttgtaccaaatctcaccgaaattggcgatttagttgggcagttgatgccattgtttgtcgtcgaactatgcaatcccgatcgatttcgtgttcgtcgtctcgcctcctcgtgatccttctctccaccatgtgcagctcgccgcgcagccatgggtacgcgacgcgtagggctcctcctcctcctcctcctcgccgccgtactgctccagcccctcctcgcggcggcggcggcggagggcgtggtccgcatcgcgctgaagaagcggcaggtcgacgagaccggccgcgtcgggggccacctcgccggggaggatgcccagcggctcctcgcgcggcgccacggcttcctcaccaacgacgccgccagggccgcctcgaggaaggcgagggctgaggccgagggcgacatcgtggcgctgaagaactacctcaacgcgcagtactacggcgagatcgccatcggcacgccgccgcagatgttcaccgtcatcttcgacaccgggagctccaacctctgggtgccttcctccaagtgccacctctcggtgcgcgccgttctctttggttgccgcggttcaggggttttgttagtggtttggtagtgtttgtggtgctaattggagtgtccctttctgatgtttgctgcagattgcttgctacttccactcgaggtacaaggctggtcagtcgagcacgtataagaagaatggtttgtgctttctaccaatatcttctcagacttataatgttgtgttgcagtgtgatttagtagcaatcagtgttatctctccagttatattgataatctgatcgatcaatactctgttggtggcttggtgcctttcgcctgttcttatatagtagttctgttggctccaagtgagtaactgaattggcatgactaatttaaaatttcaggttgataaagtgcattaacatgaaaacttatttgaagcatatatcaaactagatgttttctgcaatttattaaattacgctgtttcttgtgcaattaatactctctccaaccacaaataggtagcaatttttgcatcaacatgtttgatcttactgctcatatacagtagaaaaaatatcaaatcactagtcagatttatgtgtttatgcccaaatggtacttagtgttggttggatgtttattaaatatgataaaagtatgatactgtgaaattatttttcaagataagtttatgcaacccatttttgtatgttggtatgtccaatataatgaatagagatatcgatagctgaagttatagtggttaattacacatgtcccaaaaacatcatatatttttatttaacttatttttttggagaacatgcaaaagggttgcatgtccttccattagatagagagagttccccaaagcgtgtttggttacagacctggctatataaaccctgggttacagatcataggtttatatcttgcgaaaaggttctaaacttcgatggcccttcatatcaccacggtttcggctcttgtatttttaacaagagggagtaatactgtaataagtttctgcagctatgtaattgtgattagttgataatttttggtttgatggatttatagtcatcttagattgtgacgttgacaccatcctgatatttattctgtggactctacagttacccgatctattctcagataggccattatttgtaccatgatgtcaattctgtgaatccaaaaaccaaaactggagaaattatgtagtgtgaaattgccactatgatacttccagctttttttccactatgttctagcaaaaacaagaacccataacctgtatttacatctttggcaagcaatcaactgagtagcaacatagacgtcatgattataagatgttattcattatgtgcgttaaatctgtatctgttctgatgtgtccttggatttaaactgcaacagggtgttaagttcatgaatataatttatcagttctccttggcaggaaaacctgcttcaattcattatggaacgggtgcaatttctggctattttagtcaggacagtgtgaaagttggtgatgtagctgtgaaaaatcaggtttatcatcagctgtaacttgctttcatcttatattcttatgtgcatccaattcgagaatatcctgattttattgggtaacactgctaggattttattgaagctacgcgggagccaagtattacattcatggttgcaaagttcgatggcattcttgggcttggatttaaggaaatctcggtaggaaatgcagtgcctatctggtgagcaagtcttgctagcatcttgaaaaaaataaatccattgcactcgtatggtaatagtagcatcaacaataaaaatgaacattttactctgtgtgtgacatgtataccttcattctgaacaattttttggaaggaaagagaaaactgagttttaagtgggaaccggcaaaccaacacctatacagatcaactatgttagactgacagactatcttactgtattatattgcaaaatgaagaccattttgtaccgggctacctgcatatttctctcatccttcgaatgtgaagcagatttcctgtcactgacattgcaaagcaaactcataggtacaacatggtgagacaaggtcttgttgttgatcctgttttctcattctggttcaaccggcatgctgatgaagggcagggaggcgaaattgtgtttggagggattgatcctaatcactacaagggaaatcatacatatgtccctgtcactaggaagggatactggcaggttgatctcattttgaagttggttgggtatgttttaaatttcaatattgatagcaatggtctgtgctgataaaattatcatttactttctgaagttcaatatgggcgatgtcctaattggagggaattccacaggtgctcaattatcaattttttttcatgctcactatacctttatttaaatgcaaaatggtctaatctttttctttttgaaaggaacatagtctaaatcattttggttgttccctatgtgtcattaggattctgtgcagctgggtgtgcagcaatagcagattctggaacttcactgcttactggtcccacggtatggtgtgaactcttctttttttataaaaaaaatgtccataagcaaggaaaagtggtctggattgcatctgatactggggttcctaacattggtttattgcctgaatctggatttcaatcgtgtgtgaaattcacatctgtaaatatttcttaacaatcatttaaaccactgtgcttttaacttaagttctacggcttctaccattagcacaaaatgttgcattttttgagtacaccgagtcattgaacatttttatagttctgtcagaaaagtttcgtttagattaaacatagagcatagatgcatgattttataattttgcaggtttccttttgatcaattaaggtaatcctacaattaaatgacaagcaccaaaccaactgaatggtattctacccttaaatggcacaaacaaatattccttgggccttgcttggcagggcccaaatcccagctcattcccagggacggtcaggaaagtcttaaagaatcactaacttcccaaaaggctgtataatttgttcccaatgtgtacattgcctattgaattagatagataaccatttaaagaacatcgcgtgtattatctagtgtcagaactttcttctgtggtgggtacattccttcttttaaaattagactttgtcttgatgaatcaatttggaactatgcaggccataattactcagataaatgaaaagattggtgctactggggtagtcagtcaagagtgcaaggcagttgtttctcaatatggtcaacagatcctagatcagctgcgagcagaggtttgcagttttctacattccaaaagcatgacgacatgaagttctcaaattcgtcactggtaactgaactttctctgggtttgtgatgcagacaaaaccagcgaaagtatgctcttcggtcggtttatgtacttttgatggtactcatggtgttaggtaagatttgtggatttgctgttttttagatattgggaactgtccagcctctacagttgtgggtttactgtggatggataattgaatgcgtagcattttactttgcaaattcctaatggtgtttacttgaatgcgagtgctgctattgtttgtgcttactaaatgtactagattattataagggatgaattgcattaaagtactgttgatttcattattcttgataactggagttgttacttatgatgactagttgtgctatgtaatggcagtgctggtattcggagtgtggtgcatgatgaagttggaaaatcaagtggtccctttagcagtgcgatgtgcaatgcttgtgagacagctgttgtatggatgcatacccaacttgcacaaaatcaaactcaggatctcgtattgcagtacattgatcaggtttgtttcctagcttgtaagagcaacgctgcagtgcattattatacaaactgtgtgtaacttttccaaccttcacagctatgtgaccgtcttcctagtcctatgggagaatcatctgttgactgcagcagccttgcatccatgcctgacattgccttcacaatcggtggcaacaagtttgttctcaaaccagaacaagtacgtttcttctctatgactcttatgctgtcttttcttgggaattgcatccatattagctcttaagctcaggaattgttgtttgcatattttaagattgagatgtttttgcttaggaactttaactcaagatgtgatttctccattatcatcttgagttaaagtgatgcagccatatattagggaagagccccgtaggatgtattcccccaaaaaaagaaccccgtaggatgtttatttttctattttagaatatactccctccatccaaaagtctcatacatatttcttttgtcatcgagaccaaggagaaattaactcctccaatctatactctgcatgcaagtaatggggttggagaatggttgcttgggctccgagatatatgtttgatccagtgatgctaaacaaagagtcactctgttcattcaagccttagatgcatggagactacaaatacaaagcatctcatttggaaaaacaaaaaatgaaatacataagagacatttggatggagggagtagtccaatactccaatacaatgcttattggcactccttttttctttttttcaaattgttgcatgacaatcaaaatttaaaataacaacgttgaaaaaaattacagctagatataagaaatgagaaaatcagcacgccagaaatggtggcaaaaatgcttgtggaacttcctatagcttgagccttgaggaagaggtagataatattgtgtgtaaatggttctcatgcattcaaaattcatatattctgttttatcttccctattcagtacatcctgaaggttggtgagggaactgctacccagtgcatcagtggattcacagctatggacattcctcctcctcgtggtcctctctggtaaattatccacctctcagagcgtttttgcatttttcaccatcaatgaccctttttgtgtagcatgtactgctcaaacagaacaattgcataagtaatcgtctgtcctgcttgtgtcttagatacttgtcatccaacaaaagaagtgtattcaacattttcagagttcagactgtatgttgaaatgctcgagttttcttcttttatgatactactacttaacaatcttcgttgtgcttcacattacttaaaacaaatccccatagactgatagacatgttgcccttcactgaccacgggagcttgctgttgcaggatcttgggagatgtctttatgggagcctaccataccgggtttgactatggcaacctgaaggttggcttcgcagaggcggcataatgccccccatggtgatcggacgagtcggagagcccttagcttttcagctcgggtttatctcccgcaagcgtgtaggtatatattttagtgcatgctcaataaatattgctactgtgatctcaaaacctgtctgttttaatttggctaagctaaatataagtaggcagaattcagacgacagtttatcacaggaaatactccatgagttagcaataacaaaacaaactgataacgaggaaaacctatcagtaatcggtttaaaaaaaaaaactaacagtaagaaacaattgattatgagatagtaactgctacaagtactagataaaaaatccttatgactgacagcaaaacatcattcatataggagtattatactagtgtgaagtacgtaagtaatttgtaatcactggctggcttcttccatagccaggtaccataaaacttcaccacagagtggctacttcgtggtccacataattaagaacacctaaaaacacacgtcctcccaaggcaccaagaaggatgacaaatactaatccttctctcccggatgaatcttaaatcatctcgaggagccatcaactcacactcacgtacctcccacacatgaagtaaaacacacaaatcaaaccaagcctttctttcttttactaccactttctgggcctaatcagcggtcaatctctatttcccgccgttgtgtcggcccttccccctcgccggctgggcctgcctggcccgcgcgaacgccttgctgaggaagcgcagccgccggctgttcgtggtgatgacgcccgtggtggacggcgtctcaccgaagacgacctcgtagccgtcgcggtacgagtccatgccgggcaccaggagctgccagaagaggccccccaccgtggcgccgcccctccgcgccgactcgtagatcttggcgtacaccgtgccgtagagcgcgtcccgctgcccgctgctgtagcccgggtccttccacgacttgccgaactctgcgatcagcagcggcttcctcagcaccgcctgcgcgtccgcgatgtgcgcgtccagccacctccccatgaaccccagctgcgcctggtcgtccttgcccgacaacctgcacgcgccacacatgcatttgtcggtttcatcacttagcatttagacagccatggccgtcgttgatcgatcgatccatcgaccggtgacgacgacgacgaagaggtcagtcatataccattggtcggggtaggagtggacggtggcgaagtcgatgccggggacctggttgttggcgatgaagtcggtgccgagctggtagccggaggggttgacggcggcgatgcgggacggcgaggaggcgccgtagaagccctcgaggccgacctccagcatgtggttgcggtcgatggacttgacgtgcgccgccatctcggtgatccacgactggacggtgcggccggacaggtcggactggcacctcggctcgttcatcagctcccacgccaggatggtcgggtcgtccctgtacgccacccccgtgatcgtgttcttcctcgtcaacaccgtcttcgcccatcatcatcagacaaaagcaaagttgatcgtcagaagcgtgccgtgagaatcaacagaatttctagagaattgtggcatctatatttcctgactgataaagtaacgtgatcatggagtgggcgcgacactattgagcactaataagggcattcccaacccaataactaggatggtgtccatagtattaaataagttgccacttagaaaaaaaaatgatgtgacaagtgaataaataaggaaagagaaggaaaccatattttgcatgagacatggtttctacacaacatccaaaacatcatgtgagataagtagtattaaattgaagtatgaaatagtggtgtttgtattggaaaagtggtgtctagtactagtttcttgatgatgttaagtttatagaaactatgtctagtgttatgggttgttatgggttggactgcactaaagcacttatccgatggggccctgtggtgtttgaccaactgtctgatgcagcagagcaacgatattgcagaggcatccgacagtgcaaagagaagaaaaaggtagtgctgccatgcgcaacgttctgatgacagagtcctgcctgttcttgaagaatttaccaccactagtgtgctttttggaaagttcagaccagtccaccgacagtcacagtattaaatcaacagtagtatctccgcctcaccgtcctatttcttagatttaaatttatcctaacatagttatcataatgaattactctctccgtttaaggttatactttagttaaagtcaaattgttttaagtttgaccaaatttataaaaaatagtaatattttttacccaagataaatttatttaaaaatatatttaattattaatttagtaaaactaatttagtaatgtaaatattactatacttgtctataaacttagttaaactcgaagcagtttgactttaaccaaagacaaaatatcttataatttgaaacggatggagtactaattatcttattgtcacttctgatttaaatttctctttattctaccctgaatcagcgtactgctcttatctatacaccatttaacgagagataccttatttagtaaatcttagtatactccatgttaaataacttggaatcataattattttgggattgaggtaatacttgacacatacacaaaagaaaattcaatactaatacacaaaagaaaagacggaggaagtaccactagtccactacaagccacagttgccgctctggagtgtgcataggaatgcgtcttcccaataaatttgcggcaagatactgtactagtagcggcgcatcacgctgcatttcaacgaacgctctatccgtgtttgccttaaattggtcattctacctttgctattctcagggacgaatatttcaccgcagcatttgcgggtatatcaaaacaatgagataaacgttcttcttggtgaaactaacctcgatagctttttcttcttaactatagtctatagatcataaaatggaaacaacacaaaaatgaaacaaaggaaccatcttttgaaatacgaaggaaacaaagaaccccatatatcctagaaagtagaaatagctatggtttacttcacgtactaaacggtagatattttctcggaatttattgccgctgttaccttcacgtggttcttgtagaagcccttaacaacagggttggtgaagaactcatcgtcggacccaatgccctgcccctgcgctcttgcccagttcacatactgcttcctcccgccaaaagagtcgtagttgtccacaaggctcagtatcaccttgatcccatacttcctagcctcagacagcacaaaatccaaaccctgcacagagaacaccaaggaaacggaaaattaacacgcgaaaaccacacatctcaaaccaaaaaccatcacccccaataaacaaaaccatcaccatcacatgaacacatgctctgttttcacagagagagagagggggtgggaggtagagatgcaatggaggcggccaagtagacttttttttctcacttatccatacttttagcttattttttcttctaaattttgtactaacatgcgaaaaataaactagcaagcggtttttacacgagtagcgggactacccacttgagagggacaatgtggctaagggaccgaccttgaaggtgttctcgttgtagttgccgggggacaactgcagcgcgttgccgccgccgccgtcgctgaacgcccacgtcctggcgacggtgaggccgtgcccggcggcctcgccgagcgcggcgctgaccttgcccctctgcgacgggtcggcggccagcaacatgagccagtaggcgttgaacccgttggcgtagtacgggttgccgtcgagcacgaaccgtgtcccctgcgccctcacgaagccgccccctcctcccaaggcctccgcctctcctaggccatggatgacgacgacgacgacgcacgcgagcaccagcagagcagcacgatgagctccgagaagcctcatcccttgctctctctctctctctctctctctctgcgtgtgcgtactgtgtctgcagggtggctctcttctttgctttggatggcaatggcgatgaggtgaagcgagatgaaagaatggaacttgcaaggaggtgaaggctgcgataaatagctgcaactcatggggcgccatgtcgttctcctagcttcaattctgcgcggcaatgcaaatagaagctgagtatcactgtggggtcagctaggctcacttgtcagtgggtcactagtgccagcttcgtgcacatagcaaccaccggatgtgaagggcatgtccttcaggctatagtttcataaaaaaaagaacagtttaaagtactttcataaactgaattagagagatagcgagtttcaaaacttcagactactccataattttattccataataaacttttaaagctaaatttaaatgttaaagcgttgttaaacaaacccgcacaatactgtactactccatggctagaacttagctttagctcagcgggtggtggaggagaggggtggcattaactttgtcggtaccagcgcgccatggaaggaagcaaaaggttcctttaatatttgagcatcccacatggggtggaagtgttggactgggactgggaccgatggtgatcagtgtacggtttctttggtagggtttaccaaatctatctcgagcccaatcagctagtaaatggagggcacgtttgtggtttcggttagaactgtgactctgtgagtactgttctagcgagtccaatgcaatgcagtatcctctgggtccttgttgtacgtagattattaattgattggtccacggtgtactgtttgttgccatctgttttcgttgcatgtaataattaaccgatttttgctatatatttacagatgaatttttgtactaaaaatttatcaaatataaatacaatatgattgtgatgcaattatattgtatcttgcatgtaactataaggtcaaccacaatgtgtgctaaaagtaaccttaagcaataaataactctacagtatatcaccttaagtattgtgaaagtggaccataagaatctgacatcaaaaatgagcattagccttatggtgtggcaacaagactatagaatacaatacttttgtgatgtactgttcacgctagtacttttgggaaattttcattgtgcaaagagtttcacaggaggataagaagtgatttttttatccttcggtgggacccattgggacccagcttattttctcccataggcacaaccattgtggatatgaacatagctaatgcttacttatagcgggtcccatatatatggttgatggaaccataagcattggccttgccctaataaatttgcatattactttcatataattttaaaccgttagatttattttaagattcacacatgtgggaaagaaaaaaaaaccacagcacacacgggtaagatgatttggtcctctacgaccttcactttgcggaaatagcatactatcgaatgattcttaaaagttttatataagttatactatacttatatgctggttacaatgtgattatactatatttatatctaatttaaagaaaattcataatatttttttagaagaaaattcataataatattttagaagaaaatacatcgataaatatatagcttgttcttaattaattttcatttggtttgagaatggctgattacatatgcacaggttttacattggtacaagttcagctatggattgcattggggtaggcttatgacctacgtacagctgatccatgccagtactggtaggtataccaactatgtcgagcggccggttaattagtcaatgcctacccaatcgcgtggttcagtttgccaataaactgatttgtcaaactcttccaagacttccactggttataacttactccagtaaagtatataaaacaaaagagatggaattttcgcctgtgatgcgacgatatgcgccccctctaatgatctactccttccccatgtagtaaacgcattattggctttgcttctccgtaagcttccattcatgtgaagggggtagtttgttgttgttccttgcctctcagggaagcatgtggattcccttgtctaaaacccgttgctgccaatgctcttaactgtagagcactggtagctaggggtggacaggtggcgtgtacttgcagacaaagcagagcgagtgaatccgagtatcccaccgggccggccggggcaccggccagccaccgtgcgcgcgcgcatgtggaggcacatggggcggggactgggactatacacgggaatccgcaagggggacgggcaaatgcaccggtggatcggatcgacgtgccggcctacctcgcacggtaccctaaccgtacgtgcgggtcgcggtcggcgaggcgaccgatcgctctcaccggcgtattattcatttccccgtgggccgtgccgcaccccccccccccccccccgcgcgacgtgcgccgctctacgcacgacgtaataatgcgcgctcaagctcacgtaggcgcgcgagcattaggctcacgactcacgagtagggtacatatgggtggtacggtgataattcacgactcagaatactatcttcttctctctttttttttttccaatcaaacgcctgctgaccgatcgagtgcggaattgcagataaacgggaatctccattgtcaagtatacgttgtcttcgacaccgacaaagtccggccgtttccggtcaccctcatcacagcctaacccatttgttttttttttttcgctaatccattgttagtggacgaaaacgacagacgagacgttaccgaggtaagttacgcccgtttggggccgggcaaggaggcacctacccacatggcgcgcccctgtacgcacccccaaattagtcctagtggagtacgtgcttgcgcgccgagtctgagcggtgggcggccgtgcagtgtgatcgatcgatcgatccgcgcccctcccctccaccgacacgccctcatctctctcacctccgcggtcagagtcccgtcttatcgcgggcgcgtgggcagcaagcaagcaagcaagcaagccatttgccgccggtacctcgctttcttctttttcacgtcgttcccttcccttttgcgcggcgcacgctgtcgcgcgcctgtttgcatctcgtcggcaccggctgatcactatcagagtcccctgttactggcattaattgatcacacactgatcagacgacgcccgtaacaaaggatggggaaaattaagaatccggtgatctgctctgcagtgatcggaccatgggcagaatgtaaaactttattaggccccagccagatcatggtgtcaaacctgatcattttagtagagtagcagtgcacctgattgcacggaacaagttcacttggcgcaagaaagcgcgtctccggcaccatctacggggttgactgcttttggggagcaaatcacgcctaccatcattatgtgcctactgtaggatttaaaatgcgcacaaagtagtccgcagtacagttctttctttgaagagaaaatccattgtatactctaaaattttagctaattctttctatacttataaattttacttactttcttgtataccttaaatttcgattttgatcactttcatacctctcccgtcagttgaccgttagctgaccgtctaatttatataaaaatgatcattctaccctttggatgaatatagaaatttttgaattacattattaaaaatataaaagcttctcgcatgagactattatagttatgagtttgttgtgcgatgcattatttatcttaaaaaataggtaataaaataaaaaatcatgtatttagtttttttttaaaaaagtcataaaaatgaggagcattcatacaaagataggactacaaattttcacaataatttttatgaatgctcccgataaaaaaaatccattgtcctattaaaatatcaaataaaaattttaattatttcatttgttttatttccaaaatttatgtcaaaatttcctacactagttttttttttagaattacacagtacaacgttgacactcacaatgcacgcgcacgcaaaccctacccctatgagcatcttcgaagactgggtcggcaaattctggagagattgacgaagtcaccacaggcgcctcgctgtcgacgggtacgtcgcctacgactgaaagcacaacgccgttaaatcctgaaaaattcgctcccatggggagtcgaacctaagacctcagtagcaggctacatgccctttcgctcctacactagttatttagtctcattcaaaattttcaatcgtctttgaatcgttttttcaatctgtgcacgcaaacaaaaatttcaatcgttttttaagcttatattcaaacctaaagcatcaagtgcaaaaaaaaaaaagacatttgcaaccaaatgtaatagtgaaatgatgaaaaatataacggtagggacatggaagtgatcaaattgaaattttagggggtataaaagggatcaggtaaatttcagggttacgaaagggattgagtaagttttcagggtacacaggaaatttactcttctttaaaaggcgcagatcactataaaacatcaaatgccaatattcaccctaaatgcaaaatcaccactggaagaaaacacaggaaaaataacagacgactgtttccgaacgccaagctgaagaatcaagcgcctgaaaaatgacagacggtagtaattgccatcgcccaaccggagtgcccaagcgcctgaaggaaaaatacgagccgacgttgcacggccgaaagcccgaaccagaattccatccagcccagaaacaggccgcctcgcaggccgcattcgctgatctggctgggaggacaagtttctcttttttttctctttgctaattggacccatatgccactgcaaatttgttggttcgaaaaaaataccacattcatgatattaggtatataccactgaaactttataaaatttaaactatgccactccgtcaccatttctgttagtacctctaccatctttaacaggaaacgagcaccgggcgataccgctgccaagcacaagatggcgacaacgaggaggtcgttggcgagggccaggtggtctaagggtccggcaacgatgaggcgcagctggtggtggcggtgacgagcacattattgggcgccacgagcaggcatcggtgaggtcgaggacggtgacacggtgagctcggagatagcgcttcccggctgccgcgagcgtcaagatcaagcgcatgtcgtcggggccggtggagaagctgatgccgccgccgagcacgactccctcctgtagctccatcctctgtgtcatctccttctccctcccttcccttttcttttcttggctgcgcgggcgtcaggatccagtgccggtcatcggcgctggcgccgacgtcgagcacgactccttcccgcagctccaccctccacgtcacctcctccttcccagcccgtggcggcggcggcgacacttgcactcccctccaacaccaccggtgacgcgatgtcaggcttgtcggatttggtggctgcggctgccgctcccttccagctccacctctcttcaccgggtgctaagctcgccaccattgttggatttacatcgccgccgcatgcctcctctgcctcgctcgccggagttgggcacaagtatcggcgttggtgtgggcaggaggagaagcccacgaattgccgcccctgcttctcaagcccacaagccgccgtcgacaagtcccctccgcgccactgtctacgagcccgagcgccgctgaagatttgtcgcttactactgtatgcgctggagctggagaagaaacggaggcaccaacggaaatgtaccatcaaatgcatgctcgggcggaaatcttgacgggaatggcacggttcaaattttacaaagtttaagtgacatgcacccaatatcatgaatagtaatggcatttttttcaaaccagcgaatttgcaatgcatggatccaattaacaaaaaaaaatctgtaagctgtttattcaaggaaaaaagatctggagctctcctagtaagcaaagataacccggagctctgatgtgttgcaattgttcgtgcatgccaaatagagcaactagtggcgcatttcttcaatttgattcgtcaccatgcgcgcggctaacttttcaccccgaaaacgattctgacctgcaggcagtatcgatcagccgaccttcaggcaggcatcaactagcatatatagccgggggtccagcttcaaaagcagcagtaggagtagcaatctaagcattccgcccatcactacgccaatcggccgccggtaaccactaggccgcaaaagctctcgctcctcaccttcgtccccgacgtggcttcttccaggtctctcagcaaatgtgtcgctgagctggtgaccacggcggccacactgcctcttgccgatctgatgcagtggcgactgctgcagctaagccgttttttttaaacgaagatgatcaaaaagtatccccggctagcttctgcatatctaagctgacgagccagcaacaggatatccacgaacttttaatttggtgccattcacggtcgacaggtacgtccgtcgtctgctagaaagaaaggggaaaagaaaagagagagaggctggaatctggtgccctgtggccttggaacaatgttcccggccggtccagtccacgctgccgctcgatcgatcaggcgatcacacgacacgccacacgattgctccaccaatcgatcgatctcctttcagtatcatcaatcagttggcacgctgcctggctggtttgctgcgtcgatccatgatccatcggtcatcggagagacaagatataccgcctccagatcaataatactgaataacgttaatttttaaaatcttttattataaataatttctaaaatatttatcttgaaaatatagagaatatatgtatatattagtcttaaaagtactccaatcaaattatatatttgttgataataataaaaaaatggtgatcaaaattactttttgagattgtgttcttgtctaaaatggtgatcaaaatggagtatcaatctggaaggagtactcggtaatgtcacggcttagctctgatattatgagatagatacgtagcagatagataggttagagtgggtatatatgagccgaagagaatccaaacatgaggatggtggcgccttttcggcgagggctggcggtaaatattctgaatcccggctgagagctgatggagagagcaggagaccaccttgattccaatccctgcgatgcaagttggtgcttggaatctgagcttctacttttgcggatttgggatcccggtggatgtggactgcatgtttaggtgcatatgcagtggctgtgtgcgtgctagtcaagacaccgaccaccagtgatgatgcttcaccaggatttagaagttcagagtctacgtacccggcaaaattgcggcacgggacggctaataattcttttttttttaagagagggtacagctaaggatgcataaggccattcacaatgcaagctatgggacccatatccttagccttaaaacttgacccaaagacactcatcccacaatgcaagcatccatagtcaggataccaagcccacagctggtggaccccacgaaaaagaatcgaggcattgaatactactttatcgcctccactttcctgaacacagccctcgcctcctctcctcgagtactactggcgctaccttgcctccttctcctccctcgccgcgacgccgacgggaagccacgcctctaccagcaccgccgccctactttatctcctctctctctctctctctctctctctgtaacgccccgattttcgttcgggattaaaaatcatttaataatgcatttcctagaaattgaataaaaagttaagcaatttaatcaagtgaaataatgggagaattaaaattttcccttaaaaatcattggccgggaatattttgtaatattctttgtgccctaatgtactctccggaattttccgtgaattttcggagctcgagaaatagttttaatagcacaaagatcattgcatcaattaaaataaaaagaaaacaaataaaatttcccctctttatctttgggccgctttcggcccaagatcttctccctctccatcctctcgggcccggccgccctccttttcccctcctcccttctctttgggccgtcggcccggcttgccccctccttcgcgcaagtccgtttcgcctccctcatcctccctcctctccccgagccgccgacaggtgggccccacctgtcggggtcacccccaacctccagcccgggccagcaaccgccatggccgcccgagccgtccaacgtcgccgccgtttccgcccacctcctccaccccgcgcgcgcgcgtttgtccgtgggacctcgccgcccacttccgcgccgtccccccccactctccccgcaaaatccggccacgtcgccgcctcccgcgtctctctctcccccacgacgccgccccacttcccctcgaaatccgccgctccccggccctctcctcgcccacttgagctataaaatcaatccccgtggactcctcttcctttttccccgttttcccgagtccccccgccctctaccgagctctccacgccgatccccttcgccgccgctcgccggcgatctccagccgcccgccaccgccgctcccgtcgctgccgcgctgcgccgccgccacctatagcatcacagcgcctcgccgcaccccggcatccactccatctccctcctccaccgccggaaccaccttcccatcgcgaggccgagccactaccgccacacaccgccttcagccggccgctgccgccgcgttagtcgtcgccgcacctcgccgcttgcgccgtcggcaacgccgtgccaagatctaccccggcctccgctccgtttccccattccaccaccgcaaccaccctttcaccgtgcatcccgagccaccttcaccatacgccgcctacagccgtgtgccaccgtcgccttagccgccgccgcgtcgctccgtcttcacctctcgcctcgcagcgccgtgccgcacctcggtcaccgttgttcatcgccggaaacccaccggaacgtggtatctctcggtcgccggtgagccccaccattcctctcctctccggcgtggtattctcgccgctccggtcgcctatttccctccctaaccactccaataatttccccaagtcttgccggccctcggccgcggctccgccatggtcgggcgtcgtcggaacgccgttcccgtcgcctcccgtgccggccgccgccatcctttccgccgccggtcgcctccccatggtcgtcccgtcgccggcgctcctcggtgaggaccccctccgtctcctctcccttttccctcttttcgccgcctcccgcgcgtgccgtcgcgccggtggtcgtcgccggcgaccatcgggccgtgcgccgtcgctcccggccggccgaccggtgagccggctccagctcgcccgtggccgcccgatcctccttcggggcgatctgggccgtccacgtggccttcccgtgccgcccgcgtcggtgcctctgtggcgccacgtcggcgccacctccgctagccgtccgtcgtggccgccacgtgtctgccacgtggtgcgcccgcggaccagcgcgtgcgtggactcggtccacggtgcgcccgccacccgtgagtcaccgacaggtggggcccgcttgccggcgccacctctcccccgtcggatgacgtcataattgatttaataattgcgcaataaatcgagtttaattatagaaatccattaaaatggctcaaaacttctaaaatccatatctaattcattcgaactccgaattgagccattcaacttgcaaaattcatctaaaattgagctctacatgtttgtttagtttttatgtactgtttccttggtttttattagagtttttcctcgttttgcgtgccagcgtgtagaatccgtcgtttcggaagtccgcggtcgcgaggaaaagagttcggaagatcaaagtgaagaagcaaggcaagtcacacattccccttgagcatgttgatcctaatttacaaatgttttactgtttgcaaataaatatgcatattttgctaattacatggggtcagggtattacctatctgctcgcttgtgtcatgtttacttgatatctgttctttgtcaaccttgggtaatgaatcgactagctcatgttacttatgtgacctagctagaactatatgcttagccatgcttaattaccactagctcagttgatgggataattgcagtattagacctttttagtatcagagtgagctgcgtgctcgagacacctggccatgcttcatggtcgtaattatccaactaaaatgcgactgaatggtgggctgtgggtgcatggttttgctggtcgcacccatggcagttaaggaccggttcgcgggatgccctggaagaacttatcgtacttaccacaagccagcgtgggcaacggctgggcttgtagtgtagcttttctctagccgacgtacccaggcgagggtgggcgtgatggagttgggtcggccggggtgtccggttgatcggcttctggattcaccgcggcacgaaaggggggctgcccgttgcctgctggagacgggggcgaaccctaaggtgtggtgcgatcggttagagagggttatgcgaagggtcctgtcacggcctctttccggtatgtcgtggtggcatgtcggcgcacgggaacgtgtcgtggggctgtgtcttgtgggtacagttgtacacctctgatcagagtaaaactattcgaatagccgtgcccgcggttatgggcggtcgaccagattcaccgtgattagtctcacacttaataaatcgacctaatacactgtagtccaggtgggttggttgggcctgttcaacgtggtgtagcgttgatcagtggagatttaatgttactttaattactcaacagttttactgttttgctcaataaaatgttttacaaccgcctttatgcaaatagccccaaaccatccttgtatccccttgcacgtctgcatcgttggtgtggcttgctgagtacggtggttgtactcagccttgctattattcccccttttcaaaagtgtagtgcttctgagctgaagacgaagttagaggaccaaggctcagaccccagttgagttttgcctgt

SEQ ID NO: 74056 - DNA, 15562 bp, Oryza sativa
tcctgcagccccggaagctgggatgcagcggcgtggtgccagtggcggcggcggcggtggcggcgcgtgtcccggcggaggagacgaggacggcagcggtggcgcgggcatggggtggacgcggtcggccatggggtggttgtgaggcaaggtgttcgacgagtcggctcgagtggagagtaggaagagagacaacaaaagaggggaaacagagagaaagatgacgtgtcatactgatatgatatgtgaagtcgatatgggttccatgctgactcagccgctacgtaggataaaaccggatttaaaaccatcgaataacctattgtgaccggttttgattagttaagagatgctggatatttggttttacggttggaggatgattttgtaactcaatgacaagttgagggaccttcggtgtacttttccgaagtgaaatgttgtggtctacatgggcctgtccaggctaggtattagccgcaggccatgagcccaataattgcacgagcataattgggccgaaacttggctatttacatcgaacaaatttcggcccaaaacttcgacgtacgcatcacagcttttcaaattcgaagttgagcaaatcatagggcctcgaattgaattgttcacccaatttctgacctgcggaaacttcttatatccaatccaatcaacaagctagtgaactagacaaatttacaacccaattctgtcatggaggggaggtagtgaagatggttgatgcgaacacgttccatatatatctcgagtgactggtaatggaggaggaacttttgaagggaggtagtgaggatgtgcccctacctcctaaacggccctagatgtaaaaccatcacaagccccaagatccaccatagttgcaacggctctcctcatcgagctcggggaggacattagcaagtatagatggccataaggcccgaggcccgaaggcccggcccacggcactactttttggcccggcccaagcatggctcggcgaccgagccgtgcctgggcctccccactggcacgctgggctggcccggcacggtcgggccggcccggcacgatgggccggctggctaggcccggcacacaaagtatagggactaaaaatagacatatatatgtcattgtccaaagaatagggaccttaaatagatttattttagctatttatataccacagcccaaagaagagggaggtaaaatagacgttttttagctgtatatatgtcacagccaataggagggatgaaaaatagacttattctgagaaaaagcacaatggcccatcatgcctacgggccggcccggcacggcccgaggtgtgttgggccgtgagtgcggcacgtgggctggcacggcacggcccggtgcgtcggtcgggccgtgccggcccgacaagcctcggcggcccacatggccatctatgttagcaagtcaacctcagcgatattgcaagcaatctcgatcgatatccaccagtagctgattcatcccaccaccctttgtgtcgctggctagggatttcaaagagggatagagaaagtgcagcatgagagagagggaagtggttttctctatctattacttgtcacgtttgttctactgacaaagtgtacaccatatagaaattaaatacaatgtatattggcgtattccgaaactgtttataaaagtaaaggggtttaattcgtccagtgtaattcgaacttttcccttttagaagcatggcgttatattttctgcttattcattgacaaaaaaagtgaaaacaggacgagagacatgacgtacgatcaaggtcataattagcccccctctttttgtcggttacagaggttgctggccatgcgctcatgatcagtgtatctaagcagggccgcaccaagtgtatgcatctttttgtcactagttaattattactccttcccactcataatataagtattttggagggatataattctttaaaatcctttatattatagaacagacagagtaattagtactacttaaaacaataataaaatttgcatatataattaatcatctgaactctgaagtctgaagtagacgcgagacgcgaggtgaggtgtgtagctagatccatggacgtgtacgtaatacgtgtcagattttgtaatgggcggattacgtattttaatttgcgctgcatatatatcacgacacgagaaatgcatgttagttgctctttaattaattaatttcctaaataaaaatgaatcaatcaaggccatcttttgccggtcgccattatacactgacctgcaggtgtttgattagcactcctattcctattcctatagtcctatttgcgatagctgcctcagcatctctccatctatggcgactcaatgatagtgattattgagtgtgcccattaagctagcatcatgagttcaaaatgcagccggaaacagttttattaatcgatcgtgagaatattccctcatttctgtgtaacaatatctaaagtatattctcagctcatatgttgatcgagataaaaaaaaagataaatccagcatttaaatagtattgtatactcaaatttatcttttttttaattaattagtgtgtatcactgtactctgtattgtcaagtttttttaaatattttatgaccatttgtgttgaatttagttggaaaagataaacaagaggatatcctctcgagcggttaggcacttaggccatccccaagactgcataccatttagtgtctatagcattaaatatattattacataagtaaaaatatgatgtggaagagagttaatgatgagagaggtaaaagatgaagaaaccattcgctagttttttttttttgacaaacaaaaccattcactagttacccttcaattcttcaacacaaagggcatgtttagttcgtgaaatgaaaatttttgggtatcacatcagacatttgatcagatatcggaaagggttttcggacacgaatgaaaaaactaatttcataactcgcctgaaaaccgcgagacgaatcttttgagcccaattaatccgccattagcacatgtgggttactgtagcacttatagctaattatggactaattaggctcaaaagattcgtctcgtgatttcccccctaactgtgcaattagtttttcttttagtttatatttaatgctctatacatgtgtccaaagattcgatgttatgtttttgggaaaaactttttagcaactaaacggggccaaagtgctagctagctactgctgcttgcctgcatgtgtctccatccacgtatgtacttagttcgccaaacgctagcgtttgatcgcgagaagattaattaattaaacaaaatagcatttgtgaaccgcccaattgtgtgctttactctgcacatgatttatatataaaaactggctactttaaagatcgacgcacatgcatggtttacactcaactaattggtcctctccatttgcattattgttaggtttgctatggctgtatataaatccatgtcgatcatgtttacactcaactaggaatgttataaatgtccaaactaaaaaatctcaaaccattgatatattgatcaagaatattaatattcagtatccaaaaattgatatcgatgggttttattacgaaacaaacttgcaacattttttctaaaaaataaaatcgctaaaaataatagtaaatttcacttaactataagtactttggttaaactatcacaaaaatatagagttaacatgatgtatcataaaattatagatttaactaaatttatcacaaactacttacagatttaaggtgaaatattgctaaactgcatattttaagtaacaaagttatcaaaaatttaatcataaaatttggacatttataactcacacataacattcctagttttgtaataattttattattaaatctgtagttttgtaatacttagccttaaatatgtagttttgttgattgttaaatatatagttttgtgatatatcatcttaaattatagttttgagtgaaattttgatcaaaatatttgtagttttatgaaatttacttaaaaaatggtaatactttgtattatcaaaatatttgatagaagaaagaatgcagagagtacttgtctgcatgtatctactccctccgtctcaaaaacccaacctaatattagagatgatattttctagtacaacgaatctggacaaccttatgtattcaagtaatgctctcttgctctcttttttatgaaaaaggtagtacaactcttctagcctctgcactaattaaatgtctatacaactatgtttacagacaccccgtacgatttgaactctagtggttagagttatttagtcacaagtacgatttcaaccctagtagcataattttcagcccttccagcctctggtactcacgattttaccaacgtaccattgatgctttcccatccagctaatgttcataccttgatattataggttggtaaagctaaatagtttcttgtgttttaatcaagctgtggttttataatttatatttttttcgatcgatctgtaacttttataataattggttgtaacttcttggaagcaaagatgggaatgaattccattattaaaaacaatccatctagtgctcatatattgatctttcaggaactagtgaggtaattgccaaccttagcaaaggtaaattaacacatgcaaactaaattaattactaagttgcctttccaaaactatgattgaacggtcacgttctaggcagatctctgtgctagctagctaccggacaaatagtgtacagtaaaagtacatcttgggcatggatgtttaattagctcaatcattggcaaattgaagcaacgagccacgtaattacacacgggaccaacacccaactctgaaagggagaagaaacagacacgaatatatggccggacgaccccattataaagctatgcactgacagtctgacactgattaatcaccaccattacttaattaattaattaattcaattaactgaccactcaaatatgaaatatagaacaccatgatcacataatatatttacacgtacggatttcagcatcaatgtctatatatatatttatatatatcatcatatgaagaactttacatgttgtacgtgtaccggcgatcgagattaaagactttaattatcatcacaatcatgtcactcaaaagcagcaaactaatgcccgatccatcgatatctctcgatcgatcgatcaaaggagagaagagaaatgaaagaaactaaaccaaaaaaaaaaaaaatcttttgacaacccaaaaacctctcaccaaacatcagctatgatcttaattacgtacgcgccgacttaattaattcacacgcgcgtatacacgttgaaaacttgacccgtaggtatacgtacatttatacgtagcagcatgcttgcatgcaattatggcgcctactaattgatcggctgatcattgctatggctcatcgctcgccgtcggtctcgttgcgcctaatttggggtggattcgagcttagctagatggtactactctgtcccataaaaaaacaaactttagctatgaatctagacacgcatatgtccaggtttgtagctagaattgtttttttttttacggaggggtagctgctagcaccagttgccgagggcgtgggcgtcgaagtgcaccgccgtgtccttgctgtcgccgccgccatagatgccgccatggttgtacggaggtagctggtggttgtagccgtcgaacacgtaatcggaccacttgagctcgtccagcgcggcgccgtagtggtcgaacgtggcggcggcggcggaggaggagggggtggtggtgcttgggcccagctccagccatgggaggtggttggtgttgccgtactgctcgtcggtggtggtggtggtggtggtggcggcggggcttaggccaaccatcgagttcagcgtgctggagctcgacaccgacgggataaccgccgccgtgggcgccggcggggcgccaccaccggaggaggtggggccgccgccgccgcagtgcagcagcgcgctcgcgctggcgccgtccaccgcgaactccgctgtcgcttggctgtacccggacagcgacgacagcgacccgtcgccgccgacactcgcggcgccgcactccgtgctgtaccggctgccatcatagctctccggcggcggctgggcgccgatggaggacaggatgagctcggcgtcgctgaacaccgccggcgtgcgggcgcaggcggcggcggcgacgacctcggcgagcggcttgtgggtggccggatcgatgccgcgctggcgaagcttcttcttgatgtaagagttccagaagttcttgacctcgttgtccgtccgacccggcagctgagccgcaatctgagaccacctgattcaattcaagctgattaatttcctgtttgattgattaattagctagaaatcatccaagctataattaattaagagaagtagttaaattactagtatgataatctagtagtaatgtgtatatggatttgtttgagttaattacttgtttcctagcatggaatggagatggatgatgaggtcttcttcttcctgtgagaatgctcccctcttgaggtctggcctgaggtagtttatccacctcagcctgcagctcttcccacatctctcaaggcctaatgcaaccacaaattggaatttctaatgatatatatcaaattcaaactaccaattaattcctacctaaaaaggttcatttcagctcaattcagttaattaagtgacatgaaaatttcgtaattaagcacaattgcacaaatcatgcacagagagagtaactagtattatggcactaattaagctaaattacattgtccatctttgtagtagtactagtgctactagagctatgaactatgtatagttagatatagctagtgagtgtatatacctgcaagcttggggacggagctccagcagccatggccatacttggcaatgtggttcatcagcttctcgtcctcctccggcgaccacagccctctcctcagcttcttcctcgcgccgcccgcccgcttcgccatagatggccaccaccaccaccgtgctcaatgtcgcaattgccgccgacgacgaccgagagagaacaaaccaaaccgccggcgatgtcccgacgacgatggcgaagacgaagacgaaagcttgagctgggacagaggagagggggggggggggatgggagggggaagaagacgaggtataaaaggcgggagagagagagagagagagagagaggtgattgcgtgggcgggaggcgggaggtcgctctcaggtaggtggccattgtggtgtgcagagtgttacactctctctgatgagtgatgaagcatctcatctcatcatcttcttcttcttctcgaagactttctcttctcagctcaggtctccctaccttaagctctctcctctctctcgatcacttgctaatattttccaccacctttactaacttcaacctataatagtactcactttggtcataaatgtttgtcgtttaatttaagacaagatttaggtcctctttgaaacgcaggataagtaataggaaaaatgtaggaattaaaggggtaggaaatggaaagaggagcacattgattgcaccattggaaaaaaaattaaacccatgaaaagtttccaagaagtctaaccttttgtttatttttctatgaaattgatcatagaaatatgtaatcctacgaaaatattcatatcttgttcctacgaatcaaaggatcctatggggaaaaaattccgaagagaattgaatatttcaaaaattctttgccaatcctctatgtcaaaggaacccctcgattgatgttttggaactttgaccatcactaacttctaaaacaataatttagaaacgtaaaattaatataagtaaaattgtcttaaaatgtacctaccataatatcataagtgtgggtggggagaggttaatatcataaatttgtcttaaaatgcgtaaatcaataagttaatcacgtattacacacaacgaagcagaaaacggttgcttctgctgctaatggcagcttcaccaattatctccagggtatgtgtggtgatcaggtgtagtaaccatccacccagctcatcatcacacttcgtcagatcagccgtgttggtagggctagcagcagctgcatatgttggactctttttctgccttaagctttttgcctcttatctatctttctcctgctaacattatgttcaccttgacacttttgcatcgatcgatctgccactaactactgcagatgctattgctagctctgcatggatgcatgcccctgttggactttgtacacacacattcgctttgctttagcatcacttcattctcgaccagtgatttaattggaacgcaagcaaccgaccaacatggtttaattatcggtctcatcttctcaccatcaattaattaattaattaattaattaacaattaattacatgtaataattaattgctagccagatatgccacagcacacacagaatcttatcatgcatggccatgggggcctaattaattagcctttggttatctatatctatagcttggttagggacagacaaacagtagtgctagctagatagagcggtactgcatgtgtggaagagatggcatttggatggtaaccacatgttaaataataataaggcaaaatttgctacaggacacgcaaaaaacgtgtaattagctggaagacaccgtgaaaacgtgatacggctaacggacactacaaaaattgtgtaattagctataggacacttgtcgtattattttattattttcggatcaaaagaggtgagatatttttctaaatgcccagattgccccttctctttccttggttttctccttcgccgggatcgcgcgcagtggggcgaggttggcgaggtcggcacaagaggacgcctgtgcatgctccgacttgcaaatcagagaccagatcgagcccctgaccggctgcagctgcctcctggctgcctgctcaagctctcaagcctgaagtctgaaggagctcgccattgctgcctgctcaagctctcaagtctgaattgaaggagctagctagccatcttcttgctggtggagcgagctcgccggcgcatgcttggctgctgctagctgctagctggccggtcttcctcttgtccggcgagatggaggtgggcgccgtgagctgctaccggagagggagttggcggcgatgcgccgctgctctcgccctcgccgtagtcgtcgtcttcgccgcggacactcagcgccttcgccgagaacaccgagcgccttctcgccctgccgccccgctgccgccgagctcatgcccgcccactcgcgccgagctcgcgccgagctcatgcccgcccactcgcgccgagctcgccgacgcctccccccacccgcgcggcagcggtcggcgacccctccccccgggtgcctgctctaggcccgtcgacctcgccgtcatcgtcagcggccccgccggcctcgccgaggcgggcctctccgtctgccgccccgctgccgccatcaagctcgcgcctgcgccgacctcgtcccatcgcgcgggttcccggtgacctcgccgacctcgtcccatcacgcaggttcccggcgtaggagaaaaggaaggaaagagaaagggcaatctagacattcagaaaaatatatcacttgttttgactcggaaataataaaataatgcgaccagtgtcctatagccaattacacaaattttgtagtgtccatcagccgtgtcacgttttcgcggtgtctcccagctaattacacgttttttgcgtgtcctgtagcaaattttgcctaataataatactatttccaactgcctttctctttagcatgcacagtgattactattgatcgccttagtaattgattaatcaatagttgatgtgaacatgtttgtgtgatccctcatttgccacaccacaattaagctagctagcaattactagttttcatgacaggagggagacctctagctagttgcatctatatatctcttgcatgatgttaatttctctctcttggagaaagctgctcaacatgtacacatatagatatgcagtacctagctgccaaatgcaattaccatcctcgtcatgacagagatatatcgaagaatatacatgacacgtgctttttatcccctcttcaccgacagaacatttatctcttcccgcgtgttgatgattcggcaataattagtatttcacacgctacacatgcatgcaaggattttgggcaattagtagacactagcttccttattcaagcttttgatcgaaatcaaattagtagggtagcatatttagtgtgacggtgaagttgtaggtgcatgccacttgctaactaagggttcaaaatcttagtgtcgcacagttacgtaggtgctctttcggtaggaattgagtaaattttacaaaataatgtactatagattcattgaacaaactatcacaaaattacataagatggtgtatgaaaaaaaatgtagatttaacactaaatttatcataaaactatatgtttaaaattaaatataaaaccatagatttagtaatcaagttatcataaaactacatatttaacgtcaatttaatcatgactataatgtttaatagtgctaggtattatttaagctctggattatatagttttgtgataaattaatttttaaatatatagttttgtgatgttgcaccttaaatatatagttttatgtatgataaatttggtgtaaaatctaggtccccgttgtttggtttatataaagaataagccaacggcatatttacaaacggaaaataatttgtgagtaaaactattatatgtgtgttcttagccatctaaaagaaaatgctgaaaaataaacttcaatggaaaaaaacttcaaaatcaatttcaaatttaaggttaaaaatttaaattttggttgataagcataagcataatcgaaaagataagactgctagttttgggatacaccatcttaaatctctagtgtcttgtgatagtttggtcagactacctacatgtaattctgtgaaatttacttgtaggaatttcgtgggagataagtggagctacttcatggatttattcctaacatctgtattttgagtacttgtagacgtatattgagatacatgtgcatctgcttctaagaaataggggtaagtatagttgtgtgagtgcgtgatgaggacatcctccactattacccactggcaaagacgtcaaagtcaggcggcgaccgtgtgagcctttgaataatcctataccttgcttaacttgggaggaggaagtcaccttaaaagggagagtcacccttcttctattagactagtcttttagggtgattgggcattttcccgagtgggtcggccaaccccacctaggccggattgtgttatcagtgcgtctcctaatgtttttctaagaaaaaaaaacatatttcagagttagctaattaattatagggtcaattgcatggtatagtacgtacgtacgtatatatgcgtgtggtacatgtgctcgcggcgaattaaatccggggaccagctgataataaaaatctacgtcgacgcgtacgtatatacgtacgtgcattgcattaaaccgcgtcaccgtacacgtatgcatgtcaagttcaactattaaagccgctacttgctcaattaaagcaggactagctatattacattgcttagggccttttgacacagctacagcttcagtgctccacctcttttgaagctggagctcagccaaacagttccagcctagagcttagtggagctctctcacaaaatgagggcctgtttagtacagctccaactcctaaatataactccaggagttgagtctggtgtggacttgtggagctgcctaaacccgaatccacaactgtaggagagtttgtgagaagctccacccaactccactcccagttttggtggagctgaaactgtttggctgagctcgagctccaggaggggtggagctggacctgtgccaaacaggcccgaactagagagaggtgaagctgggtttaggcagctccataattctcagacccaactcctataattaaatttaggagttggagctctaccaaacagaccagagttaactaatttgccggtcatatatatttatacgcgtgtgggctctgtgcgtataaataggtgtgattttcagtatttatatgtgtcggccttgttgttttcgcaaattaatttttaattcgggaaatcgttataatccaagagatattgattaaagaattttaaaaaattagctttgcagcgcacatgtacaactggttgtctttgtctacgtataaattataaacatatatatgcatatatcaccaaaagcaagtgaatagtttgtttttatttttattttttttagggggggaggggggggcagcttcgtataaatgatcaattagttacacacacttaaaagaattgaatatgaatagaggtagctaaattatttttactaatcagaatatattatggattactgcaaaattaattagtccataattataaactagcccattatggaattaatgtggtagattcctttgatcatatggagctggaggcatgcagacataatgcatgcatgcatgcgcatgttaggtacaataattatatgtacatgtacattattggggtttgcaaaatagcagcttaatgtaacgcgtacatttgctaataatgaagataaagtttaaccgttgtgatatactataacgagtacgatttaaagataatcccaacctaaaaattatcaagtactattattatagtttatgtatttattatatcatatagatattatgtatagaaactatatctcagtgggcgtggcttgttcaaaataaattttcatccaattaccttttttttcttattttattcacatatccttttattttcagtttttttatgtatagagtttttttttcatgagaaatggtttcttcatctttttttctttctcttctcattaactcttatgtcacattagctttttatgaccttaactttttattttcgtgataatacttgctatagaaactatctgagttggaaaattgggaggccctaattgaccctctaagggccagcacgaccccatgcatacactatgcattgatctactcctcaaatattatccaaataaatataaggagagttatgatgatacaatatacatttaattaccatgtcctttttgcattgttttagagagttttaatttattgctattggctaatgatcgatatctgctaagctagctagggattaaaagaataacatatgtctgatatgatctgataattaataagctcatatcaagttatctaacttaattatccttcggggcagtcggatgcatttctctggacaacacaatataatatccaccgttaccaacatgatacacatctagtagtaatgaatatatatgtatgcaattttacgtctatgtatagactatgatatggaggtagaaatattacatatatattgtacatgcatggaaaattcgtcggtggcatgataattctaattacctcgatcagcacacaccgtaccaaactctaatattaattgtttaaagcagcatagctttttcattattgcttaattaggacttcagtaaaaaaagcctgaagatgccaaactcatgtatctatatatgtatattacatttaatagagccattagagaaaggaacatagcaccaactctggtggggcacttaattaatcagctgggtcaatataagcacagcagtgttgataagcttacagggacaagtgagaagaaagcagccacaaattaaatagttcatgttacagttaacgtaagttacaaattaacatatggtctagctagtaggtaactctaattcacacgtaatataatgaacgtgcactgaaatggagtgaatttcacttcaatttgcattaggtaaaacacaatgcaaattgttccacttgttgcattgggctatatcaaaatacttttttctttgtacaaggtgttagatcagtgttcttgaaataatatatgaaacttcgtgaattttgactatgtttgaacttaactaaaagggtaatttatgtattttgagattattataggctaagtttaatgatgcccttcggtgcaaagtggaatttattagtacaaaacatagtgaaaagtgagagtgggtgaaacaagaattttaattacctcgtgcagacaattgtagtagtaaatgcatttctagctctgagcttgtactgttgtacagatacaaagctagaaatgtactcagtgcgggacgatggagatagtagcaaagtttatacgtttattagacaattatccatgtgtagtatattcatgaatgatatttatataaaaatagacatatttaatgtgatttctacatttatgcagaaaatactagatgatatatgtacgtatgtgcgagttctaataagcataatatatatgatggaatttttttttttgggctaactgaaaggactgtcgatccagcccatagtcctgataatctttttttaaatgcttaaaatatcgaattgatgtgtaaatttcttgcgccgcctaaaagatgctcgacagttgagaggaagttaaattacctatatcatccaaagtgtagttctttcttggtcggtggctgagacagaaggacggccagtggcctggcccctccaacaaattatttttcatagctttcaacataagccgggtctctggcctttttctaaaaaaaaacaaattatttttcacacgtaaccccacctaattagttaggtaattagcctaagtaatagtgtattagaccctactccaagactcttaggccacttctatgttttaatcgtggcttcgccactgttcttgatagactacttgggcatataaaagggactacttactgatctttcgatgaattaggggtttcaaatcttatataattttcaaccaatgtatacaacctattttaaatgaaataaaaaaacaaacatgtcaaacatgtaaatctagagatagaaacaattgtaaaaaaataagtttgatgcattgtagctgagcataagtgcattgtaagtgagtgtaactgtaagttagatatacagggacacgaatcttaatgtaagatgctacgaacgaaaaaccgatagacaggagctcaaaaatctatcgcaagtgaaataacaaaagtataaaaattccaactgcatgcacgtaggtgtacgtaacaaccgacggcgagggatcagaaaccggatacatgcaaccagtggcggagctacatttacaagagaggggggctcagccttcttcctcctcccccccccc

SEQ ID NO: 74057 - DNA, 1646 bp, Oryza sativa
atagtgggtagtactcagtcttgctctctttcccccacaccagagctgaagatcttcctagtgggagctgtcttgtcgaagttggtttcgtcgttgctgtcaaggattgcctgtggaatggagttgccccgctgcagaagtcaagtttccaagtctagcttgttttatcttttccgctgcatttgtaatcttttatatttttgcaagacgtggatctgtatgtcaacaattgtcgtttgtgtaccctggctggtcctggacaggggtttaatacacattcagcttagaaattctggttcgtgaatttctgggcttgacaatcttccaagtgctgttgaagaacagagtctagattgagatcggctatcaaaaatgtggctgacatgaccaagtccctcaaagtcatctctggaaccgacgcccaagacatccaagccatcgaagaagtagatcaaattagacaacgggctgtgttggctatccagcgttacttgtctggataattggtcttgtaataggataacttatttttgtaatcggctaagaaactctgatacccccttttgtcactgaactgctgtgccgattaataaatcttaacttgttcaaaaattcgcaaaaatttgcaaccgttcgtatatatgtgcccccctaattttataatgatgaaggcattgaaaaaattataatttggactaaggaggacatagccatatcggccattgtacatcggtaaaacacaaccgattacggtatgaaaacgactaagggcgatataaacatatcggccatttgtacatcggcaaaacacaaccgattacagtatgaaaatgactaagggagatataaacatatcggccatctcaaggcgatgtaaatacatcggctatcatgcatcggcactatccagccgatcatgcattaacccaaacacttgggtaatatttcttcaagtatttgccattgagggctcgtccataaacatctcaatcaagtccttgcaacatataagcccctttggacacaaccttatggatttgaaacggtgtttcccaattcggtgaccacttgctgaatttgctatctcgagttcctatcggcaaaatcaatttccaaataagttcacctacagaaaacaccactttcttgttgtaatgtcgagcaatgtgttccttatccttagtaacttctgcaagggctctcaatcttgattgaaccaagtcctccctctcatcggccatgagattgtaatattcatcggctgtcaactcattttgtaagtctatcctccttgaaccgattcgcacttcccatggtaaaactgcctcatgttcataaacaagtttaaaaggaggaacttggatcgaaccgtgacaagccatccgataggaccacaatgctttggccaatctagtatgccattgccgaggataatcgaaaatctttctcttaatcaatttgatcaaactcttgttagacgcctcggcctgcccgttagcttgtgtataatatgatgaagaattcaaaaatgtgatacccatgctatcggcaaactgaacaaactcatcggacacaaagatcgagccttcatcggttgtaattgtttgaggaataccaaatcgataaataatatgctcttaaacaaa

SEQ ID NO: 74058 - DNA, 10916 bp, Oryza sativa
tactagatatgatatatcctaatattacatacaaatatgtacgtatattcaaatttataatattaaaatatattatatctgattatagattcgttttctataggacggatggatggagtatatgccactagtgtacaacatacagctagctactcctccgtcctaaaaaaattaaaccctaggtttgaatctgagcaaacatgtatccagattcaaatttagagtttgattctttttgagacagagacagagtagtagatagttacttcctccgttcaggttagcattgtccacattcatatataacatctatatgaatgtgggcaatgctagaaagtcgtataacctgatacggaggtagtagtacgtagtacactggacgccacgatgtgtgcacttgcgctgctgcatgcgagagctgggaccacacgtacggtggtcgctctctcgctgtgtgtgtctgtacatgtccgtgagtgatcactgtgtgccactggcactgcacgcgtcgtacgtacaacgctcgccggcggcgaggcgagggtacgtacgcgtccagctatagcgccatgcgggcacgcacacgcacacgcacggcgcgtcccccaccgccgcgacgcgcacgtcccacctgccgttctctctcgcccgcgcgtcgccgtcgtcgcgcgggccaacgacacaacatgttaagggcgcgcgtcgccgtcgccgtcgccgcttgctctcgcgcgcgcggcctttagttggcgcgagcgaggcgagctagtgtgacggtgtgaacgcggcgagggggggccggacgacgagaccgacagcgtgtgcgcgcgcgcgagcggggaattaaggaagaggacgacgtgctttgtacactgctacgtgggtcgccatcgctgtgcgttgtccagctagcgccggcggccggccggcgccctcgatcgtgggctagcttaattagaccaagcaactttttacaatcttacatatgcaatttctttccgaatctacagctccccgcagtccattttagattctaggcccggttctttttctcaattccaaactccaacttcctcatttttcattatcacgtttttcaaacggttaaattgtatgtttttttattaaaaaaatctttacagaagttgttttaaaaaataaataaatctatttttaaattttataatagataatatttaattaatcgtgtactaatgacctttctgatgatagaaattcaattactgagaattttgcgaagctaaaaaaaaaccaacttctaactagagttatgaattctgcaactataccttctcataatcccaaaaaaaagttgaactgttttgaagggcttttgattttaggagaagttgtcattgccagaaactccccaaacagactctagctatattttttcatctaaattccaagaatttgtagtttattaattgtagaatccataaaactgactagaaggggattgaagaagctggaaacttagcttttctaaattttgataagtttacaaactgcttttcaaactctggagctctccaatcaaaacctatctgaaacgtcggtagctaggctgggtggtacagtgctggctggtgctactgtttggcagttggagaaaacggtatagcttgatgtaggcgtatacgtagggacgtcggtctccgtacagtggtacatacgtagcccatgccatgccattgtacgacacatctaattgtgattttgttttttatattaagaaaaatcccgtggttgtgtgtcactgtatagaaggggatgtaacctattttactcattgaatcattgataattaaaacagtgcacgtgcaagaaaggtggtagttcgaaatcaaaggattatcttgggagtttttttaattatatttaagtgaaatttgaatttttttgtcgcaaaaaaagatacattgaattttattttttcaagggcgaatgatccacctaaagtttgttttaaaagaaactgtttcagcacgtacacaccacaggtagttcaaaagtgcatctgccggccaattaatgcggcacagtagctcaatataggacaggacctttggaattttattttcaaatccattatatttactcaatgtagccttttccttgctccatttcataatcaaaaggcaaataggcggttccaattaatttgcacaaatttctcgagcgtcaaattcgccacatgtgggtggtgggctgtaggctacggatcccatcggcccacatgacattgcagcggcctacgagagaatggaaggttgggccgtcagaagctaatgtctactggacctattctcaatctactaggcccattcttttttccaggcctattaggcccattctcccctcctcctacccaccacccacccgtccacgcgctcccctcatccttgcagccagcttatttcataatcaaaaactcttcctaacagtctaatttttcatccaaattctaaaaaattatagtcacagaatctagaaaataaacaagcacgaatcacagagcaaatcacaaggtcagaaattcccgtgaacttacctttaaaatgtgttaaaagtgatgtagtataatactccatccgtcccaaatcataggacgtcctcttaaaatcaaagtcggtaacttttgactaataattatactaaccatacatatgctaagtattacgtatgttatatcactagatttatattttaattttaaagtactttcatatgatgttattttcatgtttgttggtaacgtaacatagaataaattaacaaattaacggtcaaagtatgtcattgtagaccgtgtaaaaaaatataaaccttataatttgggactaagggagtattgtatttccgatattcagggagaatacaggagaccaactgacccaaatggtagatatttgcctgacaaatgattgggtttcttgcaggcacattacttatttcattcatattatcacgtttagtacatggatatgtaaatttatgatacagatacaccattggggtccaaatgttcagagatacatcatccagggaattcaggcaatggaaaagaatcaatcggtgtgtggagctaaatgcagaggcctgatcatgccacattagcaagcacaccaggccctgccctaagatcatatctgagtaatgatgaacatgtccatgcaagtcactagctttgcatcctctatctataccttcctcttattctgtatatattcccattgggtgtcccttttttcccctctttttgccacctacatttggtggtggtctaagaatgaatcttagtaatctcccctgaatgtaagatgatggcaggtaccatcacaagggtatgcacagtctgtgtacttcgcgtctgccctatcgaaaaaccagtcgcctactgcttcagcaattctctgcatatccaagaaaaaaagtacatgggatgggtctgatgagactactggttttacatgtaggagctcagagttcagacagtcaggaaatctttcgaagcgagaatgtttttcatggcatcaccgcagagtttgcgtaccttgttaccgagacgaggagaatcccctgcgtaccatgtgtcctgtctctcactttggcaatgtgcgaaacaggagttgataaaaagaccgttctgccttgcgccggagaaacccctcaccgcatcgagcatttgattcctgaaacctgccatcatacatacacagggggtcagccaatctagacttgaattgacagtttataattcacggatctgggagaacagcccagtaccttgtaaaaattgcagttggttgctattacaggaggcatgattcatcctacatcctcgccatagaccttgcggatcagcccttttgggggccacactttgttgaagctggaaaatataaaataaaatcatgtccttgaacattttatagtttatatttgtggaccaactttatcataccgttaacatgcaaaacaactgacaaatacctgccacacatcataagcagtgttcaaaataaaagttggagtttgaatgtttggcaccacattctgggggaaaaagcactgtagagagcaccaattagaaaaagaaattgtgaaaaactaactgtgtatatctttgttagatacttcttgatgttttccttaccgaagttttatccatgcgggaggtacaagacctaggcaggcttcttccggaaccctgtttttggtcgaattttcatgagaacataagcgaaaaaaagatattgagaaaatattttttttcaaaggtatcgtatattctgacataaattaatagtagcataacatgtagaagaagtgttacagtcatgacgaacagaagtatcataacatggtggacagtggcagatacctgcaatctcacaataccattgaagaagtccctcatttctcgttgcccagaaacatcaacactgcaaatggtaattaaatccataacgtaatatcagatgattagcttttactctaccagtattcatccatagcaaagaatgggcaagaaaaactgcatcaaagcaagtctcatttctatatgtgaacttacaagtccagaaacattccagcatcagcaaggcacttcacgtttgtactgccgctaaacaatccacggaactcgtcacagtgaagtatggttgaaacaccaccagcagagcatccagaaagaagtgcctggtagaattgagttgtggcaaggaaacataaattatttccaaaatccaaaaggctaaagaaaacatgattagctgtggaaggatcagtacctggttagcatatctcattccttgggccatcagatcatccatagcagcctgccaaatacgctgacctcggaaataaaggcctgcagactggagaaagaaaactctgataaatgaacccatgtagttcagtagaaaaaaacataaacatgtatattatgtagtaatttttttggggggatgtgaagtatgtatttcttcagaatatttgtttgaatggaatgtacactgtgtgcaatatggaatataggtcactaggaagaaacgtgtacgctaaatattactactatctaagagaacttaaacttaaattgaaaaacattttcctttgggaaacattaaacttaggtgatcagttatcttgattatcttctgaaacccttcagcccagttaaatatcaggaaaccaacgcactaaaatgcagaaacaaaatttgcactcaccgcatcagccccatcaccagtgaaggatccgccatcacaatatcgaaccttcactctgttccagttgtagaaatctaagaagaagagagcacagtcataatttgtcagccaccaataattaatagcaatattcgcatgaactatatcaagacagaattgatcgaaagaataccaggattttcttcaggcctgttactcattatcccagtaaactggagttggctctccatgtgatttgatgaaccacgccgactgctcttgcgaaacacgcagcttttaacatcgttgcaccagcctccaccctggaattccaaacgaatcaccatcagctactaaagcctgaacgatatacaacaatctctagtgccacaaagtgccatttgctcaaacttatctctcggttcacatatatgggaattggggtgtatttctcacctccaaattgacaagccaactgtttgcccctgatccaaaccctcggtgtaggtgataccctggtaagctcccatccaagcatactgccatgataaacaaagaaagctgtcatcgagatttgccaaccaaccctgctataagcaaatggaaacttgggtccaaattattcagaatttatgatacactactcgctagacaatcaagaatgtcaacttaagttaacagaaaacagatagcattgagtccccttttcccccaactaggtagcaaggaaattttcatcatgacaaccaccaaacattccaaggctctagatccacatgcatatatctatcaagatccacacatgatgcatggcatgctacaaccaaccaacaaaaaggttaacactgcatgatcactcaatcaaggagcacctaaacaaaaagaggggcaccaaaaaaagaaaacatgagcaatcacactcctcctaatttacaggtgctctgaaccctctgtccaaccagggtcaactcaacaaggaccggatcacagtatcacaccactcaatgactcaatcagtggaaaacccaagaccccattgacccaattccaagagctcacatgggggcaaggcaaggccaataaaaaagcaatctttgcagccggaaaaaaaatactagaatcaaggaatgaacgaacaattcagggaacaaggaaacatatataccggctcccttggcggccgccgactggatgagcgtaatcccgacgaagacgccattgctaccagagttggcattggtggagtagacctgcgtctgattcagccacggctcagagccatggactgccaccaccaagaagccaagaaccagagcagcaagagcccaagaacaacccatggttgatggttctcttctttctttgctggttcttgggccttcctcccactcccagcctctgccttcttcctgaggaatggatctggaagaaggggaagaggaggagggaagaatggaggagcagaagcggccaagcaagaaaggaagttatacgcggagccaagtgcagctggatgctggcaatggctgacaaaacaaaagcggctgcttctgggagattctgtggagcggtgtgcactgctactagtgcagctgcactagtgcttccagtgaaaaaacgtgtagtgcaattacagttgtgaagcaaagcatctccctatcttgtgaggctgtagaaatggagaagaagaagaagaagaaaagaagcaatggaaggagtcgcccggaacgtggtggtggtgatgacggaactacggaatccaggggagggcggcgaaagggtggggaaaactgtgaagtgcaattactgcttttttggtgggcgtactcgtctccattggagcaagtgacagctgggagctgagctgagcagcggccgtaggcaggctggtcacttcctcgcttgcgcttcttcgctgcagcggctacaagcagcacagctttttcatagggaggcgcaaaataattagtagtgtcggctacggccatgaatgaggaagcgcaatgtaggtcatgtttactttccaatcagcaacaatttttttaatatatacatggagcattaaatatgaaaaaaaaattaattatacagcctgtagtactaactactcccaccttatttattttttataattagtattttttattattagataataaaaaataaataaatatactttacatgtgtcttgcttttaagttttcataaaatttttaaataaaacgaatggtaaaacattgaacaaggaaacctaccactgcgttttaagtggaacggagggagcaaaggattttagttgaataggacacataccattactataaattgaacattcgttatttagattcgtagtattagaatgtgttcaattcaactaaaattcctcgcattttgggatggagaaaagtagtactactattcatactcacaaaataagttcatctatgtcactcttatttatttcaaataagtttgctttttaagcgttcattgtattagaattagagttttagaaagtagaagataaatatactataaataaataaagtgggggacaattctattggaatttagggcatgtttggaggaacttctagctgctgcagcttcttctagaatcagaagctctccaaacagtctagcttttggtccggattgtgagaaactatagttgtaaaatccagagaatgaagtagaagccagaagctaggaaacctagtttttctagattctcagaagctgactaccaaccagctgttttttagaatcttacgctcccaaacaggcccttagtaaagtgaagggtatcttaatcttttaattttgtattagtatgtgtaggatgagtgaaaaatgaaatgattttgggacggaggtaactgccatccttccttaaagaaacaatcaatttctaggaatgatttgtccatatgtatcttaaaaaatattttttaagattaaaataataaataatactcaattaaccccgtgttgatgaattttcttgttttgtgtaccatgaaaaagctcaacctttatgaaaccttatagattgactagtgagacttcttgaatttatgacggtgtagttttcataaaaaaatatatagatgattttttaagaattattttaaattttatacttataaatcgattatgttatattttatatgagtattagttaatttatttgtttgcactctcattatcaaattaatcgatagtaactctcaaataggagtatttagcattcaaccatgctgctagtcaatagtacaagtacaaagacttttttttgtcttttttataatgtttctgtaggagtatttatttgcgtattaatgttggtttaattaatagaggtgattaattcgcgtttgataccggtggctgttactgttgcttcttaataaggaggttaattagacaaagagagaagctgttaaatggtggtacaacagcaacgttttgtcgggggaggttcctagacgaaatcacatgttctgcacaagaactcgtttggacgttagtggtctacaccaactgattgatcgttttgcgacttgcgagctgtgtggcactcagccactcactggtatgggtgccatttcatggtcaactattaggaatacaaatggattaaaatattcaataacttgctcacaaaatttaaaacagaatgaaaacaatttgaaagtgaacagatcataagaagttaagaactctcctcgttaaaagcatatcccatggtgcgcttttggattgagcgtcggatccaaaccctaggtggtatgacagttttcaacaaatttcgatcgatttttttgtttaaaattttaattctcaaaaaatcatttaaaattttcactcaaagatgctttcgttctgcgtcaaaacctcaagatttcactgtttacgatcgggtttcgtcgaaaaccgaaacctagcatagttggtaagaacggggcagaaagtcctagtagtatattttaacttctctttacttctgcactctctcaaacctaaaacataaatatagattatatagagtaagtcacagtacttccccccgttataaatattttatgtttagaataagatttgattaaagttttgactatccaacaaatttttaaaaaatgtttagcttaaaattaaatagaaaggatggtacgtgtaaagttgtctcaataatattatttgcattacaaacttattgaatcaaatggatgtcattcttatataaaactaatagtaagaattttaaaagttttacccagacttattcccagtgccaaatgtagagttggctacaactctaccaggtggagttgccatgatatgtgccattccgtatacctcaacggttaggattaagccacgttaacgttaatatatacttaaaacaagtaattaactgtgcaacaaataaacttgcatcaacaacatgtcacaagatattttaagatatttttttactgtagaattgtagaattaatacaagaatttcatacttcatctattttattaaaaattatacatattacaagaatttcatacttcatctattttattaaaaaattatatatattaatattgatatggttcgctgttgcatatatatgaaaacactgtgttagtatatactgctgcttagagttgatcgactgtatgtgtttattaagaacaaatgagaacataatcaaaatagaggaagcgttgaaaaaactaattttcctatcaagctataaccattaatgttgaggagttactttattaggtaaatttaatgaggcataatctcagccgtagaaaacaatggatgatatagatttggccaactctacttggtaggggatccagaccctcctcatatgagggagtaattgtctcattctggtacacgcacgatacgtccacatatacaataaataatgctggtgcaagtaatccatctccatacaatacggtggggaccattggtcaaggatataatatgctcaaattaatcactcactagtgatagtgattaatgtacgtagcgctcgctaaaacgaagcccaactaacttttcaaccatccagcacgtcccctggatatgtactgatgtactacactactgtacagcttcatctaaatctcctagatactcccttcattcaaaattatttcaaatttcgattgttttttcaaataaattagttatatttgtagtctatatgtatctaaaacttaaatgaagaaacaaattaagtgtatgatcagaattcggaagtcataattctcctgctctatttatatattaatatatataaaggcaaagcttttgcccttcttaaaataaataaatgtactcatgatttctgtatcagtaagatagtatttttttcccgttttggaggaagggagcaagagagagagattcttcttgctcaacttaactaattactcgtaataatctcgtaaagaaatgcatggatttttagctataatgcacggcacaatcatttccgggagtactccctccgtcccataagggattttgagtttttgtttgcaacgtttgaccactcgttttatttaaattttttttgtaaatataaaaaacgaaaagttgtgcttaaagtactgtagataataaagtaagtcacaaataaaataaataataattttaaaaaa

SEQ ID NO: 74059 - DNA, 6027 bp, Oryza sativa
  unsure (1)..(6027): unsure at all n locations
cataatttgtcttaacgggaatgaatctcgccgtcnnnnnnnnnnnnnnnnnnnnnnnnnaaatggaatcatatcctgttgcggttttgggcaatccaacaataaaatccatacctatctcatcccatttccattcgggaatcctaaggggttgcagcaagcctgccggtcgctgatgctcagccttcactttttggcacacgtcacagagtgctacgtattccgccacatctctcttcatgttgggccaccagtatccttccttcagatcttggtacatcttcgtacttccggggtgcaatgaatatgccgattcgtgagcttcctttaaaattaatcccctcagtccaccctgttcgggtacgtaaattctctttttataccatagaacatctttttcgtcggttgaaaattcctttgcacgtcctgcagctaagcgttccttcacctctcggacttcctcgttgtccttctgggcttcttctatttgggttctcaaaagaggttgaatgtctagggtgtttatccgtccacgacgtactatatgtaggttcagctgagctatttccctcctaagctcagggaccaatccttccattctcacatgattgcaatggctcttacgactcagagcgtcggccaccacgtttgctttgcctgggtgatagtgaacctctaaatcatagtccttgattaattctaaccatcgcctttgcctcaagttgagatctgactgggtgaagatatactttagactcttgtggtcagtgtagatatcgcaatggtttccaattagataatgtctccaaatctttagcgcatgaaccacagctgcgagttctaggtcatgggtagggtagttttcctcatgtggtcgcaattgtcgtgacgcataggccacaactttcccgtcctgcatcaatactcctcctagtccttgccttgaagcatcacaatatataacaaagtcttttttgatgtcgggaagaactaaaataggtgccgaggtcagcttttctttgagctgctcaaagctttcctgacactgttctgaccacacaaacttcttttccttcttgagtagttgtgtcattggtcgggctatcttagagaacccttcaatgaaccgtcggtagtatccagccaagcctagaaaactctgaatttcagtcacatatttgggtgctttccattccgtgacagcctccactttagcagaatccactgctactccaccggccgagattacgtggcctagaaaagcgacttcttttaaccagaactcacacttgctgaattttgcatataacttatgcttccgaagtttctcgagtaccaatcgcaagtgttccgcatgttcttcctcatctttagagtagattagaatatcatcgatgaataccaccacaaatttgtccaagtagtccatgaacactttgttcataagattcataaagtatgccggagcgttggttaaaccaaacgacattacggtgaactcatataatccatagcgtgttgagaacgcggttttgggtatgtccccggttctaattttcaattggtggtatcctgaccgaaggttaatcttagagaacaccttagctcctttgagttgatcaaaaagatcatcaatccatggtagtggatacttgtttttaatagttactttgttcagtgatcggtagtctacacacattctcatgctaccgtctttctttttaacaaataacactggggctccccaaggtgatgaactggggcgtacaaatcccttctcttgcaactccctgatttgctttttaagttcttctaactcattgaccggcatccgatatggtctcttggatatgggggcagttccgggtatcaggtcaataatgaactctatgtcacgatctggtggcattccaggtaaatcttctgggaacacatcaggaaatcgctgcactacgggcattccctttaggggtagcatggtaaatatacctccggcacgttcggttagcctaggatcttgatccatggttgctctcatatccgatccccagggtgtggtcagggtaacttctctatgtctacagtcaattattcctctatgctttgctaaccaatccatacccaaaatgacattaagagtttggggtattagcaccataagattggagggaaataccacatccctaaggcggatgggtacgtcaatgcaagctatatccactgctatctcacccccaggtgaatgtactaacattggttgtcttagtttaactctggttaaattgtgttgttgactggctttcaaagatataaatgaatgcgatgctcttgaatcgaaaagaactttaactggagtgaagttgagtgaaaatatacccatcagtacgccttggtcttcctgggcctcttcagctcgaacgtggttcacttgcccgcgtccaaatccggtagcggtcctgttagtctgcggagtcctgaatagacctcgtccagcagcaggggtagcagtcccgtgaatagccgttgcattagctccggtgcgaatgggtgtcttgtttggatgaggacatttattggcgaaatgcccgtactctccacagttgaaatagcttcctggccttactgatccagtggcggcctgattcggtgcaggagcgcggttctgaatggtaaccggcctgtggaaattgctggaggcggcaggtcgactggttgtcaccactgttggtctccatgccgaggaggttgtccctttaggacgctggggtgcggtctgaggcgagcggttcatggcaagcctccttttacgattgtgctccacgaccttccggtcgttctccagcctaacgaccttattgattaaactctggaaactatcgtggtcttgtccaatcatgggcccgcgtaatttatcattcaagccttcaatgaatttgtcgatcttttcctcctcgtcggcaagatctctagtcgcgtagcgcgccagctgagtgaaacggttcaggtactcttgtactgtggtattcccttgctgtagtctcctgaactcattcttcttcatccgcatcaccgcagcaggcacgaagttgtcacggaaggctgtggtaaattcctcccagtttggttctccggcatcttcttctcgggcttctttgtacgtgtcccaccagtctccggctggtccttccaattggtttgccgcaaagatcactttatcggcctcacgtactcgaacaagagttagcttcttctcaatgatccttaaccaatcttcagcatccataggttcttcagctgtggcgaatgtgggtggcttggtcctcataaactctccaaagcttgaccctccgcggtcgccttggttgttcgcgatagcttgcagaacttgagtttgggtggccataactccggccagagtggttaagtcgggtgtctaagtttcgtcattgctggttgttgcccgacgtcggcttgccatctgtgtaggttgatggagtaagtatcctaattttctaactagctcctatggctttatcccattaagggagttgtgttgatatgaactttgttttgcaagcatggtggaataaactcatttataacacaacaacaatagatatcataaataacatcatagagtttcacaaatggtacataaatcatgatgcaatcgactgcatacatacgcagtccaaataaggttcatccaaaagatacatcaaactaatcatcaaactactcgtcaatctaggtaagggagggggggtgtctcgcatactatccaaaaatccatctgatacgagatcgaagctgcaaggagtccgtcagtctagtcctccagccatccgcaggatcctggggcaggtagagggtggtcgctggcacgcgcaaacctgagtccccacggctcagaagtagtggcctctggatctggcttgggcctcttgcccggaggtcgtgtgctcttgcgagcagtgatgagggtgcgaggacctccaaggaaggtgatgcggggaacaggggtctcatcctctgaaggatcagtgatgtctggctcgatctctggctcggtgtcggtcccctctgtctcggagtcgacctggatcggagtctccaaactggaacccagctgcggagaaagtgtaaggatcagtggagtgtgcaccatctccgggacaggtggctgtgccgctgtcgggtccactaggtaaggtgctgactcgtagctagcatactagcctctcccagaagagcatggaacgccggtgggtaccgcggggtgaggaaaaagtagcggtcacggcctactgctgtggaagtagaagcccctgtggtgctgatcttggctactcgaagctgctccttcagctggctgacgtgctcctgactctctctcagttgctcctcaagagtatccatcatcccgcggcgatcgttgtactggccagataactgctggaactggtcgccgtggacctggagctgtgccttcagtgagtctatctcactgccccaagcctggtgctcctcctccaactgaagctgctgcactgagaggtcagtcaactcagtctccagctctcccatacgtctctggtggtcgtcaatctccaacagagcctcctcgtagtagtcatctactgcctcagcccatcgtgacaaccgagtcaccatcgggttgtagcagcagggcgtgtcctgaactgtgcaaactgagttgctctcctcccggaacgggtgatgagcaaactaggtactcactaactcagctcggtggatagagctgagtcggaagaaggcctcccgggctgcatcctgcatcgcggtctctggcaggtctcggtggtgacgtgtctgaaagctgtagtccaactcggaagggactcgagggtgaaccttaacccgagccttccaaactgagccacactgtctcactcggtatgacgggaacccagagtatcgcagacgcctcaacatccgatgcagctcgatgacatacccctctgattgaggtaagctcaactcccaggtagcgggtgaatccggatctgccatctaattttaagaaaaacccaaagtcagttgagagtaaaacttgttttgtaaagaaaatagttaagagtaagatgaaaattgtaccgagttttgtaaacatagcgtttttatttttgaaagtattactaaatgggaatttctcccttggccaacttagaaaaggggtggggcgccttttggtcttttcttacagtcgtatggctctgataccagctctgtggacccccgtttttataacaggaatcaattgtgtaaacagtaccatttccctggatcaagtagtctggtacacacgaattcatagctgaaataccaagtgcacatacacgagtgtctaatacgaattattacatcataaccccgcaggcgtagtcttaaatcatcggaccgagcggtccggaatacatccaaaagcagaaatagataaggcagcggaattcaggcagcggcatgccattgccacaggcaacgaccgtactaagacctactgagcgccatcgtcttcatctccctcctggtagtaggcatagggatcctccgaggcttcatctcccgcttctgattaattttatatttgcaagggtgagtaccaaccgtactcagcaagccaccacagcaatgatgcacatgacagaggaattcaaaggatggctatggttcttttgcgcaaagcaagttttgtaattcttttcacaagcctaagacctagcatagactgatcaagttttaataccagtgttcatattaaacaatgacggttctgtccaccatccattgtgatcccaaggatagcttcccgccattgagtcgttatggttttctgaggacgtccacgttccccgcctctcaggaagtggctccatcagcataaaaatcatcatgcaatatcccatcccacacaagttaaagaatttagagtctagccaagtgtaatacatgtcccggtgctcaataaccgcgagcaccgctatt

SEQ ID NO: 74060 - DNA, 1373 bp, Oryza sativa
attcctgcagccctgctgccatgatagattaagttaggtagatctatgagatttctttaatggaccatgaattatctaagcacacgcatcagtacaatcacagtagggatttacctatatatcgtactgacagtgctagcagctaatccttgttcagatctgtgcaaaaaaaaattactcaatcttatcggctgtgcgaggtctcaaatcgggttaacttaattcaatcagtgactgacagaacccagttgcgaaatggagtgtgtaaaacagtagaatagtagcgtattccgtacttcaagaatggcgcagaaagcacgaggaagtacagtatcccagttccgtcttagtaaaatacgggttaggataaataccaaaccaaagcctaatatatactatcgtactaccagtatattttgggaagaaatgagtaggtacgagcatgcaatgcgtcaatggcggagcggagtagagagcagaaggcgcgtggaaagctgcatcggagcacatggatctgctctgcatatgcctgattttgcattgctactgcttcagataatttactcccaactctgaacaagtgacctgcctgccatatttatattcgctgaatcttgcgctaaatgtttttttaaaaaaaaaggcgagtagaaatacagaaaccgggaagagtgatctgtagcatgggtcaagcaaggttcagagtcttcagacaatcagacaacatgttcggctgtctcgtctgtgtaagaagttcaacgcatcaatctattatagccgggccggcatatgaacaggaacagccacccaaaaaaaaaaaaaaaaaacaggaacagccaaggaaaggaaatggagcgagtgttggtgctgcttattattcatcaggatcgcattcacgcatactcctatgctgttgctgcttggcttgttgactctcattggctgtaactaaccatgttcagagcaagtagtgtaggaggtttttcacttttgctgaatcagcgtgctcgaacgcctctccaattattcatattgaacgacattagagatgagataaccatttggaagaccgcaaaggttgctcgaatcccctgatggatacgaaactcctatggcgcgatccatcgcttggggcgatcggttccctgccccacacggtataccgttttactttcctattttactaagtttatacatatcaagtttgcacatttaaagtttatacaagtttgtacacctaaagtttgtagacctaaaacatattcaaattcatctttaaatgcatttgaattcaaattcaaatttgaatcagtatataaacttttgacctataaaaaatgtgtaaatcctagatgtataaactttgggtatat

SEQ ID NO: 74061 - DNA, 5687 bp, Oryza sativa
caccctagaataaacaaaaccccaactagtggacactctactcctggtatcactagtatgattttaggtagatgctacgctgtttaattaggtaacattaggtggttttacaactctagactttgggatattcatatcacctggacactttggaattgttggtttattgtggaattggattcacaccgccccctctattcaaaatccccaaaatggttttaggctgggctcggggtgcatggttttgatagtagcacctcggccatataaggaccggtcttcgggcctctgttgcaaagcactaccgtacttccacatgtctagtgggtaaggcttagtttgtggctcagtctggttataaacaaaagtacacggatggagatggacgaagtcgggggtcgatggacatctctaggacaaatgaaggctacacgagctgcggcccggtagtcgagatgtcatggcacagggccggtgtcctgctgctaggggctcagtcctgcctacctgtcccgggggttccggccgtaggtggggttgggtcggtactcttgtctatggctaggatgggttggaaactatgtcacgtcttccgtccgtataccgtggtggtatgtggcacgtggttacacgtgaggaagatgtgtcttgtgggtaaagatgtacacctctgatcagagtataatctattcgaatagccgcgccctcggttatgggcaagccgagcaatgtacccaagttagtgttttaattcttaaaatttgcttaacaactaaaatgtggaatggttggcctgggttggcttgggacgagctgggacccagggtcgggttgccagttcggtctgaatcatcgtaggccttgggttaaggcaggttcgtgtgggttcacggccttgattaataatattgtatagctctaggatcgtgtttacaaaatagctttgggcaactaagtgacttttaaatgctgtttactgcaaaacttaacccctatattattatccccttgtacccccttgcattaattatgcatctccggtgtggcttgctgagtactgtggttgtactcattcttgctctatctttctccccccttcagtaagagaagctttggagaagaagtcttaggtggagtcttggcttataccccagttgagcgcctgtgaagatggagccgtaggcccgctagtccgctgctgtttatttttgattgtcaggccttaagtgcctttgtaataatgtaaatattatcgatataataaagatgtgtcttttatatcatgtttgtatggtgtaccccggcttttcctgggacggggattaatacactagcgttcgggaaaatgcaattttctcggtcgcgacaatttccttgacatacaagtttagaatttaatccgagtcctcttaaagatattctttctatacatggcaccccatacctagtcggactatacatgccgtgtaggtatggggtatccataatctccacagtagcccctgagacctttacagtcgacgaaacaatctcttctcgtagcacaaaatgataatccgagtactccgacttcttctgccttgatctcccgagtaccaaaatcaaagactgtgaaggtctaaaaatagaaaaaaaccgggtgcatcgactagatgcacctaattaggtgtagcccccgactatgtgattagttaaaaaactaaacatatagtcaagatgcaaactacatccaacagagtggtttgacaactgaatatcatatagcaaagcatatgcggcgttcaataaaacatccagccgactgcttttagctttaatataccaaaaatgaagatatgaaaaggcccgagtgaaaaacactctaaagatccataaattcacacatttgataagaatccgagtaaaaactctcaaaaagatccatcaaacgtgatataaatgtgataacataacaagtgatgagtctaactagcttaggctatgactcacaccagaaaaataagcatataacatgccgagtgaatgactgtattaaaaccagtcatctcaataaaacccaaacagccttcgcagcctaataaggcctacaaaattagtataacacctttctgttgggcacctttttatttgcatcataataattccaaagaattatctaaccgcatcaaaaatgattttaacagcatcgggctaaactgtcgtgagcaagtgttgccaaagcaaaaatacctaagtccctaaggatcacaactagcaacgctggtaatagaattgggctgaagtactgtaacatcccggcctagggcttaataggattaatagaatactcatatcaacaagttgcaacttcttttccaaaatccaatctccaaagaactccagggttaagcgtgcttggcctagagcaatttgggatgggtgaccgaccgggaaattcttcccgggtgcacacgagtgaggacaaagtgtgcagaaaagacatgtgttggtctgtgagggcagtctatgacctatgaaagctatcagatgtaagcgggcccggcctgggggaaggcgggacgttacaaaatggtatcagagccgactctcgcggtttcacgagaatttcccgggtgcacacgagtgaggacaaagtgtgcagaaaagacatgtgttggtctgtgagggcagtctatgacctatgaaagctatcagatgtaagcgggcccagcctgggggaaggcgggacgttacaaaatggtatcagagccgactctcgcggtttcacgagaatttcccgggtgcacacgagtgaggacaaagtgtgcagaaaagacatatgttggtctgtgagggcagtctatgacctatgaaagctatcagatgtaagcgggcccggcctaggggaaggcgggacgttacaaaatggtatcagagccgactctcgcggtttcacgagcgcgtgtgtcgcagttgcgcagtaccatttccctggatcaagtagtctggtacacacgaatttatagctgaaataccaagtgcacatacacgagtgtctaatacgaattattacatcataaccccgcaggcgtagtcttaaatcatcggaccgagcggtccggaatacatccaaaagcagaaatagataaggcagcggaattcaggcagcggcatgccattgccacaggcaacgaccgtactaagacctactgagcgccatcgtcttcatctcccaagcagaaatagataaggcagcggaattcaggcagcggcatgccattgccacaggcaacgaccgtactaagacctactgagcgccatcgtcttcatctccctcctggtagtaggcatagggatcctccgaggcttcatctcccgcttctgattaattttatatttgcaagggtgagtaccaaccgtactcagcaagccaccacagcaatgatgcacatgacagaggaattcaaaggatggctatggttcttttgcgcaaagcaagttttgtaattcttttcacaagcctaagatctagcatagactgatcaagttttaataccagtgttcatattaaacaatgacggttctgtccaccatccattgtgatcccaaggatagcttcccgccattgagtcgttatggttttctgaggacgtccacgttcccgcctctcaggaagtggctccatcagcataaaaatcatcatgcaatatcccatcccacacaagttaaagaatttagagtctagccaagtgtaatacatgtcccggtgctcaataaccgcgagcacggctattcgaatagatttggtttactcacactgcagtggatgtacactttacccgcactccgcgactgcccaacacatgagcctcgtcccaacacatgagacgcatcacggcaaagcttttcgataacctcgcattggcagtacccactccatgaacttaaatcctcatgcactctaggcgtccatgtttctagcagtgagaggagttctggcgctcccgggaaagagaagtctctcacgcatattaaattatggttcaagttaagttctctctctcacacactcatggcagtcctaccaatggcgacaccgatgtagggcacgcttctcggccctacctcaacggctgtcccatcgtagcgcacctgcctcactcaggggtgaaccatctatgcaaggatactgcctccgctcggctatctaatccgctaggtctatacccatacaagaagtgcggttgtacgggggttgtttcatgcttaacttcatggctcggttcttaattgaccggggacggtactagccttttccagataccacccaaatcctccgtccgccccagtcaaaaacagttatttaattttatttctcctttcacaaatcatgtcatcaacatcatggcaatgtggcgctcatgtctccacatgccgcatctcaattaccttcccaaaggtaattgccccagcatatagcatttgataaatatgagtatgcatgattctagaatagcatttctaagcaattgtcatagttgactagggactcatacgtaaacattgttacaaagatttaagggtaaacaataatcaaggcatggcataatcacaagtaggatgttcatcattgcatgcaattttatttgtaaacaaaacaatttcgcaattgggatcaacatgttcaaggaatagtgatgacttgccttgctcagagtcttgcgggtcttggccttcgcttggatccgcaactctctcgggctctatagttacgtgcaaaaattgatttgaattcggttagaattcaaataaaaatccaaataaatccaaatgaaagtcgaatgtgaaagtcgattcctttttattaactttactatctgcgaactacggcaaacccaattttgacttaaactattttgcgggtataaatattttgttgtcataagtttttaatttaatctacccgagcattatatccatataataggttagagatttctatcacgagctaaatatcggacgaaatcctagaaatattatatgatttaatttagtctatgactaaaagattaaatataatgcacggctaaaatccctagtaattaaatccgaatttctaccgtgaaccgatgacttttagagattaccaaaaataatctataataatctataagaattcatctaattgtttagttattaattatatctaaattactaccaattttaatctaatctgatcaagaaacatatttttataattaactcggaatttcgaccgaaatactattacgctcgagcaatttccaaaaataatctacgattaaccccgaccatttttatttcctaaatcctcctaatttctcccccaatttcccttctattttctccttttcttcttttctattttccctctttttctctcctctctttctttttctctcttttctcttttcttttctttctctcctcccggctccttcctcctttcctctcttttctttttctctgctccctcccggcttctttctatctctctctctcggctctttgcttccccgggcggcgacggcggtgggcgcgaggtgaggggggggggagacggctcaccggcggcggcggtggcggcgacgacggcgatggcggcgcaaggcggcgacgcacggcgcggcggctccggggcgacggcgcggcggcttcgaaggtggcgg

SEQ ID NO: 74062 - DNA, 735 bp, Oryza sativa
cttgtgggcaatttgtgcttgtggctagaatagcgagttagcaactagcactgaactgttcaggttgcaggtctagcaatgctcttggctctaagctcttccggtggtgttcgcgcgagaatcacacgtccgtcaggaagctgttggaggtggatggcacgtcagagagatcaaaactcctgaacaaagtatgtgccctgccagcaactggttgtgttcacttgttagtgttagccttcgattttgcaggcatcagtaatgagtttagttctgtatgtttcatctgttcaatcgttccaccatttgggctctaccaagtgaaagctatttatatttcccaagtcctctaattattgttgtgagttcaaactagtgcatagtaaccttgtttaaatacaatgcgcatatacttgtacattaacttccttgatgttatgacctttatagtttaagcctatgcaatagctctacttaatgacgtctggatttgatttgcacggctctctgcttgatgccactcttcactaataatgtcacacaactattcatctgtacttgctgtgaacagtgaacattgtctggattatttatgattgcaggtgtctgttttgatgggttatagtaatacacaagaattaattgagcaagaaagagcccgcagaggatctgctacagaattgatcagtgtatgcaaagaaattgagttcccagaaatgtgtgcagggctgcaggaat

SEQ ID NO: 74063 - DNA, 724 bp, Oryza sativa
tcctgcagcccagatcgacgcagctcagcctcgatcccaatcactgtcaagtcagcgtggcgactgatgaggagcaccactagcactgttccatttgtaagtactctgctagctactagcacaagcaaagcgatgcagggatcagctagggattcgtcagcttggccgtgctgataatataggaaatgcccttggtttacaggtctttcattggacgcaccggcgacggctttccccatgtggtgttcgccggggttagcgattttgatacatatatctggcaggtgaaggtgctgcgccgtcgagatgcgcgcgcggcgacttttcggcgcgtcaaacacgagaagcatatagaaggaatagaatagttacatggagctggtctttagccaaattctcctgaaatgggaaagcctatgggagaagcgcagatgtcaaccatcgacccttgcattatttggaaaattctaagcttagggctaatagcagtaggagagtgtggagtgtggtatggtcgaagcgtacaggccggtacatgggactgatggtcccatggctatggaggtctaggctggctttttctagcaagatatcatattattgtacaagcttcagctctcaaagatgggtggagatttggtggtcctgaaggaatgttcatcggcaagaatgcgtttttagtaggactagtgttcatcttgcctgcagcttttgttggcacact

SEQ ID NO: 74064 - DNA, 5010 bp, Oryza sativa
gctagggaacacaagaactaaagtggaatggctaaagaatgagctggggtcgagttggctaaatataacggctaggtgacgtcatctagccgttactcacatatttgaactggagggttgccaggaggttccgggcctgggtgccaggaacttccgggtaacacttaggaaaattttcaacctcacctcagcgccaggaagttctggacagaacctccgggtgggactctctgtcccaagtagagccattttcaaaaacagctcctaaaaatatttcaacacttggacactactaagagcacttgtgttatctcagaaccacacttggaacccctcttaatagaacggcttttcctaaattcaaagcgaaaaagtaaactagtctaactcggccccgagtcttctcgccgctttgattttgatgatttgggggggtctccaagcatcctagcccactcctaagcaacctgggactaatacaccactaggaatgtcatcttcttgcttcaccttgagggttctcaacgtcaacgccatttcactattaagactattctcacctacactcattaagcatattagtcccaaatcaattatatctttgccttgatcaatgcccactttggattttgacttgatgttcatcgaagaaccacatcctcttgatcctcggcattccatcttgcggtcttcttataattgatacggattactcataacttcaaatggcctcgcacggtccatcatgaccatcatgacaaaagccttcactcgcccttcaccaccggattcggtccatcggcgccaagcctcttgcttgcccttcaccccccgcatggtccattatagccgagccttgcttgcccttcaccgttttgccataaataaccacttcataccccgcatcatcaatgtcttcacttgctcctcatcaaggtataatgtccatcttctagccgagccttgctttctcttcaccggtttgccatagatagccatttcataccccgcatcatcaatgtcttcacttgctactcattaaggtataatgtccatcttctagcttcaatcttttaacttgatgccggaacttaacctaatctcaccaactcatggaaatagttagttccaacaatgggttgtcattaatcaccaaaacaatcaccgcactcttaggatcatagatattccaatctccccttacaaggcaattctagtgcatagatctttcaaaattgtctaactcttaagttcacgttaagatgctattcatttaggatgaattaaggttgcacagagagattcattgcgcagcaaagagagacaaaacgagatccttcgttcattaagatttgtaaacaaagagggaacaccagtagggaacttaatatatcagagtaaaagaaatttacttacaaataattaactcatccatacgattttaattcccagaaggtagaatagcattgaattgcaggtaaattcagaaccgtagttttctttaacaccatgatcaaaactctagtaaatttggaattacgcaaatcttacactgcaaaatctcaccagtggaccagcaattatctcatctcaaccctatagaacacgtacgatcaaggagcaaacataaataagatcccctaattaatacaaaacgatcactctaataacactactagtcttactactaattaatattttgatagcaaagtgtcacagcttcagcttcaacttcgcatcagtctccactcttcttcttcttcttctccgactgctcgtcgccgccgcggcctggccccttctgctgccgctgcgctgccggcggcggctcgtcgcgcgacttggagaccatcatccccattgccggcgtcgcgtataacctctccttcgccctctccttgcgtgcgcattgcttccttctggaggagttgtacgtcgtccccgacgcgcgctgcagtccgtgcgagctcatgccggcgagcatgcgcgcgcggccggcgcgctcgtaccgcggcgcgtcctccacctcctcctcgagctcgcacaggtcgtccgccagctcgtcgcacatcacgtcgccggcgaaccccggcgccgacgcctccaccgcctcccggcgaagctggagcgtccgcgccgcctcggcgtggtcgccgcgctcggccgccgcccgcgcgatcgcgatgtcctcggttgcctccacgcgcacgcgctcccgttccacctccatggacacctcctggtccgccgcggacacttccaggggccgcctcacgacggcgtcctcgccggcggcgacgtcgatggttcgcccggtcaccgtgtcgcggtacgtgcagctgagcttgatcagctgggtggcgtcctccgtggcttcggcgatcggcacgttgatgaacaggaggaagcgccgctcctcgtcggcgtagagctcgccgacttcgaccgacgcggcgcgggcccgtccgcgtcgacgcggctctcgtagcgccccgacttgatctcccggacgagcacgcccgggctcgagcacgccacggcgatgcgcgcgtcctgcacggcgacggaaaggagccctccgatgcactgcgcgaacgagtcctggatggccgcctcgttctcgacgaaggagaacgtgccgcccgtcgactccgcgatggtgttcatcgccgccgcgtcgtggtcggcgccgaagccgaacgtgtggatcggcgcgagctggccgcggccgccggaagacgcgaacgaaggcggcacgaggtccatgtaactcatgccattgccgcgcctcgggacgacgtacgagtccttcccgtcggacaggaggatgacgctcgagacggcgttcttgtgccggcggtcgccgagaacgcggccggccacgcggaggccgtcgccgatgttcgtggcggagtcatcgacgagggactcgacggcgcgcttcgccgtggccttcccgacctccgacatgcggaggagccgcgtccggcggctcgcctcagtcgagaaggagacgacgcagaggcggtcggcggggccgaggttgtcgatgacgaaccccatggccttcttcaccaacgccagcttcctccccgccatgctcccgctcacgtcgagcaccgtcacgaggtcgagcggcgcgcgcgacgccgccgccgccgcggccccggccgccttggcgtgcacgagcacggcgaacttgtcccgggacgcgcccctcgccacggccgggtactcgcagtgcgccttgaccaccaatccagccgcggcatcgccgtcagtcgccgccgcctgctcgccggccggctccaccggatcgtcgtcggcgtacaggggaggctcgtcgtcgtcatcaggctccaccgccgcggccgacgacgaggacagcgccggcacgtcgctccagcgcgcgttgcagagcgggcagacgcggcggccgtgcgcgacgttccgggcgatgcagcggttgtggaaggtgtgggagcactccgccgtgaagatggcctgcccgccggcgatctcgccgaggcagatggcgcacggatcggtctctctctccatgggtacgaccgtacgacgaagtgacgaacagttgggacctctggtagcttcctcgtgcgaaaccctaacgatagatgcgagtctttataactgcggcgacttcaattaaggagatagatagcatccgtgcacttcaagtgcaaggtttgttttttttttttgaataaagttaagttcaaggaattaactgaagagaacattccaattaacacgtatctccactcataacactctcaattaaattttaggccttgtttggatgtaccacgttcctggcccatagacgtttttgtgccaagataggggaccaatcggattggagtaagttcactttaggtcctcatgttgacatcgagtttaaatcactcttaaccgcaaaaccaaatataactagaggtcaggaacagtattgtactattgtgtctagttccgactgacatagtgacatggcatgttaattatgatcaacccggctaattcagtgtgaaaccctggtggcaggggctatcgtcctctacccctcaactcctcaggtgcgtcgaggttgaaaaattacattaggctaggcacataacatttgacaacggttttttttcctttggcacgtgagatcacgtgatggctacaacatcaccaacacaaaaatgttgcaacacaacaaaacttccttgttgcaatgtttaccacgatatatttacaataggtgtgacatggtgcacgggaggtgttcgtccgttctagcttcttctcctctccctgtcccgctgctgctgctgcggcggcggcggcggcggccgcgtcagctcccgcgacctgcgcgaccggtcgagcatgtccagcatcgccggcgtcacgtacgacacggtgatccccgtcgggagctccgacgatcccccgcctccgccgtgagcgtggcggcgcggcgccacctcgccggacatctgcctcgacgtggcgcgctgctgcgcgtgcgagctcagcccggcgagcacgtacgcgcgcccggacagctcgtactgccgccggtccgccacgcgggcgcgcatctcccgcagctccccggacagcgccgcgcacatggcgtccccggcgcgcgccgcggcggaccgcgccaccgcgcgctgcctgctccggaggatctccgccgcctccgcgtactcgccgcgctccgccgccgcccgcgccagcgcgatgtcgtcgatggcttccacccggacaagctcccggtccacctccacggagcgctcggcgacgccggactccgcccgcgacggcctgagcaccaccgcctcctcgtcgccggccacgctcgtggtccgtccggtctccatgtctcggtaagagcagcttacttcgatcaggtgggtgacgtcatcccaggcgggggctctcgggacgacgacgaacagcaggaagctcctctcctcgtcggcgtagagctcgccgacg

SEQ ID NO: 74065 - DNA, 33926 bp, Oryza sativa
acatgccagccaccaaattaaagagaattggtgataacgtgtccccctgccttagtcctttttttgtttgaaagaaatttctgatttcgtcattcactttgattgccacactgcctcctctaactatttgatcaatccaacgataccgtaaaggagagaagcctttcatcctcaaagtttgttgtaagaacctccaatccactttatcctaagctttttcaaagtcaagcttaataaccaccccattcttcttcttcccgtgcatctcgtgaattgtttcgtgcaaaataacaacaccttccattatgtttctcttgggtaaaaaggccgtctatgaaggtctaatgatcttttgagctactagagctactctatttgctagtaccttcatgaaaattttgaagcttacattcaataagcagataggccggtattgttgaatttgtttggcctccttatgtttgggtagaagagttatgataccaaaattcaggctgggtagtggcaattcttctttatgaaagttattgaacatggccattaggtcctttttaatgacttcccaaaacacctgaaagaactctgcaggaaatccatcaggacctggagccttgtgtgttacaattggaagatagcctgctttacttcctcctctgagaattcctttgttaggatgtcattttcttcatttgagacttgaggaatgtcctctattctagactccctcatagaaaaattattttcctctggggtccaaagaggtttttgtaatattttgtaatgtactttctcagctatacgtcacccttgaatacaccctcctcttgttccaactgaaaaattcgagccttccggtgctttccgttagctatcaaatgatagtattttgtatttctatcaccatccacaattctttttgttttcgcccgttggtaccattttatctcctcttcccttagcaaaagtgctaatctattttttagatagttcttgaggtttaactcttgttttgatagacattgcttctcagccttcttgccttctctttcttgtatgctccacttgtatttttcgcccatcccctcaaaaattgacgcacccgacgtatcctattttgccatctttccaactcagtccccccattaacttcctgtctccatacatccgctaccatgtcatagaagccatctcttcacaaccatccaagctcaaacctgaatattggttgtttaggagtattaacacccgtgtccaacaatagtggtgtatggtcggaacgttccgtactcaaagctcgattcgaagctagaggatacttatgttcccattcggtactcatcaaaattctatctagcttctcaaacgttggttttgacaaggagttagcccaagtgaatttacacctagaaagttccaactctcttaagtccaagctatcaatgaccgcgttaaagaggaaaggccacttctcattgaaattatcattgttcttttcagaaggatttctaataatgttgaaatctccaccaaacaaaacaggtagtgactccttactgcaagaattaaccaactcaacaaggaaagcttctttgtattcctcttgggccgccccatagattgccatgaggatccattgaaagccatcatccttatttttaatgtggaacttaatataaaactcaccttcatcaacgcttgaaatgtcaaagaccgcctcattaattcctaacaaaatacctcctgatcttcccctaggtcttgtccaatgccaaaagaaatcttggcctccacaaaaactcttaagactagcgttggagaaatcatttttacatgtctataaaagggcaataaagtctagcttttgctcttttgaggtatccgaaagaaatctgaatttagccaagtctcccagacctctgctatttcataaaattcccctcatgatgccctctttttgcgaatagcgactctaaccttcctctttcccctccttatctcagcatttttcctattagatttattggagaatttttgaacaccacaacttaggtggtctttctcctcatccatgacttcttctactaaatcaccacataagtgaccaagaacaaggttatctaactcttcttctccttctgaactaaatcccttattgttaacctcattacacaaacaattcgacaagggtaaactcttagaaattctatcttcttctacttctctaaggctcaaaatagaatctgaaattttactgcatgaacccccaagatctaaccctatgttgagcaagtctgaaacgatagaagcatttgaaaaagaaagaaacgaattactcgcattattacgtgattcaaggtttttccacgcctttcttttcccagccttctccacggcgtgtgcctcatccatgccggccaatctggagctagcccacgtcggagtagtcacaacctcgctaacatttgcagccatcaagatttgctcctcctcctttgctttctctcctctttcaattgcagcagaaaggttgttctcttccatacccactccctgtccaacgacttcttcttccatcacctcatcataaaccttattaagcacattttccattgccgcctcaacaacctcctctgctgccatctcagctctgtccttctctaaagtgcagttgccgagatcatcatttgctgccactcccgttcctttccctgcaacatccccttccttcccatcctcttgcatatcatccccttagctctcttggtttccctcgaaatttctttatcaacaccgtgttcctcctccttctcagcctcctcatctcgatccccatcctcctcctgttctatctccacctcgtcaccattctcgtcaacccccaatttctccacttcaaatttcaactcaaaataatgatctccaatcactacgtccagatttttcggaataatccttggatttaaaacagcaataaacacccttccaaactcacttttccttgttgttttcatatcaactgtttgggtggcccctaataaggatcccacagcccaaagaggaagaaactctctcatcttctttcgtagccaaacaccctaacccacactttcggtaaaagaaagccttcctctttctccgaccactcctcaaaaagtaaacggatgccatttgatattccactttctttcacatcagccctaccaaaagcaatggctctcttcaaatcagctctcgatggaaagggaactaagtaagagctgatatcatgctcaaccagttcccacttccactttgccggaaaaagcttacacaactgcgccgccatctgttcctttgtaagctgcccccctgtgcaagcaaccaaagccatctttgattctttcttccccttaagtaacggaggatgagggatatgatagaaacctaggccctccaaagcgtacccgacagcatgtgccactggtcttggttgcttaagcacgtggtcatgtgaatcacaaatatcacaatatatttctattgaacatccttagccaatgtgacctttttgataacatcttgaacaaaacttggccttggactgagttttgtgacgcctgcctccctcattataaacttcttcctcctcgaggtcaccatccatagacattttctcctcttccagcccgagaacaattccttcgagctccttcttctctacttgatcagccaacacctccctatctcctatctttacttgcttgctgcctccaatcgaactcgcccccattgcctcctttgctttccggatggttgttgctttctctttggaaatcccctgctgccaccttccctcattaccttcttgcatcggtcggtttgcaggacgctgctgccacggtctttggatgccccaggctggtccctctctacccggccgccctgcatagccgccccattgcgacccgaagcttcgcggtcctctcggtctaaagccgctccgctgccactccctcctatggcctccttgctgaccgtagccatacccgggctgaaaacccatctggccgacctcaaggcttccgctaaagaaagcctcatcttcatcgcgaaacacctcctccctgctagtaccccctccaccttgcctgctgcgatcattcctccacgccatgcctccctcctcttctcctactcctttgtgtgcggataacccctcgccgccggccaggaagccaacagtcgcactgctctcgctttcccttctcttttctgtaaaaagcgaacacagctgcacggtgtggcattcccttgcctgttcgacttgtaccggcgtcggttcccctcctgtggcccttttaccacggcccaagtttgcaagcagccggcccaaaccactagtaaacttgaatttaaaccttctctctttaatccccacccagacaaaaacctcttccttttcttttcctctcacaccgattgacaacaaatcgaccacgtgatctgtctcctcggttctcgtcaccccctgtcccctcgcatttgaaccttgaacagtgaaggacgtgcacctttctgtgcgacacttcttgaatcggccatagtaccccgggaagataaattagaattcatatgaatttgaaaattctatgcagggttgcaaagctatctttctgaattattagatcaggcactgaagaatgaatagacaaaaaggaaatgaaatcaaacaagatggctgcagtctattcaatatatagttgcaactgtactttacaggtcacttccttgccatgaaggaacaatctgtaaatacaaactattaatgtgtcagtaattcaatttgtagtaatccgttgtgagcatataaaagagagaaatttaatcttgaataaagctaaaacagtaagggtaccaggaatcctaaaatctaaaaataaaagaggaaacatcttgagcagaaatcgagtaatcattaagatacatagccatagggcctcttgattccgcagctgtctgtaggaggctaggagcaaacacacaagaaaataaaaagaaagggaaaacagtggtgctaccttggagatggaggttgggagagattggcctagaggaagccagacctgtgttgtcagtgagcgggagaagacttaatcagcatcttcagtccatgggaacggtaagtgctgctagcttaatggatcaccaaaaaaacagctttattaaccatcagaaaggtttaaaacaaaatctttttactccatctaccaaaagcagaagatggtggaaacaacaaaatctttttacaccatctagctttgatggctaaatctcgcacttgagtgcaacaagtgatttgttgtaataaccaggagaatacatactatattggttaataaaatccaaaatggagtctgtttggcaatggaaaacaagcagagatgtttacaacacttccattttctcataatattttttaaaggaaattttctgataatttagaaacatataaggattgatgacattttctgataatctagaaacattttctgataatcccaaattgggcaatctaaaagatcaacacagacagtatatagagaagaagaattgcagatcatcaaccatatcctgtatttgtatttgtatttgtagttctagatacaacatactgaaacactggataagtacaaacttcttcctttcttagcctgaagggaatcaaagcaaaaaaaaaaaaaatccagaacctgaatccctaaccatcataagacaaatcaattattccataccccagaatcataggtgatgtagcagaggcagacatcgacaggaccaagatcataggtgatgtatcagaggcagccatcgacgggaccaatgggagagcctctccaggcgtcgacgccgtgtgggacggctgatcgcgaaggagacaggcaagaagcgatggcggaggtggccaaggcgcttctatgaccggcagcgtggaggcatccatccatccgttcggggggcgaccgggcaaaaggtggggagacgtgcatcaaggtgcgccgatgggagggagtggtgtgtgggaaggggagggggttccaggaggggatctgcggtggaggtggagcgacgacgagggatcgacagtgggcggcggaggatggacgcctggggttgtggtggcgtcgcaggacggaggtcgtggcacttggcgtggcgatgccggtgtggcatgcgttggtcgtgatggaggcgcaagagggcgaggggattggggatggaggcgaggagggattggccgacgtctgatcccgatggtgaggagacgcgacgatgacggtggcggcgacggcaatgcaagacagcaagagggaaagggaggagaggagatagggtgacgagagggatgtgggttgtgggggtgcggtgctgcactgctgcgtgatgcggagcaacgcgggctgacggaggagcgttggatgtgtcggaggatcctgaaaaagacgtgagccgttggattgcgcaggactctccaccaccactactgattttctaagtagtagagatagagattggtccacctagtcagatttccgtctatatatatcttttatttttgtccctaataaaaaaaactgatctgatttttctccttcaatttgccttcaaaactatcggaagaggttgtgattctccgctccaaaacccatctacaaaaccatctcattgactatttccctgtacacaacgattctgcccaaaatctctcgagtctctacagcacctccaccttggatggcggccgccagcggcagcactattccctacagccctggccgcacgtcgccggtactgtggtgcccaggccccagaaccccagatctagtccggccgtgcggcgggcgtgcatccttgatcgggtggttcactggttctggggccgttccccgggttgcctccccggcatgtgcttgccgcactgcagcagcagccgcatcaccatgatgtattcacttgctgaatttgaaggcaatcaacagcaggttagcataacagttacttcctccgtttcacaatgtaagtcattctagtattttctatattcatattgatgttaatgaatctagataacatttatattgatgttaatgaatctagatagatatatatgtttagattcattaacatcaatatgaatgtcgaaaatgctagaatgacttacattgtgaaacggagggagcatgtaagatcgcacaagatcaaacaaacctatcagagtgaatggagcatgtaggatcgcacaagatgaaacaaacctatcagagtgaatggtagggaaaacaaaaaacccaaaaatcttttgcggaattaaagattaacctcgaacggagtcgatgacaaagctctatcgccgttggtcgaaccgccttcctaccgtcggtcagtccgccgaagcctcaccggtcagaccgcccaaagaccagcggtcaaaccgccactatcccaccggttagaccacgcgcatacctgcagttagaccgtcgggacacagagacaccagtaggtgacaaactcaaatatgtagattataactttcgacattattgcatcaactagtgtttacaaagtgcaccaacagcactcctcaccaaaatctcgaactaaactcgaaaccctaactttgtctcaattcaagtctctctaaaaccgataccgggaggcctcaccctccctctctatttatacatgaggtaggttgtgcaaagcccacgaatctaacacgatttagaactcctaactcacgtaagaaaccctctcttgcaagtatcgaactcatctctttccttatttcaatcaatcttaccgaattcggactcccttccaaattcaactcctctttccatacatacacaatccctcttgtataccatatgaatttcttcatcatgacgtgtgttgtcctctagcctttagtatcccacatgatctcttgatccctggacatcaacttctcccaagttgactccgatctatcaccggcaatactctcccgaagcctcaagcaatacctgcacatgcaacaaccaagaaaccatattccgagcacaagttcgtcccaacttgactcacattagtataataacagtatcaatacttatagaaaccatctagaagccaaatccccgaaggaaacatccaaattcaacaaaacaacccgaaatcgaacacgattaggatcatgcctgtcagaccgtcaggtcggccagtctgaccgccgcaacacttgcggtccgaccagtggcactcagccggtctgaccgccagggtcaaccgaaaactaccacttcacaaaaacaaccgtcttaaaaaaactccaaaataacattagcaaaccaccaatattttcatcacaaaatctaaatcaactctaggattttacaatctccccttgatgaaaatcattggaaaacaacaactggtttgtggtgttttgtgaagcaaatccaaaaagcatctcaatgccaaaaagtttcaaagaaaaatctctcacttttgaaaaaaaaagaaattccttctacttatgacaattatgcacaatttgttaccttgttctcccccttttgacaatgagttaatgaacatttctttttttcgaaaagctttgctataacaaaagtatttcaagaacatgtgttgcaataacaaggtagatagcatgacaatctagttaacaagcatgcatagaagtgtaaacatgaatctaagatattgtcaataagatcaaatcaacactaaagattcatgacttcaaatgatttataatgcaatatattcacaagcacataggttgaaaaataaacactatacatatatacctattgcatttatcactctttcccaaattagcttcagcacaaaacaatcaagagaaatttttaacttttatttgagcctttttgctcattttttctctgaattatgtcgggtacgtccttgtcattaagactgtttccaaggattcgacacccattatttttgttcgcatcaaatacatccttgttgtcaagactgatttcaagaattcggaattctttttttctcttatagatattttttattctcttgcacaatgagcaatttaaagctatttaaggaatagcaattcaataaagcatacacataagcattaacaaatcaaaccatatgctagcatcaatattgcatatttcgttaattcaagtgaaagattatgtatcatgtatcatatcacttaaaaacaatatcaaaagctcatataaaaactaacatgcatacaagctagtctagtcatcatattatctaacatgtactgatagcatgctcaagtatataccaaaagtacaaacaaagctcttcttctttttcaattttgtattttttttatattttccatttttatcacaccatgcatgaattaaaacatgaatgcaaaaagaaaaataaaaagaagaaaagaaaacatgaatgcaacagagagccaaaactcccccttaattgatgccaaaaggacgaacaatccccaactcgcctcgaaaaaaagcaaatcaagaagaatccaacgatttcgtgaaaatatccgccaattgcaattgagtatcaacaaaagccaattaaacatctcccttctcaacatcatccctcaaaaagtgatagcgaatgtcaatgtgttcagtgtgtgagtgttgtacagggttcttagcaatattaatagcactagtattatcacaaaagaaaggaactttctcaaaagtaagaccataatctctcaaagttgaaataagccaaagaatctaagaacaacaactagcagcaataacatattcagactcagcagttgattgaacaacattagattgtttcctagaagaccaagcaatcaaagaagtaccaagagaataacatgttccacttgtacttttcctataaattctacacccactacaatccgcatccgaataaccactcaagcatatagaagatgatgtagaataccatattccaaatacctcatgatgcgtttaacaacttgacgatgtgaagcacgtggagaagcttgaaaacgagcacataaatacatagcaaattgaatgtccagtctcaaaacagtgagatagagcaaagatccaatcatgttcctacactcctttgatccacaacttcaccatcttcatcgagatccaacacaacagttgatcccattggtgtagagattggcttgcaatccacactacaagagatctaatgatagatgacactccatttatgtcacaaacattgaatttttcatcacgtttcgtaatctatgacgctcacgtgacgaaaattcatttgtcacctatcatgcgtctctaatggtgttctatgacgaaaccctattttttcgttattaatctagtgacgatccttctgccgtcctaacattgtgacgctcatattcattattatctagctaaaaaacgtcataaaatatcatgtggcctgttaaggcccatgtagtgagcaacctatctttgggctaggccttgttaaggcccatgtactgagaaacctatttatgggctaggcctatttgaagtccaattagattttaataaattcagcccaattatactatatccatctatattgaattaaatattgagtgggctctacatattcaaaagacctaatatgcccaagcattacaatgaaattgcatctgggtcatgcatacttgagaagcccatatatcaaacagatttagccagttaaaatccaatacaaaacccaattaacatccacacatctgacatctgcagtactatgaattaacacgtggccaacccagccacttgtccaaatacaaccacaatcgctgaccaaattaaaatacattataggctcattatctaaacaagttcaattatatgacagcttcactgaccaaaaattatttcacatgtgcagttacatcaggtcctgaatagcaaaataaacaggtttggcacattactatcctaatcgagtcacaactcaatcaccgtccaaaacaaagtcatatgtccaaataatcattcaaattaactgacctgaacaagtcacatgtcaaagtcgcaccaactaaaacactacaaccatctcatcatgaatcagcatattactaagactggccaaaagaagaattattaaggccaatcaactgacgaagaagggtattggtctcctcaaatttccaatctcttccaactgttgctttcttgttgcttttgattcatctatcttttccttcaaggaatccaacttatcctgccacaaccatacaaaatattacttatattgccttttgctctctgtcatgaacacactagtatatgagaggtaacacatgtagcatatttctatcacacgtagcaaggcaacatgaagccaacaaaacgcaagcatgtaatatcttttattttgccaaccatacacaacatgtagctgaaagcattcatctcttatgaaaaaaaaaatccaagataccatagatcaagaataaagttacaccacagaattactaaaattacatcaatgcattctatagtaagtttcttttatagttggattttaattatcagaactagtacttgggagcaaagaaagcaatatggaagaaaaacatatagcacctaagatttagctataggtgttcaacttctccatttaaaattcagattataacttaatagaagcaacatatatgtacatacaaatgaagtgaagtaaaattaatcatgccacaagtaacaattcctataaactaagacctaattcatgtcatgcagatgtagttactctcataaaacaacccatgaacatatagtactacaacaaacaattaaaaattaagacagttgcactattagggaagaagacttgatctaatgacaatatgtgcatactaaatgaagtgaagtgaagtgaaggatatatgagatgtagtgcgtggggctagagagtttacatctagtatttgcaatagaggggttccagcagtgcattgggttgctttgtacttttgccagttgcagctgagactcttctcgcgcgcaagaagctaaactagctggcaaagaggacatcttcttggatgagtcatcatgcaagccaaatctctgtccaacaataaaaacatgaatgaatgttattgggcaagataccaaaacactacacatgtcatctctaactagtaaagctgtaattaggtgcacaggactcttcaatttgtggtgcgccatcgatggttccctgaataatgtgcaagtaatttctgaggaataggcatcatgtaatgaaatcgtgtaactgcatatataagggtgggtgtcaattgcaaacagttttacatgacagacaaaaatgcagttcaattacctgatttatcagtgcaagcgtgcagtaaggtggtgggaagtagagtgagaaatttgtactactagtaatgaaaacaaatctgaaattgcaggaacttactcctattaattggaccttgcactatctataagtttatgcagtgacattctgcggcataacattttttttgcaactgctaccagattagataagggcgacctgcgagaactgcacgattactggggagggaggacggcgatggaggcaatgtcataggccttgttcattcaaacaacatacaaataaggcgccgtgctccttttccacatccatcggccatcccaattgtaaaatcaaaggtgttttctttattattattctgtgatgaacaattgacaatggagattattggttttcatatttggaatttattcacgaagtggttttggagatgattggatttcacaggtgatcgcaggatttgtcattttatgtgaccggtcatacctggctctggtagccggttagaccggcgtgtatcgcgcggtcagaccggccgacattgtgtcggtttcggttttgggttgtttgtttggatatccgtgattatttcatgattatggcttctaaatggatactatacgtatgtaatactgttgtttactactaatgagtcaagttggagatagcttggtctcggaatatggttttctttgttcatttcatgtgtaggtgactcgatgcctcgggagagtatttgcggtgatggaccgagagtcggcttggggataagacgacgtccgtggtggacagagattatgcgggatacttaggctagagttgatgcacgtggttgatggagattccatatggcatatgatggaggtattgtgtgcgtatgggatgcggagtcgaatttggaaggagtccaaatttggtacgattgttatgtaaagtttctttcttgtactagagggtttcctaaggtgtttaggactcttagtatgagtttggttcgtggctttaggctgcctacctcgggtataaatagagggggagcgtgaggcttcccggtatcgcttttgagagtaattgagttgagtttagagttacggtttcgagtttagtcgaaattttgaaggagtgctgttgttgcactttgtaaacacagagagaatcaataaagtcgtcatccactttaagagttcttcgatttgtgtttcaccgggtttcggcggtctaaccagcaactcaccggcggtcagaccggcggcaagcggcggtcagactggcgacatacgggcggtccgaccggcagcggcaacaggcacggcaggcatctcagcggttcgaccgatcgatctacatcggtcagaccgacgttcatcaggcggtcagaccggcgcatatacttcggtcagaccgcgatccgtcgatttcgagggtaacttttatttccgctaaaagttttcggtttttggtataccaaccattcacccccctggttggcttatttattgtgtttcgatcctacaatgatttgggatgcaagttctagaacatggatataaattaatatgtattgaactacatgatatatatgcaatttatcaaaccaaaatcagtctgatagcatcaatttgggataactagctagcttcaccaataacttgactgaggttagtgaggttatatctttaccatccctaaatctctactaattactacaatatagccatgcatatattaactgaagttgcaactgcaaatcttacctcatagtccaatttttaagacttattcgaatcaagctataacaacctgtttgtgccactgccatatttcgccttaattagagttagtttattttgggcaggccaaattatttagtgtcgccttcatttcctggatatttgtgtttagccatttaatctgacagatgtaccatgcagtctcaacagctaactactatacttgctcactgatgatcatgaaagcttagacatcaatgaacatatcacgatactgtgatggtgtatggaaatatcacggtataccattaaccaagatggcatgaaattatccttcgttttttaataattaaccaagaaacaggaatatcccgggaagcactgttaacatgcttgtatatctaataacaaggcaactttaattttcttgttttctttctgaaagtaaccttcaacaatgaaccgtaccccacacaagtttgttttaattaattatcgtttataattaactaacagaatgagttgattcactgatacatatttcagacacatctcatagttcaaaatgtaggatcgaaacacaagaactaagccaaccagagaggggcgaatagttggtatatccaaaaacccaaactttttgtggaattaaaagttaccctcaaattcgatgtagatcggtctgaccgaggttgatccgccggtctgatcgcgcctataccgttggtctgaccaaagttgttagcccggtccaaccgcctgaagatcgcttctgcctcctgtcgccgtcgctggtctgactgcaggtaagccgttggtctgaccaccgcaaagccgccggtatgtcgccggttagacctccgaacccgggcaaacacaaatcgaagaactttcaaagtagatgacaactttattgcttctctccgcatttacaaagtgcaacaacaacactccttacaaaaatctcgactaaactcgaacacctaactaaaatatcaactcaatgctctcaaaagtgataccgggaagcctcacgctccctctcaatttatacatgaggtaggaagcctaaagccacgaaccaaactcatactagaagtcctaatccacataggaaaccttcttgtgcaagaaacaaactttacaaattaactccaatcataccaaatttggcctccttccaaattcgactccgcatcccatacgcacacaatacctctatcgtatgccatatgaaatctttaccaaccacgtgcattgaactctagcctaagtatcccgcatgatatcagaccatcacggacatcgtcttatccccaagccgactcccaatccatcaccagcaatactctcccaagccatcaagacatctacacatgaaacaaacaaagaaaccatattccgagaccaagcactctctaacttgacttattagtagcaaacaacagtattatatacgtatagtatccatccagaagccataattatgaaacaatcacggaattccaaacaaacaacccgaaaccgaaaccgacacagagtcgcccggtcagaccgtgggctggccggtctgaccggcagcacatgcccggtcagaccggacccaacaaaacaacagcacctgtagatcacttgtaaaatccaatcatctccaaaaccaattcgaaaataaattccaaatatcaaaaccaataatctccaatgccaattattattatagaataacaatcaaaaacactttgattttacacaaaatatatttttgggtaaaagaacataagttttcactgatacatttaagacaaatctcataaacaaaatcccgtatttattttattttgtgttctagtaaaacatttaatatgttcttcaaagatttgagattgcgagcaataaatagaagtttgcccaagcctccatccttcttggtattagtagtttcttttgttaaaaaaattggtaatttgctttagctgtgtgtgaaagaaagcctagaacaggagcaaagtcttgtacaagaaaggactacagagaactactaacaaagaaacagaagctaccatggttttccagcaccagttcagagcttagaaacattccgaacaaaaagataagcggcgtacttcattccataaccttttttctttttttgcccaaactaaaactgcacatgaaccgccgcaccctgaccgacatagacatggttgatgtgctctgcaattccgagcaccattccgtgatccatggccttctgactttgcagagagagattttctggcttaccgggcaaacaaggaagagaatcgtacgtctttgttcccgaatgcatcctaaccctaacgcacaatggtgatcgggttgatttgtgcctgaagttagatgattatcattgcacttagaaactgaattagctgaatatgagacgaactggtggcaaggcgttgtgcgtgtggatggataaatggacgcagtggccttttatacgcttcagcactccatcatctaatatgctaaatagcattgtttgcttttctgagacaatatcagttgtggtagggtacgtactcggtatatgctagcagagtcagaacaacatgttgcaattaagtcactgctgcagagaggggttaactccaagcttccgataagtatattttctttggataaatgtgtggtatcttttcaaagggataaggatggcaaaattggtcaaaataacggagaaattgtgaaatggaaggaagtagtatgtttaaggtgaagccaattctgttgttgtaaggtgaatccaaaaatatcggtggtatagagctaaacatccagtattttctacggtattaattgaaccgtattttttgaataccaatgaactaacatgacttgcaagcaaaaaccattaacttttgaggttttcttccatatttgaagaggtatatacctactcacaatttcagatttaaacaattaaactggttaaattgattagataaaaaattaatgtctaattagtcgttgcgaggtatagagaggtatatataactctccatgtcaatccaggggtatatactgtaaaatcaaaggtgtttttggttattattctgtgatgaacaattgggcattggagattattggttctgttatttggatttatttacgaagtggttttggagatgactggatttcacaggtgaatcacaggttcattatttcatgtgaccggtcagaccgggcaggtgctgccggtcagactggcggtgatcaaacggtcggaccggccagcccacggtctgaccggccgacactatgtcggtttcagtttcgggttgtttatttggatatccgagtttatttcatgattataacttctagatggatactatacatatgtaatactattgtttgctgctaatgagtcaagttggagatagcttggtctcggaatatggtttctttgtttgttccatgtgtaggtgactcgatgtctcgggagagtatttgcggtgatagaccgggagtcggcttggggataagacgacgtccgtggtggtcagagatcatgcgggatacttaggctagagttgatgcacgtggttgatggaaattccatatggcattcgatggagttattgtgtgcgtatgggatgcggagtcgaatttggaaggaatccaaatttggtacgattggttatgtaaagtttctttcttgtactagtgggtttcctaagatgtttaggactcctagtatgagtttggttcgtggctttaggctgcctatctcatgtataaatagagggggagcgtgaggcttcccggtatcgctttagagagcaattgagttgagttttgagttagggtttcgagtttagtcgaaatttttataaggaatgttgttggtgcactttgtaaacacagagagaatcaataaagttgtgatctactttgatagttcttcgatttgtgtttcaccgggtttcggcggtctaaccggcggcgcaccggcggtcagaccagcagcatcgcggcggttcgactggcaggcacacggcggtcagaccggcggcgacaggagtcggcggcagacgttcttggcggttcgaccaatcgatctacatcggtcagaccgacgttaatcaggcggtgagaccggcgcaactactttggtcagaccgcaatccatcgatttcgatggtaacttttatttccgctaaaagttttaggtttttgggtataccaaccattcaccccctctggttggcttagttcttgtgtttcgatcctacatatacctctagaatgtaggtacatacgttataattggcacaaatatgtatacctctagaaaatataagaaaatttcacaagtatttataaagataactttccaattatattctaacttgtacgattaattttgattccccattttatggagggtaaaaggagatgtacatatatatcatgtatggagagctatatacctctcaaagtttgagagaaaatcacttaacctttttaccttttcaacacttattttactactcgatatcatatcagtcccctacactccagccatttcattcagactactgcaatacgtccacgtatcaaccgatccaatatataaaggccattcccaacccaagaaactagacatagtttccataaactctacatcatcaagaaactagtactagacactactctttcaatgcaaacactactattccatacttaaatttaatgctacttatctcacatgatgtcttcgatgttgtgtagaaactatgtttcatgcaagacatggtttccttctctttcttcatttatacatttgccacattattttttatcctaggtggcaacttatttaatgctatggacaccatcttagttattaggttgggaatggcctaagccagaaagcaacacatccatcggaccttccgaattctgtttttcactttttttttcgaaagctacaaaactctacaatgtgtggtgagctcaatctgtgtcacaagtgcgagccacagaaaaagaaatgtacttttcagataaaagatcatcacaatatcctgcagctttaacttataacaaagcttgcaagaaaaacatgataattcattgaatttgtcacaagtgatcggtcgaatttgtcttgacgtccttcctcttgcttcaaatacgttgcaatatcaagtcatcacgaacaaaattaatcttaattagctaaccaaagctcatcaagtcaactagtgatcacattagcattagacaagcttgtcttctcggcaatcatgctgttcgatcgaactcgccgccgtgatggtggctaaggcgacgtcggcgagtagtgccgcgtggggaaggccgtgttctggtcggcgccgtccctactgttgacgtaaatcgaatataatttcagtagttgatttaaatggcttaaaacttctaaaacttcgtaactaatttatatgaactctaaatttagccaatctggaggactgcgaccgcaaggaaaaagcatatggaagctagattaattgaagaagcaaggtgagtcacacgttccctgcttgaatatgtttaacctactttatgaaatggttgccatttagaaataatatatatatatatatatattgctaattacgtgggatacgggattactaaatccacttgcttaacgccaatttacttggtatccactccttatcaatccttgggtataataattttatcagcttgggttaattatgttgaccaagctatgcttagccatacttagttcatctaatgggataatcactttactcataatttgtatattgacgagcttaattcaagctcgagatattgtaccattatttgttggtcctaatttgtccaactaaaatatgtcttaatgatagactatggatgcatggttttaatttttcgcacccatgataatgatggacctttttgcgggaatctctgaaagacttaccgtacttaccacaaaccaataggtgtaattgctaaccttttagtatagctctcccctttcataggtatacaagcgagtgtggccgtgaaggagtttggttgaacaggatggtctaagcagcttccagattaaccgtggcataatgaaggggttgtccatcctgattttagggatggtggcgaaacatgcagtgtggggtgtcaatggttagggaagggttatgaggaggtggttggttgggcttgttcaatgtgttgtaccgttgttaagtggagactaatcttttcttaattaatcaaatattttactatttttaactacaaatatttacaattgtctttatccaaaagagtagatcatgatacaaaagactactatctttgtttccccttgcacaattacatcattggtgttgcttgctgagtacagtggttggtacttagccttgcctaattttctattctcaaatttttagtgcctctgtgatgaagacggagttaaaatatcaagcgttgtaccctagttgagtactcctgtggactgaagctaaacacccactaggatagtccttttccgccgttgcattcttttcggtatgaggactaattgtcacttttgtaaatatttatgctttatttatgtttggatatgtacaataacatgtcatttgatgtaccttgtgttgattcctaaacaaggatttaatacacaaattggtctgaaaaaaggaaaaatttctgggtgtgaatcaccacacggcacaacagctcccactcaaaaaatgacacggcaacatagagcctacaccgcttctccaaccacatgaaaccatgctgccatagcataagtaggtggttattgttgctgagcttgccacctagttaggcagttgtgactctgcccatgcgaatgctccgcaactcggtggaaacatccagcactgccacctacatgcacggatcctcttctgctgcaagcaccaagaaagtattttcaatgccgaaggtcgcccatgctatgccgagaagacaccaaattggccaaactaccaagaacatgtgaatcccattgtttttttgtctagtgctctagtcttctagcaaagaccttatcaaaggtgtttgaagagtcaagggggataaagagaagtttgctcctatggcaacaaacggatcaatcagctatacataccgcctccatctctttcaataggaagtaccgcagggcttcaagaatcatgaccgacctcttacattggctacatactctgacactgatggtttgtgtttcgtgcaacggctctggctatatcctcatctccacctccttgtgatgttgcaagcgaagtttatcttgattaatgcgcaaacactggacgaacatctatgttcgtttccgatgcatcctaaccctaacacgtaatggtgaggtagttgtccatcaacataacttagattagcctatcgtgcagaagctgaatcagatgagcatgagacgaagaggcaaggtcttttgggggactattatacaattgtggtaggatatatatataattcgtatgctagcagagcaggggtattacgatgcaattcagttcctaagagaagggtgaaataggacaaaacaatggagaaattgaaggcagtggtatgttcttgaaccatggagaaattcaactgtaataaagtgaggagtgaagccaaaaatgttgggtggtataaactaaacttcctgtattttgatggtattaattgaacgattcttttttcctttcaatgaactaactaacctgacttgaagcaacaaccactttgtaccttttcggaactttttttttctaacacgatatcaaatgagtctctacgatcataaatgtgaaagtatcaaattatcctatgtgtaaaccagaagcaaaaacatccatcggcttttccaaattctgtttcttcaaagctcacaaaactccacaatatccagtgagctcgatctgtgtcaccagtgcgagccagagaaaaagaaatgtaacttttagataaaagatcatcacaatccacctttaatctatcagaatgcttgcaagaaaaccaaggtaatcaataaaaatggtacaagtgatcgatcgagagtttgtcttcacgtcctttctcatacttcaaatacgttgcactcccaatcccaagtgatcaagaacaaaattaaattttctaaattacaagcaaatcaaagctcatcgaagtatagctatggcattggcatcagacaagttcgtcctctccgccatcgtgctcgccgtcctcaccgtcgcggcagcggcggcgggctacggcggctacggcgacgtcggcgagtactgccgcgtggggaaggcggtgtcccggaacccggtcccatcgtgccggaactacatcgcgcggtggtgcgccgtcgccgggggccgcctggactccggcaagcagccgccgcggcagctcctggagccgtgctgccgggagctcgccgcagtgccgatgcagtgccggtgcgacgcgttgagcgtgctggtgcgtggcgtggtcacggaggagggcgaccgcgtcgccgggatgatctcgcagcacgcggcgcccgggtgcgacgccgcgacgatcgccgggatggcgagcgcgctgacggactacggccggtgcaacctgcagcacactggtttctttggctgccccatgtttgggggtggcatggattaacttccttagtaattaattaattaggcctttgcttaattaattatttaattagttatccgggttactggataattaattatcgatatttgctagtagcatctatcatgtttggatgctgctttctccgtgaatgtgatgataataataatcagaagaaataaataagaagagttggattcatcagctttccagtatcatcctcacaagcctcatggtcaagactatggaacctatacctgtcctgatggtgaagagagtgccactctgatgcatgcggtgcatatgcttagtgctatggatgcagtaagtgtggagcgagccaaagcagctcatgacagggaaaactggaatcgaggcaagatttgcaagttggagagcaaggtgtaccgtctacagaaggaattagctgaacttaaaggagaaacgccgccgccaacacccaagcttcgcctcactgcaagaaagagaacctgtccgccacctcgtctccagttagcttcgaagattcgcgtgatgggtgaagctgtgcccgatcgtgctgaacctgtcatcgacatcataagtgatgaggaagaggaggaagaccctgaagaaagagagccagctactccagaggaagaagatccatcgcttcgttccgacgcaaggcgggattagtcgcttagttagatcgttgccgtagttcactgtgattagattgtttgtttaagtttgcttgtgagtgtgtgggttttacttgttgcttacatcattggtgggatgtaacagcatgagtctagttcttttgcttgtcagagtgtaagatagttggtgagacagtgttaatgcaacttaaatgtaatcatacacagttaagagcaatatagaatttaaattaattaaataactccgttctaagggtgtctctctgtcgttctttcctgttgtctctgcttatcgtcagatggtgaacacgcgcactggaagtggaagtggaagtggaagtggagctactaacaatggaggagatcccacgctagctcagattctggcccaacaaacacagctgatcaatctgttagtgcagcaggcacagaatcagcaggcaaacaatcagaaccagaatccacccccacctccccaaaacaagctggcagatttcttacgtgtgagaccccctaccttttcaagcactaccaatccagtagaagcaggagattggctgcatgcggtggagaagaagttggacttgatccagtgtactgagcaggagaaagtttcttttgcttcgcatcaactgcatggacctgctgctgaatggtgggatcattttcgccaaggcagggctgaaggagagcctattacgtggcaagaattcacggccgctttcaaaaagacacatataccaacgggtgttgtagcttctaaagaagagagaatttagagcactcaaccaaggatctcgttcggtcaccgagtacctccatgatttcaaccgtttagctcgttatgctccggaagatgttcgcaccgatgaagagcgtcaggagaagttcttggagggactgaatgatgagttgtcttatgccttgatgtctacggatttccgggatttccagcagttggtggacaaggcgattcgtcaggaagacaagtataaccggatggagcagaagaagcgcagggctgcccaattcaaggcacaacagggcagtaaccagaggccgcgtctcgttacgggacctcaagctccatcgtaccctcaaggaggatcttcatcagttgtccgcccccaacgccagttctacaacaacaatactggtaatcgtggtaatgacaaccgcaacatggttgctcgtcctgcagcaactccagctcagaaccagcccgtcaggaaggaacagggaagcaagccaggggtgtgcttcaattgtggtgatccaggacattatgctgataagtgtcctaagcctcggcgcgtgaagaacgctccagccccgaataactccaatgctccagcaccaaaggcacgtgttaatcatgttgcagcagcagaagctcagaatgcaccagatgtggttttgggtacgtttcctgttaactctatacccgcatctgtgctttttgattccggtgctacgcattcttttttgtctaaaagttttgcgagcaatcatgggatggaagttattagtcttgggagacctttactagttaataccccaggcaatcaagtattttcgacacagtattgtccttccgctactatagaaatagaagaagttcctttcccatcctcgcttatcttgctagaatccaaagatctagatgttatcttagggatggactggttatctcgtcacagaggagttatagattgtgccaaccgtaaggtgactttaaccaatagcaatggggaaacagtttctttctttgtgtcctctcctaaatctcatggtgtgatcttaaaccaagttgctctacaagagatccccatagtacaagactacccagacgtgtttcccgaggatttgccaggtatgccacctaagagagacatagagtttcggatagacttggtacctggaaccaaccctatccataagagaccgtacagaatggcagctaatgagttagctgaggtgaagagacaggtggatgatttgcttcagaaaggatacatcagacccagtacttcgccatggggagcaccagtcatctttgtggagaagaaagatcatacttagagaatgtgcgtggattatcgagcgttgaatgaggttactatcaagaataagtatcctctacccagaattgatgacctgtttgatcaactggaaggtgctacagttttctccaagatagatctccgttctggatattattaacttcgaatccgtgaggaagatataccaaagaccgccttcacaactcggtatggtttgttcgaatgtaccgttatgtcatttggactcactaatgccccagcctttttcatgaatctgatgaacaaggtgtttatggaatatctggataagtttgtcgtggtgtttattgatgacattcttatttactccaagacaaaggaagaacatgaagagcatcttcgtctagctttagagaaactacgtgagcatcagctttatgccaagttcagtaaatgtgaattttggttgtccgaagtgaagtttcttggtcatgtcatctcgtctggtggagtgcagtagatccaagcaatgtggagtcagtgttaagttggaagcaacccaagacggtttccgaaattcgtagtttccttggacttgcagggtattaccgcaggtttattgagaacttttcaaagatcgccagaccaatgactcgtctgcttcagaaggaagtgaagtacaagtggacagaggattgtgaacaaagtttccaagaattgaagaaaaggctagtgactgcgcctgtattaattttgcctgattcgaggaaaggtttccaagtgtattgtgatgcatcccgactcggtttgggttgtgtgttgatgcaagaaggaaaggtggttgcctatgcatctaggcaattacgtcctcatgagaataactacccaacgcatgacctagaattggcagctgtggtgcatgcattgaagatttggctttcgaagaaggagattatgtataccttcgggttacgccgttacgaggtgttcatcgtttccagaccaaagggaaattggcaccgcgttttgtgggaccttttaagattgtgagtcgaaaaggtgaagtagcttatcagttagagttgcctctgtcaatggcgggaatacatgacgtattccacgtgtctcagttgaagaaatgtttacgtgtacctacggaggaagcagatcctgatcgtatagagcttcaagaagatttaacttatgttgagaagccagtcagaattttggaagtaagtgagaggaataccaggaatcacgttatacggttctgcaaggttcagtggagcaatcattcagaagaggaagccacttgggagcgagaagatgaatcgaagtcaactcatcctcatctgttcgccagttcttctgaatctcgaggacgagattccgtttaaggggggtaggtttgtcacgccctaaaaatcgcctaatgtaaaaatacattgtttaaatcatttttagaaattattttaaaagcctacaaactaaaccctaattatctaggaaaattttcaacataaaaatgagctagataaaattttattaaatactatacttgctcctctattttctagatttttctggaaattatttgagcaagggaagtatttttaataattgaaacaacatttcacaaattattttaattttaaaagttccaaaacccctccctaaagccgttgggccgtttttggcccaacatctttcctctctcccgcgggcaagccggcccaagccggcccagcgctgcccgagtcggctcaagccgagccgcccacccctccctcacgtgggacaccgacatgtggggcccacatgtcgggcccttctcctacctccggccggccgccgcttgccaagcccgaccgagccgccttccgcctccaaatccgctccaatccgaccccgattcttccgggtttttgaggggtttttatccccactttctcctctatctttacccccaagattcggagcaaatcgttgagtattctctccgaatcgagttcgtttcgaatttatccccaaaaaccgagtttagattttcccgagtcgatttcttgcgggaggagtccgatctcttcaatccaaggctataaataggaccacctcgtcgccctctttcgttttccccatctcccgagctctctcgtgctccgtagtgtcgccgccgcgcgtgtctagctcgccgccgccgccggtcatcttcggcgccgccgcgccgccgcttgcgtcgtcgccgccgcttgccgccgccgccgttaggtgcgccgtggtgaggggaacctcggccgcccgtcccctttcgccgccggccgccgtagctcgccgccgccggtcaaccgagccgccgccgtcgcccttctcgttgccggccgtcgtcgttcgtcgtttgtcgttgtggtgagtaccgttgggttcgtctcgtcgtcctctacgtgtacatgccctccaaatccgcggccgaccaccctagctccggcgaggtcgccaaccctagccggcctccgtaggtgacgtcatgctgacgtcatcagttttcctttttcccgattttctaatagattaaaacttcggaaaatcataactaaataaccgtagatccgtttcaggtggttcaagttgctaaatttttctaaaatcaagatctacatgttaaaaatatccacatgtactgtttatgcttgtttttgtactgttttgttgattttgtttaattgctttagtttctgacgttccggaggagagcgtttccgttgaggaaggttccgaagcgtttgcggaagcccaaggcaagtcacacagatcccaaacaaccctttgagcatgttgaacccgtttaaagctattattttatttcaactatgcattgttttcgaatgtcatcgggtggtgaacctttcccaattaaataatggccgaagatgactttattttcctatgggtcataatttgattagcatgaaccttatatattggattggttcagctaaatgttatatgtaggtttgcttagccatgcttagaaacattagctaattaaaggggattaaatataaattatattatattattcttattattatggttatatttaatggtcgctcacgatggttaatcgtgtgatgttaattaattgataattaaagcctggttaaggtgggttgtgagcatatggttttgatggttgtgctcatgacaattaaggaccggttcgcgagctactgttgtgaaacatttatcgtgccaatcacaagccagcgtgggcaacggctttatcttttgtatagcgtgattcattatagtgcgccagactgagaagtggcgagaagtccacgggggtcgctggggagtccatgccttgtttataagggggtgattatgatccaggaaaggtgcgctgtaatgggttatgttgtgcaaggggtattgtcacaactcctttccgaggtaccgtggtggtattgaggcacatggtgacatgatgtggggttgtgtcttgtgggtacagtggtacacctctgatcagagtttaaactattcgaatagccgtacccgcggttatgggtgagttgagcaatgtttttcgtgattagtctcacactactcatcaatgttaataatgtgataattaatttggctcctggtttggaatggataattcctggtttggaggtttaatttgttcaactggggttggttgttcaaatgtggttgggcctatgcaacatgggtgtgttgtatggtgttatttaatattgattaattattcaactgtttttactattctcttaaatatttattaaatgctgtttctgcaaatgagctatattatgccatcctttgttatcctgtgcacttgcatatttgctgtgtgacttgttgagtatgtcatatgctcattcttgtaatattcattcatcagaagacgagtatctcagtgaaggtgatgatctggaggattaggcttgttcttggttaagatgcctgtggagtggagtcgccatagctgttccgtagtttgttatagttttatctttccgctgcgtaaaatgttattctttgagaggaactatctacctctgtaatcttttattatttgcgaatattaaatagttatttatttgtactctattatcaatttgtcattgtgtgcctcggttgattcctggacgagagtttaacacacatgtaagcgtttggaattttggatagaaattccgggcgtgacagctgctacggttctgcttccccgcttctgatcgcttgcgagcatgagagattgaaacaaggagggcctccggaaccacagcttcgcctgaaatctgcaccgagtaggcgggtgatcaggtttttgaggagtgcttccgcatgactgctcctcgtcttctgttcgtcgtcgtcgtctgctacaccatgtctggtgcctccgcagctgccgcgcctagagatggaggcgcactaggagccggagccgctgcgaacgaaaacatcaacggaggcagttctgcctcacaatccagcggagggacattcacagggtataacctttgcttactgttaattcaatttttgatacctctgttagtcgcaattctattgcgttcattgtatgatcatgatgcttattatattttaagcatgctcctagttatgttagattttatcactagatcaccccacattgttcatgccatggttattgtcttaatattttggattaaaatatgccgatatatgaccatatttccaacaaaaatgtagtttaaaatttacggaacttgatcgcttaaatatcaggcaaactctaattaattttctggttgcttcaatcataagaagatggtccaaaaataattagacatacaagcattactataaaatttactttcatagtcccgagtaataattcttttacgtaggttaataaaaggtgcaccctgctgtgacgagcccagggtggcctcagccctgaaggtacatttattctccacatgtaaaaaatatttttcacagatgattccttaagaaaaccgctagtgacatagtctgaactatccatggataagtcggttccaatggccattatttttgtattattgtatagtagtgaaggctgcatacttaatcggtacttaattatccattacaaaacacagaagttgcaaccatgaatcttaaggttgatccataacatagtaatttgtacctatcaatttctagtttcaataaattacaattttactccaacctgttcactaaagaatatcgattggagacttttccaagagatcaatatataagaatataactttgagcacttaatttcaaaaacatcaaaaaggagttattaataatgtgaaagcttttattcaaaccagctatgctatgttgaattgatatgccgaaaacctatattctaaagaataattgtagctaaagatttaacttatcactacttaaaaaaacacgtagagatcaaaattataggtgccggaaaagctaaaaccaacacctcctatagtgcttttctctccccatgagctgaaaacatataaaaccggcacccttaagcgactataggtgctggttctaaagaaaaaaaatgcacctatactacatatatgtgcttttttttctaaaacaagataactttaatatattataagtgtcggttagttaaaaaccgacatgatcttttaaaaaatcgtcacctataccaaaccgagccgagcacgggccttatccacttcgcgcgcatctgcggccctatctcttctctccctctctctccctctttctctctctctctcgcctctctttgtccctctctctctcgcttctctgtcgcggcggcagtccggtggaggcagcggtggcggcggccacgacctcccctccaccaaatctggccacaggggaggcggcgagatgggaggcagcgatggcgcctgcgtcctcccctccgccagatccggtggtgttttcccaatcggggctcattagttgggaactttgacgtattctcataggtgccggtttaggagccgacaccttgaggttccagaacctaaagataaaaaagcggctcaatgtattaactcgattcgagccgatccattgagcagatccagttcatccccacaggaatcaaagaacacatacaaggtcaaagaacacgtgaacacgtgaacttcagggacataaaaaacattaacatctagaacatcaaaaacacgatggcagctggcgtccttctccacccctgccgccgtcgctgcatagagaggaggggtggtcatggggatatgtaatttgatcctatatatgtgagttcaatcagatttccatcacttccgaatgtgtgtatgtttggtttctagtgcctcctaatcctatgtacgctcactgaaacagtctgccctcccactatggttgctgttccatttacttgcactctgatagtctgatgtaagttagctcatatgggaattgtccatgtttgggatggttcggtctggctagccctttattatcagtcaaagatcaactcctatagtatgtactaatcctccacttatctatgctttgtataaagttaaagcctattaaatctaaaactcaacatgcaaccgtgccacatcatcacccactagcaataattacataatctcatgcaagcatagaacatgatgtacaatttatttaatgatacaaatcaaaatgcaagcatatctaataatcacccgtcatatcatttcactaccacagaatagggattcggtgccggttgggaaactcctttcgatgccggttttcccaaccgggaccacgaaggcggcacaaatcacaggagattaaaggtgccggttttaaaaccggcacctttgaggcgcacacgagccaaaaaaaatcggcttgagtcgatgcaagccgtcaagccgatcccaaatattgcatcaaaaccatgaacacatgaactaaattgcctcaaatccataaacacatttagatcacattgaacaaatcacgaagaggaaataatacaaaacacaaagagggagggacaagaagggaggggaagagatcgatccgcggcctccagccgcctccctcctgccactcgctgcctttgcatcccccctcccttcccttctgccgccccctcccttccgccgccgcatgacgcctcctccgctgggccccctagctagggttaccaaaaaagctcggagctcgcaaactgctcgacctcgattcacattgggctcaattcgagctcgtctcgaactctaaatgagtcgagcccgagcttgtatccaggcttgcaagcctcaccgagcgagctcgaatagctcgacgagctcagccactcacatttgctctaaaaatcctcgatgttctctgacattggctggttctggccaagctgtcatgccctctaccttgtttgcatcagacgttttcgagtagctcgaatagctcgaatagctgggacttttccacttgctagctctcaataacttcaggcagcaagcatacagaccaaagcacacataccaacaaagggtgtgtttagttcatgctaaaattggaagtttggttgaaattggaacgatgtgacggaaaagttggaagtttatgtgtgtagaaaagttttgatgtgatggaaaagttgaaagtttgaagaaaaagtttggaactaaactcggccaaaggctgcatgcatggcatagagtgcatcgccatcaatggagtgcactcatttcccgtaacagctgcatatgtaaactgtaatgtatggttgctagcatgtactatagcatattctagtagtactactgcttcaaatattggctttctaacagcgtgggacaaggattgacttcccactatataacacactcgaagctcggcaaaagctcgaagctcgaacgagccgagctcaagcctgtcttgaggctcgaagtctgacgaggctcggcttgagctcggtttgactatttatcaagctcatgccaagactggtaagctcgctcgagctcggctcgttgacagccctagggccacccctccgcgggatctggcagaggaagcaaagggcaggggaggtcgcggccgcctccgcctccgctggccagacgcccgccgcctccccttccactggatctggcggaggggagggcgcagccaccggccatgggagagaagggagggaaggagaggggatgcgagtcgagtaaaagattgacgatgggagtgagaagaacaggagacgcgagttgaaccttatcttcttctcgtgctggtggggcccaccggctcatcgatttgccagctcggctcaattagtaggtaatggttttttataaaaaaccggcacc

SEQ ID NO: 74066 - DNA, 13666 bp, Oryza sativa
gggcacgggcgcggtcacgcctgccacccgcttttccaccacgcccgccgcgcccccgccacgcccgccgcctgcccctcccccaccacgccccgccgcaccccgccacgcccgccacccgccgcgcgcccatcaccggccaccaatgacatctgagacagtgacagtgagagattgagagaagaggggaagagagatgtgtgggagtatgacaggtggaccccacctttttaaaaaaaaattgctgactggattgccacgtggacgtcacgtaggacgataccactttggattgggttgaggggggttactcgtccggtatagatagttcagggtataaaatgtctggtttcgtggttaaggggggtaatttatactgtcgtcatagttcgggggggtaattcgtactttttcctattatgaaatatttttaaaaagtagttgtgacctatattttggaatggagggagtaataccttttgttacaaaatatatatgaacaagaatacgtagtgatatttgtattttagaacagatgaagtgcatccaacaatctccgatcaacgaaataaggcaccagcaaaacagattttggtactaactggagttcaggggaagaagattatcaccgagacaacgttatgttgtaggcaataatattaaaccgcttgattcaatctgatggagctgggtgttaggaaacgatacgcaaataaacaataaaaaataatatataaattacggaagatacgagatttaacgtggaaaaccctcctaaaatagaagagaaaaaaccacgggtgccagccagtaaaatatcttcaatattggggtgaggttacaacaccgaacggcggcttacaataagtatatttgaaggtgtaacctaaaaggataacgatccgtacctagtgtccgtgcactaccataaatcttttaagtagaaactttcaaatgtaactataataattatcatatggttttattataactctactatagcttatagctacaatataagttgtatataagtatagaaaatatatgcaactttctatacctaaattataattatatagatgttataacgtagttataattattgttactcactgtaactattataattgtaatgtaacttatatataaatagagtagcacgaatcctggccaacattgtatggccgaaaattcagacgccaggaaagaaaaaaaactgccacaagttttctagcaattctgatctaaaatgctactagtcatgcatgtaggatgcatgagcccctttagactaggtttggtgcattccgcacagagccatcagtgctactgatagaaatgtggccgtcaccgtgcgtgccaatcgccttgctgtgcttgttcttgccatccttgcagcagtacttccagttgaagttgagaaccaagcatgccactaacaacaggccaacggccaccatgacgatcactagtatgacctcctccttgtggttcatgtcctctacacccttcaactccagattcagcagctgcatatatatatatatgagatgttgttaaaaaaaaagatcggtaaaacatagttttgtcacgtgaactgaaacaccaggtttttggatgcgaaaaaaaaaacacacataaagaagagtccgtcgtatacatacctagagagatgagcagagaggagcggaggatcttggagcgctgtgagaggaatcgcatgtccaatctctgctcatatataagggcgtcaagaacgttttccaaatgtgagaggtttccttataggagagcccgcgagtgcgatacaaggaagaacacatcgcgatctcgcatttgctgccatctatcagtgccatgcgatacgatcccctcataaaacctgtggatcttcttccaggtgaagcgtggagagcgaacttcaaatgtggaagcgttgattcggcgaatctatgcttacaacaaatacagaagtttttcccccggaacgacaactgtgtagcgggtaacgcttggtactagcgcgccatgggccgtgtggctcaggggctgacggactcatgcggcctgcgctgttgcgtatgcaacaaatccaatttgggttcctcaatcgatatgtgtccaaccttaccgtatccctcaactgcaatactaatatctttgaccacttaactatgaaagctagtcctaccaagcgaatcagcatgcggagctcacatgtcagtgaccccatctctaggggtggatatcgagctggctcggctcggcttggctcgttaggataacgagccgagcttagaaacctagctcggctcggctcgtcaacaggctcgagccagctcgttaagctcgcgagctaggggcaagagacgtagtcggcgagcacaaggaggaggggaggagcttgacggaggaggaaacgagctcaattgagctcgccggcgaccacatggacatggaggagctcgatggtggaggggatgaactcgacgcagctccgccgacacttggaggagacgagctcgagcccgccggtagcgtcgggcgctgggggcggacgccggcggcagcggcgctggatcgctgggggagaggcggagatcagcggtgatgggcgctcgatctcccggcggcggcgggcataggggataggcggagaccgacggcggcgggcgctcgatctcccgttggcggcgggcgctggcgagggagaggaggagaccggcaacggcgggcgctggtgggggagaggcggagaccggcggcggcaggtgctcaatctcccagcggcggcgacggcaggggagaggcggagcggcgtgtaacataccaaaaattaaccattttctaattctgcattatgctgagtcttatgttcttaataacttcctaaacctaggaaaatataattagagggactttctaaaactaacttgcataaaatctctttctggtatttaacttcttttgtgtttttcatttaaaaattaaaatacatgtggttgaattgatgtatttcctgatttggtttaaaaccttcttttgactaaaattcctttattcaaaattagtttgaaaaccctttctatttttttatggattatggtccaagaaaccttcccaattttacccttgaacctaaaccaaagtaattccaattttattggaattaattgttagcccattctttgatcttaaaccgatcctttgattcttgatccaaattcttccttttgatctagccactgatttaattcccgtggcttgatttccttctcagcacaagaataatattattacaaatattgtaaataattgctcttatactaagataataagattatatccttgtcatccaaatatcctattagcctcagacaattctttgaaacccatgccatatattttgagtctaaaaatcctatttatcttcctccatttatttcctctcctcatttcatttgagtgcatcaaataaattccgttatattcaatctctcaaaatattgcactcaaactagaaaatatctctttcggaaattatatccaaatataatttcctttcaaaattccttattcaaattatctccaaatatattttgctttcaaaatcttctattcaaattccttccaaatacaaattctcctctaaatcaaattattcagcccctaggaaaaattagactttcttccttctacgtttgggccgaattctccttttcctccttttccttttctcagtccaagccggcccaacacccagccgagccgccaattcgcgccgccgctcacgcccgtgccgtgttcgtcctcctccgccgctgccgtgccttgccctcctcctccgccgttttctccttctctaagctaccgccgccgccatattgccttcgacgccaaggatcccctgcccaacatcagccgcacatcatctcgctaacgtcatcctttgtgccgaaccgacactatcgtccaatgggaagaaagagtcggcgccgtcgtcctcttctccacgccgccgtcgccatgtccttcttctcctcctcttcttcgaaccgacctctcgccgcctataaatagacggcgaggtcccctctttttcacacatcatcatagcttgaagctcttcctctctctcctcccatggccgatcgtcgacgccgtcggtcgatctccccatccgtagctcctcttcccctctcctcgcaccaccggcttcgcctccatccggcgagtccatttttcccctttcccctctccctccacctctaagtcaagtcaccaccaccatcatccatgccgactcatggtgagcccttgccgccgctgttccggccatctccctcactccctccacctgccactaccctcaccgggtgcgcgtcgtccgggaacacgtgtgtccgccggcgtcgcaacctctcgaccaccggagcaccggcgcccaacctctctctcctctgtgttctcggcagaaagaagaaggaaagaagaagacgggagaaggagagagaaagagaaaagaaaaagaaaaggagaacggagtgacaggtgggcccttctacagtacaatttcgtattttctagatttaattcaaatctaatctttagaagcccatatctcctacaccatagatccgattccagtcaaacttggacctaaattcatctaaattcaaaagctacattttgatatcaaatttgctattttactattttatttgaaattccttcatgccatttgaatttatatttgactttcgaatatttcctttttactccaaaatagcctttagccactaaaaagccgccggttgaaactttacgccttccatggggacgttcgcgcggtctactggccccgacgtcgaaccgttggttgtaaagcccggcagaacccaaacccaaggtcaaagtgctgctcctggcaccctacgcctcgacgcgtataacagtcggagcttcactattccctcgaccttcacagcacgccgcatagttagctctcgagctctgtgtgatcctagccgctccaccgccacccacggttgttggagtaacactccacccccaccaaacctataccaacctcctattcctctagccgatatgttgtcggtcgacaccggctagagaaaggtatcaaatctactcgttatgctctagcatcgactagcatacaaccaaccaaaccctagccgatatgttgccctacttcacaatcggcttaaataccaccaaaccctaggtatcatactgcccaaacctaccaccagccaatactagccacatactcacttaaccagttatatcctttattctccaagcaaccaaaacccacacatgaaatataagcgccagtagttgcttaatcccttctagcctccaactctctagaatatccgcataaaatatcagcaccgtaatccatataccctataaaataaaatagatagactatatcctaaaccctagccctcctaactgtttatctctttcttgctattatatggattttattgaaattggttcttcatctttcttagtagagtctattttattttggatggcaacctgtgatatttcgaggattggataataaggttgcttatctcggatttatttgcgttggagcaaggcaagttattattcctccccttgagcataattaccctatattctatatctcttttctatgcattagtcattcatgattttgaatgcataacctgaacatatagcaaaccagatatgctagcttttgcttagccctgcctagttaggctgcataaaaatataatgaacctagattgggacagtacgtaagatttggttgatttctgggtggctagtactgtcccggtcgatataattgccaccaaatacttatgtcaaacgaacgagtatgaccacagcttcttgaatggggacagacctagatattatgttaattagcaatgtggtacctctgtacagtggttccttttgtaagtcctcgcgcaagaggcaatcttatgccgagcagggcatcttatgatatttaccgaggcgcaggtaaatatattgattttcgctcatgagctgtgtgtgtgattttatgtaaacctggttgagatgacgggggtctctcaacccgttctctctaaaaaccccgggaacgccagaactcctctcgctgctgataacgttacgttcagagcgcatagggactagagttcatggaacaggtgccacaattgttaataacctaatagtgggccatgactaagctaatgaatattggcaagtcatggactgccggtaaagcgtacatttactgcagtaaagtgaaaatgaatctattcgaatagccgtgctcacggatttgagtatcgggactcatatggtatttggttagaaacctaattcaagattttattaaatactgatgcatttcaaacatcataggctttcttcttctacattatctgctttctgcaagtaaatctagtcctactcaaatactgctatttcatacattcatattgaatataatagcttgctgagtacattgtactcacccttgcttcaaccccatctttttcagagtccatttggagttcttatcgaggccgggagttcaatcacataagttagttcccttttaacttaatcttcaagtctaggttatttagatggtttaagtctatagtaaaacagcagagttaggtcattctaaagcttctgctgtaatagttagccacaatctcgtaaataccctattactttatgtaataatatctccttcaaagctatgtctaaacgtatgcaaagacgatccagattgttgaagctgtatcaacttattgatccagggcttgatacagtctaaacatgtcggttaccgaatcattagttttgggacccgacacggcgacggcggggggaaaggcgcggcggcgacggcggctaggggagagtggggaattgagtgaggactaaggtttgcaatgtcttgggcttgggccattttgttgtattgggcttttgggctgtgatggagtctagctcattaaggctcgcgagccagctcgagctggctcgttatctctaacgagctaaactgccagctcggctcgttagaaaattcaaacgagccgagccgagcctgtcacgagccgagcgagctaacgagccacgagctttctgtccacccctacccatctctctactctatcctctaagtgccggggaggaatagggttgttgcttggtcatcgcctcccgcactagtcattgttgctcgctgctcgccaccgctgcccacttcctaatggacccaaagctcgctgccagcggcttcttcgaccgctaccatggcgggggtagaggggagaggaggaagcatcaatgacaaaagattgctgaccatgccgcctggatccacttgccagccttaaagctcgtcgcctgcatcctcctcggctaccgctgtggaccaagaagagggaagaggaggcaatgttgaaccattagagacataagctcgctggccacgctgcttagatccgctcgtagactccttggcagccaccatggctcaggaagagagaaggcgaccactaagcagtagccatagaagcttggtggcatgccacctagatccgcttgcggccccgaagctcgcgcctgtggccttctcggccactgccatggggtgcgaggcggggagatgaggtgatgatgaagcattaatgatagaagctcgccggccacaccacctagatcttctcgccggcctcgaagctcatcgcctacagtcttcttgggcaccaccatggagcgagaagcacccgttctcaacttctcattgatgaagatgcatagggagagagagaagaaagagaagaaagagagagtgagaaataagaggagagtcattgacaagtgtcataactaggtcaatgagccacatcagcgaaaactatcctcaaaacatcatctatatagttattttgtaccagttttaaacttttaatagttagaaaaatcagtgatatttgtgatggggagatatgaatttaatttgggaaactataatttgatgagaaagtcaatgcgttacttatttcgttgcgtatttcgcggaagggatacgggccagaggccacatcacagcaccgtggggcgggtgcgctatcagcgagtgggcgtggccgacgtgatccagcccagtattcgagccgcacacggagcgcgagagaaaacaagacggacgaggccgcctgcctgccgcccgcgccgagcgccacgcgaggggcagatctggccgcccgatcgaccgctatccggccgcggaacagtggagcttgtgacggtgatccccgcggcgcattccgtggctatatatccacttgcgcaatgtcagtgcgggcgtacggtacgtcggcggtatctcgtccgcggcagctgcaatattctcggaacgaccaaggccaacggcgcttttttactgccaaacgggctgcagtcttctttcccgtcgagaatcctcaaggctcaagccagtgtccgtgtcttggtgtacgtacgagccctacacatctactcgattcgatattgcgatgctgcatttattgattactacttactccctccgtcccataaaaaaccaacatagtaccaatgtgacatattctaatattacgaatctagacatacgtctgttcagatttatagtactataatgtatcacacattcgatatttcgtttcttatgaaacggatggagtattactaactgttgcagcttcgctctcactggtggagaaggggtttttactcccggttcgtaacccccatgtactacgaatccgggactaaaaatgtttttagtcccagtttttaatataaccgggactattgtgaaatctggtcgaccgaccaaagatggtttctccaccggtgtctcaaagagaaaaacgaaaaattgcatcttcattcagggggagtagctcgctgtgatgtctctttcaggccaaaattattcaagtaggcaacagagattaaacaacggatccatcatccatcccctgccgccattacgcagtttggttcagctggtacactcttaaaaatctaaacggacaacaccctccaggtggagttggtgcacgtacgtacgtgcctgttgtctcctgttgtgacttgtgtctcctcatcatttagttctaacatcgtacatcatcatggcaactgatacggattagtcacagtttattctttcgagccagctgggttagctggtcgctacttaaggtctgaaggaggaggggacgcctagtttattcacctgcctttggtcctttccattttgataaggtatatcccacttgtaatctaatctagtcctgatgctattattgaaaactcatccttaatttgattccctttgtccagtcatttttcttttcttttttgtcgtccacgtatgcctatcgtgtaatgctgtgtatatatgtcgtcgaacaataatctcgacgctgattgctgatctaactgaccaatgaactaataaataataacttgtgagagagagcaatgaattaactaattcttgcaatagatattcttatctggtttttgaaaccacgcaagcaaaaataatttatttgcatcctgttttacaattgaacacaatgcgctacacggaactgcaaaaagtatgctgttgaaaaattatttagtgcatactattgcctctaatcgggggcggatccaggaaaaaaaattaaggggttcagttatacggtatcttcaatctccagctatttaaggactttagtttatcatttatggtgaaaaaatcgaaggaggtgctccagaggtatccatgggtcttgagggtgtaggggggacttgagtccccctgcacccacgttggatccgcccctgcctctaataaaatatctggcaaacatgcacacaaatcgcaactctttgttttttcaagtgaaagagacaaatgggcatatcaatatatttcttataattgttttattcagtattttagtggaagaataatatacctatatgtcagcttgccgtctgcttaatttacaaatatatattttttaaaaaagtggctattcccggaatataagggataagatggtttcctgaaaggccatatgacttctgcaaacattaaaaaaaattatgaacaggataggtatattaatcagttgctgcgaaatggcaaagctgactttgtaaattttgttcaggaaagtgttcggtgacaaattatttaagagaactgactaaagtttgtagtttatggggtgatttgaactatcgcaatagttaaatgggtaattcaaactttttactcataaagtagaagcatgatcaaactctcaactctagataactgacataaatatataccggggtccattctaacttcagtcttcaaggacgtgatactaaactgtaaaactagactttggttggtaattgatccttcattgccagtttggcacagctcaaatcaaagaaattacaagttacaaatgcaactgacagaaatactgcagtagagactgtagagtcgtagtgatgcagaatataacaagatagaggctgtgattagatcagaggtgtaaagttttagcgtatcatatcggatatgccggtacataatgaaagcattaaactagactaataaaaaaactaattacagaatctatcagtaaaccacaagacaaatttattaaacctaattaatctgtcattagcaaaccacattgttaaatttttttagcatatatttaatattttatgcatatatccaaacattcaatgtgacctgatgtaaagttttgtcagggatctaaatagggccaaagtaacaacgcagtaatgcacggcatatgcacatcgatcacacagtgttcacatttcacaagcacccccatatagctagccaaggtcacatggcgatgcaggagaaccgcgagcagatgagtagcgcggttcacatcacctgcactgtagttcacagtgcggctatagcggccagcccagcggcgtttgaccgaagcttaaacatgcatgacactgtgcgcatgaacatgcatgaattgcagtctctgcagatgtcgcatcgacctggcactacgtaaaccacacctggatctggatctggcacatgaattgcctcctctagctaatttcactgcaaaaaagaaaaaccgcaaactaaacaccctatcatgtactgttccagctagtagaacacagtagtatagtactactatactacagccccatcgtttggcctaaacagccaaagaataagccaaaatttgaatttttgaacttgattttgaagttgattttgaaatgcttttaacgtaatttttgttaatgttggcttttaagtcgctacgaacaaatctacaaaagttttacttataaattaattttaattttctaataagccaaataagccattttggataaaatggcaaccgatgggagccctagtagatcaactgctttggtgggcttttaattaagcagattccatttgaaagtttaatttactggagctgtgagtgtgcgaggtcggtcaggttagttgggaaggttgacacggagaaaaccggtcagtcttgtcatcgcggacagcacggacacgtacgcgcacgcctacacgtgtgcaggcgcggccacatgcagatgccgcgccggaagtagagaacacgcatgcgacaagactacaagagactgctaggatatgagaattagggggtgtttgggtgctaaaaaataagtctcgggacttattttttggtttgagggactaaaatcacctaaacacccccttaacaacctgcatacagtagtgtttgtgttggaagcctgggagggccaagctagccaacgtgccgcgatctttggtgatctttgataagatgtgcagttgtgcactgcacagactcgaagggaagagagagagagagagagagaaaagtagtacagtactgtatacgctgcctgtccattctgactgacaattttgtttgtaccgacgagcctcggctacgcgactactcctacacgcgatagttcacgacgagaaaagttaggaaccctccgaactatcgcggtcatctgaattaccccctaaaccacaaaaccggacattcttcacccctaactatacaaaccggacgaattacccccctcgacccaatccacggtggttttggtctacgtagcgtacacgtggcagtccagtcagcattctatattttaaaaaaatgtggggcccacctgtcatacacactctctctcactcacgtcagcggcaggcgggggcaacggctgagggcggcggtgatgtgaccatgactaccacggatgcaaccattgctcacattatggatgaataagaagatatcgagatcacgtcgtccaagtgctagaatccgattcggccacctgctacactactgacttcaaacggttaccgaatctgcatacgacctccgttttcggcccgtgagtatttgatggaaagctcttggagccctttttctgacggatccagcctcatctccgaattccatctcgtgtggccggaatcacaggcacaaggtgttgcatcacctataatgggcctatgggcttgtaacttcatttgggactccggcccaggtggggcccatgtggggtgcgccccaaccaggtggagcacgcccctaggcacccctaggtcgtcctcccacccctatatatagctaggtactccttcagggtttattgggttttgttagattaaagtttagccattgctacttgcttgcagctcgcgtgtcagctagaccgcccgtctgcttgttcttcggaaccccaacttatcgtgtgtattcattcctatttgcaatatcagattgcttttatcttgttcttgcttgtttcttcgatttgcttgcaggaataaggttgatctgcaccggcaagatcaacaacccacggagaggtgtatcgatcgcaaaggcgcaacacaatgtcttgtacggttgtagtcggatcgtcaacgtttctcccaaatcgtagttatctcaactcaccgaaagatcgggccaaacaactgccttgagtgtcgaatggaactcagggttcatcaggtggcctcggcgcggaggcggcgggggcggcggctgagggcggcggaggcgccgtcggcagtggtgctgccgccgcgtcgccgctcggcctagatggtcactggcgacgcatgcacggcggtgctatgcggtggcggaagaaggcggcgacacgaaaggggagaggaggcgcgagcggcaagggcagcgactcgggatggttgctcgggacacgggaagggcgacagcgacgagaatcgagggggagaagggccgacggcggagcgtgactactcagcggcggtgggaggggaggcacggcgcgggagctagtggggaggccggcggccaaggcggcgggttggggtggttcaagggaactccaggagggtggtggcgcgaggaatcgacgaggaagaccacggcggtgcacaatcgagcgcggcggcggtgaaacagagcaaaaggggaaacgacggcgcacaatcgagcgcggcgacgtcggacag

SEQ ID NO: 74067 - DNA, 18426 bp, Oryza sativa
  unsure (1)..(18426): unsure at all n locations
cctccactcctaccactgttgagctaaaactttttagcccatgtcacatcaaatatttgacactaatttagagtattaaacatagactaataaaaaaattaatttcataaatgagagctaatcaacgataagatttttttaagcctaattaatccataattatcaaaagtttactgtagcatcacattgccaaaatcatgacgtaattagactcaaaagattcgtctcgtgaattagtccaagcttatggaataagttttgtaattagtgtatatttaatactcgaaattagtgtcaaatatccgatgtgacagggacttagaatatgtccctggaaaccaaacagccccctagtctcctcttctcctggcatccctttcccttttgattcttttgatttggtttccctcccttctcttttgttttatttttttcctcccttcttcttcgattcgtcgaccccggccctgcttctttcgctacggctcctttgccctttttcttcgtcttcgactccctttgcgtttggaagctcgcagcgcttcgatcggcttggcctactgctaatcatgtgcccaaacgtgctgcttgtggagatagcggtagcccagttgtaggctgcttttggaccgaggaatgagctcgctttttagggccgatctgatgagagtgagtacgtaacgtagcagcagtagtagcatcgtgctgtaacatctcgtggtgtgatccatccatatccatcgatcggtggatcggtccggatatactgcagtcaaagctggtgtggtctaagggtgcagcgacggcagcgtacgtacgttgcgtggtcgttgatcgatcgatcgatccgaatcacacagagtcacagctagctatagctcgatcgatcagacgatcacatggtacgtgtagtaaataaatggcattcgatccatcgcgtcgtcgcgagagagataaaaggggcacgatgcagtggatgcatgcagtgcagatgcagatgcagcgccaggctttcgggattcatcagagagctgcccaccgaacaacggacgcttgcgcatgcatgcaatgcatgccacgccatgcatcatatcctcgtcgtcgtggctgctttgccagcttgtttgcccccggtggtggtggtggccggcctggggatcccacaaagcccagcagagagggtaggaggattcagggacagatcgaactgtgcccctcgtgatcggcgaaacccaatggagactggacgagtacccagcagatgagccgcacaagctatagtttggcgctatgcaccagccagcccggcctccacgtccccatatgctgcgtcggagactgttcccggtttcacgtggcctctcttttgacccgtctttgaccacgccccagcaagccagccagccagccaagccgatcgatcgaccaacaggaaggcaaggcagacatgagacatcctcctcgcccccgcgcgcgcgtcgacgcgcatctgcctatctatcccctgcggcggacgggcgctgcatcgcgtctcgcgcccggccggaatccgaaatctagccgcgcgggccagggcggccacaggccacgtaaaaagccgccaccccaccgtacttcacgtcgtcgctataaaaaccccacacccgtaccccttcacccatcatccaccaccaaccgatccatccatccatccatctgccgcaaatctcctcgtcgtttcgccgaccagctctcgctgccgcccgcgtttgatcgagcaagtcgatcgttggttagcgcgtacgtacgtcttggtcatttgcagctgccacacctccgcgccatcactacaaactcgatcgatcgatcagagagtagtgcagcgcgcggttgggcatcatgctgcacgaggcggcgccctgcacgtgcgggctgctctacggcagctgcggcggcggctgctcgctgctgttcccggcgggggcgccgggggaccaccaccaccaccaccactacaagcagtactgcggcgccggcgacggggagtaccccgacgtgccgtacggcggcggcggctcggtggactgcacgctgtcgctcggcacgccgtcgaccaggcgcgccgaggccgcggtagcggggttgccgtgggatcagtcgtctttgcagcccagctgcaacgggcggcaggagatgagcggcgccgcggcgccgcgcacggagcccagcggtggcgcgggcgccgccgccgcgtcggctcctcgccgctgcgccaactgcgacacgacctccacgccgctctggcggaacggcccacgcggaccaaaggtactgtccattgcctacaaaagcacactgatcataacatacataattacacaaacacgtataagctaatgcaatgtgctcgcgtacacaagcagcatacacgcattctcctgcatgtgtgatcgattcgatgctaaacgtatgcgtgatctgcttttcagtcgctgtgcaacgcgtgtggcatccggtacaagaaagaggagaggcgcgccgccgcggcggccgtggcgccgacggcgctggcgtcggacggcggggtggagtacgcgtacgggtacccgcggcagcagcagcagtggggatgctatgggccggccgtggcaaaggcggcgtccttcggcatgttcggtgacgcggcgggcgaggacgggccgtgcctgccgtgggggctcggcgtcatgccctcgtcgccggcgttcggcgccgtccgggagatgccaagcctgttccagtactactagctaggctaccagcctcatcttactccctcttcactcactagatctcttttctcccctttttagtaacaacaagatgctgtacttctttttgagggcatgagatgctgtacttgaccaacgaccccagctgcatgaaagttgaagctgatatgtatggtcatcaagttttctatactaggctgcattttgtcatcagcgtccattgccatttgtaatgtctattatttgagtaaaatagatttttaaggcaaattagccaaacattaattatatatgcgggtgaagccaacctgctaaactatcatctctttgttgcacgacgattgcaaatagtagtagtatagtactgctgctactaaagtacagtggagccctgttctttttgtgcaagagcatatggtatgacgctgcattaccaggagtaacagtgcctgttcctgttggtaaccatgattggtttccattggaaacaccgtgcacagggtagtacagctagagcctatagagagatttgcacctttttgctgggccctgggagtgggaggatgccccaacggtcaatcatcggtagctgcatatgtcctgggacccgccaacgtaagggcccgcgttttcatagtttctacagttgtaatgtatcagtagtctcgactttctacgtgattctgagtaagaacaagtttaatagtatagccaactactagctccaaatcatatatagccagtataataatcaatttatataatagttacttactatactattaatacttgattctacctgttatacacacattacgttttagaggctgtgctgcagctggctacatatctgtagatctgtagcccgctgcttttctctatcttccttttatctttttaaaatatatttatagttagcttatagcctgctactgtacctgctctaagctgcccgatggaggagcgcccaaactgcagtcgatccgccccaccgctgtgtgtgtctcagtcctcgtttctcttctccggccgccgtgttcgtcgccgccatcccactgactacctcgacatagttgatagtagtatcattttctcaaaaaaaaaaaacatagtgtagtttcatcttgaaaaccagattacttagcccaagttgcacaatcttgattgttgggcagttgggcttagttgatgtatgccgtgtacctgggcgtctgggcccattagaaaccccagaacgtttggtgtaggcccaggccgtgtacttgggcccatctgaaaactccaacacgataacgtggcaggctggcggcgggccccttcccccatgacccccaaaatctgatccaaaccaccatccatcaacccaaccacaccccgcgcgccacgctccgtcgccccccacacacaacacaaggcgttactccggcacctcccgcctctctctccctcgccatggacgcggcggggaggaggctcgcccgcgtcacggcccacctcctgcccagctccctcccgctcccgctcgcctccgcccctaccctcgcgccttcccccgccgcgtcgccagcgtcggacagctaccgacgggtccacggcgacgtgccgtcggagcccccggagtggcgcgcggcgacggacgagtccgggaagggcttcgtggacatcctctacgacaaggccgtcggcgagggcatcgccaaggtgaagagctgtaacgaatttaatctgtgttatgccaaatttgccaatttaatcgctgtagtgtacagcacagtttagctccctttgttgaattgctaagaccgatctcttttgttgattagcattatagtgtgtgttcatctcccatttcgtgattggctgattcgcaatcgcgattcctgttgcagatcacaataaaccgccctgatagaaggaatgcattccgacccctgaccgtgaaggagcttatgcgtgctttcgaggatgctagagatgatagttcaatcggagtcatcatactaacagggaaggtaactatgctagagaaatcattaggtattcaggttccagctggtacgcaatgtgaatgaaatacttactttgatgttttttgatggacaggggacccagtccttctgtagcggcggtgaccaggcgttaagggatgctgatggatatgttgattttgatagctttggcaggctcaacgtcctagacctccaggtcatacgcattactctgacatttgcacacactgattgactatctcataaaaatatattctcgcacctcataacaagcttctggtgctccatgtgctgttttttcaaaagcattccgtgcaagtattcgagggctcagttttgtagctgaggttggatgtactactctcctctgtatgtttatctaatctttaggccaaagcctcttttcaggataaaattcatttttagattactaggcttcaattctgagtgtgttcaatgttcatgatattcttatatgagcttccataaactactctattttggtggtacttcaagtcctacatgaaaactacttgttcacattgttgatgtcttatgttccactgttcactcatcaaaccccgtacagaatgatgtttttagctctgagcagaatgtacattttgtttcttcaggtgcaaatacggcgccttccaaagcctgttatagcaatggtattatcatcactattgtgtttttcccctcatttaaccattctacattagtactacatttctaaatgttaaatttggtgctcatactatatcaggttgctggttatgctgttggaggaggccatgtgttgcacatggtgtgtgatctaacgattgcagctgacaatgcaatttttgggcagacaggtcctaaggtgtttttctggcctgttattacttcctgtatataggcattacacgttgctattataaaagttagtcgatatagcggaacgacgttagttgctatcacagtatcactcaaagttctgatgcaacttctgttacaacaatctaatttgtcttgacatttcttttttccttttttcccaccgggccagcgacagaaccggccaaatgcagtaagatttaaagatggaattacataaagctagagtccaacgacatgattgttgggaggtgtattgacctttctctagcatgtagaggtccttgtgcttgctttagtagcactgatgaatttcagctatgccacctaaagaatatgataactttggtttcaccgtagtacatctaagcttctataagcttattcagactttgattaaatgggaaaattttgtcactgaactactagtgcaatcaaatgttaatgaaagtaggttgaatagcttggtgtttgggctatgcatcaagaacacacggtgcatttaggctctgtttgaaagcccgtttagcttttgctttactgccagactgccacacatgaaacgaaaaatatcattagcatatgattatttaattattaactattacaaactcgaacaattggttatttgatttttcaaagaaacttttgtataaaaagtttttgtaaaagacataccgtttagcaatttgaaaaatgtattcatggtaaacgagggagttgtaaaagctaaacgaggtttcaaacattgtttccttgtagtttgacagattgacccttaccgggattcgggattacctgtgtgctatagtacttttaagagtaggttatctgaatggtctaatctgagttgctttttttttttgcacttatcttttttttttctgaaagattttttttgcttttcttattcagagtaaattttatcagtgaaacgcaaagcttactttaccttgtctctctgatttatacaggttggaagcttcgatgctggctatggcacttcaattatgtctcggttggtaagtcaatgaggtgcatgtcctcaatagagcttttgtgtcattgcgtaactttccatatgaccatatcatgcattgaaatcccctatccaaaacatcttcattttttcagaaaatagtaagatgtttctgtctctctttttttttcctgtctcggacaggtaggaccaaagaaagctcgtgagatgtggtttctgtcacggttctacacagctgatgaggcagacagaatgggtctcgtcaatgtagtagtaccagtgagtgcccgaggagtttacaactaatgcacagtctctaactctctatgactcatgccaggtgtttatgcactaaccgtatacattctttgtgcatatagctcgctgatttggagcgagaaacggtgaaatggtgccgaaaaatcttgaggaacagtccaacagccatccgggtgctgaaatctgcactcaatgcagctgatgatggccatgctggccttcaggtactagcaccattcatcgaaagccagagataaaactacagctcctttcttcctcctttgtaattgctgtagtaaaaaaacaatcctccttttgcctctttcctgaacatacttaccccttggatgcttgagtttattggaaccactgatgcaatcggcgcttctgctgcaggagctcggtggcaatgcgacactgatcttctatggaactgaagaggcaaaagaaggcaaaaatgcatacatggagcgacggcgccctgatttctcaaagttccctcggaagccttaaaagttgaacttgtgcactactagtacagatttctctacaattctgctgtatgtcatgacgcagactgaaatgctactcaaatctccgtttcctcgtcaactctgccggaagcataggtgggcgtcccaatgattgccagccccggtggacgggtgtagaagcgagatcgttatcctttacatgtcatttgttagttggcatttttataggtgtaaattgcagtgcttacgtatatgtgaatattcatcccgacatatcatagccgctggaaataaatggccttgtggtgcattagttatttgatcctataacaattggcctatatttatttttttgctggttgttttgtttgcttttcaatttattttaataactttttcaaggatatttatctgtaagaatttggatgtggcttgttgataagagtattctgtgtattcgagattctttcgtgaccccgtgagagatgagatgagcccatagaaaacgatagtttggtgacgtaaacctgcggctgaggcccagtagagaaaaccaaaaaggcccagtcctccttaatattatcctttgttgcgtcgcgtctctccacggccccgaatcgcctgcggcagccaacgcagcatccaccgtgtccccatcgcaagcgaacgccacaccaagtcgccacgtacccaacacacgctacgcatccaccgagtcggggcgcacgggatccccgtctcccccgcgccgcacaaaataacgaaattaaaaaaaagataataaataatattattaaaataacaagaaagcacagccacaattcaccacctcctcctcctcccctctcgccgggttaaacaacgaggaaaacctaacctaatcgggaaaaaatatcggaggaatccagaagcggggggctcccaccttgttggcgacgatgctgcgcgcgggagggaggcggctcttggcccccgggctccggcgggtcctcggcggcggggcggccgctccggtggccgtgggcggggcgaaggcgtaccacgagcgggtggtgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnccgcgttgacgagagctccggcaagatcgtcgacgcatgctttaagacctttgggtgcggatccgccatcgcgtcctcctccgtcggtgagccccccaaccccaactattcccctacctgttcccccccaccttcccttggatgatatggtttaggcttcgttttcgtcttcgtgaggttttctgtatttttcaattgttgggccatttgccaacgatgagaaattgtcggaacgtacgaggaaggattgtgatttgctttgtagtatgatagggaaattccgggggccaattctgagcgtgagatatagctacatgagatgcttgttgaaacaggaaggctgtttggatcagtgtaggaattatagtactaacagcaatattttttgtgtctgtgtccaatagctgcctgtgttttttcaccttagaaatcatgttcaattcaaatatattcaatgtaatgttatcttgatttggtgcagagagtattaatactatgtgtatgttgtaaacctgtggaggcagatgtggttgattaatcctgggtttaatttgattgagttatgttaatttggtggtctagggtagatttggttgattaatcctgggtttaatttgatttgagttatgttaatttggtggtctagggtagatgtggttgattagtcctgggtttaatttgataagtatgttgttttggtggtctagggctaaggtgctcgttctgcttgtctggtacaagcggttactgttttcagatgctcccctccccctaatgattttctgttttggtgagcttatacttatggattatttgtcctaattagtagcattgaaagtttttacatttcccaagttgtatgtcctaaacgaaatttgacatgattgggccccaccactgaacaaacaacttgagaaaggtgtattatcggtgaaatacttttgatagtcagcagctcaaactgttctcaagatgatcgcaattttgtggaagaaaacagaagagtctttacagaattgctatttatgttatgtgcattattctgttgtgaggcgaattcctgtatgtaactttattcatgttatgttacggcaaatgtcgccatgatatgatgcatactgtatgtattgtttgctagttataagccaaaaactagaaccaattgcagcttgaggttaatattaacttactttaatgcatttgcatattttccacatgaaaatcatcatgttcagatgcctggagttcacccctgttctcaaccaatagagttaacaacatcagttgcccagctggtggattaactcttatgattgttctctagaatctctttactatggaagattgtttgtgctgagaaaatttgggtcccaacaacaaattcaattcctgatccggcttttgtccttgcagctactgaatgggtaaagggcaagcaaatggaggaagtagtgactataaaaaacacgtaagctattccccttcctggttgtttgcactgcaatactctcagtggttacattaacatgctatgcttatatggccttttggatgtcattgaactactgtggttcgttattaccttgtggtaattaagtttctggctggtatgtgcaatttccttttcagaccatactttttcatcaaaattttcaatactaaatgtcggtaaaggggttccatctgtgagattttctttgtcattcgttgtcgtaatgatgaccgtctttcagttaatgcttcagcatttggacatgtctgaagcactttggtaaaattatttgatatgcacttgactaacatgatgtttccagaactgttttgtatagatcatattggtttttctgtagttccttggcagtggagtgtgtcatgtgtttgcattgattcatgaacttatttgtgtttaatggatgcattttcattcagagacttgatttgcctgtttgctaagagttgtttggctgctcatattttcttatgaatgtagatggtaatcccatcaggataaccatgcagcatacagtttagcttatgccctttgcttgcatggaagactaatatactttccctttatttttactaattttgtattttgtctatcaataagtttgtgtgtgaggatgctgtcaaatgctttcaatcaagttctgtaaggctgtaacagggttttgtgctctgctttgcagtgagattgccaagcacttgtcacttccaccagtaaagctccattgtagcatgcttgctgaggatgcaattaaagctgccgtgaaagactatgaagcaaagaaggcgaagctagcacaaaagggtgaagagaaggctgccgaagcatgagtgccagaggttctgtcatgaagaatgttgcagtgccctgcgtactcgtagtaaagaacctgtcatgaagaagtctctgctctgcttcttgctggcgggaaatagtgtgtaacgctcacaaactctatgcagcatgtatcataaggatgaaggcaaacatttttgaataaatgtgctgtcatcttgaaagaaaaaaaaaaggtgtatgcgtgtgtatggcctagtaatgaacatatggtacggaattacggtcgcgagataaggcacattgtttctctttggttgtttcaattagtcttaggttgagttggtagatgctcatgaacttgagttgcctggtcacttgcatcatttttctttttttttaaaaaaataactgtttagtagttctccgtgtttctccatccaacaggaatgcagaatagttattgttttgagagttctcctagtatctccatccactaggaatatactgaacttctgtagatatatccatggtgcctgtaagagtgcaagttctgtttgagagacactcggaagttcgcagggcgagtccggttaatggcccgtcacaagcagctgtcacatacggcggagtatgcgacctccggcatcaccagacccgcgtcggctgccgccggatctaaagtcaggcacgggaggaggcggtaggcggcggggatgctggggcagcgtgcggatggcggcggcaggcggcggggatgcagccatgcaggtgtcagcgggagtagaggaggcacggccggcggtgtgcaagccggcgtggagcgtgcggcagagggaggccggcgcggcgggcgtcgtggaggatggcgcgacaggcgtcacggaggccggcacgacagtttggagtcgcggtcggcggcgtggatgtgagatcggtggtgacggtcgcgtcacctggaagcgaggtcaatgacgacgtggaaacttggttggcggcggcgaggttgtcacagcacgtgggggcgcaatcggcgtgaggtgaccggcgaggcatggatggtgcggaggccggtgaggcgcggcttgcgcacggtcgcggcgcaaggaggcgtggcagaggcccggcgcgacgtgaggaggtgcagctagcgcagtgggaggcgaggtcggcagagacggaagccggcgaggcgtgtgccggtgcggtacaacgaggcgcggccggtggtgacacgtggaggctggccagcggggagcgccggtacagtggtgcgtatgcgccggtggtggtttagatggtggtggagcaatggtgcgtcaactgtggattggcaggcaaagaacggcgggtgaaaacccagcctaaccttgaccgggctggcaacggtggcgtttatgcgtcactcccctcctgagggtgttgtcgtgccgtttcatccctctcaaggcagaactagtaaagcttgcagtagctttccacctccgacgaaaccggagatccttcgccaaatacgaccaaacgtggcctttccatcatcccaaaatcaaaatacgaaaaagggtaaacgctaatagcatcaccccctctgaaactctgacgccattgcgatcacatgttaaacctgtacgtttggcatgccagcagctcatgcgccagaagcaattgagcttgccaaacattaaccatcgcttttgagtgcgtccggtaaagcacgcgcgcttccaggccagcgtacgtcggcgaactgatgcggtgcaggtaagatagcgtttcacgaccctcacctaggcagtcacatggttagttggtcacacgctgatgcgcgccaaatccatacaccgttttttgcagcaaatgggctgtgagcccacacaagtattgccaactgggcttggacgggttactgagctgtttgggccatctaccaatggttaaaaaaaggaataagttcatctaaggtcccttaacttgtcgacaaatccgattttcgtccttcaaccgcaaaaccagatagaacgggtccctcaactatcaaaaccggtgtagattaggtccctcggcggtttcgatggtggttttggctgacgtggcgtctacgtggctaattttgactcagtctcgatctgatgtggcactgatgtggcgtttacgtggcaattcgacctgggaaaataataaaccccatgggacccacatgccagtttcacacaaaaataataataataatggtgggacccacgtgggccccacatgtcagtctaactcaccccctcctgttctgcttcctctctctccttctcccctctctgtctctctcttgcgctgggtcattctgattctcctcttccccatcttctctgtcttcatctctctcccctctcctctctctctcttctctccggttgacaggcggcggggagagggcagtggccggctgggagaaggggcgcggcgcggcagccggcgggagggaaactagcggggagaagggaactagcccggcggcggaggcggcgccgccgtggccatggctgcggacgacgtcgacgtcgacctcggcatcctcggcgacgagatgaacgtgtcccgctgatcggccaacacacgcgcgcatcctcggaggcggccatccgtgcaggcgggtgagggggccacctcgccggcgggagaggggagaggcggtcggccgcgaagaccaccctagtgacgatgattccaactacaactcctagtgacgaactcgaggtcgacgacgaggactctaactacaactcctgctccgccgctgccaacgacaccgctaatcccgtgagtccatgacgacctcgctcacctccgacggccacgtcgtaagcgtctacttccgccttgaagcgcccctggcgacgtcacgcctgtgccccaggcggccactcttctccattttcgccgccgtcgtcgtcgccggccgcatcccctagcacaagagagagatgaagagaggggaggagagagaggaagcagaagaggaggggtgagttagagtgacatgtggggtagcgtgggtcccaccatcattattattatttttgtgtgtgaaactgatatgtgggtcctatggggtttattattttcccggatcaaattgccacgtaagcgccacgtcataccacgtcagatcgagaccgagtcaaaattagccacgcagacgccacgtcagtcaaaaccgccatcgaaaccgtcgagggacctgatatgcaccggcgttgtatctagttttgcggttgaaggacgaaaatcagattcgttgacaagttaaaggaccttagatgaacttattcaaaaaaacaaaaggaagaagaagaaacagctttctatgagcttcccatgaagtcgatgagctcaaattatttgctgcgagaaaagaactcagtgctgtgttacaaatcgagtcattttgaccgcatgacttattgactttctcccagtgcacgacaccattggcatgttgagggggcagatgccagatgaggaacactcctacagttaacttttcttcaaaaaattgtgcaggttagctgaattttcttcttcaaagatccaaatcatttttcttagtccttgtttagcttgagacttgagatgtgtgggtctgattcagcttttgcgtcgaaattacagggtagacagcctcccattgctacatgggtcggtagatgcgtatcatcaaggtgccaaatggccaataggcaatagcatcatcaacaattcacatcttacatattacaatagagtttaaaaatagaacttcctccacgcaaaaaagatagaaacaacatccatttgggtatctccgcgcatagatatctggaaccttactacctcaggagtgttcttcatctggccccctctacatgtcaatggtgtcatgcactgggagaaagagtcatgcggtcaaaatgacaaccagaaatggttgtttctgtaaattcaatacgatcaagggaacacggcataaatgcttgaaatcttctggtaaactatcaatttagggtgtatttagttcacgctaaaattaaaagttaggttgaaattggaacgatgtgacggaaaagttagaagttttgatgtgatggaaaagttggaagtttgaagaaaaagtttggaactaaagtcggccttattgttttcgtatgacgcactatcaatttgtttgacatgtctaatgtcttcgagaaaaatagtttgacatgtcagtagagtgatgtacacaggcatgcaaaggaagcaaatcacataaatcacactaactattttcaacacaatgaaaaatgataagcggagaagactactgttagtgttattgttactttaaatatggtatatatagcatgtgttcctgatgaaggaaatcacaaacatgcaaaaatcgtcatgaacaacaaagaaatgtgagagctgaaaaggcatcacagtgttaactggagaaatgagctgagctaattcaagaataaaggtgataaccacagcactgaaaacaaggccaacaaataaaaatgggatggcacattatggtagaatgcgcgcacaaactggaaatcagtgggcagtgatcctcacaatgctagaagctcccccacaaaaaagtgacagcagcatttgagcatctataacaagaacagatttatatcgagaagaactataggaacaagctgaacaagctaactaataagcaaccaatctgcatgaagttttaattttagacacaattattgaacagccccaagatgtgtaatgtcacagttgcaggaaccaatcatctacaatatgtatatgttagctaacgacatttgctcatattcgcttatctcggggcaaaagatgatactttgaaacaactgtctgtcacttgtacacgggcaggatcgcagtaatgatacatatcaacttctaagtgtcttggcatcatttgcaggatggacttcaatgttcagaagctcaagagatattgattccaacgaggaaatgataaatagttgaatctactctaaaaatatgatagtaggaaatatggagtgatttaatccagagctgaagcttgagcatgttcagaattttcacttcgagttaagggtgattgacctgacagtagcttttctctactgccatgattaacaatttaacagacagcataatttcacttcaacactacaccgccattgcacaattctcaccattatgattgcgccaatatacaaaatctacattggcaatttagcgcgtggaacatcgatatcaatacaagatggaatgtgaactaacagatccacatacagaaatctcatagtatgaaacaacaaaccattgtaaatatcaaaggtggtacacaagattagggtgagaaaaaaaggggagtcctaaaattacctagtgtcacgcaatggacaccttggcgccgacctcctcgagctgcttcttggcatcctcggcctcgtccttgctgacaccctccttgaccttcttggggaggccctcgatgaggtccttggcctccttgagggccaggttggtgagcgcgcgcaccaccttgatgctggcgatgcgcgcgctgctgggaacctcctcgatgaccacgtcgaactccgtcttctcggcgggggcctcgtcggcggcggcgcccgcgccgcccgcgccgggcgcggcgacgacggcggcgggcgcgaaggcggcggcggagacgccgaggcgctcctggaggtggtccacgaggccccgcgcctcctcgagggtgagccccgcgatggcgtccccgagctccaggaccttgggggactcggtggcggtggacgccaccacggcgacggcgcggcgtgggcgggcgcggctggggacggcgaaggaccttggggcggcggcggcggcggcggcgggggaggaggaggaggggagggagaggagggagaaggcggaggagagcgcggtggaagccatggggatggggggagtgagctctcgcttccggagttgaggtgagctgcgggaggaggaagcgaggagacggggggataagatgaggcaccgctgggataagacggcacgctatatagtgcgccgcgagtggctaatacgcatttttttcgttgcgatgcctaatcaaattgtgcgaactaggagtgctgactacttggaagttaaaagagggatataatacatgagagcagtcccaaaccatagcgtttaaaggtagtgtatatggtaccatgtcaataagacatcacaataaaaattacactccataacttatggtttcttaaagtggaccattaataaatacatcatctctcttctctaccaatcatatttattctttatctattatgaagaaactattctcccccaatgcaaaacttgatagtgtctactgcataggttctcgtgttgaagctgtgtcttgtatgagacccaatttcttcctctcttcactctctctcttaattaatatagtgccacataagataaaagtccaacatgacaatgtagttaatgctatagacaatatcctaggtggagggttgggactgccatgataaaacatatccctgctttacaaattaatcatcatataagtttatacaccaagaccaaggacaatttaaatcatatcaataaagacatcatagacacattctcccacgatgcatacatcgattaaaacctttcgttataaaatatactccctccattccaaaatataaggcataaccacatttaacccaaagaccaagaaacaattattatcacctctttgtttgaatcaatccaactaatacaatatatgcacccaatagaattaaacatcttgtgagtgtatgatttaaaaaataataatgtaagatagaagatatgataattaattgccatgcatgcatgcaggccttatattatgaaggaaaaagtacgaattaccctccgaactactgtgacagtatgaattacccctccccccggaaccacaaaactagacatattacacctcgaactattgataccagatgaattaacccccccccccccgaatcattcctaagcggtttttctcctacatggcatacacatgtcgctgacgtggaaattcaatcaacaaaaaaataaaagaaaatatagggcccacctgtcattatctctcttccccctctccttctctctctcaggcgtgtgtcgacgggcagtgggcagcggcagtggcgtgtggacgggtggtcggcgtgcgggaggcgacggcagagcgcaggaatggcacagcaggcaacgggtggcgccgaggagggcattggaggatgcggcctacgtagtcatcgtcgtccctctctctctctaggctcaggcaagcggcgggcgacgagtcctcccctgggagggcgcggcgggcaccgcgcgcgacggacgtggtggggagggcgagacgggcggcgtgcagcgccgaggacattggagacggtggtcgtctctctctctccctcgttctctctctctctctggtgccgtcgggagagccaagcaagg

SEQ ID NO: 74068 - DNA, 39831 bp, Oryza sativa
ttgggagcaaagaaagcaatatggaagaaaaacatatagcacctaagatttagctataggtgttcaacttctccatttaaaattcagattataacttaatagaagcaacatatatgtacatacaaatgaagtgaagtaaaattaatcatgccacaagtaacaattcctataaactaagacctaattcatgtcatgcagatgtagttactctcataaaacaacccatgaacatatagtactacaacaaacaattaaaaattaagacagttgcactattagggaagaagacttgatctaatgacaatatgtgcatactaaatgaagtgaagtgaagtgaaggatatatgagatgtagtgcgtggggctagagagtttacatctagtatttgcaatagaggggttccagcagtgcattgggttgctttgtacttttgccagttgcagctgagactcttctcgcgcgcaagaagctaaactagctggcaaagaggacatcttcttggatgagtcatcatgcaagccaaatctctgtccaacaataaaaacatgaatgaatgttattgggcaagataccaaaacactacacatgtcatctctaactagtaaagctgtaattaggtgcacaggactcttcaatttgtggtgcgccatcgatggttccctgaataatgtgcaagtaatttctgaggaataggcatcatgtaatgaaatcgtgtaactgcatatataagggtgggtgtcaattgcaaacagttttacatgacagacaaaaatgcagttcaattacctgatttatcagtgcaagcgtgcagtaaggtggtgggaagtagagtgagaaatttgtactactagtaatgaaaacaaatctgaaattgcaggaacttactcctattaattggaccttgcactatctataagtttatgcagtgacattctgcggcataacattttttttgcaactgctaccagattagataagggcgacctgcgagaactgcacgattactggggagggaggacggcgatggaggcaatgtcataggccttgttcattcaaacaacatacaaataaggcgccgtgctccttttccacatccatcggccatcccaattgtaaaatcaaaggtgttttctttattattattctgtgatgaacaattgacaatggagattattggttttcatatttggaatttattcacgaagtggttttggagatgattggatttcacaggtgatcgcaggatttgtcattttatgtgaccggtcatacctggctctggtagccggttagaccggcgtgtatcgcgcggtcagaccggccgacattgtgtcggtttcggttttgggttgtttgtttggatatccgtgattatttcatgattatggcttctaaatggatactatacgtatgtaatactgttgtttactactaatgagtcaagttggagatagcttggtctcggaatatggttttctttgttcatttcatgtgtaggtgactcgatgcctcgggagagtatttgcggtgatggaccgagagtcggcttggggataagacgacgtccgtggtggacagagattatgcgggatacttaggctagagttgatgcacgtggttgatggagattccatatggcatatgatggaggtattgtgtgcgtatgggatgcggagtcgaatttggaaggagtccaaatttggtacgattggttatgtaaagtttctttcttgtactagagggtttcctaaggtgtttaggactcttagtatgagtttggttcgtggctttaggctgcctacctcgggtataaatagagggggagcgtgaggcttcccggtatcgcttttgagagtaattgagttgagtttagagttacggtttcgagtttagtcgaaattttgaaggagtgctgttgttgcactttgtaaacacagagagaatcaataaagtcgtcatccactttaagagttcttcgatttgtgtttcaccgggtttcggcggtctaaccagcaactcaccggcggtcagaccggcggcaagcggcggtcagactggcgacatacgggcggtccgaccggcagcggcaacaggcacggcaggcatctcagcggttcgaccgatcgatctacatcggtcagaccgacgttcatcaggcggtcagaccggcgcatatacttcggtcagaccgcgatccgtcgatttcgagggtaacttttatttccgctaaaagttttcggtttttggtataccaaccattcacccccctggttggcttatttattgtgtttcgatcctacaatgatttgggatgcaagttctagaacatggatataaattaatatgtattgaactacatgatatatatgcaatttatcaaaccaaaatcagtctgatagcatcaatttgtgataactagctagcttcaccaataacttgactgaggttagtgaggttatatctttaccatccctaaatctctactaattactacaatatagccatgcatatattaactgaagttgcaactgcaaatcttacctcatagtccaatttttaagacttattcgaatcaagctataacaacctgtttgtgccactgccatatttcgccttaattagagttagtttattttgggcaggccaaattatttagtgtcgccttcatttcctggatatttgtgtttagccatttaatctgacagatgtaccatgcagtctcaacagctaactactatacttgctcactgatgatcatgaaagcttagacatcaatgaacatatcacgatactgtgatggtgtatggaaatatcacggtataccattaaccaagatggcatgaaattatccttcgttttttaataattaaccaagaaacaggaatatcccgggaagcactgttaacatgcttgtatatctaataacaaggcaactttaattttcttgttttctttctgaaagtaaccttcaacaatgaaccgtaccccacacaagtttgttttaattaattatcgtttataattaactaacagaatgagttgattcactgatacatatttcagacacatctcatagttcaaaatgtaggatcgaaacacaagaactaagccaaccagagaggggcgaatagttggtatatccaaaaacccaaactttttgtggaattaaaagttaccctcaaattcgatgtagatcggtctgaccgaggttgatccgccggtctgatcgcgcctataccgttggtctgaccaaagttgttagcccggtccaaccgcctgaagatcgcttctgcctcctgtcgccgtcgctggtctgactgcaggtaagccgttggtctgaccaccgcaaagccgccggtatgtcgccggttagacctccgaacccgggcaaacacaaatcgaagaactttcaaagtagatgacaactttattgcctctcttcgcatttacaaagtgcaacaacaacactctttataaaaatctcgactaaactcgaacacctaactaaaatatcaactcaatgctctcaaaagtgataccgggaagcctcacgctccctctcaatttatacatgaggtaggaagcctaaagccacgaaccaaactcatactagaagtcctaatccacataggaaaccttctcatgcaagaactaagccaaccagagaggggtgaatagttggtatacctaaaatcccaaactttttgcggaattaaaagttaccctcaaattcgatgtagatcggtctgaccgaggttgatccgccggtctgatcgcgcctataccgtcggtctgaccgaagttgttagcccggtccaccgcctgaagatcgcttctgcctcctgtcgccgtcgctggtctgaccgcaggtatgccgttggtctgaccaccgcaaagccgccgatatgtcgccggttagacctccgaacctaggcaaacacaaatcgatgaactttcaaagtagatgacaactttattgcttctctccgcatttacaaagtgcaacaacagcactccttacaaaaatctcgactaaactcgaacccctaactaaaatatcaactcaatgctctcaaaagtgataccgggaagcctcacgctccctctcaatttatacatgaggtaggaagcctaaagccacgaaccaaactcatactagaagtcctaatccacataggaaaccttcttgtgcaagaaacaaactttacaaattaactccaatcataccaaatttggcctccttccaaattcgactccgcatcccatacgcacacaatacctctatcgtatgccatatgaaatctttaccaaccacgtgcattgaactctagcctaagtatcccgcatgatatcagaccatcacggacatcgtcttatccccaagccgactcccaatccatcaccagcaatactctcccaagccatcaagacatctacacatgaaacaaacaaagaaaccatattccgagaccaagcactctctaacttgacttattagtagcaaacaacagtattatatacgtatagtatccatccagaagccataattatgaaacaatcacggaattccaaacaaacaacccgaaaccgaaaccgacacagagtcgcccggtcagaccgtgggctggccggtctgaccggcagcacatgcccggtcagaccggacccaacaaaacaacagcacctgtagatcacttgtaaaatccaatcatctccaaaaccaattcgaaaataaattccaaatatcaaaaccaataatctccaatgccaattattattatagaataacaatcaaaaacactttgattttacacaaaatatatttttgggtaaaagaacataagttttcactgatacatttaagacaaatctcataaacaaaatcccgtatttattttattttgtgttctagtaaaacatttaatatgttcttcaaagatttgagattgcgagcaataaatagaagtttgcccaagcctccatccttcttggtattagtagtttcttttgttaaaaaaattggtaatttgctttagctgtgtgtgaaagaaagcctagaacaggagcaaagtcttgtacaagaaaggactacagagaactactaacaaagaaacagaagctaccatggttttccagcaccagttcagagcttagaaacattccgaacaaaaagataagcggcgtacttcattccataaccttttttctttttttgcccaaactaaaactgcacatgaaccgccgcaccctgaccgacatagacatggttgatgtgctctgcaattccgagcaccattccgtgatccatggccttctgactttgcagagagagattttctggcttaccgggcaaacaaggaagagaatcgtacgtctttgttcccgaatgcatcctaaccctaacgcacaatggtgatcgggttgatttgtgcctgaagttagatgattatcattgcacttagaaactgaattagctgaatatgagacgaactggtggcaaggcgttgtgcgtgtggatggataaatggacgcagtggccttttatacgcttcagcactccatcatctaatatgctaaatagcattgtttgcttttctgagacaatatcagttgtggtagggtacgtactcggtatatgctagcagagtcagaacaacatgttgcaattaagtcactgctgcagagaggggttaactccaagcttccgataagtatattttctttggataaatgtgtggtatcttttcaaagggataaggatggcaaaattggtcaaaataacggagaaattgtgaaatggaaggaagtagtatgtttaaggtgaagccaattctgttgttgtaaggtgaatccaaaaatatcggtggtatagagctaaacatccagtattttctacggtattaattgaaccgtattttttgaataccaatgaactaacatgacttgcaagcaaaaaccattaacttttgaggttttcttccatatttgaagaggtatatacctactcacaatttcagatttaaacaattaaactggttaaattgattagataaaaaattaatgtctaattagtcgttgcgaggtatagagaggtatatataactctccatgtcaatccaggggtatatactgtaaaatcaaaggtgtttttggttattattctgtgatgaacaattgggcattggagattattggttctgttatttggatttatttacgaagtggttttggagatgactggatttcacaggtgaatcacaggttcattatttcatgtgaccggtcagaccgggcaggtgctgccggtcagactggcggtgatcaaacggtcggaccggccagcccacggtctgaccggccgacactatgtcggtttcagtttcgggttgtttatttggatatccgagtttatttcatgattataacttctagatggatactatacatatgtaatactattgtttgctgctaatgagtcaagttggagatagcttggtctcggaatatggtttctttgtttgttccatgtgtaggtgactcgatgtctcgggagagtatttgcggtgatagaccgggagtcggcttggggataagacgacgtccgtggtggtcagagatcatgcgggatacttaggctagagttgatgcacgtggttgatggaaattccatatggcattcgatggagttattgtgtgcgtatgggatgcggagtcgaatttggaaggaatccaaatttggtacgattggttatgtaaagtttctttcttgtactagtgggtttcctaagatgtttaggactcctagtatgagtttggttcgtggctttaggctgcctatctcatgtataaatagagggggagcgtgaggcttcccggtatcgctttagagagcaattgagttgagttttgagttagggtttcgagtttagtcgaaatttttataaggaatgttgttggtgcactttgtaaacacagagagaatcaataaagttgtgatctactttgatagttcttcgatttgtgtttcaccgggtttcggcggtctaaccggcggcgcaccggcggtcagaccagcagcatcgcggcggttcgactggcaggcacacggcggtcagaccggcggcgacaggagtcggcggcagacgttcttggcggttcgaccaatcgatctacatcggtcagaccgacgttaatcaggcggtgagaccggcgcaactactttggtcagaccgcaatccatcgatttcgatggtaacttttatttccgctaaaagttttaggtttttgggtataccaaccattcaccccctctggttggcttagttcttgtgtttcgatcctacatatacctctagaatgtaggtacatacgttataattggcacaaatatgtatacctctagaaaatataagaaaatttcacaagtatttataaagataactttccaattatattctaacttgtacgattaattttgattccccattttatggagggtaaaaggagatgtacatatatatcatgtatggagagctatatacctctcaaagtttgagagaaaatcacttaacctttttaccttttcaacacttattttactactcgatatcatatcagtcccctacactccagccatttcattcagactactgcaatacgtccacgtatcaaccgatccaatatataaaggccattcccaacccaagaaactagacatagtttccataaactctacatcatcaagaaactagtactagacactactctttcaatgcaaacactactattccatacttaaatttaatgctacttatctcacatgatgtcttcgatgttgtgtagaaactatgtttcatgcaagacatggtttccttctctttcttcatttatacatttgccacattattttttatcctaggtggcaacttatttaatgctatggacaccatcttagttattaggttgggaatggcctaagccagaaagcaacacatccatcggaccttccgaattctgtttttcactttttttttcgaaagctacaaaactctacaatgtgtggtgagctcaatctgtgtcacaagtgcgagccacagaaaaagaaatgtacttttcagataaaagatcatcacaatatcctgcagctttaacttataacaaagcttgcaagaaaaacatgataattcattgaatttgtcacaagtgatcggtcgaatttgtcttgacgtccttcctcttgcttcaaatacgttgcaatatcaagtcatcacgaacaaaattaatcttaattagctaaccaaagctcatcaagtcaactagtgatcacattagcattagacaagcttgtcttctcggcaatcatgctgttcgatcgaactcgccgccgtgatggtggctaaggcgacgtcggcgagtagtgccgcgtggggaaggccgtgttctggtcggcgccgtccctactgttgacgtaaatcgaatataatttcagtagttgatttaaatggcttaaaacttctaaaacttcgtaactaatttatatgaactctaaatttagccaatctggaggactgcgaccgcaaggaaaaagcatatggaagctagattaattgaagaagcaaggtgagtcacacgttccctgcttgaatatgtttaacctactttatgaaatggttgccatttagaaataatatatatatatatatatattgctaattacgtgggatacgggattactaaatccacttgcttaacgccaatttacttggtatccactccttatcaatccttgggtataataattttatcagcttgggttaattatgttgaccaagctatgcttagccatacttagttcatctaatgggataatcactttactcataatttgtatattgacgagcttaattcaagctcgagatattgtaccattatttgttggtcctaatttgtccaactaaaatatgtcttaatgatagactatggatgcatggttttaatttttcgcacccatgataatgatggacctttttgcgggaatctctgaaagacttaccgtacttaccacaaaccaataggtgtaattgctaaccttttagtatagctctcccctttcataggtatacaagcgagtgtggccgtgaaggagtttggttgaacaggatggtctaagcagcttccagattaaccgtggcataatgaaggggttgtccatcctgattttagggatggtggcgaaacatgcagtgtggggtgtcaatggttagggaagggttatgaggaggtggttggttgggcttgttcaatgtgttgtaccgttgttaagtggagactaatcttttcttaattaatcaaatattttactatttttaactacaaatatttacaattgtctttatccaaaagagtagatcatgatacaaaagactactatctttgtttccccttgcacaattacatcattggtgttgcttgctgagtacagtggttggtacttagccttgcctaattttctattctcaaatttttagtgcctctgtgatgaagacggagttaaaatatcaagcgttgtaccctagttgagtactcctgtggactgaagctaaacacccactaggatagtccttttccgccgttgcattcttttcggtatgaggactaattgtcacttttgtaaatatttatgctttatttatgtttggatatgtacaataacatgtcatttgatgtaccttgtgttgattcctaaacaaggatttaatacacaaattggtctgaaaaaaggaaaaatttctgggtgtgaatcaccacacggcacaacagctcccactcaaaaaatgacacggcaacatagagcctacaccgcttctccaaccacatgaaaccatgctgccatagcataagtaggtggttattgttgctgagcttgccacctagttaggcagttgtgactctgcccatgcgaatgctccgcaactcggtggaaacatccagcactgccacctacatgcacggatcctcttctgctgcaagcaccaagaaagtattttcaatgccgaaggtcgcccatgctatgccgagaagacaccaaattggccaaactaccaagaacatgtgaatcccattgtttttttgtctagtgctctagtcttctagcaaagaccttatcaaaggtgtttgaagagtcaagggggataaagagaagtttgctcctatggcaacaaacggatcaatcagctatacataccgcctccatctctttcaataggaagtaccgcagggcttcaagaatcatgaccgacctcttacattggctacatactctgacactgatggtttgtgtttcgtgcaacggctctggctatatcctcatctccacctccttgtgatgttgcaagcgaagtttatcttgattaatgcgcaaacactggacgaacatctatgttcgtttccgatgcatcctaaccctaacacgtaatggtgaggtagttgtccatcaacataacttagattagcctatcgtgcagaagctgaatcagatgagcatgagacgaagaggcaaggtcttttgggggactattatacaattgtggtaggatatatatataattcgtatgctagcagagcaggggtattacgatgcaattcagttcctaagagaagggtgaaataggacaaaacaatggagaaattgaaggcagtggtatgttcttgaaccatggagaaattcgacggtaataaagtgaggagtgaagccaaaaatgttgggtggtataaactaaacttcctgtattttgatggtattaattgaacgattcttttttcctttccaatgaactaactaacctgacttgcaagcaacaaccactttgtaccttttcggaactttttttttctaacacgatatcaaatgagtctctacaatcataaatgtgaaagtatcaaattatcctatgtgtaaaccagaagcaaaaacatccatcggcttttccaaattctgtttcttcaaagctcacaaaactccacaatatccagtgagctcgatctgtgtcaccagtgcgagccagagaaaaagaaatgtaacttttagataaaagatcatcacaatccacctttaatctatcagaatgcttgcaagaaaaccaaggtaatcaataaaaatggtacaagtgatcgatcgagagtttgtcttcacgtcctttctcatacttcaaatacgttgcactcccaatcccaagtgatcaagaacaaaattaaattttctaaattacaagcaaatcaaagctcatcgaagtatagctatggcattggcatcagacaagttcgtcctctccgccatcgtgctcgccgtcctcaccgtcgcggcagcggcggcgggctacggcggctacggcgacgtcggcgagtactgccgcgtggggaaggcggtgtcccggaacccggtcccatcgtgccggaactacatcgcgcggtggtgcgccgtcgccgggggccgcctggactccggcaagcagccgccgcggcagctcctggagccgtgctgccgggagctcgccgcagtgccgatgcagtgccggtgcgacgcgttgagcgtgctggtgcgtggcgtggtcacggaggagggcgaccgcgtcgccgggatgatctcgcagcacgcggcgcccgggtgcgacgccgcgacgatcgccgggatggcgagcgcgctgacggactacggccggtgcaacctgcagcacactggtttctttggctgccccatgtttgggggtggcatggattaacttccttagtaattaattaattaggcctttgcttaattaattatttaattagttatccgggttactggataattaattatcgatatttgctagtagcatctatcatgtttggatgctgctttctccgtgaatgtgatgataataataatcagaagaaataaataagaagagttggattcatcagctttccagtatcatcctcacaagcctcatggtcaagactatggaacctatacctgtcctgatggtgaagagagtgccactctgatgcatgcggtgcatatgcttagtgctatggatgcagtaagtgtggagcgagccaaagcagctcatgacagggaaaactggaatcgaggcaagatttgcaagttggagagcaaggtgtaccgtctacagaaggaattagctgaacttaaaggagaaacgccgccgccaacacccaagcttcgcctcactgcaagaaagagaacctgtccgccacctcgtctccagttagcttcgaagattcgcgtgatgggtgaagctgtgcccgatcgtgctgaacctgtcatcgacatcataagtgatgaggaagaggaggaagaccctgaagaaagagagccagctactccagaggaagaagatccatcgcttcgttccgacgcaaggcgggattagtcgcttagttagatcgttgccgtagttcactgtgattagattgtttgtttaagtttgcttgtgagtgtgtgggttttacttgttgcttacatcattggtgggatgtaacagcatgagtctagttcttttgcttgtcagagtgtaagatagttggtgagacagtgttaatgcaacttaaatgtaatcatacacagttaagagcaatatagaatttaaattaattaaataactccgttctaagggtgtctctctgtcgttctttcctgttgtctctgcttatcgtcagatggtgaacacgcgcactggaagtggaagtggaagtggaagtggagctactaacaatggaggagatcccacgctagctcagattctggcccaacaaacacagctgatcaatctgttagtgcagcaggcacagaatcagcaggcaaacaatcagaaccagaatccacccccacctccccaaaacaagctggcagatttcttacgtgtgagaccccctaccttttcaagcactaccaatccagtagaagcaggagattggctgcatgcggtggagaagaagttggacttgatccagtgtactgagcaggagaaagtttcttttgcttcgcatcaactgcatggacctgctgctgaatggtgggatcattttcgccaaggcagggctgaaggagagcctattacgtggcaggaattcacggccgctttcaaaaagacacatataccaacgggtgttgtagctctaaagaagagagaatttagagcactcaaccaaggatctcgttcggtcaccgagtacctccatgatttcaaccgtttagctcgttatgctccggaagatgttcgcaccgatgaagagcgtcaggagaagttcttggagggactgaatgatgagttgtcttatgccttgatgtctacggatttccgggatttccagcagttggtggacaaggcgattcgtcaggaagacaagtataaccggatggagcagaagaagcgcagggctgcccaattcaaggcacaacagggcagtaaccagaggccgcgtctcgttacgggacctcaagctccatcgtaccctcaaggaggatcttcatcagttgtccgcccccaacgccagttctacaacaacaatactggtaatcgtggtaatgacaaccgcaacatggttgctcgtcctgcagcaactccagctcagaaccagcccgtcaggaaggaacagggaagcaagccaggggtgtgcttcaattgtggtgatccaggacattatgctgataagtgtcctaagcctcggcgcgtgaagaacgctccagccccgaataactccaatgctccagcaccaaaggcacgtgttaatcatgttgcagcagcagaagctcagaatgcaccagatgtggttttgggtacgtttcctgttaactctatacccgcatctgtgctttttgattccggtgctacgcattcttttttgtctaaaagttttgcgagcaatcatgggatggaagttattagtcttgggagacctttactagttaataccccaggcaatcaagtattttcgacacagtattgtccttccgctactatagaaatagaagaagttcctttcccatcctcgcttatcttgctagaatccaaagatctagatgttatcttagggatggactggttatctcgtcacagaggagttatagattgtgccaaccgtaaggtgactttaaccaatagcaatggggaaacagtttctttctttgtgtcctctcctaaatctcatggtgtgatcttaaaccaagttgctctacaagagatccccatagtacaagactacccagacgtgtttcccgaggatttgccaggtatgccacctaagagagacatagagtttcggatagacttggtacctggaaccaaccctatccataagagaccgtacagaatggcagctaatgagttagctgaggtgaagagacaggtggatgatttgcttcagaaaggatacatcagacccagtacttcgccatggggagcaccagtcatctttgtggagaagaaagatcatacttagagaatgtgcgtggattatcgagcgttgaatgaggttactatcaagaataagtatcctctacccagaattgatgacctgtttgatcaactggaaggtgctacagttttctccaagatagatctccgttctggatattattaacttcgaatccgtgaggaagatataccaaagaccgccttcacaactcggtatggtttgttcgaatgtaccgttatgtcatttggactcactaatgccccagcctttttcatgaatctgatgaacaaggtgtttatggaatatctggataagtttgtcgtggtgtttattgatgacattcttatttactccaagacaaaggaagaacatgaagagcatcttcgtctagctttagagaaactacgtgagcatcagctttatgccaagttcagtaaatgtgaattttggttgtccgaagtgaagtttcttggtcatgtcatctcgtctggtggagtggcagtagatccaagcaatgtggagtcagtgttaagttggaagcaacccaagacggtttccgaaattcgtagtttccttggacttgcagggtattaccgcaggtttattgagaacttttcaaagatcgccagaccaatgactcgtctgcttcagaaggaagtgaagtacaagtggacagaggattgtgaacaaagtttccaagaattgaagaaaaggctagtgactgcgcctgtattaattttgcctgattcgaggaaaggtttccaagtgtattgtgatgcatcccgactcggtttgggttgtgtgttgatgcaagaaggaaaggtggttgcctatgcatctaggcaattacgtcctcatgagaataactacccaacgcatgacctagaattggcagctgtggtgcatgcattgaagatttggctttcgaagaaggagattatgtataccttcgggttacgccgttacgaggtgttcatcgtttccagaccaaagggaaattggcaccgcgttttgtgggaccttttaagattgtgagtcgaaaaggtgaagtagcttatcagttagagttgcctctgtcaatggcgggaatacatgacgtattccacgtgtctcagttgaagaaatgtttacgtgtacctacggaggaagcagatcctgatcgtatagagcttcaagaagatttaacttatgttgagaagccagtcagaattttggaagtaagtgagaggaataccaggaatcacgttatacggttctgcaaggttcagtggagcaatcattcagaagaggaagccacttgggagcgagaagatgaatcgaagtcaactcatcctcatctgttcgccagttcttctgaatctcgaggacgagattccgtttaaggggggtaggtttgtcacgccctaaaaatcgcctaatgtaaaaatacattgtttaaatcatttttagaaattattttaaaagcctacaaactaaaccctaattatctaggaaaattttcaacataaaaatgagctagataaaattttattaaatactatacttgctcctctattttctagatttttctggaaattatttgagcaagggaagtatttttaataattgaaacaacatttcacaaattattttaattttaaaagttccaaaacccctccctaaagccgttgggccgtttttggcccaacatctttcctctctcccgcgggcaagccggcccaagccggcccagcgctgcccgagtcggctcaagccgagccgcccacccctccctcacgtgggacaccgacatgtggggcccacatgtcgggcccttctcctacctccggccggccgccgcttgccaagcccgaccgagccgccttccgcctccaaatccgctccaatccgaccccgattcttccgggtttttgaggggtttttatccccactttctcctctatctttacccccaagattcggagcaaatcgttgagtattctctccgaatcgagttcgtttcgaatttatccccaaaaaccgagtttagattttcccgagtcgatttcttgcgggaggagtccgatctcttcaatccaaggctataaataggaccacctcgtcgccctctttcgttttccccatctcccgagctctctcgtgctccgtagtgtcgccgccgcgcgtgtctagctcgccgccgccgccggtcatcttcggcgccgccgcgccgccgcttgcgtcgtcgccgccgcttgccgccgccgccgttaggtgcgccgtggtgaggggaacctcggccgcccgtcccctttcgccgccggccgccgtagctcgccgccgccggtcaaccgagccgccgccgtcgcccttctcgttgccggccgtcgtcgttcgtcgtttgtcgttgtggtgagtaccgttgggttcgtctcgtcgtcctctacgtgtacatgccctccaaatccgcggccgaccaccctagctccggcgaggtcgccaaccctagccggcctccgtaggtgacgtcatgctgacgtcatcagttttcctttttcccgattttctaatagattaaaacttcggaaaatcataactaaataaccgtagatccgtttcaggtggttcaagttgctaaatttttctaaaatcaagatctacatgttaaaaatatccacatgtactgtttatgcttgtttttgtactgttttgttgattttgtttaattgctttagtttctgacgttccggaggagagcgtttccgttgaggaaggttccgaagcgtttgcggaagcccaaggcaagtcacacagatcccaaacaaccctttgagcatgttgaacccgtttaaagctattattttatttcaactatgcattgttttcgaatgtcatcgggtggtgaacctttcccaattaaataatggccgaagatgactttattttcctatgggtcataatttgattagcatgaaccttatatattggattggttcagctaaatgttatatgtaggtttgcttagccatgcttagaaacattagctaattaaaggggattaaatataaattatattatattattcttattattatggttatatttaatggtcgctcacgatggttaatcgtgtgatgttaattaattgataattaaagcctggttaaggtgggttgtgagcatatggttttgatggttgtgctcatgacaattaaggaccggttcgcgagctactgttgtgaaacatttatcgtgccaatcacaagccagcgtgggcaacggctttatcttttgtatagcgtgattcattatagtgcgccagactgagaagtggcgagaagtccacgggggtcgctggggagtccatgccttgtttataagggggtgattatgatccaggaaaggtgcgctgtaatgggttatgttgtgcaaggggtattgtcacaactcctttccgaggtaccgtggtggtattgaggcacatggtgacatgatgtggggttgtgtcttgtgggtacagtggtacacctctgatcagagtttaaactattcgaatagccgtacccgcggttatgggtgagttgagcaatgtttttcgtgattagtctcacactactcatcaatgttaataatgtgataattaatttggctcctggtttggaatggataattcctggtttggaggtttaatttgttcaactggggttggttgttcaaatgtggttgggcctatgcaacatgggtgtgttgtatggtgttatttaatattgattaattattcaactgtttttactattctcttaaatatttattaaatgctgtttctgcaaatgagctatattatgccatcctttgttatcctgtgcacttgcatatttgctgtgtgacttgttgagtatgtcatatgctcattcttgtaatattcattcatcagaagacgagtatctcagtgaaggtgatgatctggaggattaggcttgttcttggttaagatgcctgtggagtggagtcgccatagctgttccgtagtttgttatagttttatctttccgctgcgtaaaatgttattctttgagaggaactatctacctctgtaatcttttattatttgcgaatattaaatagttatttatttgtactctattatcaatttgtcattgtgtgcctcggttgattcctggacgagagtttaacacacatgtaagcgtttggaattttggatagaaattccgggcgtgacagctgctacggttctgcttccccgcttctgatcgcttgcgagcatgagagattgaaacaaggagggcctccggaaccacagcttcgcctgaaatctgcaccgagtaggcgggtgatcaggtttttgaggagtgcttccgcatgactgctcctcgtcttctgttcgtcgtcgtcgtctgctacaccatgtctggtgcctccgcagctgccgcgcctagagatggaggcgcactaggagccggagccgctgcgaacgaaaacatcaacggaggcagttctgcctcacaatccagcggagggacattcacagggtataacctttgcttactgttaattcaatttttgatacctctgttagtcgcaattctattgcgttcattgtatgatcatgatgcttattatattttaagcatgctcctggttttgttagattttatcactagatcaccccacattgttcatgtcatgattattgtcttaatattcttttgcaatggaccaatcccgagattgcctccgtaacgggcaggcgattcaattccaattgatcacgtcgttattgcggcaacggccggatatcgctcctgcgttataaggaaagatctaatccgataagattccgggcttactttccatctggtgttcttcctcatcctccttgcgcacggctgtgctgctacggttctgcttccccgcttttgatcgcttgcgcgcacgagagatcggaacgagcagggcctccggaaccacaccttcgcctgagatctgcaccgggtaggcgggtgatcaggtttttggggagtgcttccgcacgactgctcctcgtcttctgttcgtcgtcgtcgtttgctacaccatgtctggtgccaccgcagctgccgctcctagagatggaggcgcaccgggagccggagccgttgcgaacgacaacatcaacggaggcagttctgcctcacaatccagcggagggatattcacagggtataaccttcgcttactgttaattcttttgatacctctgttagtcgcaattctattgcgttcattgtatgatcatgatgcttattatatcttaagcatgctcctagttatgttagattttatcactagatcaccccacattgttcatgccatggttattgtcttaatattttggattaaaatatgccgatatatgaccatatttccaacaaaaatgtagtttaaaatttacggaacttgatcgcttaaatatcaggcaaactctaattaattttctggttgcttcaatcataagaagatggtccaaaaataattagacatacaagcattactataaaatttactttcatagtcccgagtaataattcttttacgtaggttaataaaaggtgcaccctgctgtgacgagcccagggtggcctcagccctgaaggtacatttattctccacatgtaaaaaatatttttcacagatgattccttaagaaaaccgctagtgacatagtctgaactatccatggataagtcggttccaatggccattatttttgtattattgtatagtagtgaaggctgcatacttaatcggtacttaattatccattacaaaacacagaagttgcaaccatgaatcttaaggttgatccataacatagtaatttgtacctatcaatttctagtttcaataaattacaattttactccaacctgttcactaaagaatatcgattggagacttttccaagagatcaatatataagaatataactttgagcacttaatttcaaaaacatcaaaaaggagttattaataatgtgaaagcttttattcaaaccagctatgctatgttgaattgatatgccgaaaacctatattctaaagaataattgtagctaaagatttaacttatcactacttaaaaaaacacgtagagatcaaaattataggtgccggaaaagctaaaaccaacacctcctatagtgcttttctctccccatgagctgaaaacatataaaaccggcacccttaagcgactataggtgctggttctaaagaaaaaaaatgcacctatactacatatatgtgcttttttttctaaaacaagataactttaatatattataagtgtcggttagttaaaaaccgacatgatcttttaaaaaatcgtcacctataccaaaccgagccgagcacgggccttatccacttcgcgcgcatctgcggccctatctcttctctccctctctctccctctttctctctctctctcgcctctctttgtccctctctctctcgcttctctgtcgcggcggcagtccggtggaggcagcggtggcggcggccacgacctcccctccaccaaatctggccacaggggaggcggcgagatgggaggcagcgatggcgcctgcgtcctcccctccgccagatccggtggtgttttcccaatcggggctcattagttgggaactttgacgtattctcataggtgccggtttaggagccgacaccttgaggttccagtaacctaaagataaaaaagcggctcaatgtattaactcgattcgagccgatccattgagcagatccagttcatccccacaggaatcaaagaacacatacaaggtcaaagaacacgtgaacacgtgaacttcagggacataaaaaacattaacatctagaacatcaaaaacacgatggcagtcggcgtccttctccacccctgccgccgtcgctgcatagagaggaggggtggtcatggggatatgtaatttgatcctatatatgtgagttcaatcagatttccatcacttccgaatgtgtgtatgtttggtttctagtgcctcctaatcctatgtacgctcactgaaacagtctgccctcccactatggttgctgttccatttacttgcactctgatagtctgatgtaagttagctcatatgggaattgtccatgtttgggatggttcggtctggctagccctttattatcagtcaaagatcaactcctatagtatgtactaatcctccacttatctatgctttgtataaagttaaagcctattaaatctaaaactcaacatgcaaccgtgccacatcatcacccactagcaataattacataatctcatgcaagcatagaacatgatgtacaatttatttaatgatacaaatcaaaatgcaagcatatctaataatcacccgtcatatcatttcactaccacagaatagggattcggtgccggttgggaaactcctttcgatgccggttttcccaaccgggaccacgaaggcggcacaaatcacaggagattaaaggtgccggttttaaaaccggcacctttgaggcgcacacgagccaaaaaaaatcggcttgagtcgatgcaagccgtcaagccgatcccaaatattgcatcaaaaccatgaacacatgaactaaattgcctcaaatccataaacacatttagatcacattgaacaaatcacgaagaggaaataatacaaaacacaaagagggagggacaagaagggaggggaagagatcgatccgcggcctccagccgcctccctcctgccactcgctgcctttgcatcccccctcccttcccttctgccgccccctcccttccgccgccgcatgacgcctcctccgctgggccccctagctagggttaccaaaaaagctcggagctcgcaaactgctcgacctcgattcacattgggctcaattcgagctcgtctcgaactctaaatgagtcgagcccgagcttgtatccaggcttgcaagcctcaccgagcgagctcgaatagctcgacgagctcagccactcacatttgctctaaaaatcctcgatgttctctgacattggctggttctggccaagctgtcatgccctctaccttgtttgcatcagacgttttcgagtagctcgaatagctcgaatagctgggacttttccacttgctagctctcaataacttcaggcagcaagcatacagaccaaagcacacataccaacaaagggtgtgtttagttcatgctaaaattggaagtttggttgaaattggaacgatgtgacggaaaagttggaagtttatgtgtgtagaaaagttttgatgtgatggaaaagttgaaagtttgaagaaaaagtttggaactaaactcggccaaaggctgcatgcatggcatagagtgcatcgccatcaatggagtgcactcatttcccgtaacagctgcatatgtaaactgtaatgtatggttgctagcatgtactatagcatattctagtagtactactgcttcaaatattggctttctaacagcgtgggacaaggattgacttcccactatataacacactcgaagctcggcaaaagctcgaagctcgaacgagccgagctcaagcctgtcttgaggctcgaagtctgacgaggctcggcttgagctcggtttgactatttatcaagctcatgccaagactggtaagctcgctcgagctcggctcgttgacagccctagggccacccctccgcgggatctggcagaggaagcaaagggcaggggaggtcgcggccgcctccgcctccgctggccagacgcccgccgcctccccttccactggatctggcggaggggagggcgcagccaccggccatgggagagaagggagggaaggagaggggatgcgagtcgagtaaaagattgacgatgggagtgagaagaacaggagacgcgagttgaaccttatcttcttctcgtgctggtggggcccaccggctcatcgatttgccagctcggctcaattagtaggtaatggttttttataaaaaaccggcaccaataacatattataggtatcaatttttaattaatcgacacccgtttttttaagaaaaccggcacctatagaatagatgtcagttcttatttagaaccggcacctataattgcttaaaggtgcccttttttgcgatttcaacctgcagaagtgggaaaagacttataggtgccggtttcagtatttacggcacatatagtaccgatacctatttgatgttttgtagtgatgtttgcataatatttttacaaatctatctatcacttttacaatatttaacatatacttatcaatatgattcacactgaagcacgagtatcatttgactgataaatcctgatgttcaaatatttttttctttttacttctagcttgattgtgaaaaaaaatactaagaatttctttgtaattcccgcagcaaagcgcgtggaatcacctagtagaagaagattgtaacacccaatcctttagcaacatgtagtagtggtgtaattctggtatatgtggcctcaaattggttgtacttggtgattcaataccacctcagaagtttagattggtgataatcatcttataatggcaaggcttggtgttctagccttgtacaccaggttatattttactcactgagggacaaagcacaagtgcggatatagttatctatgtcgggcggggaccctcatctgtcttgacgagctgcttcgtcacgcattattggtcagtgatgtgaaaactcatctatgttgggtcagcagccatctctgatagcaatcatctttgtcaggcctaaataaaagatgtaacggatgctagttacaacctgtcacattgagagtcatccgtgacagttgtttgtaaaatcatgaatttcaagtgataatattcatgcatttcatatgtgggattcgaacctaagatctctcaccacatgcaaaccaaccttaccatctcacctggagaccacatgttgataggtcatctgatgctattctcttaactattcttgtccgaatatggaacataaatttgaaactctagataactttaaatgagaatgcttttaactacaaagttgcagctcagagagctctacaactttatcataaggtatgtctccatccaaaatcgtttgaaaaattcaaaaaatattttggaaatagatcacatcacttataacacacatttggggatgaaaacaatcttaaatgaaaaatattgtcaattagaaagttgtagatctcatcaaaccctttgaatttgacataggccatgtttctatccaagatcatttaaaaaaaattaaaaatacgttattcaaaatagatctctccacttataatgcatattcgagcatgtaaactgtctcaaattcaaatgttctcagttttgaagttatagatctcatcaaggtctacataacatgtaaattgatggttcataactacctcccttcacggataagtgtggtaattaagacataggtcacggatgagtgctctcatctttgatgggtcatctcattacacccaccatggatggcatgttatctgtggctgggcatggttatgacctgttataggtaatccgcgacgtcttagaaatacgacccgacaaagatgaccttatatcgttgacaggtcttcatgtatattcatatcttaaatgggctactttttgaaccgttgagatgagttatccgaaacgagtcgcattagcccaacacagatggctcgtcaagaatgcccagatatgtaccagtgaaatataagcacggttaaacgttgtgtcatccggctccatgtgcaagccaggcttctttaggaattaaagtccagcggattaaaataacttgcaaatgaagattctaagaatggatagaatgcatgcacttcagtacatcatgaagagtcacgctccggttctctgaatttgtagtatgtacctgatttattttgtgcaccgtgaactattcatatatatggcagtttcctatgaactataattgtttggtatagcaaccaatcatcttagtgattactatgaactatagttgtttggtatagcagccaatcatcttagtgattactttgaacatcatcatacatgtacgtccctagaatttcagtttcacaataccccaaaagccaaccttgtatgcaagctattgaatcaaaacaagatgtggccctctaaatatttgttttgaaaaccaccaacttgcacgcatttagagatccttcattggacatgtacgtgagcatgagcacgagcacgagattcatcatgtggcagagcacgagtaagctaccccaatggatgtagtcgcaagctacccaatctaggactggcagcatgtaaacctggcacggtatactcatggagaagatccgtctgcagttcactgacattgcaacctagcaaaggatccatatgcccatagggttgatacttgtgctgtataagctgggttcccactgcctcccaaccctacaggttacgtttgtcatgttggggtagggatacctcgtgagtgtattctggaaatagctaggatccttggtcgttaaacactctgtggtttgtatatatgtatggacatgtacactttaagtcatttaattgccttgaatctgcacttcaatatttaggttgctcgtttgggaggatttcctcccatgtgaaatatatatgtaacttatgttgtttggtggctaccttgatcatccaaccttcggattgttcgaatatgtgaagacttgaactacatacatctttcattgcaattatttgatatggctggccaatatcagtctgcagtactgataacttcagtgtggtcatcagtgacagtgaggttattatgatgagaaattttatggtccttgatgttttgtaccaaattttatacataacatattgctttctcaggaactgtaagatctctattgtcaaaacatcattgcacaattgggattctcatgatgttgaaaatatattccagccaccaaatataactagccacatagtcatgcttttgcgtgacttttgttccatttaagaacttccatacatggtttattagttcaacttagcttttaaaaatctttttttgcatgtttattttcctttataaaactaataaaaaccgcatatgaagccgtatatagattatgatcagatataaaaataaattctgtttaaattctaaaaatatgtatatgaggttgcgaaatatcatttctctgtgcatttatttaaacccatcacaaaaattcatttttcccgtacgtcagaaaacatcatagtccacagggtttgctctaaagtctgatagtgaggggtataaactccaagctttcatacgtattttccatgaacaattaatgtgtctgatatatcttttgaaacgacgtgaacatgcaaaaaaataatgaacaaatgtgaaattgaatgcagtagtatgcacatgaaacttggggcaattcaatcgtaatagggcgagccgtgaagccaaaaatatattggtggtatcaaactaaatatcctgtgatttgatggtattaagtgaacgatttattcggttccaatgaactagctgacctgactagcaagcaacaatcatgtaacttttcaccttttcaggacctttttttttccaatacgatatcaaataagtagatctagactctagccatttcacaacactacaatatgtccacgtataaaactatccaatatataaacctgaagcgaacacatccttcggctattccaaaattctgtttcttcacaaaactctacaatatatgtcaccagtgcgagccagacaaaacgaaaagtgatttttagataaaagatcattgcaatccagctttaatttataacaaagcttgcaagaaaaacaaggtaatatcattgcaatccatctttaatttataacaaagcttgcaagctagaaaaacaaggtaatatcattgcaatccagctttaatttataacaaagcttgcaagaaaaacaaggtaattaactaaaaatggtgcaaagtgatcgatcgagagtttgtcttcacgtccttttcttttgcttcaaatacgtttcagtaccaagcattcaacaagaaaattaacttagcaaaaatcaacgctcacatattcatggcatcagcttcagacaagctcgtcctctcggccatcgtgctcgccgtcctcgccgccgtggtggcagcggcgtcgggctacggcgacgtcggcgagtactgccgcgtggggaaggcggtgtcccggaacccggtcccgtcgtgccggaactacatcgcgcggtggtgcgccgccgccgggggccgcatggactcccgcaagcagccgccgcgggagttcctggagccgtgctgccgggagctcgccgccgtgccgatgcagtgccggtgcgacgcgctgagcgtgctggtgcgcggcgtggtcacggaggagggcgaccgcgtctccgggatgatctcccagcacgcggcaccggggtgcgacgccgcgacgatcgccgggatggcgagcgcgctgacggactacggccggtgcaacctgcagcacacggccggttcctttgcctgcctcatgtttggtggtggcatggattagattaattatttcattagtgattaattaattaattaggcctttgcttaattaattatcgatgtttgctagtactagctagcagtatcatgtttggatgctgcttctctatgtttgtgataatgataataaaaagaaataaaatgaggaacggatgttcctctttgttgttattcttggaaaatcgttttagttatgagccatgttttgatttatgttggtgcagccagaaatttttcgctggttgtgcttactttttgcaccaccagtttttataataactcaaatctaatatgttttgtataaaaaagtgtaaaagtatgatagaaaataagaacagtaatatcacataacattgtaatcttggtgatttggagaaaaggctgaagtatttaaaaaaggagttagagaagtgtaggagaggtaatatagggatagatcaagtgacgagggaggaggtgttgcggtacaaggtggaaagactggaggaacagattgatgtgtactggaggcaaagggctcatgtccggtggctgcagcaaggggatcgtaacacctctttcttccatgcggcttgttcggagaggcgcagaagtaatagaataggaaggctgagaaaggatgatgggggatgggtggaacaggaggaagaaaaaaaacagtttattactaactattttatgcagctcttctcatcaaatggagtacgtgatccccggcaaattctggaggctgttccccagcgaatcaatgctgagatgaatgaagagttaacaagggatttctctgaagaagaagtgaagaaggcactggataatatcggggatctgaaagcaccggggccagacggaatgccatcactgttctataagagattttgggacgtggtcggtgatcaagtagtgaaagagaccctggcagtactgaggggagctcctatgccgactgagtggaatgaaacaactatagtgctgatacccaaggtgaataagccagagaacatcaaggacctaaggccgatcagtttgtgcaatgtgttatacaagattgtgtcgaaggttttggcaaatagattgaaaggtattctgcccgatgcgatttctccatctcagagcgcttttgtcccgggaaggcttatatcggataatattttagtggcttatgagatgacacacttcatgaggaaaaagagaaaggggaagttgggatatgcagcaatcaaacttgacatgagtaaagcctacgatcgggtcgaatggcatttcttaagggagatgatgttgcggctgggttttgacgagggatggacaaatttgatcatgcaatgtgtcacttcggtgtcgtatagaatcaaggttaatggtgaattgacggatgttttccatccgggcaggggccttcgccaaggggaccccctttccccctatctgttcttactgtgtgcagagggtttctcagccttactgaagcaagcagagaatgaaggaagaatgaaaggtgatgcacagtgcctacaagagatcctatctctatatgaggagttatccgggcaaatgataaataaggacaagtcggtggtgatgttcagtccaaacacgtcgaacagtaagcgaaatgaagtcatgcaggccttacaaattaatcgccagacgatgaatgagagatatctgggtcttccggtatatgtcggtcgagacaaaatgaaggtgtttgcatatctgaaggacaggatctggaaacggattcagggctggaaggaaaagatgttatcacgggctggaaaggaaatcctgatcaaagccgttgcacaagccatcccaattttcgccatggcatgctttgacataacgaagaattttggcggaccagattagctccatgatcgccaggttttggtggaataatcaggataaggaaaataaaatacattggctcagttgggagaaattgacaaggccaaaaggagagggagggctggggttcagagacatatatacttttaatctctcaatgttggcaaagcagtgttggcagctgttgcaggaacctaactcgctgtgtgcgcaaattttgagagcaaagtatcacccaggggcatcaattttgcaggcatcaccgagaccgggaatgtcctacacttggcgaagtattttaaaaggggtacaaattttgaaggatggcatgatctggagagtgggcaacggtgaaaatatccggatatgggatgatccctggataccgagggattggacaaggaagccaatcacctgcaggggcacaaacctggttactcgagtaaatgagctgattgatccttacacgtgggagtgggatgagccactagtgagacaaaccttctgggaggaagatgttgaacacatcctgtcaataccggttcatacagatatgaaggatgttgttgggtggcactttgacagtaaggggcagttttcagtcagatcggcatataaggttcagaaggctatgcagcgaagaaacgacaccaggtctccggcaacctcatcgggcgatccctccggtgatcaagtatggaagaagctttggaagttcaactgcccaaataaaattaaacactttttgtggcggttgggacatgattctattgccctgcgcatgacactgaagagaagagggttggacctggataccaagtgtgttgcctgcaacaggcttgatgaagatggtggccacctatttttcaagtgcaaggaagtgaagaaaatttggagggagttaaatctggaagatttaacatgcgagttagccaatttgcattctgctagggcgattgtggaagcgctctctgcactgggggagaatgaaaaattaacggcctcattgctgctgtatacttggtggaatgagagaaataggagaagggagggggatggaagaagagaggcacatctgctggcggttgtcaagcaggctagaagaccaagccactgggagagaccgacgttggatactatgaaactaaatatagatggagcttttagaccacagggggcaataggaggatggggctatgttaccaggggagcggatgcacaagtggtcctagcgggagcgggcaaatcgactcgaatgcaagatgctctctgtcggtgatatgggaccgggggtatcgtgaccagaggcttgaggcagacacaatcgcccacgcggcctggcaccttcgaggacgtcgggcccgagggtgaggtgtctgccctcctcctgatttctcccgagggggggtcgggttactcctgccccggccccgagggccgaggcaccccgaccccttgaggaagtttgcgccacatatatgggataggtgaacacggcagtgctcacctaaccgcatttattgtagtctggtcaagcgtgtcacgctgcatgcagcgcagtgcagcgcgttcctttatccggtctgtgaccggtcacagaccggtcagatcacgggttaggtggcgactggcggtctgacgcacgccttgccccatcccgtcaagacgaaagcctctaggcacttgtctcaagccggagctagcgtgttatctcttagagatggcacgttagccctggttagatttataccaggcttcatcccaaccattacatgcaagatgttacatgaagaagggcaaacatgcacgttgctaagctgacgcatggtagacaaggatgactaatctgtgaccggtctgacactggtcgcgtcatccacagacagccataatcccacgttgcacctgtttccggcggaagcgggggtaggtatgggctgtcccgtcagaagggcactcggacagcaaccgtaccgatctccgtccatttatgaagagaagaacagtccagtttggaaagggagaggggcatgtggtatccccttgagatataaaaggaggaccttgcccacctagaatggggatctttttggctggttcatactttgtaacttgtccatacacagatccaccaaaacacaggagtagggtattacgcttcccagcggcccgaacctgtatacgtctcctgcgtctcgcgtttcttccgggttcgcgatctttccacatacagcgagagcttgggatttcaccctaagcccccggtcgaaccggcaaaggggggcctgcgcggtctcccggtgaggagccacgagctccgtcatctggcgcgccaggtagggggctcagcgtgtgttttctgagctctcatactcttccgtgtgcgccaagtttcccttgttcagcctaatggtcgagcaagcaaaggcgcacgacctctctccgagtgtgagcggcgacgacggggagccaaacccacgccgtcgagctcgtactcccccacctcctccacaccaaaatcctaagcatggggaggcgctcgagagggttgataaatccgcagcatcaccggtcgtgggtgatgcaggagaacggcgagatggggagcgtcgcctcctcgtctacggcgacggcagcacgcctcagggcgcgcttcaggctgctggcgcgctcctacgtcacccgcccgtcgtccatgacccggagtctccagctcagcgatggctggacgacgtggccaacttggtcatgacggcccagcagcgcctgggtgctggtggacggtccgccaccaccaagacctccggcgccaccaccaccggttccgtgtcatcaaggcggagggcgcggcgagcggcggcggctgcacgtcattcggctgccactccctcatcgacaccttcgactcgggaggatcagcatggggagccggatgcccgcctcaacatcgagcgccggcgtaatagccggcgtactccccgtgaaacggagggtgcctcctcgtccagagtgtcacctcgacatggacgtgaggaccagccctccgtgcccccggctggtggtgtcggctgtagagcctttgtggcgagtcttcggaatgtccgttggcccccaaggttccggcccaccatcaccgagaagtatgatgggagcgtcaaccccaccgagtttctccaggtctatacgaccgggattgaggccgctgggggtgacgacagggttatggctaatttctttcccatggccctgaagggacaggcgcggggttggctaatgaacctgccacccgcgtcggtccactcctgggaagatttgtgccaacagttcaccatgaactttcaaggcacatatccgcgcccaggcgaagaagcggacttgcacgccgtacagcgaggggatgatgagtcgcttcgctcgtacattcagcggttctgccaagtccgcaataccataccatgcatccctgcacacgcggtgatctacgcgttcagggggggtgtgcggcacaaccgcatgctcgaaaagatcgtttccaaagagccccagactaccgcagagctttttcagctcgcggaccgagtggctcgtaaggaggaagcttggacctggaacccctccggttccggtgtggcagcttcggccgcccccggatccgccgctcagacagggcggcatgacaggaggaggaagaagaggtcggtccattccggcgacgagggtcatgtcctcgccgtcgagggcgctccgcgggccacccgaaaggggaggcctgcaagcgacaaaaagaaagaggctggtactcccagcagggagcgcccagccggtaggtggtgctccgtccacaacacctccctccatgatctcgcggactgccgcgccgtcaaaaatttggcggagcgaacgaggaagtgggaggaggacaggaggcaggagcgccgggaaggtaagtccccggcggttccttccggcaaacggcgaagtgaggccaaacagaaggcccccgctgttgacatcgatgacggtgatgatgacctaggtttccaagaacctggggccaccattgccactgtcgatgggggagcgtgtgctcacatctctcgccggagcttcaaggctatgaagcgagagcttctggccgcggcccctactcatgaggcgacgcgtcgggcacggtggtcggaggttgtcctcacctttgaccagaccgaccacccaccgtgcgttgcccggggagggcagattgcgatggtggtttcccccaccatctgcaacgtgaagttggggcgtgtcctcatagatggaggagcggccctcaacatcctttcccccgcggcctatgatgccatcaaggccccggggatggtgctccagccgtcccaaccgattatcggtgtgacgctggggcacacatggccgttaggtcacatcgacctaccggtcacctttggtggatcagccaacttccgcacggagcgggtgaacttcgatgtggcggacctcagtctgccctacaacgcggtcctggggaggcccgcgttggtgaagttcatggcggcggttcactacgcctatcttcagatgaagatgccgggccccggcggccccatctctgtccatggcgacctcaaagttgcgctcgcttgcatggagcagcgcgcggaccacctcgctgctgcgtccaagcacgagggtggtgacgagaggcttggcacctccgcccccaccgccccgaggcggcggattgtcacatgcgacgaggtcccggtcaaggaggttgccctgggcgacggtccatccaagaccacacggatcggtggtcttctggatggcaaataggaagacgcgctcgtctccttcctgcgggcaaacgctgacgtcttcgcatggagaccggcggatatgcccggggtccccagggaggtgattgagcaccgtctcgccgtgcggccgggcgcgaggccggtccggcagaaagtgcggcggtaggccccggaacgtcaagccttcatccgcgaggaggtggcgagacttctggaggccggattcatccgtgaggtcatccatccggagtggctggcgaacccggtggtcgttcccaaggcgaacggcaagcttcggatgtgcatcgactacaccgaccttaacaaggcatgtcctaaggacccttaccccctgcctcgcatagatcagattgtcgactccactgcggggtgcgaccttttgtgttttctagatgcatactctggttaccatcagattcgcatggctagggaggatgaggaaaaaactgcgttcattacccccgtaggaacctattgttatacatcaatgcccttcgggttaaagaatgcaggtcctacttttcagcgtactactcgaatttctttgggtagtcaaataggacgtaatgttgaggcttatgttgatgacttggttgtaaagacgcgcaaccaagagactttactctcagatctagcggaaacttttgaaaatctccgcgccgcccgcataaaactgaaccccgataagtgcgtgtttggtgtacctgcgggcaagcttctcgggttcttggtctctgcccgaggcatcgaggccaaccccgagaagatacgagctatagagcggatgcgcccccccagcaaacttagggatgtgcagtgcgtcaccggttgcatggccgccctaagtcgtttcatatcgaggctgggagagaaggcgctacccttatttaagctcctcaagcgctcggggccgtttacttggacggaggaagctgaaaatgccctcgcccagttgaaggcgtatctcagctctcctccggttctagttgccccggagccaaatgagcccctgctactttacttagcggcgaccccccaagtagttagtgcagcgttggttgtggagcgcgatgaggacaatcctcattccgcgcacccccaccctgtgccgacttggcccgggagcaagcagggaggagaggcccccgagtcgaacggtggcctaaggcccctgacgaccggagtcggccctctgcccgcttgtcagacggtgctgggtgcccccgaccctcaggaaggccccgaggccactgagggaaggccgcacctatcgccctttggccccgaggctaaccctgtgctgactcgacccgggagagagcagggagaagaggcccccgagccgaacggaggcctgaggcccctgacgcccggagttggccctttgcccgcttgtccgacgacgccaggagcccccgacccccaggacggccccgaggccactgtgggaaggccgctcctgtcatcctccgaccccgaggtcatcggcacagaagacgagtgcgccccgaggggccacttggacgaagaacgccccgggggtacggcccctagcgaagaggatcggccccgccgaaaggtgcagcggcctgtctactttgttagtgaggccctccgggacgccaagaccagataccctcaggcccagaagatgctttacgctattctgatggcctcgaggaaactgcgccattatttccaggcgcatcgggtcactgtggttacgtcttaccccctcggtcaaatcttgcgtaatcgcgagggtaccggacgggtggtaaaatgggcaatcgagctttttgagttcgatctgcactttgaaccacgccacgctatcaagaaccaagccctcgccgattttgtggcaaagtggaccccggctccagagaccgtctcaattcccgaggccagcacggacccctcacagctgcctcacacctcccactgggtgatgcagttcgacggttctctgtctctccagggcgccggagcgggggtcacgttgacctctccgaaaggagacgtccttagatacttggtccgtctcgactttcgagcaaccaacaatatggcagagtacgagggactccttgccggactcagagtggcagttggactggggatccgccgcctcttggtgttaggcgactcccagctggtcgttaaccaggtctgtaaggagtaccggtgctctgacccacagatggacgcttacgtacgccaagtgcggcgtatggagcgccattttgacgggataaagcttcggcatgtacccagacgggataacatggttgctgacgaactctcacggctcgcgtcctcgcgagcccagaccccaccgggcgcctttgaagaaaggcttacccagccgtcggcgcgacccgaccccttaggggagacggatgcgcctgatcggcccccgaggcccgtcggagtccaggcctcgggacccgaagggagcgctccaagctcccttagattgattgcatggatctctgagatccaagcatacctcacagataagactctacctgaggaccgcgaagggagtgaacgcgtccaacgcatttccaaacgctatgtgctggtagaagggaccctctatcggcgcgcggctaacggaatcctcctgaaatgcattcctcaggaacaaggcgttgagcttcttgccgatatccatgaaggcgagtgcggagcccattccgcctcgcgcaccttggttggcaaggcctttcgtcaaggattctattggccgacagctctcaatgatgcagttgatctggtccggcgatgcagagcgtgtcagtttcacgccaagcagatccatcagccggcccaggccctgcagatcataccactttcgtggccatttgctgtctgggggctcgatatcctgggaccgtttaagcgggccccgggcgggtttgagtatctgtatgtcgcgatcgacaagttcactaagtggcccgaggcttatccggtcgtcaagatcgataagcactctgcacttaaattcattaaaggcatcacggcccgttttggagtgcctaaccgtattattacggataatggcacccaattcactagtgaactcttcggcgattactgcgaagacatgggcatcaagctctgcttcgcctcacctgcccaccccagaagcaatggccaagtggagcgcgccaatgcagaaatcctcaaaggccttaaaaccaagaccttcaatattctcaagaagcacggcgattcatggatcgaggagttgccagcggtgctctgggcaaaccgaaccacaccaagccgagcaaccggggaaacgcctttcttcctcgtctacggcgcagaagcggttctcccatccgagctcaccctgaggtctcctcgggccaccatgtactgcgaagccgatcaagatcagcttcgcagagatgacctcgactacttggaagagcgaaggaggcgcgcggccctccgagccgcgtgctaccagcagagcctgcggcgctaccatcagcgccacgtccgggcccgatcactctgcgtcgacgacctcgtcttacgccgcgtccaaacgcgtgctggattgagcaagctctcaccaatgtgggagggtccgtatcgagtgatcggtgtccccccgccgggctccatacggttggccacgggcgacggcactgagctgcctaacccgtggaacatcgaacaccttcgtcgcttctagccctgagggagggctcgggtgtcagcgttttgggctcgggcaaacccggaccccccccctcgggtgtgcagggttggccgggggctaccacgcatgcacattattatttctcttatttcagcgtttcaaaaaaagcagtttcaatttcctaaaggttgtgtctgtgccgttttttccttttgaagaatcttgacttgaaataaggtcactcgtgctcaaccttgccctcgggggctcggttcggtcagctaaaatcgccaaacggggcccagaactgagccgtgccccggggcgtggtgaactccgggggggaatcggcaaaaacccacaatcgggtcacctataaccctcggtcaccacgttcccggcctggccagcctcaacatgtggatctccccaggcactagccccgacccgagccattagaggactgggacttgggcacgagcccttaaatcaagctaagacacaaaagaggaccacggcacagatcatcctcatctcatacgcatagcaaaataaaattgacacgaagaattttttcatttttgattccagattaagttgatctatacaaaaaagaggcatgaaggccttagaagaaagaaaaagaaaaaattggagattggcgggggcctgggggctcattccgatgcgcccgggtcgccggcctcgtcgccatcgttgtctgcaccgctggcgtcgccctcctcgtcggagttgggggcgaacgcgagccgaggggccgagccctcgaagctgttgacgatgtggtcggcggcatcccggacccgcgcgcgcgcatcgtcctcggtcccgggagggaactcatccagcgccatccacggagagaagttggggtccctggcctggtaactcgctaatacgagttcgaccgctccttgggcgaggtccctcgaggatgacttaatggtcttctcgagctcctcggggagttgttggagagcccaggccatcttcgtgaggcgcggagcgaggccttccagattggtggagtgcggcattgtttggcctttccagaggcccgcttgccgaccggcgcgatctaggcgggagaccgcatcccaaagtgtgccaggccctatctcgcccgccaagcggagggcctcggcctccccggcggatgagtcaagggcgcgctgcatgtcggcgacggtgtgttcggcagctgcaaggcgggcgactaagtcgctttcgcccgcagccgccccaccgatgggcgctctcgcggccagctctttttcccgctcc

SEQ ID NO: 74069 - DNA, 47774 bp, Oryza sativa
  unsure (1)..(47774): unsure at all n locations
ttagaatgatttattagatacacatacatctattgtatataactcatattcacacgataatgattcccgtaaaacaaaacgtgcatcaaacaaggcatgatcttctgttaatttgtcatatgtatagcccatcttgacatgttaatacatacccatgtatatagcccaccaccttgaccttgaatactatcttatgcatgcaacagaccatgatgtgtgatgacacttgctattgtccatgtaactccaattcttcttcggtcgttactttggaagaccgcacacgctatctctactgcgtaagtaatatttggattttttgcattgatctatctttatatgtcaagtggtatgcgatgcaaaatatatcctgatgtaaagtgggatatgatgcgaaacatgtctcgatgtattgctaggagtgcctcgtgttactcactctttaggagatgtctatgatgtaaagtggaaaatgatgcgacacatatcttgatgtgttgctaagagtgcctctagttgtcactctctctataggagatgtacctatgtactcactcagcatcctattacattatttggacgattttgcatgccgttccaccccatgcaatgtggatgcatctaatgtatgttgctccattgtatgcggtgtgaacgcatcctgatgctaacaaagacttcggttctcactctgtaaaccatatcatctactactccatacatcttgacatgttgcaatcactagtgaaatctttttttttttgccatggatgctccttctatgccataatacttcacaaagtttgtcaaatagtgattacattatattatgttccccatgctttatttataaaataaagagtaactagaatggtggcctacgcaaattacttgccaccttgacctatgaatacttttttatgtatgtcgcagaccatgatgtgtgatgatgctcactagtgtccatgtgaactccagttctccggtcatcactttgcaagactacaactgctatctctactacgtaagatatttgtattttttttccgtattagtttgctctttctatgtatgtcaagtgttatacaatgcgaaacgtatcttgatgtattgctaggactacctccaggtgtcactcacactgtacgagatgtatctatgtgcacgctcaacatcctactacataacttggtcggttttgcatgcagctctgccctatgtgttgcagacgcattctagtgtgttctatatcctatatgttgctccaccgtatgtggtgtgaatggctcctaaagttttgttagaaaagactccagtcgtcactccgtaacccctttgtctactactccatgtaggagatacatttttgtactcgttatgcatcatcttataatttggacgatttcacatgttgcttctttttctctacgtatcttaaggcatcttttgaaacggagaaatcacaagagaacttcatgggatctaaactagtttctaaaaaaatgaaaatgcatgtgttctaaagagctctaaatagtggagcaatatttggtaaaaacatgccacgttattttactagcattgactcctcttgtgattgtgcagaccctatctatcctggtatgtaggagatgcatgaatgtatttccttcttttccattgtaaaacttggaaagttctatacattgtcttaccttttctcttcccttttttgttttgtagaacttgtgcatattccgacgtattactatgaccgtctttgtgccttgtaacactatatctcttgactctttctctggcatacgtgggacacaccgtcagtgagccaactgacccaagatatgtgtctaaaacttggaaacccctgcacattgtcttaccttttctctttcattttccctattttgtagaacctgaacgtattccgacgtaataaaatgagtgtctttgtgcctcgtaaagctctatctctagtctcttgctctggcatgcgtgggacacaccatcaatgagccgaccgaccaaagacatgtgactaaaaaaattgaaaagatatgcgcattggcttatcttttttcttcattttttcctattgtaaaatgtgaacgtattcctatgtagtacaaagggtgtctttgtgccttgtaacactctatcttgcgtgggacacaccgtcaatgagccaaccgacccaatgtatgactaaaacttggaaagttctacacatcgtcctaccttttctcttcccttttttccttttgtaaaacatgaacgtattccgacataatactatgattgtctttgtccttgtaacaccctatctcttgtctcttgctccggcatgcgcgggatgcatcatcaatgcgatatctcttgctgtaagttcaagtgccttaatttggtttcggtgattaatgacaaatctaattatatgagactaacgtttttatgagcctttctttgactagtctcatttggatatggaagtaaaaatgatgagaggtatgtattaaacttcacatattctaacttggtctctcttgtagatccaaaatatagtgtgagcttcctatttgatctttattgattatgtgcatatgcgttccttcatatccatatgtatgcacatcttgagggggagcttattctatattttgtttattataagatttctatcttgatttgaaatcatttttcatctcatctctctatattgtttatatcgggttattatccatcaccaaagagagaaaagattgaaagatcttggattaaacaatttgtgtaattgttactttggtgatagatgataaaccgatgtttatgggattaacctctcttttgcataagttgtctactaggttatttcccgataatgagatgtggaagatatgcattcttttgtgatggaccttaatcatgacaaggatgaaatgcatggagataaaacgatatgtaccacttcttatctcctactttttgattggttcatatatatgattttcatgttattgatatataagtgtgagactaatgtttactcgaatgttatcttatttagtctcatttacattgagaacaaggagatcatgaatgtatatgttttatgttggtctacagcattactacatatgccttctctatatgtataggataaacccccattggtcattctctaattatgcatacacttgcatctcttgtatatttatttgtatgcatatatttagggggagcaaatcctatacatttattgtgcatgttctagatccatgttgttcacctattatttatatcgaatctttgcacttgagcttgcatacgagtatatgacacttgtgatgttaatgaatactcaacaaacatatccatatctttcatatgcaaccggttggtcatcaagtgaaggatgacaaccgatttgttgagactaatgttctcctttgaggtgtgaaaaggaataggtcccactacgatgaggctaatgaatgacaccatgggttagtggtcaccaagccaaggacatcgtcatgttggcaagaatgaagtcaaacttgtgatgagaataaagtcttgacaaaggatggacaagacctcagcataaacatggttcaaccggatggtcacaagtgttgatctcggctcaagcttgaccccaagatggatggcgcaaggcaaaggtataatgtagctaagaatgttttcttagtattttcccggtcttggtgtttggtgtagaccagatttgctagataggcgccgtactatcaagaggggtctatgaagcgagcttgtggatgatcttgtgccatattagttcatacgcatgtaggtgcattttgtgggcttgtctaaccaagtgtgatgagttttctcaagtcttaaaccaagagagaagtgggcatgtccaataggagtgagtgacatcttgtgcgtatgtccggtggatatcctttggagtgtgagccctttatccttgacttaagttgtgtttattggatggatttttcatgggttggatggccttttgaataatctttccatagagtccaagaacaccaaattccgagacccgagtcaagagatatcgccgttttactaacggtcggttgagctgaaaagtgacctgcggtctgaccgtgggccttaggccggtctgaccgggtctgttagccggtctgaccggcgtggtaaggccggtctgaccggccccactggtctgttgcactggtctggtttttggtggcgatacagagccgccagagccgcaaccggtcagaccgagccgacggcggtctgaccgagccgtggacggtctgaccggccactacactgcggtcagaccggccagtgtcacgcccggaaattcactagtaatttccgaacttatttgtgcataaaatcctcctccaggaatcagccgaggtacacaaactgacaatttaatatacagattcatcaataactaaagcgaataaatacttacttaagaggcacttagtcctcaacatgaagaaaactgcagcggaaaaataaaatctagcgaagctccggctccactcccacaggcagctcaactggggtataagccaaacgtcttctcctcctggatcctttttcttcaactgaggttgattgattattgcaaggtgagcatatgacatactcagcaagccacacagcaaatatgcaagtgcacaaggataccaaaggatggcataatattggctcatttgcaaaagcagcatttagcaaaacatttaagagaagtaaaacagtggagtaattaatcaggaattttaatcaacactgaacagcacacccatgctgcacaggcccaaccatcctgaacaaccatacccggctgtacagatctaatctccaaaccaggagctaagcaaattattatcaggtataacatccataactattgtgagaggtgtgagactaatcacgaaaaacattgctcaactcgcccataaccgcgggcacggctattcgaatagttttactctggccagaggtgtaccactgtacccacaagacacagcctcaacatcatgtctaccatgcgtcgcgatactggaaagtacctaaatagaggctgtgacaataccctctgcataacacaactcaccacagtgcaccattcctggatcataatcacccccttataaaacaaggcatggactccccagcgacccccgtgggcttatctccgccacttctcagtctggtgctccgcaatgaatcatgttatacaaaaggtaaagccgttgcccacgctggcttgtggttggtacggttaatgtttcacaacagtagctcgcgaaccggtccttaattgccatgagcacgactctcaaaaccatgtgctcacaacccaccattatcaagttttagttggcaagtaattaattaatcaatcacgattgaccatcgtgaactatcattaagccatcattaaaaaaatagtgagtcataagttatcccaatagtgtgctaatgtttctaagcatggctaagcaatcacatctaatatctagttgaaccaatatatataaagctcaactagtccaattataatcacccaaggtatcaaggaataaagtaatcgagaacaaaagggccataacaaagagtaggttaattccacccaatgacattcgaaaataaatgcacagttgaaataaatagagaatttaaatataggatcaacatgctcaaaggattgtgtttaggatctgtgtgacttgccttgcaataatcggtcttcaattaatcttcttgaacacttccggcgcactcgcgaaccttcgcaacgacggaaacgacaagctaacacgcaaaacgaagaaaaagactaataaaaaccaaataaacaatacatgaaaagtaaacaaacatgtagatcatatttttagatgaattatgagacttgaacggcctcattctgacttcaaatgaatttattatgaattttacaagattaaatctatttaaagcccatttaaaaagaattaaataaatttaattcaatttatggacaattttaatatgtagatctttattttatacaacttttgcaacttgaaccacattaaactgagttaagatgaattagttatgaatttttaaagattaaatcggattaaaacctttatatggattttaattgaattatgacgcaataatgaattatttttgaaaaggaaaagaaggattattgcgtcagcggctagggtttcggtggaccgggcgcacgggcgacggttcacgggaacggacggccgagatcaaccctatccaaaacggacggctgagatcgatcggtccacgaccggctcacgggagaagggacgataacgccagcgatgacgtcaccgacagcggcggcggctcggcggagcggacagctcgggcggcgcacgctcgccggcgaacggcggcacttcggcacaaacggagggcaccagcacgtagaggacgacgcggcgaactcaccggtgaccaaaacggcggcggcgacgaggaggaagcggcgaagctcttcgggtcgacgacggcgacggcgctccgacggtcttcggcggcggcgaagcggtggacggggacggcgacgacttggcgaacccgatggtggcaacggcgaccgacgacggcgactgcaacggcggcgcggcgcggctgaaccgacggcaacgacggcggcgactagggctacgcggaggcggcgctagacgcgacggcaggctaaggcaaaggaggcgacgggtagaggggagctcgggggtccttatataggtgcaaggaggcggcggcaaaggcccacggcggccggcgacgagaaggaaagctcgcggcttgaaggaaagaggccgatccgaatcgaactctattccacgaacttccaaaacgatttagccgatgtttccaaaggagaaaaggtagaggagatcccggagattgtttcccctcaatcaattcggccggagaaggaaaggagcggccggatttggaagaaaacggcgacggcggcgcgctagggtttcaggcggcagcggcggctcgaggaagacgaacctgacaagcggggcccacctgtcagcggctgagagagagaggagagcggcggctcggcggactgggccggctgggccgagggaaagagagaaagaggttttgggccgactttcggcccaaagccaaaagaagactttttaaaacctttttcaattaaattatttcttaaatgcaattccatttattaaaaatacttccttagctcaaataattcccagaaaaatctaggaattatagaattaagcaaagtatttaatgaaattttatctggcccctttttatattgagatttagcaaattaaaattagatcttctcttttaggcttttaaaatcatttctaataattccttttaaacaacaatttataagttaaggatttttaaacaagaaaagctcttaacaattatacttagatcattaatgatcaaataattactgaactgttctttgtattatttaagaattgagctctgaaaaatccgagaaaatttcagagagttgacttaaccatggagaatttaataaaaattaaatccatccatgctttagatttaagaaaattttatttcccacattttacttcacttgtaaattaaagatcatttaatataaattccaataataatttattaaataatttataaatcctaaaacgaaaatcaggatgtgacagccaggttgagtgggctcaatgattgccctgtaacggctagttttctaaccgttacaaagtagtccggtctgaccggcctcacaacggcggtctgaccggtagagcacaaagttggggatttcggttccaacggctagttttggtggttgggggtatatatacccactccccagcagcaagggtaaggttttggcactccattgcattatcttgaacccttgcaagagctctcacacccttgtgcacttagtttatctagtgaggtgttagagagtgagttaagccaatccaagtgcattgcttcattgttatagctagtgtggcacttgatcatcctcggcaagcatcctagacttgttactcttggaggttgccacctcctagacggcttgtggaggtgttgcccagtgacctctccgaggagattgtggaggaggcccggcaccgtttgtgagtggtttggagttcaccaccttcggagtgaaggaagaactacctcgagtgatcgaggcttgggtagtcctctccgtgggccagctcccgccttgcccaccccttgacgaagggggcgtgcggtggcttcgtggttgagcagtggaattgggctcgtctcaacggggattaggaaaccggcgaatttccgaacctcggtgaaaaaattccttgtctcttgtctcatttatttgttgcatttacatttgtgctatttacattcatagagacatatttgagcccatatcacttaggtttgcaaaacttaacttagttgcttagttaaccttgcacctcaccttgcctagcaacttaggttagttttgtttaagtgccattaagttttaaaaccgcctattcacccccctctagtcggcctccttgatcctacacttgcctcttgctctggcatgcgtggggcgtaccgttaatgagctaactggcccgagatatgtgattaaaacttaaaagttctgcataacgtattaccttttctcttcccttttcctatttagaacgtgaaaatattccgacgtgatactacgagcgtctttgcatcataacgctctatctcttgtccctttgctctggtatgtgtggggcatgccgtcagttgctttggtatgcgtgagacataccatgagctgctccgttgtgtgtgggacacaccgttagttgctctgttatgcgtaggacacaccctcagttgctccgttatatgcagaaacactatgagttgctctattatgtgtaagacaccgtcgattactctgttatgtgtggcacacaccatcggttgttccgttacgtgtgggacacaacgtcaataagctaaccaggacactggcccaagaaacgtgactaacatcactatctgccagctaggttccaccggtcagtcgaggcttaaataggaagctacatctcacggtttccaatgtagtacaacgagtgcatttatgccttgtaacgctctgtctcgcgtggaacacaccgtcaatgagccaactgacctagtatgtgactaaaacttagaaagttctacacattgttctaccttttctcttcccctttttccttttgtaaaacatgaacgtacttcgatgtagtactatgactacctttgtgccttgtaacaccgtttctcttgtctcttgctctagtatgcgtagggcgcaccgtcaatgagctatctcttgtctcttgctctggcatgcgtggggcgcaccgtcaatgagctaactggcctaagatatctcactaaaacttaaaaattcatgcataactattatcttttctctttctttttcctatttagaacgtgaaaatatttcggcgtgatactacgagcgtctttgcgtcataacgctctacacttgtctttttgctccagtatgtgtgggagacataccgtgagttgctccgttgtgtgtgggacacaccgtcagttgctccgttatacgcggacacattgttagttgctccgttatgtgtaagacacaccatcgattactccgttaaatgtggcacacaccgtcggttgttccattatgtgtgggacacaacatcaataagctaagacacactgctagttgctctgttatgtgtaagacacaccgtcgattacttcgttaaatgttgcaccatagtagaaaaaaccggactggtcaccgaaccgtccggacgtctaggtcacgggtcgaacggttggaccgccgggtcaaccggttcaagtgcaggtgaaaaaccgttatttactcatgtactcatttcaaacacaatatatgcgttgctcttttggctagaaaagtttgcgatctccccagagatccacgttcgaatcccatgcgcactagattaagtgctatttttggctgttgggccgcaaattactggattgggccttgatttggcccataattttgtgttaccaggctgggcatgccggttattttcccctccagtctttttgcacgaatagaccggccacatcgctggttccgatttttcacgatcgaaccgccgacttggtccggttttttgcactaggtgtggcacacaccgtcggttgttccgttacgtgtagaatacaacgtcaataagctaaccagcccactggcccaagaaacgtgactaccatcactgtctgctagctaggttccaccaatcagtcgaggcttaaataggaagctacacctcggggtttccaatgaagtacattgagtgtctttatgctttacaacgctttatctcgcgtgggacacaccgtcaatgagccaactgacccagtatgtgactaaacttggaaagttctgcacatcgtcctaccttttctcttcccatttttccttttgtaaaacgttgaacgtacttcgatgtagtacaatgactgacttcgtgccttgtaacaccgtttctcttgtctcttactctggtatgcgtagggcgcaccgtcaatgagctaactggcctaagatatctcactaaaacttaaaaagtcatgcataacgtattaccttttctcttcctttttcctatttagaacgtgaaaatatttcggcgtgatactacgagcgtctttgcgtcataacgctctatctcttgtctttttgctccggtatgtgtgggtgatgtaccgagagttgctctgttgtgtgtgggacacaccgtcagttgatctattatacgcggacacattgttagttgctccgttttgtgtaagacacaccgtcgattactccgttaaatgtggcacacaccgtcggttgttacattatgtgtgggacacaatgtcaataagtgtgtgggacacaacgtcaataagctaagacacactttcagtttctctgttatatgtaagacacatcgtcgattactccattaaatgtggcacacaccatcggttgttccgttacgtgtgggacacaacgtcaataagctaaccagcccaccggcccaagaaacgtgactaccatcactgtctgccagctaggttccaccagtcagtcgaggcttaaataggaagctacacctcggggttttcaatgtagtacaatgaatgtctttatgccttgtaacgctttatctcgcgtgggacacaccgacaatgagccaattgacacagtatgtgactaaacttggaaagttttgcacatcgtcataccttttattttcctcttttcccttttgtaaaacatgaatgtacttagatgtagtactatgactgtctttgtgacttgtaacaccatttctcttgattcttactctggtatatgtagggcgcaccgtcaatgagctatgtcttgtctcttgctctggcatgcgtgaggcgcaccgtgagttgctccgttatgtgtaagacacaccgtcaattactctgttaaatgtgacacacaccgtcgattgctccgttatgtgtaggacacacagttaattactccattaaatgtggcacacaccgtcggttgttccgttatgtgtaggacatagcgtcaataagctaagacatactgttagttgctccgttatgtgtaagacacacagtcgattacaccgttaaatgtggcacacaccgttagttgttccgttacgtgtgggacacaacatcaataagctaaccagcccatcggcccaagtaacgtgactaacatcattgtctaccagataggttccactggtaagtcgaggcttaaatcagaagctatacctcggggtttccaatgtagtaaaacgctctatctcgcatgggacacatcgtcaatgagccaactgacccagtatgtgactaaaacttggaaagttctgcacatcgtccaaaaccttttgtcttcccctttttccttttgtaaaatgtaaacgtacttcgatgtagtactatgaccgcctttgtgccttgtaatgtcgtttctcttgtctcttactatggtatgcgtagggcaaatcgtcaatgagctatctattgtctcttgctctagcatgcgtggggcacaccgtcaatgagctaactggcctaagatatctgactaaaacttaaaaagtcatgcgtaacatattaccttttctcttcttttttccaatttagaacgtgaaaatatttaggcgtgatactacgggcatctttgcatcataacgctccatctcttgtctttttgctccggtatgtgtgggagacgtaccgtgaattgctccgttatgtgtaagacacacaatcaattactctgttaaatgtggcacacaccgtcggttgttccgttatgtgtgggaaacaacgtcaataagctaactggcaccaccagcccaagaaacgtgactaacagcacagtctaccagctggtttccaccggtcagtcgaggcttaaataggaagctataccttgggtttctcacctccatcagttccatctcatctcatggcttatccgtcttgccgcgtgtggtcggatggcctcccgcgaggggcgcgcggcccgcgagctgcagccggccggcccacgagctgcagtcggcgagctccgcggggcgcgcattgaggggtggcgcggctggcgagcttcggctggcatggatcgaatggcggcacggacggcgagcactggtgggcgcggatcgagggcgtggcggcgagttcagacgggcgtgaatcggagggcagtgtggccgatgcgtgcagtgagcagtgagctccgagtctctgaccagctgcaggaaggaacaagaagagcgaggacgtatgccgacgcagaggaacggcgtagaggacacgacctccacggcacggtcgcgacgctctttccccatgccccacaccctcgatcccgtcgaagaacgcgtgactttctttggccactcgggcttcagatttgtgggcccagacacactcgtggtaagtggtaacaactctctcggattctccggcgtggagcgtttgggcagaacgccagcacatcgcactcgtgactaacatcactctctgccaggtgggttccaccggtcagtggaggtttaaataggcagctacgcgtcggggttcctcacctccaccatttccatctcatctaatggctcgtccatctcgccgcgcgtggtcggatggcctcccacccgagctactcgccataattgtcatgcagctcaactgccttgccgaccgcgcctgcttctcctttttccttttgtaaaacatgaacgtacttcgatgtagtactatgactaccattgtgccttgtaacaccgtttctcttgtctcttgctctggtatgcgtagggcgcaccgtcaatgagttatctcttatctcttgctctggcatgcgtggggcacaccatcaatgagctcttgtcatgcataatgtattaccttttctctcctttttcctatttagaacgtgaaaatatttcggcatgatactacaagcgtttttgcgtcataacgctctagctcttgtctttttgctccagtatgtgtgggagacgtaccgtgagttgctccgttgtgtgtgggacacaccgtcagttgctccgttatacgcggacacactgtcagttgctccgttatgtgtaagacacaacatcgattactccgttaaatgtggcacacatcgtcgtttgttccattatgtgtgggacacaacgtcaataagctaagacacactgctatttgctccgttatgtgtaagacacatcgtcgattactctgttaaatgtggcacacaccgtcggttgttccattatgtgtagcacacaacgtcaataagctaaccagcccaccggcccaagaaacgtgactaccatcaccgtctgccagctaggttccaccagtcagtcgaggcttaaataggaagctacacctcggggtttccaatgtagtacattgagtgtctttatgctttacaacgctttatctcgcgtgggacacaccgtcaatgagccaactgacccagtatgtgactaaacttggaaagttctgcacatcgtcctaccttttctcttcccctttttccttttgtaaaatgtgagcgtacttcgatgtagtacaatgactgcctttgtgccttgtaacaccgtttctcttgtctctcactctggtatgcgtagggcgcaccgtcaattagctaactggcctaagatatctcactaaaacttaaaaagtcatgcataacgtattaccttttctcttccttttccctatttagaacgtgaaaatatttcggcgtgatactacgagcgtctttgcgtcataatgctctatctcttttcttttttgctccggtatgtgtgggagatgtaccgagagttgctccgttgtgtgtgggacacaccgtcagttgctccgttatacgcgggcacactgttagttgctccattttgtgtaagacacaccgtcgattattccgttaaatgtggcacacaccgtcgattgttccattatgtgtgggacacaacgtcaataagctaagacacactatcagttgctcagttatgtgtaagacacatcatcgattactccgttaaatgtggcacacaccgtcggttgttccgttacgtatgggacacaacgtcaataagctaaccaacccaccggcccaagaaacgtgactaccatcaacgtctgctagctaggttccaccagtcagtttagtatgtgactaaacttggaaagttttgcatatcgtcatcgagctccgcggggtgcgtatcgaggggtggcgtggctggcgagcttcggctagcgtggatcggatagcggcacggacggcgagctctggtgcgcgcagatcaagaggtggcaaggcggcgagttccgacgggcgtgaatcagagagcggtgtggccgatgcgtgcagtcgccgatgcagaggaacgactagaggacacgacatccacagcgcggtcgcatcactcctttcccacgccccacgccctcgaagacatcgaagaacgtgtgatttgtgggcccagacgcacttgtggtaagtggtaacaactctctcggattctccggcgtggagagtttgggcagaacaccagcgcatcgcacttgagactaacggcactctctgccagctgggttccaccgtttcgtcgaggtttaaataggaaggtacgcctcgaggtttctcacctccaccggttccatctcatctcatggcttgtccgtctcgccgcgcgtggtcggatggcctcccgcccgagctactcgccataatcgtcctgcagctcaactgccttgccgaccgcgcctgcttctcggccgtctgccgcgcgtggcgtgacgcggcgccctacgccgacgccccgcagcgcggtgtcccgtggctcctcctcccggcccgcgacgcgccgtccttcttcagcctccactctggcgccacgcgccgcatgcgcctccccgatggcgtccgcggcacgcgcttctgcggcgtccacgacggtggctgggccgcggtcgccgccgatacgtggcgaggcttcgcggtcgtcaacctcttcaccggcgtgaggctccccctcccggagaagctgagggtcgaggtcccccccggcggcaaccacgaccagttcgcgttggccgccggcttcacccgccaccacatgctcatccgcaccgtcgtcttctcctgccctcccacctcgccgtactgcatcgccgccgcgcacgtgtccagcgcctccaacatcgccttctgccagccggcgtcgctgtccaccagctggaccgcgtaccggcgcgacatggacatcatccaggacctcatcttccacaggggagcgctgctgcagggcttccacgtcctcaccaacaaggaggaggtcctggtgtacgcgcccacggcgccccaccgccccggcgcgccgctgaagctcgcctgcacccgctactcgctgcggccccgcgacgactaccagcccgacgacgccctgccgccgacgttcatcgcgacccgctacctcgccgagtcccgcgggaagctgctcatggtgctgcgccactacaccggcaaccccgtcgtgcggcgccgcacccgcatgttccggatcttcgagctgacgttcggcgagccggcggagcccaggcgcgccgccaccccgtgctggtgggtggagatccccgagctgaccggccgcgcgctcttcctcggccgcagctgctccaggtccgtcgatgtggcgcagttccccatgctccaggaggacaccatctacttcctcgacgacgcgaacctcgacctgtccatggtgctcaacaacgggagcacgtactgcaacgtcgacatgggcatgtacaggaagggcgagaagatcaggcctggcgctcgccaattcccccgtgaattcactgcagactgctcgcctccgatctggctcgtcccctgattattcagtgggtattccagcgtgttactgcctgtcgtttgggatttactccattaataaatcgctggcagttctgtagggtttcagaaaaatgaaaaatgtatcttgacatgttgtaatcagggtttcatttaccgccggggccgcggttaccgcgccccggcggtaagcacggttaccgcacggtaaccgcggtaaccgtgacaaaccgcgacaaaccgtacaaaatttatcaaaaattcaaattatttttcaaatttatttgaatttgacgcggttaccgcggtttaccccttaccgtacccccgcggtaagcgcggtaaccgcggtaaccgcgcggtttaccgcggtaaatgcaaccctggttgtaatcaccaatgaaatcctcgtcgtgtcattgatgctcaattttgttgtcccttcagatattatacttgtcaagaatttgttcagcttttagatttagacttccaggtaatgggattcaatgttccaagtagaacatgttcaagcaattacagcaaggtgcacggaggattaacagcaaacatacacacaagtgacagagaacaaggtgaagcatggcgtgtacttgtatacgcatactttgacacacacgtcatgcataatgccactactatgctagcgaaaggtaagaggcatgcaagatgcagacgctcatgtctgacgtccctgctcataaaccaccagctggtgactgcagtccccactagcagccgaaactgaacccaggtaaagcgcatgaacggctacggctgcatgagatagaaagaggaaacggccaagccaaagccgtcgtgatcaccaggccagagaggcggccgcgccgcgcccacgggagtcggtgggtctagcccacgaatgtttgcgtctcgcgttcacagtcagatacgttcatctcccagtactttatagacttttctagttacaaaaacaaatcgctgaatgctttttttatttcctaaaaaaacccggagtctggtgatgattagatttgtttttgatttgtactaaaaattttacactaaattttttaactgcaaatataattcatactataaagtttataaataaaaaacatatttatgtaaagtttgtagcataaagtctatataaaaagtttatatataaaaaagaatatatgtagaaagtttccatgaaaataactcatataaaaatgtttccactaaaaaggctacagagaaatactataacgaaaaaaataaattcggaaaagaaaaggattgagaaaaatagaaagactgatacataatgtactagagaatcacgcaaaggaaaatagcggaaaatcgaaaagaatcacataaaaaaggaaaaatgggaaattaaaaacgggagaaagatactgcaacgacgcgacgcaccaatatcgcatcgctacgtctctcatcctcccctatcctaatctatttgcctgatgtattagtggcgaacgtttgccgaataaccttttcggaaatgggttcatcctccattttaacaaaacgttcaaattaggtcccataaaaatatcgatggctgctttaattggtgaacatgtcatcttacaaatcctactattataaaaatacgaggcgtttttggcacatcgcactagtagaaaaattgcttttgcaaatgggctaaaaatatttttctaggcggagctccacgccgccggtactttaaggcatacaaaaatatacgattttttttacatgcggacattggccccgcccgctaaaatcacattcgcaggtgagcctctaaatcttcataggcattacattcacccgcctgcaaaaacaatcctaccgaataaaagaaaatcgcttgctaccactcccacccgctgccccctccccctccaatcgtcggctctcctccctctcctccttcgtccgccgccaccgtcggctggctcccctccttcgaccgaatctgggagggagggaggaaggggagtgccgcctccgccgctagccgactcccctcctccggccgaatctggtgagagggaggagagagagcgagctgctggctctccttctccatccaccgccgctgccatccggctcccttcctccggctagatttgggagggagggagggaggggaggggcgccgcctctactgctaccgccggctcctcctccgtccgccaccgccagccagctcccctcctccggctgaatctaggagggagggagggaccgcctccaccgctgccgccggctcctccttcgttcgccggcgccgccgactcccctcatctggccagatctaggagggaggggagaggtaagcgtcgtcggctacaatggcccccgcctccgccctccgcaccaccggctgggagaggagagcaagtgaggggggaggaggggaaaggtgagggagtgaagggagaggtggagggttatgggtggaggagcgaggacttagtgggtgaaggataggaagtgggtagcgcgtggatggcggatttttgcaggcggaggacttaaggtccccgcctgcgaaataggcgggactagctttatggtatcatgaactacttttacaaatgatgattttataatccgtctgaaaaaataaaatcgtaacattgccaaaaaaaatcaattttttacccaggtgcatgtactaattcctgcgcgagttagctctgtctcacacagcttcgcgcgcacaacttgtttaatttagagtaaagtccatcactggtccctaaacttgtaccgttgtgtcatcccgatccctaaactcgcaaatcgatcgttcaggtcctcaaacttgttcgactgtgtcatcccggtccctaaacttgtagatcactcgtttaggtcctccaacttgttcggttgtggcaccacgatccctaaacttggatttgaatatcatctgggtcaaataggacggtctaaagactttatatttaaaaataattcataactttttcatgtgaactctaatgaagacaaactttatatcaaacttgtagcactcgacgcgatctacaactttgtagttgaatttttttttattttaagtcattttttgtcccaaaatgtaattttaaaattaaaattttaaaatctataaacatgcaacaatattttaggaccctaaacagttttaattcaaaaacttttcaactacagagttgtaggtcgcgtcgaaggctacaattttgatataaagtttgtcttcattagagttcacgtcgaaggctacaattttgatataaagtttgtcttcattagagttcacatgaaaaatttatgaattattttttgatataaagtttttagaccatcctgtctagggaccggggtgacacaactgaacaagtttagggaccggtgatggactttactctttaatttacccagtgagcacaataaaccccgcagcggcatcgtcctcgatcggctcgccacgatgacacttcgatgctttaggcttaaatagtaatatgcacgtgctaacgctacaatgacatttgactttaaaagacaatacatgttttgacaatcaagcaaagaatgatgtaaaaacaacaaactttacaatctaaacatgactaatagcatgaattagtatgtatacaatgcgaggaaggtaaatgttatttttcctcattctgatacatagagtttaagtttaatttgtccaaaatttctctcgtgtttagacttttgtttacaacttatgtagggcctaccccctattaaaaaaaataacacccattatctttctcatgcagcacgcttctccttccgctctcctcccccagcttgcgatatcagagcatccatcaaattcaaccgaaaccagcaacctccaccagacctgaccactcttaaccgctagttggtaatgtatatgagaacatttatcaaaactatcacttaatagatcttaagaaaacaatattttgcataagctggtgcgcaaaataaaaagcaacttcgtcggttctcctcttcctcctccgtccgtcgctgccgtcggttggctccccttcttcgaccgaatctgggtgggagggaggaaggggagcgccgcctccgccgccaaccggctcccctcctccggccggatctggagggagggaggggagagagcgagccaccggctctcctcctccatccaccgccgccgcagccagctcccttcccccggctagatctaggagggagggagagggaggggtggggcgccgcctccaccactgccgtcggctcctactccgtccggtgtcgccaaccagctccccttctccggccgaatctgggatagaccttaagaaaacaatattttgcataagctggtgcgcaaaataaggagcaacttgaacagccaatagagcaactcacataaaacactactaatgcaacgctaggaggggaaattttcccggaagtagtgttgatcactggtcgaaggccaactgcatcctgaatttattcacacgctaaaagaacagaacatcacatttatatgcctttaacagcaacaattttacctagtatcctttgctgctaacttctcccagaccatgcgcctgatatgcttgtttaaatgtatgtcctccaaaacagtagcagctctttgaacaactacactcaaaaggttagtaaatatttaggcatcatgatcatctttatgtagacaacctagagcaatatgccatctagtttcactgtacagctccgagaaccatccatattacaaatggaacttctaagtaaatattaaatattatgtcgacttcatacattcatgaaacactcaggcaatacaggctaaatgattggtatctttttaaatgtgtacagatattacaattgcaatcatacttggcacattaaaggtttatttttttgtgtcgattggatctttcaaatagtaatcaaagttaatgaagacaacctgatcacctcttagttagaccatgaaatcagtaaaaccctccactccaaaactcatgaatgcttagaggtacaccctatgcatgggttatgtatatgttgtgtttctggtggtgacctaaattagtttcagattacaccttcagccaaccttgagcttggacaagtccaagatcagcttttctatagacttcgctcgctacaatttagaataagagtaaaataatggtctgctgaacttctgaaaattagcaaaacttctgataattgaaaagacactgctaagacatctattttcagttatctatttagagggtagagaggtattgcaaattaaaaaatatatgagcctaaagcattttaacccaaattatatatcaatgtaactcagtaacaagcttgcaagaatgaagcatttaatagcaaaccataagaaattatttatttgaactgaaagccttagacttttacatgaaaacaacatacataaatttcaaacaggagatgcacacagaggaaacaatattagataatatatattcatggatccatatatttggaagtactttttttaccaccgtattcagataataccagatcggactttacgctgaatggcaatgtgacatacatcagaagtgtttttcaccagagttctcagttctacaacgatattaaatttagaaaagaaagcaaaccaccaaaatagttcgccaaagatcaagttaattttatcgaaaccaaacatgactgatgcgatgctaatgtaaaccggctaattgcaaaaaaaaaatgaagtagcagtgtttcagtttagagtaaggaatggtacgtcttctatctggtactgcagcaatagaaagctagtaagctagcactgatcatttcatctgttaatcatgatatgtacataattattcacatggttggcatatatgcatattttgttgctagtttggaacccatttgttatcatacatatttttttatatctttctgaaaatgagtataaaatgacacgcaattcaattttgcatgtaactatttattattaatgaacctgaaccatcaacatatttttgttgctgtacaactgggatatttaatgcttaaatttttacattttggtaggatgtattcttttctatgtgctcttaaattgaaaaaaaaaatgcacactcaaaaactgaaaaatacataagaggctttaaacactccattatagaacatgttgatcacattttagtccatactcacaacagattaaggttttccagcttttgaggcataattacattattacataaatggataaacatgtactgttaaatccaatcttgcagctaggccatatgttcttaagaaattatatatagactatacatagttatcatatatgacatgcacagagaaccgataagaactgttaaaatggtaaatttgtcccattgagacagaagaaacaaatataactgaaaagtggaggccttgtgcatctgcaagaattgggcgaataaatgataggactgtccattcatagatgcgaagcacaggctttttgggtagtttatgccaatgcattcaagacttcaagcacctaatagcaatatatcttaatatatgaaagttgaacccccaaaatgcaaaattacagcgccatgtcatgcaggaaatatggaccgtccaattttttgctcagaatgtcaagagccatcggatcctttaatcagagaaatctcttcccggtacttcaagaaccttctttgtaaaaagaatccttccatgtccgtgggaggcagggaccccaagccaagccaagcgcctctcctgcctgtcacctcatggactccgcatctgccgccacctccctccaccttgctgccaccatcgggtcgtcctcctccccataccgagcgccaccactggaccatcttcctcccatgcaatgcgccgctagaatctcctcctcccaatgtccagtggcgagatcctctcggatcccaaacgatgggagtgaatcgcctcctcatccgcatccctactgccatctcctcacttccaatgcccatcaccggagccaccacatccatctacccagatccatcaatcctgcactaccttctctagctagactaaattctttttctggagtgaaattaagctgaggtatttacttcttaatacttgggccttcattctctacattttatagatcgtgaccggtagatgaaaagtttcaaggaaccctataatacatataaatacattgctgaatatgatagtgcaaatcaacaccacgagtttctattttcttactgacataactactgcttagcatgttgttcttcaacttttcagggtgctgaaacattctcatcatttacccttttttttaggaaatattatataaataatctcagctggctgaccaaagcttgaaatttactttcgaattgctttcaactacaaaacataaaaacaaactgaaatcaccatgattgtgtggagcattataggacgagattgggtggaatgcagacagatttataaaactgaaacaataacatatcagaatatagtagaaaatttatgtcttcgtgatattgggtcaaagtaccagagaaagtgagtaacattaatttgttttcgcagagtgccaaaagagctaccaatttaattattgatggcctgagaaagtattaacttagtcttaaacatcatatattcgtagttgcacttatactgctccacgctaccacttaatgcttatactaagttaactctttgacaagtagtgctactgtaactggtagacaacccaaaaggtctacaactgaagtcaagttgcagttgcacttcagttgtaataagccatggtagatctccagttattgaaatcttattgccttattggttttaaagaaagatcaagtaaacttggagcaccataaaaaaaatccatatcgaatatactgtaatctatagaagtcctaaaagaaatcattatttacttaaaatatggttcgaacatgcaggcaataatcatactgatttttaggtgaaatgttacatgccacagctactttgtggcattgatcattgccatagtcatcacattattcaccgcaatattaatgcttccaatcttttgagtgacaaccgaggcatattgaaaatagccgattttggcctagcaagtttctttgatcctgaacaaatgtcggttcatcgattagatcatcagaaagaagattcccattttgttgatggttgatgaatgcaaagcatattaagaagcacaagttaagattataaggccactaggaaaggaagtgctccttatgaatcttcgacttatgttgttgatatttcgtaatgcaataaactaattctgtttaggcgcacacagttccgatatgcggctgtgacagcacatattcagagtatcaagacatccaaatttgcaataaaagcatttggtacttcagcccctatcagtattctttctcatgtctgtgttcctgcccttttttttacttccgccccaatcaatattttttctcttacgtcttggtaaataaaagcatttgcaaagaaaaaaaatcccaagttctgttccaattaagcttaaatttttttcaaggatttatgaatgatcccatactcggagtcaatgctttggtccttgcctggttggattgtaaacgtgatttttttcaccaacagaggtgcttgaataatcatatacaaggggccgtgtttttattgtcgtactttgggaaccaaaagtaaaaggttgatcatcattttctgtatatgataagtgaaagcatctagcagagaaagaggttatagtcgtgcgaatgcccgacttatttaactagtatatcaatgatagtaccatcaagagagatgtacacaatatcgtaccaagaattaacgattgttatttctaaaatgtgatttaattttcccaaaccagtaggccaaacttgtagttgggctcatattggtatgtgcaagtgtgcaacatatatggtctctctcttcaggtacctagctccctagtgttgacaataagcttagtaatcagtacaggtatcttgagcgttgattttctctcatgattcaggtcatccagtaaagaatccaaagtggcaaggttgaaactttaaaagaaattctcaccttatcctcaggaacacttttgcagaggttggtcactaccatttgctccatcttttttttttgccaacctaaacacctcaataaggactgacagtcttgacgtctttgccatttttcaaaatctagtaatcatcaattcattatttcagtgcaagcgtgaactgcatattagatggataccttgtttcttatctgaactaaatcaattgacagatccactatcaggagctagaacctaaaagatcatacgcaccatagctttcgatgttaacttctccaatcaaaggagattttgggggaagctcaggtggagatgcagaagaccaggcggcggcgatccatggcctccaaattcgtcgtcggatcgagccatggcccccaaattagatccccgcattcgctggaccgagcaaagatgggagggggcagtggagttggggatgaagaggcggaggcggaggcggcagcagcggctgaagtgacggggaggggaggagcaagaggagacgtaggtggaggtggaggtggcgctggtgaggcggcggcggcggtgaggacgggaggggagaggcggcggcgatgcgggcgtgtgggaggagtggagatcccaggcggagtgggctcgcaacttgccgcgaattccgaagtcaacgactcggttgtccccgcgaattccgaagtccgattacgattccaagtagcatgcttgtccggttcggtttctaccggtatgcccgctttaaaaggacacagcagaggccttcttttctcaccgcaaattccaaatttgtcaagtccaaaattgtcccctacaccaatggcaggcagatattacactccccaaactcatcctcctcctccacccgagaacacgctcgacgtcttcatggatggcgacaccataccgatccacaccaccatcacgtcgtcgcactccctcgctgcccaatttatcaacgagatagcccgcgaacgtccccagggggggctcatcgtcggcatcgacacggagtggcgcactgaccatctgcccaacggcaaaacatgttacaaggtcgcggtgctccagctctgtgtcggccgccgatgcctcttgttccagatctaccaagccggcaacatggtcccacatgagctcgcggagttcctcgccgacccgagcgttcgcttcgtcggcgttgcagtcaacaacgacatgcaacgtctggccaatgattgcaacctgagggtcgcctgtgcggtggatctgagatatgctgcggcggccgtgctcggtcagccggagcttgcgagggcggggctgaagagactggcgctcacggtgatgggcgcccacatggagaaggagaaaaacattacgaagagcagatggggtgagccgacgctgacgtgggagcaggtcaactacgcctgcatcgacgcatacgtgtcctatgagattggccggcggctgctctctggtgaacctatactggccgctccgttgtaggtacatacacgcagggcgaacttgccaccggtgcaatgtttagttcgaatataaattatagagataagtacgatttagagatggaattctaaaagtaaaatagagtcccaaattctagagataaatcaactataacttatccattcttggtctgtcgacacctttcacgtgtgccctgtaatgtaatatcaatcctataatcttcctgagtgtcatatcaatttgctaccaacctatcttagattatttttagtgatgtttatcaatagatcaatttcctttttagccaaccctcgactcttctctattcggagatgtatccgtgttgcttcctttttcatcaacgcagttttgagcacacgagtataacatattgatttggaataaatctcaaattctcaatccaggtatgtatatataccaatattgtgtgagaactcccgtcgggtacagtggtgactacgtggtgagcacactacgtggttcaagtgtctctccttcttttagcttgtgggcatatacaaatttatcatctgatattatataggccgtgcactgtctatttaccacaaagaaaattcgcaatgtcccccctcttcttcacttctataatcgggttgcattgaattgcagtgtctatgtttttttgacgctcggtactcatcaattcaccttctgctgtccctaatctcaaatttaactaatcgagttgagtttgatagggagtgcgggttgagagacatgggtgctagtgtgctactactaaagtgagctagctagtttgtactgtagtacattccacaaagggccgtgtgatctttcaccttttgatgtttggaccacttggccatgaatgctccggtctaaggtgcggtcaaagaatccacgttagattcgagcaaatgcggaggagagatataaatgatccactctaacgtgtggtcaaaaaatcaacgtcatattcgagccaaggtggaggagagatatgaatgctccactctaacatgtggtcaaagaatccacgttagattcaagccagggtggaggagagatggaagaaaaggggtggcctctacaagcttgtgaattgcgtgtattatgcaagacaaggtttcctcacgctagaaaaaaagtatctgcacgaggtccaaccccccccccccacacccccaaagcatgcacaaatacgaccattgaaaacttcggagcgacgtaccagactagagtgtcactgggatggtcgttgcctcaccggggaagcttcgccgacccccaacgccccgatccatgctgcctagaagccccaccaccacgtgcaaccatgaagcccaccagccctcgacaccactcgccgtcttggttggaatcttcatcggcctaggggccctaatctgtgccgcccaaagttctacgggcccaacatgctctaatccatgctgcccgaagctccgttggtcatcgtcccctgatctgtgctaagcgaggtggatctggaggagcagttgtgcccgtctttgctcttccgcgaaggagcaacgacgatggacacatgaggtcactgacagagtcccgtgtgtcccattgaagcagccaaaaccaggataagttgtagcagacgcacaaagaggagtcaaatgtcaccgttaggagaacgctggagagccgtcgccacagtcggggggagagcagaggttggggtagagtatggaaagtaaggaggggaaaggggagagacaatcaaataatgaagggattttatattagtttttggattttagggtgtttagtgtaaaattttgaactttctttctttagagttttctatatgcacaatttcttgatgtttcggcgaatatttactctttcctgtcttatttgttaattcataacctgatctaaatttagaaaacacgaggattaaaatagaaaatattagagactgcacaaaaagttaaagacacaacttaaagctacctggaagagatttttttgatgtggccttgtcctagtctgcaactctgcatgttgtgcacccaccattatttatgacctaatgcttccgaaaagtctcttcagctggtccaagcttggtaattgtaaatgggccatgctggaaacatagccgaaaagaaagctacgagcccgtccacgatttgagtgactaaaaccgtgctaagactgtaaatacaatggcctaaagaactagtatgaatatgcgacggaacacattgaacatagaattcaaaggaactaagcgaggtggatctggaggagcagttgtgcccgcctttgcttttccgcgaaggagcaacgacgatggacacatgaggtcactgacagagtcctgtgtgtcccattgaagcagccaaagccaggataagttgtagcagacgcacaaagaggagtcgaatgtcaccgttaggagaacgctggagagccgtcgccacagtcggggggagagcagaggttggggtagagtatggaaagtaaggaggggaaaggggatagactatcaaataatgaagggattttatattagttttggattttagagtgtttagtgtaaaattttgaactttgatctaaatttagaaaacacgaggattaaaatagaacatattagagactgcacaaaaagttaaagatgccacttaaagctacatagaagagattttttggtgtggccttgtcctacttgtcatgttgagtacccaccattatttatgacctagtgcttcagaaaagtctcttcagttggtccaagcttggtgtcaacgagtgatactcgtggaccggatgagttgagtatcggggtatgttggaacgagggtctacgtagtacgacatcaagcagacaaaagacaaggattatactggttcaggtctcttgtcaggtaatagtcctagtccagtttatatgagattgatgatgacgagaacagattacaaagagagtagacgaaacagatgataccggcgaaatcgtagtcgatgagttcgacgagacctcccggcaacttggctccgcatactccggcttcgtaaactatggtgggtgtgttggcgatgaaattcgatgccttgcacccctccctaggagtcccttttataccgtggatcatcttgacccccaataaagatatgaggatagttgatctagtacggtataacaaaaattctatcccttccgagtaggactttggaaatcgcttcactcgtagagatattttccataatttggaacaaattcctaacgatgtacatggaaacgatccgtgtacgtgaaggtataccttatcggtatattccataagtcgtaggatagaatgtatgccttatccgtaaccctaacacttggtaactgtaaatactcaaatttttagggaaaaatttttacgaaaagttttagttgtgttcttctcgatctttccattagagcgatcttgcttttaatcttttctttttatcttggatctaaattttatttgcaaagttaaaagctctcttttaaattttataaaatccttcttttattctctattttataaaaaaaccctccatcttatttctttcgacttttataaaaccctttatttatcccctgttttatttcttttgaatttataaaagtcatttattctctattttatttatttcaaattttataaaaccctccttttttatttcttccgacttttacaaaaccccttcatttatttttctagcctctaagcgttgctccagaacaaatttcctttggatccttttccaaacatctccaaaatacatgaaataccatctccctagaggcaacactcttcctttagagcttaccattctaccaccaattctgttcctatagaaattcttatatttccctacctacatttatttccaaaatgcagttttaccctccagtaaatactctctcctttgaaatcctctccacccaaatgatccatttttatccttgaggctaaaccactataattccatttttgttggaatttattttggatcaaaccactgtctaaacctaatccagtaaacctttacttcctctccatcgattcaaaatatttcgtggccaagttcctattttgattgaaccacccatttgatttctatggcttgatcccatttgtagcacaagaataatattatcacaaatatttgagtgattgcttttgtgctaggaaacttatttccaacttcctttagcccacaaatgaaccattaaaaatccataccacatattaattggctaatatcctatttatttccctccatttatttttgccaccttcccaaaatttatccaaagttagtagataaatcattcgtatttctttcccttccttttaaacccttttcaatttttaaaatttaaaatattagagaaaatcttttgtgacaactcttacatttggctctttttgaattttataaaattggagcattttaatccttttcacaatttatatctcaaaaataaatatctttgattttattttaaaatatttcaaactccttttactttaaaaactttattttaaattctttttataaagttcaaaagaccctcaagctttcctctttagtttttatctcatttaaaatttatttaaaaccctccatataaattttccttatttttattcctagaaatctttttttagttccttttctaaaatttcaaagagtcaacaactttccttaattttcaattcctccaaatcttatccaaaagtccacaaaaattctcattgtttcctattaatttgggccaaactcccaattcatttggctcattcttttcccccttactcaattttctttcttcctcttgggctaccagcccagccgagctgcccgcctcttgccttctctccctgtgggcacgccgccaccgacaccgcatcaccatgggcgccgccgccaccagccaatcatgcgccgctgccgccgccctgtcgcaccgtccccgccatccgctattgccacgccggcaccgttctgccaccaccgcataccaggggcccccggcaccccctaggttgccgccgctatcgccaatccgcggccgccgccgctactccgccaccaccgctgctaagccgccatcgccgttgtttttgccactgccgcccgacgccgagccattcccctcggttgcgtgtcgccactagccgccgccaaccaccaacccgtcatcgacagccaatcgaaagctgacactcggtgccgtcacatcactattccgagctgacgccgccgtgccgtcgtcgaccaactctccctccaccgcctttgcctcccatataaaccggcgaacccctcccattttccccatccaaaactcaaattctctctctctctctctctctctctctctctctctctcttcctcaaatccaccaccgccggctgtcgtgttcccttcgctcctccaccgtcggccgttgtcctagcccatgcgccgtccccagccgccgccggaagcgccgagccaccggaccgtgcgcaccgccccttctctgcctcccccctctttctctgtggctcaaggaagaagaagagataaaagaaggctatgacgagtgggccccacttctaaatagtaatccttttctttatttgatttatttcaaattccaaactttagacatccatatctctccaaccgttgatccaattccagaatttttttgacctaagttcatctagtttcaaaccctttattttgatactaaatttcctatttttaaaattttatttaaatttctttatttaaatagcttttccttatttatttatttactttctgattttaaattattttaattaacctttaaaaattattttaaatttatttgatatactttatatccctttaattttaaatttcttgttttatttaaaaacctttttaaaattaaattatcctttaatttctttaaaaccccatttctttattttaaaataccattttaaattttatttctttaatctatttgaaacccctttttgaattcaaattcctttgatttatttaaataccctttttatttctaaaccattcctatactatctcattgccactaaacagctactgtggacactttacgccttctgtggagacgttcgcgtggtctcaaactcctacatcaaaccgttggtcgtaaaacccggcataacctaatcccaaggttgaagtgtttgtctttgcaccccacgcctcaacgcatatagcggtcggagccttactactctctcgacctccataacacgctgcacactaagtccttgggctatgtgcaatcctagccgctctattgtcactcacgactatagagtaacactgttccgctccacacaaatctcctaactcactagtcgttgtgctgcttgactgtagcatcgactagacaagccatttaaggcgttatgctacccaacctcagcatcggctaaccaaacccaaatttctagccgtcgtgctgcccaactatagcaccgactagaaaccaaatccaccaaataaaccccacctatccaaattatcctttcttcgattttatttaattcccaacctttagaaaccaaaacctctcttttgttttccaaatttaaatctattttgaaccattcctttttccctcgctttgctccaattttatttattccttggtttatcatttctttgtagcatttttttatagggtttatttgctatctttttgtattagtacgttcgaccgtacagcaaattctatcgacatccaaggagcttatgtggacccagatggctacgctaaaaccacaagaatctcgaggcgtgaggcaagacataactaaaattttgatcatatagaaaactcaatataatcttcagtttaattttatgcatgatatattactcatttagcatctcatcggtagatgttaaatgccttcaagcattattacatgaggttatagaaagatacatggttatcattttatgtggtttattattcaaatatctttacaaacttaggaatctggttaaaatgggcatttgagttgaggttgtgattgttgaaagttgtgaatgttggaatttatgatgaagtttgttggtatggaagttttggatgttgacataatttttggtggtttaactggattataattacccccttataccatgggaaatgacatagtttgcgcccatccacacgaccaagtaattggacttagcctagtattgtcccactatatgaaagactgttgggtagctcattaggagcagttttttggggtgaatcatgcgtaaggtgtttgggcggcatgattcacaacagtgggcttcatgaaagtgtgacgatatagtaaccttgcctaggcctggcaagagttcaaccactatgatgaaccaagaccccactgtgcagtaactagtagtaagtgggactctcgaacggctatggtgtttacagcctttgcaaattgttctcatcgtgtgggtaaagctaggcaaacactacatagtcgtaccgtattcgaatacaccatgctcccgattaaggagatatgtcataagggtgattcctactcctgaagtataagtagttttaaaaaataaattttgaggataagaatgatatatgattttattactcctttatttactcattgtttcatttattcatatctcttcacctttaattatttataatatgtcttgctgagtacataagtacccactcttgcataatttaacatatagagaattgtgctaataagaagaccagaagatagcgaggtctacagcaacaacaagtttttctaggatagtctagcttttgcttgtggagttcattagttgtagtttagtagtttaggagtttggattttccttgtattttcaagtaaggatgtattagtgtggatctcttcaacctttaacaattgtataattaggttgtataaacaaatttgtataattaattgaaagctgttttgtatatcaatctgtgcgtgatcgaaatcctagacgatcacgagtggatatttggggcaccaggcctaaattgggtgtccccacaaaacatagccaaaaagaaagctacgagcccgtccacgatttgagtgcctaaaaacgtgctaagactgtaaatacaatggccaaaagaactcaagtatgaatatgtgacggaacatgttgaacatagaagtcaaagggacggttaaacatatactgttcttttgggtatatggcgccgttgagtttttaacaaacatttgactattaattttaataaaaaaatttgtgtagatataaaaatatttaagtcaggcttaaagaacatttagtaaaatcaagtcataataaaataaatactacctccgtcccaaaatgtaagcatttttgtcacaccccaatccggcaccgccgcacaacggcacctgataggagcgtgtcgtaggaaaaatggcgcgaaccgcttcctacgaaaccgcgatctcggtaccagtcccaggacatagtgctggtacccacggtgacaaatatgaatcattgcaaatccttaaaatagatagaggacttatttaccttaacttaggttgcagctcagaacaacccgagaatgcaaccgacgacacggacgaggaaacaccaacaacaacagcagcagcggaaccaacgaactaacacccaacaccacaggcgacggctgggaaccaggacgaaaccctaatcttcacttcactttatcttctcttcagagcggaggaactatatatatatatttatatagagcaagggtgagtactctcgtactcagcaagtcacgggaactgaggtgtttaatgcaagcttggaagagagacaaggttgttttgcaaatcttttatttgaagatattttgaaaacactaagtggtttatttctttctaagtttgggccgaaaagagacttgcgtctcgtttcgactttaagagatgtttttcaacagctcatttggtaatgtaccgacctcccgggtcagatcattacttctcggctcccagagccattccacttgattaatcggctcccagagcctttttcattttctcggactcccagagtccagctgcccagcagcacaacaatccgcttccactcgggaagcctagtctatgatgcccacagacatcccgaatcacacagattcgtttctgaccactcaggtcatccatctgccacataggctgattctggttacgattcccacaccacaacaacttttcacaaagcacaggcaaacaaatctacgcaacgggaaccaccttacatccgcccatgaccgtgggcacggctgttcgaacagttagttaacctctgcagaggggtacactttacccacaagacacgaacttactccagacactggccggtgtcagaggttcgcgacaaagcctttcccaagccgacccagggatacctcatgccacatagaaggatcaatcctcacataaacataggccattataggtgttcacaattcaaactccaaccacctcgatcggtaattcagcaagcttctcgttcttgcattaccaggaacccggtttgtccgaccccgccccggcgttcccaactattggcatgcgaggtttccctgaaccgactagttacttagccagggtgtcccattccaccttgtggttgcactttgattatgttcgatgagtttcccacaggaatcggtccttatatgcgaatacgggacagtgccacataggcacaacccccgcatcgcgagttttcacaattaattttatttttaaacacaccgacaccacatatcgggttttgaaggcttcacaaacccatttcccaagttttcgacaaacaacggtgtatgtgggatatttggtatatgcgctcagagagcacgaataccgaggtaccacaaggatggagcgacaaggaatcagggtagtacgacctacggaaattagtgcgactactgggtaggtccgtcggtttggcacgcaaaccgaggccaagcaagttaagtgtgtgattctaataatgcaagttgcaaacaaaataataatgacttttcaattataggggcaattgatcaaagggtgacttgccttgctcaaggccttcacgaagcttcacgaatcttcgagaaaacccgcgatcgacgaaaatccgcaaccgcaaccatacgcaaacaatcgaaaacctaaacaaaagaccaaagaaggatcctatttagactaattaatagtgccattaaatagatctcaattttacggaattactggaagtggaacggaggcgatcggagctacggatcgagggatatgaatttggaggtctaagtggattttctggacaaggaaatgttttgtcggaatttatggaaataatattctcaagaatattattgacagtcactgaccaaggaaaatgattcatgaaattttggaataaggaattgatttctgaaagagggggaaatgatttattgaatttatagaaaagagaaatatttgtggaatattggaaaagacattctcaagaatatctttgactcattgactagtggggtcaacaagaaggtgagagagaataaaattgagagggagcaaatttggacttgtagctcatgagagatggacactgacttggacggagggaggaaatatggacttttaggccgagcgtgaggcgcggcccaatgggttgaaggaggctcggccgagccattgggccggcgcgggcgcaaggaggcggcccattaggggcgcgcggaagggagagggggcggtccgggtggaccgaacccaccatgcgaggtcccgggtggggcgcgcatgtctgcgacatggttcacggagggatgggcgcacgcgaggtgcggcgcaagggtttcgggtgagcgcggttcacgcgcgagcaccggatggaccaaggatgtggcgggcccacgcgcagccagttggtgcaccgtggaccgtgcgcgcgagggggggaaggaaggaggcggctgaccggctcggctcggtcaaagccgaggtggcgccgacgtggcgcctacgtggcagccacgcgggccggtgggaggaggaagaagggggcgcggccgaatggacggcggacggcggccgagttcaccggagcaaggcgctacctcaatggaaaaagaaagcgcaccgggggagggaatggacgagaggaagcgagccgacggctcggattcgccggaaagaggccggaggcggcggattgcggcgacgcgcgccgctggcgagcaaagggggaaaacggcggcggtcgacgagggatcaattcaaggcggtgggagtatctccggggttcaaggagttcatctccggcgttggatggggcagagcgacgtcgtggagatctggcgacgagcggcagcctccgggagcgagcggcgacggtggcaagcctatggcgggtggtggcgaggctaggggctttgtccacgcgcgttcgggaggactaccgagctaccgcgcgagctaaaggaaggagggggcaagcgggaagggagaacggagggaggcactaccgagccgagacgggcgctgtgacgagcggccgacagtgcgggagcgagctctccggcctcgggccggggaaggggaggaagatgggtgcccggagtcccgcgtcacgcgtcctcgcacgcaccggtcttcccggtgctcggcggcggacggcgacggcgagagcagaggaagggcgacaatggtgcggtggagtaggagtgtgaagcgggagggattgagatgggaaggggagctcggcttcgggttttataggcgcggggtgaggtgatgtcggtttgggaggggagaaccgaccttggcggtcaagcgctcggctggcggcagcggtggtttcgtgggcgatgcgaaagcggcgacggcgtggatgcattgggcggcgaaggcggtggatcgtgcggcggaaattgaaccgcgggagcgggaggagcagcgccggctggcgcggggcgagctggcgctgggtcaaggtgggggcggcgagctggcggtcgcgcccgtggtccaggcggtggcaggcggtgacgccgatggtggtcggggaaagggaaaaagaagggggaaaaagagaggctcgctccaagccgattcaggaagggagtaggagggagagggagagctcggcctccgggttttagcaggacgcgcgtggagcggctcaggcacgcgcgcggggccgtgcagctgtgtggtgcagcgcggcagggcagcggggccgggcggctgcgcggcgcaggcgcggcagggctgacagcggcagcgaccggccggtcgacctcctcgcgagcgagcgcgcgcgacgcgggggtgcggccggatttcgaacggcggcggcggggaaatcggcgccgaggagagggagaaaggaagcagagagagagagcgaggaaagagagaggaagaagagaggcgatgcctctctctctcggcacatgcagcgcacgtgcggggaggtggagaagcgggctgagaggagatgggccggggaagaagagtcggcccaccgagccagagggaggtaaaatagactttttctgaatgattttgatttggagagatttggagtttgggttttgaatctaaatttgatactttgtacacaagggttcaaggagtctaagaaggaaacaaaacgggagtttggatatttttgggattcggaaatgtatttggcgaggattcaagggaagggattgactttcggaatttgatttcagagactcgaatcggaagaggaattttcgaggtggaggattttgatttcgatgagagggaacaacgggattaaattgggatccttggcacaacttagactcgcacacaaagaacaaaaattttcgcaattaggatttttgccgaattagtttttaacgtctcacgaaaagcagagtgttacaatttttagctatgaatttagacacgcaaaataattaaaaaatacttacattttgggacggagagagtaataattaaaaaaaagataataatcaaacgtatcttaaaaagttaacgatgttatatattaaaaaacagagtgaatatatcttttcaggtgaggtggtaaaaaaaatcttgtcatgcggtatctggtggacacgatttattgtataacggagcgtacgggtttcagtatcaacatgctgcccgttataacgtaggactatcatcgctagctacctgaacatgtgaaaggagaggtgttaaagctttgtactataggtcctgtttaaatctcaccctaaaatttttcaccatgtcaatgtttgaacacctgcatcaagtattaactatatactaaaaaataactaattacgtagattgcaactaatttacaagacgaatcttttaagcctaattgctccatgatttaacaatatggttctacagcaaatatttgctaatgataaattaattaggcttaataaattattctcgcggtttactgacagattctttaatttgttttgttattagcctacgttttatacttcaaatgtgtgtccatatatccgatgtgacacggtaaaaaattttacccctacatctaaaggggtggatctaaacaaagccataactattgttagcttaggatgtgtttagttcacgataaaaatagaagtttggttgaaattaaaatgatgtgacagaaaagttaaaagtttgtgtgtgtagaaaagttttgatgtgatggaaaagttagaagttcgaagaaaaagttggagataactacggcccttcccaacaattgtaccttgtcttgggggtctttggctttactatcggacgtccgattaaactgaaaaaaattggacgcccgtatatttgtcgcaccatattctgatcttctctatgtgatgtgggaatctctgcatgcatgtactccttgtacttttctcttctttcttctctctcatgggttggtgtacctcacatctatactactttttctaatcaattttctaaatgatttttcttctaaactattgatccaatttatgatgtgattataccattgtatttattttaattaaacctttataataagattcggcatgaccatatcatgagaaaattgataatattttttattgaaacatttttatatactatatgaaacatcgaggtgtaatgattgaaacatgacataatactactgaaacatttatataattttttatataatacatgaagcatcggggtgtaacgattgaaatattacataatatttactgaaacatttttatatactacatgaaacatcggggtgcaacgattgaaacatcacataatatctactgaaacatccaaataatacaatgtgcaacatttacaaatgaatcaacgaaacatcagaataagtcacatccacataacgccacgtacaaacattaaataaaaattgattatagcatgaaaacttaaaacgtgcaacatatttggattccaactgaaacaatttcttttcacacgtgaaacatcaaatttgaatggttgaaacatatatattattttgatcaaaatataatcatgtgagatcttattatgaagatttaattgcaatgagtacgatggtgtaattagattcaataacagatgagtaatttaaaagaaaaaagtattcaaaacttgctaataaaactttatcctttaaatagcaatgaaagagtacatatagagacacatactatgctgcaagaaaaatagagcacatgtagaatagcagcgtccgattttttttcaacttagatcggtcgaccgctccgaaaaagtttgggactaaactcggccttggtgcacacgcgacactcattacgactgtgggcttgtttagttcacgaaaagaaaatttctgggtgtcacatcggatgtttttgaccagatgtcggaagaagtttttagatatgaataaaaaaactaatttcataactcgcctataaaccgcgagacaaatcttttgagcctaattaatctatcattagtatacgtgagttactatagtacttatgctaatcatagattaattagactcaaaagattcgtcttgcgatttcctccctaattttataattagttttataaaaaatctatatttaatgtttcatgtatgtgttcaaagatttaatgtgatgtttctagaaaaaactttatgagaactaaacaggaggcctgtgtctgcacctgcgcgctcagaccgtcgactcgtcccacgctatcgaaccagtagccattagccaaaataaattggccatcccgtcgacgcgatcatctgctggtgctggccactgctgggtcgcttcagcggttcagccgcgcgcccgcgcctgcggccgctcccacgaatccactatcagctagcgcggcgcccaactgcccaagctgtccccgactccccgtccactgctcggcgcgtggcgtgcagaacaccacgtaatctcgtataattccatcgccgaccagaatcacgcgcaccggtgcacggtaccgtactacggagtactaccgtatacggagtacatagtaggactacctctgtcccaaaataagtgtaccttgtcttatttgaaaaatttatgaaaaaatgaaaatatttaataacacataaagtactattcatattttatcatctaatagcaataaaaacattaatcataaaaaattttcaaataagacgaatggttaaacgttgaacgtgaatagtgcaaaactacatttattttaggacggagagagtatataccaccatattccacgaatgtactgtcgcaggattactaacagcgacaaccggtggttggattttatctcaactccacgccctgtaaacacacatgttaaaagacggagggagaggtcgttccacatgttcttgcgtttggcacgaccgtctgcctgcgccgggctatccaatcccaagtccaccgcatggttttcctaccccggacttttgagttttgaagcgtaacaaaagtccatctactggtgccgtcaccatcacagaatacaggagattcacgcccccattcggcagtagaattactagtagttacttcctccgtctcataatatagcaatgtagtaccggatgagatatttcatattacaatgaatctatacactcttctattcagattcgttgtactatgaaaagtctcatcgggtactagattgctatattatgagatagaggaagtataatcattagcagttaaatatttcactcgcatatctcattgacaaggctcaaaacacatactccctccgttaaaaaaaaaggcaaatcctgggtttccgtgtctaactttaactgtccgtcttatatgaaatttttttataattcgtatttttattgttgttagatgataaaacatgattaatattttatgtgtgacttgcctttttaatttttttcataatttttttaaataagacagacggtcaaatgttagatatggaaatcagagtttttctttttttagacggagggagtattttacaggggtttcatcgtgtcatttgccacccgtatcacggattcacggatccccccaacaaacgtggaggcctaaccccagccgcatattcgcgtcccactcaacgacggattctccgaggccgcggggcgcgaggcgagagcggagagcgtcacgacgcgggctctgcaaggccagctcggcagagggggcccccttcgatacaaacgaagccgccgctccgcatcagcagcggcccaagctttcttcctctccttaaacccaaacccatccatctcctcctcccgctgcacgcgggtcacgtcgcacgcgcacctcacctcctattctcttctcttcctcgccaacctcctcctcttcctctgtccctctctctctcgctctccattcccaaatctcctccgcatcgggatggcgcaggtggtggctgcggcagggacggcggcggcggtggcggcggtggggaggccgctgggtggcggcggatctggggccgacgcgctccgcccggcggcgaggctgtcgttcgcgccgcgctggtgcggtgggagcgcgggggcagcaagggcgcgccgcgagtccgccgtcacgtccgtgattagccgcgccccgcgtctcgacgccgaggtgctgccggtgtcggccgacgacgacgcggacgtgaaggttctctctatctctctctcctcgtactcttttgactggtatctcgcaggtcgctagctgggtttatccccccgggtggatttgggatgggatggagtgtttgaggtgtccggttgctttcgggatgaaaagggcgtgaaattggcaccctgtgacggtgaaaccgagtttgtcacatttgggggtatcgttttcgtgcctgtggcggtgaaatttagagggcggagttgctgtaaatgtcattttcttcacttttctccatgaatacgttctcgtgtactttcggttttgatacgtttcatgcatccttaggagctcgtaggctggtagctaacctgttaatcagtagttttattgaatagatcattggaaaatatttttttccttagtaaaagtggccattcccctcttctctttcagctcatgattcatttggttttttagtttctggttgtgtggatctgggttgatgtactattttggaaaatgacattggcacaattctgagttagttagggaccttatcttgtaaggaaggaaaaacttcatacttgcaattccttatcttgtaacagtcttctaaaaaggtgcttttggaaatatttctctgcagagtctgaaatgtgctaatcttatttcccgccactgtgaaatattaaactacttgagcataatgaaactatctcgtcatgggtaggctacttcgaacaagaatgtgctacttctgtgattagtttggttaaaaccattcaagaacgttgtcatttctcaagccacattaagctatgaaaactcccaaccatcaagaagactcaattccttttgttctggtttggtttgaggtgaatactccctccgtcccattttttatggcgcacctttttttttgcaaagaccaagacgtgaaaataggtcacgatttcttctgcatgtgcccctaattaaacactaattaatctagcatgcagatcactcccatcgctcctcttcccataactcacgcatgcatgtagattagatccaaatgtccctgcccgatacgtctgccctctcccgcaaagggtatggcttgacaagccgattaattgtcgggttagttgcatgcggatatccaagcgttagatgcatgcaaagcagaagggcatcatggggaagaaagctacttaatacatgatacgccctgtaatttgggactccgtcgaaaaaaagttacgccttgtaaaatgggacggagggagtattatgcacagattgtcaccgtagttagttactgtgcattgaaagtttcagtaacgtagaatgtaatgctgtaatcttttaaaacatactcttatgacttgaaagtttgttaaactttttggcaataatatctcttttacaggaagaagaaaacttccagcatctcaaggccattcagcaacttgcaacatcagccaatggtgtgtggtctaaaccaaatgtgagacgcaagacaaagatcgtgtgcaccattggtccttcaactaacacaaaggagatgatatggaaacttgctgaggctggcatgaatgtggctcggcttaatatgtcacatggagaccatgcatcacaccagaaagttattgacttagtaaaggaatataatgctcaaacaaaggataacgtgattgctattatgcttgacacgaaggtcagtattatttctttgagtttttgtactctaatgtatgggcggttcacagtaatcatcctaagaacctgctatatttgtgttagtcttacacagagtatgatgtgctcatgctagagtgtttttttgcggtctacgcctcctctggaggtattgtgaggtagaggcatttctagtgttaatcaggaggtataatacatctactgagagctatatacctcctgcttaacactatgaggtacctatacctttcaatacttaccaagtaccaggaaaaaaacttgctggcggctgactctgcccttttcattttcttatgctatagagggtttctcggatcataatggtgttttacatatcagggaccagaagttaggagtggagatttgcctcaaccaataatgttggaaactggccaggagttcactttcacaattaagagaggagttgggactgagacatgtgttagcgttaactatgatgactttgttaatgatgtagaagtgggtgacatgctcctcgtagatggtatgtggatattccttcccctctaatctttaacttacttttgtctcctttgcatagacacacatatgattgtattcactgtaagcaaaacaactcactctatcgaaaacagttaagtgttaaaattttgctgtagggttagaattaattatttatttcatatatggcacgtgctcatacgtagagcagtagatagatccatgagtgatctgctcttggttaaattactaagctcttcaaatatcgtatatgcatttccttctgcccagagttaatggaatttaacatttcctttttttccattcttttgctgcttccctagagctcattcttgcgactactgtgaagtgccaattcacatgaattatgtgtcgtatgagtatgcgtatgtgggcacagtatacaacataattatctgcaactggcaagttctaagaacactgttacctgacattttttttagacatcatttcctagatgaagtctgctagtcttgatttgctgttaacattgctcagtcatgcacaactgattaacacttcttctagaccaccagatatttgtagaaatcttcttttctgctttgagatgattgtgtattctgatataacttcgattctatacggtttcatgatgtgcttttattgatcgatatgttgataccatttaggtggaatgatgtcgttgttggtcaagtccaaaactgaagattcggtaaaatgtgaagttattgatggaggtgaactgaaatccaggcgtcacctgaatgttcgtggaaagagcgcaaccttgccatcaataactggtaatagtcaacattcatttcactgaatattataaacactcttgtttcattctcattntctgaacttgcagacaaggattgngatgatattaagtttggtgtggagaatcaagttgactactatgccgtttcttttgtcaaagatgctcaagttgtgcatgaattgaaggatatctcagaagtataattatcccctacattatgaaaaatatccagcacttattcaactgtcttaatagtgtgttttgttttgattctcaggctccaatgccgat

SEQ ID NO: 74070 - DNA, 11469 bp, Oryza sativa
caactaagtatctttaaatgctgtttactgcaaccctaaccctttatattataactcccttgtactcccttgcatttattatgcacttgtgggtgtgtcttgttgagtacggtggttgtactcagtcttgctcaatttttttcccaaacccagaagaggagtctctggaagatgaaggttttggtgtctagctcgtgcctgccgtcaagcgcctgtggtcgtcgccctagtcttccgctgtttctcgtttgtctttgtgtgtgctgggccttcgctgcccatgtaataaattaactatttacgcttccgcttgttgaactctgaattgtatcaacttttggtgtaccttgcctcctgggacaaggaataatgcacgcacgtaaggaacgcccgttgggttatttccggtcatgacagttctactgcttgggcagcctcatcccctgtaggcaatgaattccatgtgtcttggtacactggaggaagacaagagtactcaggaaggactggttcaggatttttgaacatagaaccagttggcgtgccaacctttgttcgaggtcttgaagggcatggagaaatatttttggcttagtgttcccctgagttgaaaaccagcgcccccaacaacgcacggtttgctcttgtttggctggggcttgaggaagaagatgcggcggaacaaggcaaaatgaggcctaatgcccagaaaagcttcgcaggcatgaataaaatttgcaatatgcactatggagtttgggttcagatgatgcaggctgattccatagaaattcagaattccccgaaaaaatcttgaggttggaagggagaaaccgccatagaagaaatgagcaaataccacgatttcatgtgtatcgggggttgggaatgcttcgccgaatgccggtcaccacccgatgatctccttcgctggaagaacgccgtgcgccaccatctccttcagattatcttccgtcacatcggagggcgcccactgactctcgaagctttctctttctcccgccatgaatgtgaactggatggtttgatttggtccgagatacggctggaaagggatggggaatcggagcggtggacgcggggagaaatttcgtgaagttttttaggatggattggagcggattgatgaaccctagtttggccggcgcagttttgtactgtagcaaggaatggggaaaatggcgagagtctcggcggggaagacgaagagacgttttatttcacttcggtgcttttagggtatcgggagtgctaacaggcctgggcctgcacagtacttcagcccaattttatttccagcgtggctcgttgtgatccttagggacttaggcactttttgctttagcaatttgtgctcacaacgatgtggcccaatgcttttgaaatcctttttaatgcggtttgataattctttggaattaacatgatgcaaacgaaaggtgcccgacaggaaggtgttatacaatttttgtaagccttattaggctgtaaaagctgtttgggttgatttgagatgactaatttattaaaggtcattctcttagcatgttatatgcttaatttggttatggtgagagtcatagcttaggctattagactcgtgaattaccatgattaaaaatcatgtttggtggatctttttaagagttatttactcgaattcctatcaaatatgtctcttttttggacctttttgagtgttatcactcggccctttttgtattttttatccttgatatgttcaagttgagaagcagtcggctggatattttactgagtaccatgcatgcttcgctataaaaccactcggttcttgactacatgtttagtttttcaactaatcatatagtcgggggctacacctaattaggtgcatctactcgatgcaccatgttttattttcgcccttcacagtttttgattttagcactcggcaagctggagcaagttgaattgaggcactcggattactgttttttgttttgagaaggctattattgtcaactgcgaaggtctcgggggctactgtggagattatggataccccatatctacatgacaattataatttagttggatatacggtaccaaatatagatagaatatctttatgaggactcgggttagtttttaacttgtatgtcaaggaattacccgagatcttagtcggttacgattgcattttatctgtaattacatattccgttagggatatggactgtactttgtaaagcggactctttcccctatataaggagggttcgtgtgcctctcggggcacgatttcttttttccagtttatacaatcaataacacactcggcggaataatccccggacaggagtagggtattacttcttgaataagaaggcctgaacctgtataaaatcctttgtctccaaacccatccactttcctagcttgatagccaccccgttttattattgccgaaatcttgtttcgacaatcttactacaccaataagaaaaatccgttccatcgaaaacatggagcttagttgtaaacttattagccatggcaaaaactctagatcggttaaaattcaaagaagaaaacaagactctgatacgacttgtaggatcgaaacacaagaactaagccaaccagagggggggtgaatggttggtatacccaaaaacccaaacttcttgaggaaataaaagttaccctcgaatcgatgtagatcggtctgactgcgcctgtgccgccggtctgaccggtgttgatcgtctggttggactgccctggaatcgcctctgcctcctgaagccgtcgccggtctgaccgccgatgagttgctagttagaccgccgaatccgataaaacacaaatcgacgaactctcaaagtatatgacaactttattgcttctctctgtgtttacaaagtgcaacagccacactccttacaaaaatcttgactaaacttgaaaccctaactaaactatcaactcaattgctctaaaaagcactaccgggaagcctcacgctccctctctatttatacatgaggtaggcagcctaaagccacgaaccaaactcatactagaagtcctaatccgcataggaaacctcatcgtacaagaaacaaactttacataaccaatcataccaaatttggactccttccaaattcgagtctgcatcccatacacacacaatacctccatcgtatgcaatatggaatcttcaccaaccacgtgcattgaactctagcctaagtatcccgcatgatatctgaccatcgcggacattgcctttccacgaagtcgactcccgatccatcgccggcaatactatcccgaggcatcaagtcacctacacatgaaacaaataaagaaaccatattccgagaccaagctatctccaacttgactcattagtagcaaacaactgtattacatacgcatagtatccatctagaagccataatcatgaaacaataacggatatccaaataaacaacctgaaaccgaaaccgacacagagtcggccgatcagactgcaggctccaccagtctgaccgacagcacatgcccggtctgaccggaccacatcacgaccagcagttcctattcacctgcaaattccaatcatctcgaaaaccacttcgtaaataaattccaaatatcaaaaccaataatcttagatgccaattattcatcacagaataataatcaaaaacacctttgattttacacatggcctctcctgtcctccagaactatgcgtctcctgcacatgccctgtatcttcaccatgaagacgagttgctaggctgcaagactactgctcgtgacttcctgagacaaaatacgtaagtgtttttctcttctaaggcggtgttcccacatagttgttcccatccgaaacagtaatcacggaaaacggagtggtccattagcacgtgattaattaagtattagctaattttttttcaaaaagcgtgcgtgtggaaaacgagaaagaggggttgggaaaagggataccgaacagagcctaagggtgtgttcggaagtgcttgttccccaccggaacagtgcccacggaaaatggagcggtccattagcgcgtgaaaagcactaattactataacttcattttgtagcatatttttcagaaacattgcaccaatttccaggtgaaatggcaagaacgaaaaggttgaatgtagtaaaaatcagtgcccaatacaagagtggagatggcaatagcagtgaacatatctagggctgtcaacaagccaagctcgagcgagctcgtctgcccaagctcgagctcgatacaagctcgagcagagctcgagccgagcctattgcaccttcgagcttttaggcaagctcggttcgagctcggctaccgagctcggtcataagtagtataagatatattttagtgataatcccttgataagtgtaattattttctagttaatcacactaataaaagagtaaaaaatgattaaaataaatatattgtgctaacacatgataatttattgtgttaatagatactaatatatatatttatctattagtttattaaatcaataaggtaaacaaacaatataaattgtacacagttaagctcggtagaaactcgagctcggctcggtaaagcttgcgagcttttgcccaagctcggggtcggctcaattggagctcgagccgagcttgaattgagcatagaacgagccaagctcaagctacttgtgaccttcgagctttttttgacagctctaaacatatcccagtgcaagcactagaagataatgagatcgaactagagcagcaagatgatggctccttgaatatgtcaggtatgactacaatgaagatagctaaaaccagtaggacgaactaaatgtttatattgaaaaattgggctcagctactattgttcttgtttaattttataggtgagagtgctaaagaagacaaactttaacacatccactactagagaaagcgtttttgctcccggtttgtaaccccctatactcctagttttacaatcgggagtacgaatccgggactaaagatggatatctttagtctcgggcgaaataattgggactaaaaatccatctttagtcccggttggggcagtgccagtcccggttggtcactgttggtatttgatatggttacagataaaatccgcaagcgcacggatataccgatgtagcacttcccctacggagtattccaagggtatcgaatccaagggaacgtgtgtgatcagagcttcctccggttcacccaaggacaccaagaaaatgataggccaggatagagaggatttactagtgagaaacagtgtctagggaaagcttaattttaatcctaacgcaatacttcaggcactggcaacccgctgttcctagatgtcgctctactacgtacccagacagggaggacttaagtgctctcgagggctgtcaccacctctacacccacctcaacgtactgtgggatacgcagcaattattggataataattacctaaacaccacgtctaagcaattaatatctactttagtgtttataactcaccaaagcaatcactatattttagttgattatagcgaacaataatcccgtatgctaattaggaactaaccaagaggtaattctcacaagataaatctaaattactcaagaagaatattatattgaattcagaataataaacagaataaaagaaataggagaagattaccgacaactccggaattcttccgactccttctactctactctcttcctattatagtatacaatattatagtacaatagagcctcttataattcagcttaagcttagaagtgtgtgtgtgaagtgagggagtgaagcctttatatagaggtaggtatgactgttggcgaaggggaaatgtccgaagtaccccgcaaccgccatcagggagtgatctggagcgtccacgccaaaccccaggatcaacggtgaacctgggctgggccctcctggcctggccttcggtcggtggattccccgatccttcgtctatccatttctcggagttttgggttgattcactaatgttttgatgaagttcacaaaccctccttgtatggatacataattctcctcactttagtctgattttcctcccaacttcagggtttatcatctgcatacaaatatacaccaacacttgtggaatacgtgagattaagcacctatcactatgttggatgttttattatccgaactttatgcagacgttggcggtatagaatcgacatttaacagccgccaacaaaaccccccacacttagcactttgctcgtccctgagtaaaggtcagtgtagaatgaatttcttcaagagatgaatcaagcatataaatcattcacacccatacctatacctgtgaattttatcagtggctatcttaccatcttgagtaattgataaatggaatgatcttgattccagtccttcttgcttctctgttagactcgtggggtttttatgaattttcgcaaactagctcttttcctcatattgacttttctctcttgtctctcaaagatgtatattttctttttggatcctctccaaggcaaagtatgccagaattcatccctattctaaggctgttatgtggagcttggtagggataaactggtgacatacttgcatcatatatattgcaaagtcagaaatatggactcaagaagatcatccgtcatactcctagatcaagggtctttatttgtggttgaaaatggaaatatgttgtggaatgctggaataaagaaatgattctcctttttcctattctttctctccaaattggttctcttggcatgatcatggaaggggcatggctatattttcttttcaactttgctcaatgtttttaggacaagctttatttccatcttcttctttcttttttttcttttttttcatagccatgcctttccctccttttctcattttctttttgccatgaactttcccaagaaaagaaagcatagttcattgtaggagtttatttgaatgatatttttgtggaaagccaacttctagtgtagaagcttagcttaattttatatgtgaaattggaaagtggaaatgatactgactccttgatcatgacagtatgaaagatatctaacacaagtcacacaaatttgacaaaactcaatataatgtcaagcagtcatatgcatgataatgtttgattattaatgtacttgcatatggtcttggtaggtataaggtaaagtcaactggaggatagagtttttaaaatagttctatttttgaaaacaaattcccaagagtcataagaaagttgcaaggattcctttcatcttaatcatctcacataaagcaattacttagatgcataaggttccctaatcatggatggttattcacaagcacaagttcagctgagaataatgaatatacaagatcaatcacatgaagaatttcattagttggaaattttatctcttacttatgcttgaaccagttgttttctgaattttcagctctagtactataccatggtggagatatacagataaaggacgtgcttacctgcttacctgtgaaaactgagagggataggggccagcactggttcggccgaaccactctggtgcctgatccctctgcaactttctgcagagttcagtgcttccaggtgttcagatatttcaacaattctcagggcatatgcacgttagaagctgggatatctcgcccacacttattcaaaacctgaattttcttaaacataaaacaaaaacaaactttggcaaacattggggtaaacaccaatgtgccacattattaatagcaagtgcttacatgattggaaaaataaaaccaagcacctactactattttattcatgggaaaggaaacatctaattagcataatacttattttcctttcccatctctatgaatgcacgcttgattttagcgtacaaaccacgattaagggtatcaaagctattcctaatttcagcgagttctacccctagctccgcaatacgatccctaagctctatgttctccttgcggagtttcttcacttgagcggcgagcttgtggatcgagggcttcggtgatttcacctcatcctcttggaattggccgggagccctcacaattggagggggcgtcaaatgacgcttcaccttcataggtggagggctatgggattccgctgcccccttcttctcccatgccgtcaaaggccggagtaaacctgtcacgcccggaatttctatccaaaattctaaacgcttacatgtgtgtgaaccctcatccaggaatcagccgaggcacacaataacaaattgataatagagtacaattattactctaattaataagcaaataaaatatcattacagaggtagatagttcctctcaatcaataaagatctaagcagcggaaaaaaaaagataaacggcgcagacgactccactccacaggcagcttgaccagggctatacctaatcctccacaccatcagcatcactgtagaactcctcctctgatgaatgattgcaaggtgagtatatgacatactcagcaagccacacagcaaatatgcaagtgcacatgataccaaaggatggcatagtatggtttcatttgcataaataatatttaataaacatttcagaatttaataaaacagttaagtaataattaaacaatattaatccaacgctatacaacataccatgttgcataggcccaaccattctgaacaaccttcgcggctgcacagttctatctccaaaccaagaattaaccattccaaaccaggagctaatcaaattattaccagttatagcatcatttattatgatgggaagtgtgagactaatcacgaaagacattgttacacccgcccataaccgcgggcacggctattcgaatagttttactctggccagaggtgtaccactgtacccacaagacacggccccacgacatgtcaccatgcgcctcaataccaccacggtacctcggaaaggagctgtgacagtacccctcacacaacacaatccaccacagcgcaccgttcctggatcataatcacccccttataaacaaggcatggactccccagtgacccccatgggcttatctccgccacttctcagtctggtgctccacaatgaaccatgctatacaacaggtaaagccgttgcccacgctggcttgtggttggtacggttaatgtttcacaaccgaaactcgtgaaccggtccttaattgtcatgagcacgaccatcaaaaccatgtgctcacaacccacctttatcaaattttatttggcaaattaattaattaaccaatcacgattgaccatcgtgagcttccattaaatatccataagtgatagtgaagtatgatttatcccattaatgagctaatatttctaagcacggctaagcaactataaataacatctagctgaaccaatccaatatataaggtccatgctagtcaaattataacccataggaaaataaagtcatcttcggccataattaaatgggaaaggctcaccacccaatgacattcgaaaacaatgcataagttgaaataaatcaatagctttaaacaggttcaacctgctcaaagggttgtttgggatctgcgtgacttgccttgctggccttggaactcttcaaattcttctcctgcgaaaacggactctccggaaatgtcggaatctaaatagaaaggggcaaaatcaccaaacagcacataaacaagcatgaacagtacatgtggatatttttaacatgtagatctcaattttagaaaaatttagagacttgaaccaactaaatccgagctaagatgaattagttatgaattttcaaagattaaattagattaaatcatttatttagattttaattgaattatgacgcaataatgaattatttttgaaaaggaaaagggaattattgcgtcagcggctagggttcgcggtgaaccgggtgcacggcggcggctcacggaaacgaacggccgagatcgattcatccaaaacggacggccaagatccatcggtccatgaccgggccacggggaatgacaacgatgacgtcagcggtgacgtcaccaccggcggcggctcgggcgtgcatgctcgcgagcgaacgacggcacgacagcgcgaacggagggaaccaacacgtagagggcgacgcggcgaactcaccggtgaccaaaacaacggcggaggatcaacggacggcgacggcgtcgaggaagaagcggcggcgaccttcggcttgacgacggcgacgttgttccggcggtcgacagcgatggtggaggggcggacgaggtcggcgacggcttggcgatcacgatggtgacctccccgagcgacgacgacgaccggagtggcggcggcgcacggctggacgaacggcggcgacggcggcgctaggctacacggcgctagggctctaccggcgacgagaggccaaggcgagggtggcggcgtgtcttacgtgcgtgcattattccttgtcccaggaggcaaggtacaccaaaagttgacacagttcagagtttaacaagcggaagcgtaaatagttaatttattacatgggcggcgaaggcccagcacaccagaagacaaacgacaaacagcggaagactagggcgacgaccacaggtgcttgacggcaggcacgagctagacaccaaagccttcatcttccaggaactcctcttctgagtttggggaaaattgtgcaagactgagtacaaccaccgtactcaacaagacacacccacaagcgcagaataaatgcaagggaatacaagggagttataatataaagggttagggtttgcagtaaacagcattaaaagtcacttagttgctcaaagctattttgtaaacacggtcctagagctatacaatattattaatcaaggccgtgagcccacacgaacctgccttaacccaaggcctacgatgattcagaccgaactggcaacccgaccctgggtcccagctcgtcccaagccaacccaggccaaccattccacattttagttgttaggcaggttttaagaattaaaacactaacttgggtacattgctcggcttgcccataaccgagggcgcggctattcgaatagattatactctgatcagaggtgtacatctttacccacaagacacatcttcctcacgtgtaaccacgtgccacataccaccacggtatacggacggaagacgtgacatagtttccaacccatcctagccatagacaagagtaccgacccaaccccacctacggccggaacctccgggacaggtaggcaggattgagcccctagcagcaggacaccagccctgtgccatgacatctcgactaccgggccg

SEQ ID NO: 74071 - DNA, 2601 bp, Oryza sativa
cgccacgctcgccgcgccgccgccgtgcctccgctccccgagacgcctcggcgcgcggaccagcggctcgtcgtcgtcgaacacccgtggctccacaggccgaaagaacggctgcgccgccgacgcagattctacgcggacgcgcccggcggcgccgcgtcgttgccgcggcggaacgacgggagctcgcgccaccgcgcgtggcagagcgggcaggcgatgcgtccgcgcgcgacggtgccggagatgcagtggaagtggaactggtgcgagcactccgccgtgaacacggcgtcgccgccgccgcggccgccgcggcgcatgtcgccatggcagatgccgcacggggcgctgtccatgccgcccgccgcgaggctttgaccgagaaaaaaaccctccttggtgtggcggcaacccaccaacgtgtaggatttgatgaatcattttgattggacgaaaatgtgttcttgactcgtcgttggaattgcgttcgcgtatgcaccgcgttgaacgcgttcattagggtcctaaacaagtcaccgggtttctgcgaattagtctcgaaccatcgatttggtggagtattgtaatcgtgtttatgggttgactagttaagtggatctgattttgctggagtataataatgtgtctttatgtctgattatgttttataaagttgttaatcatgaatataaatcaggcaactgaaattagagttgctagttgctaccacgtctattttcaccacagatttgaaagctgtcgttgcttcccttgttgcaaacttgcaatggcaggtgacagcatggagccagagttcacaaagccgtagctgctaaacgaaacaaaatacctgatttctgcaaggacaacaattcccagtgcagctgcatcagcatattctttaagttacatacaccatttcaatccttgggaaatggcatttcaattcccaaaccaaaaaccaaagcattgccaactagaaacagaattgcaaaacacgttcatcagcactgaatctacacaagcaggaggaatccatccagtcatccagacatatcaataccaatgagtagcaactcacaaaaatatacaaggttctgaattctgatgcatctttgattctttacagagtagacgagcaaaactttaatccgagacaggcatatatatgaagtatactgctacttctgggcctctgcctgttcaaagtttacctctgaagtagctaaaagctctacggggaaaaaaaatctcaactgctctgtgcacactacactactacagtcaagatgtacaactatatatttacaaggaaaacatacaaaactttccacatcaagccgtcaaccgtgtgcgatgtgagcctttgtgtgctagccaaatccgaactgtgcggtcatcacttgccgaagccagcatatgtggcttagcaggattccagctcacacaatttacagtaagtgaatgaccgtataagacctttattggcgtctccaggtgccttttccaaatgtagacctgtcatcattttggcacatcaaaaagatggaaaaggcttgacaagagcagaaatccatgtactagctaatttcagtttatttttgctgttcacagaatcttgtacataggtccatgcctaacgatgtgaattatgtgcctccactaggaaatgtcaactatcaaacacactgcggagttaacaagagcaaatctattttcagataaattaaggaccgcaaaccaaacaatgctaatcaacctagtaggaccttcaacattattgatatttcagttaagccagaattgaatgtaaggtttagtgctatgttaaagaggccatgtggacattatcagtgagcctgcaatgtttacaatgtttcctcatagaacaggaaccttgaaagagtaccaagaaccaagttacaaggtaccgctgctctatatgcgccactccttattctcaatgtacgcttatgcttgggagggtggttatgttgtatatgtatatacaatcatatgatctacgaaaaaagtcaggacgaggcagctaaggccaaatgcaatattaaattccataagaaagctatacctgggaatcctcactgccactagctatgaacagagagtttgatccaccaaagcaagatctaatcacaaactttccttgcttgtgtcccttgaatttattatccgccgcagtagaactttcactgattctccacaaatgaatttcctggctgttgaggttgacaatcagtgattgtccatcaccagagagagatagcgacgaaatcgtctgctgctcacgtattctccattcccgcccctttggaagttctcgaatccaaatttcattggaacatacacagataagatgtttgctatcaggagtcacagctatatcactgactttaggtattctatctccaacccatgattccagttcttgaccttctaggtcacaagtgaagatcctctttggagaactttcaggctcacagctggcacatactattttctccgaattagggaaccatgcacatgaattgataatatggccaactgagctgctaaatttaagactggggctgcaggaat

SEQ ID NO: 74072 - DNA, 6547 bp, Oryza sativa
catttcagacatttaccatagtatccaatacttaaaaattcatatcaaatttttctggtaacatttttaataaataaagatttacattatgaagggatttctcataaagtatatgtgtcagtttcacaggggaaaaatagctccgctcatcagtggacaaagtttaaaatgtatgattgcacgtatcgtataaaaggcatatactttctataaaatatcttatagcactagaaatttatgttttcttccataccactaagtttcaacatttatcctttttgcaccactcccattaaacctgttagtttcagctgccgttaagtcattggaagctgtcagatgtttttttcccgaaaagacagtcatacctcagtcaatagttgctggcccacattattggaaacttcaagcttcttctcctttcctccattcctcttcctatggtggagagggaaaagagctttgatggaggtacaagagaagattagcagcaacaggaattggggagtctatatcacactttggcacaaggctagattgagggatgttgcattctctaatcaatcaggcttgttctgttctccaatagctttctctatgtgagttaaaccattaccaagtatggattatggaagatgggttaagtggaatgcatggcttgttctgttctccaatagctttctctatgtgagttaaaccattaccaagtatggattatggaggatgggtcatgtggaatgcatgctatgttttgcatggagttagtctgaatgttgtggtccagaagtggttaaagttataagatattttatatattaaaaacgagttgacttataaccattagagttaagaagaccaagttgtaagtcgtattctgaaacaacaatagtgaaaagcattgttaacagctgctttggtgaaaggcataccttccatatgatggccgtgcaatcacttgaagatgatgccagatagtttccatcatttgagaaccttacaaaccaaacttcattgttatgaccacataatatctgcaaacaggcatggatgtgtcaaatatccatcttcggactatagtccccgcccccaagcatgaaacttgtctagtgctatagatccctgaaagaatacataaatgagtttacctgaatagtaatcccctcttggctaaaaaagaatctaataacattattatcattggttttgaagtatctcaagttatgatcatttcttttagaatataacagaatttgaaaaatcagaactccacagaagacctctacacaagcagataaaacatagtttgaaagcagagtagaaaagaaaggtttgaagtggtgctgtttacagtgtttctatctttcaaaacaaaaccgagatttcaagtgcaaagactcttaaataatgcaaatccctgcctcactggggctagagaatatgcagtacttttgaagagtagtgtctcccggtagcatgataattttatgcttccaaacattggcacggaaaggataaaagctgcatatatattgaaaaaattacagtgaatattcgagttactgagttagataaccatacagaagtacgttctgaaaactagtcagaacaattgccagcataaaaattgtacattgtcggctctagtttttgaaattgatctgatttcacatacttataaaccttataactggggtgtttgtgcaaaactggtaatacaaatcaacaatttaaactcgcacctgcgaacacttggaaggaatctgctcttcagggcacttatgatcctcaaacaaagtgacctcgtccggtaaattgtgatatacacaagacgaaacctgcttaacaactgcattctccaccagaagctctagccgaccgcttggcacatggaaccatggcgggaaagcatcaaccagatccaagaaaagcccaatcctccacccgaccacggcatccggcgcgaccgccccctcgcacgagaccattgcgcgtgccagccagtgcacacactccctgtcaacgccgaggggcgcaatccggcgccagagcacctccctggcgcgcggcagcccagcgtcgccgatccccagaagctccaggaagtgccccctccacaccaagaactccgccgccgcgcgctcccggtccccgaggcccgccacggcgcggatcgccgccacgcacgcgtcccaccggccagacattacgtcgaacaggaggcggtcgtgctccgccgggtacagcggcatgccggactccgcctccagcgccgcggccgccctccggtaaccgagcgagtagagcgactgcgcgatgacgcgcaccagctcctcccggtccacgagcccccgctcgccgccgagccgggcctcgccatgggaagagacagagctcgcgtgcatctccatggacacggctgattcgcttcgccagcttgagggatctcacaccccaagcagccgccaagaccaaaaccccctcaaaaatccgagttccgaacacaaaagaagatcaaatttccgagcggatcaaatcaaaacttcaagagagtaacaaaaaggggtcaaaaatttctccgctccaacacagacgcaacaagaaaagcctcgaaagcgatcaaaaattccacgcactaaatgacagaaaatgacagggagagctcaaaatccgcaaaaaattatcggataattcgggcgaatttgggagtggcagtgtggatttacaaatgatccgatcaaaaatcgaggggctactgggttttttttcctcctccgtccggatctgtgtgaccaaatctgtgggcggaaaaaggatgggaatttttggggacgggatcgatgcacggtctgtgtgcgctggagagatctggaccgtccgttggatgctgggggttggatccgagccgttggaggtctcgtggatcaggataggatcagtgttgttggtgtcttgtgggctggacagtagcgcgctgataagaccgggaatctggagtctagaatgttcggagaagaggcagtttcggtgcttcggatatttttgctttgctctcagccccctcactcggttgagttcagaataaattgcacaatacagagggtagagtgcaccttgtttctagtacaatatatatgatgaattacctattcatatatattatactagaaaatgttctttttagttctaaatttttaaattttgagatggaggtggtacatagtttcattttacattagggaatattaaaataagtttcattttgcacgaggtggtgcatcatatcattgaaaagaaatctagtaaaatatgaggaaaattataaaaccctttgaatttagactatgtttgatgaagatttattcaaaatttatgaaacgtcatggaaatcatatatatattatgatgtatcatgttaagtgaaacttaaatcaatggacacaggtgcaaagtaaaagcatgtcctaaacctagtgtaaagtgaaacaacatacactttatctggtgcaaaatacaacttactcttattttaatggtttactttggtcctaaggtcttttttagggaggggcaaagcaatcactgaaaaaatgttttcttcgatataagtccttagaaccacctaatactcttttctaaaaaaaattaatactcacattggcataattgtgtagttaaatttcaatattatagatacgagacactcctacatgagtgtattcgacaaggctcgtggaggttttaatccaagttagatctagctgggcgggcaagcaggacaggtgccaaggaggcaaagacggcagctatatgatgagggaggaacaatgacaatgagcgtgcatcaatgaagatgacagtgaatcggtgcgcatggaatcaaatgtaggagggggaggtgcatgagccctctcctctcaccttgtgcacccatgttgcacctaccaccaccatgcctgcacgagcttaaatttggattaggagagaaggtcaattctcgtgtttacaatgggttagactcacttgggaggctgattttcatgagtgaaactaaaacgcggcaaaccaaacacccttccgcagcatgtccggtgtgttcctacaacaacttgcaaagcttgtttttcattttctaccaagactcctttcaattcagaattgctagaaaactattgatagtttttttttctatcctaaaactttcaaattattgaccatcggttggcctcgagattcaaagaattaatttttaacttgcgcaaggactcccaacttgttgggtcaacgcatgtgcttgtagcatacttttttgggttaattggatatttggatcatgctattataaatttaatggttttgaaatataccattcatatttacctatttgtaaccgtatcattataatttcacaaatattagagctatgccactacatagcttttctctacattttctatttttttaggactaaattaaactaccctcttcttcttccttcatctcccatctcactccatatcttctctcttgttcatcgatctccttgtccaccgccaagctcagcctgctgctccgactggcaaggaagcaaagatggtgctgttatggaggaagcaaagaccggcaagcacaaggaagcaaagatgctgctattatggaggaagcaaagaccggcaaacagcaggacgtagacgaaaatcttacgatgcacacgcatggctggtggatgtcgagcagcaccgtgtagaggcgtcgtcgagcacagaggaggaggggatacatacgcttgagccgagttgtaagccgaggagagagagagagagagaggatattcacgccgccggcgagcaccgtcgtccccgtgccaccctcttcgcatgtatggaggaatccgatgcagtggcgacagcggccaaacggcgagacccccggcggcgtgctccgtagcttttgctacttgatccggtggctgggtagcaagtcccggtggcgtgctcccttccagctctgccggcagcggcggcagccctcagcctgctgcagctcttcatgagcttgtgtaagttggctggaatagaagacagaggaggaagaaagaaggcataggtattttggtctaaaatttttataaaatatggtgaaagggtatttagtggcatatctctaatatttataaaattgtaatggtattgctataaatagatgaatagtaatggtgtatcttaaaaccaccaaatttataatggcatggatctaattaaccctacttttattatcacttccggtattggcgggggccattacaatgttatcaaccgattgaaactttaatacagcctttttttatcctgcaggaggggaagacccaatattatactagcatatcttttggttcttcggtcatccagaggtgtacattctcattctgcctggattcggtattatcagtcatatcgtatcagttcaacaatagtattccagctttgaaatataaaccagtagcagtttataaggaagttttaccggctaaagtgcaggattttggggctgtttggttcccagccacattttaccattacttgccaacaaaagttaccacaccttgcctaaggtgaggtgatcaaattgttagccacaacttactaagcttaaggaaatcttgccacacttttttgagccattgacacgtgggacccaatttgttggaggggaatcttgccacaactgtggctacaaccaaacacctgtcaaatttgcctaaccttaggcgtggcaaactgtggcaaagtgtggcttgtaaccaaacacacccttaatcaagaaacatggtagatacatacataaatggcaaaatttgctactaattagctgtgagacactgcaaaatcatgacactactcatgaacactacgaaagttgtgaaattggctgtaggacaccagagccaatattttataatttccgagacaaaagaggtcagagaaattactaaaggaccatattgcccctggacgctgcagcttgtagaccagacccagtcggcatcatgtccatctcccccacccgacttcccattcctccccaatctctaaccctagtcgacggtggcggcggcgtcagattcggcgccggcgccagcggtgaggacggcgagcgacggcgacaacctcaatggtgcaagtctggtcgaagcagatgcagcagagttccatgtcgctcacctgtgcccaaatgatcaacacattttgcgaattcacaggagtttgctgttcttctcagacttgacctgtcattttgctgaattgcccatactctgccactgaaccctacatcagcagagcccatggtgtgcccatccccacttaagttcatcggtgagcttgaaccagaagctaaggctctcctggaagcagctctgatggaagccaacagggagagggagaagaaaatcctgaatggcacaaagtactccctgccatcccctttgcctggtgatgacagtgccgatgacgatgcatgctcagaggtatttgagtgctgaacaatttca

SEQ ID NO: 74073 - DNA, 5523 bp, Oryza sativa
gtgagcgacatggagctctgctgcatctgcttcgaccaagcttgcaccattgaggtcgctgccgtcaccgccattgccagcgtcgtatctgccgccgttggcgccggcgctgccgccactatcaactagggttagggattggggaggaatggggaaatcgggtgggggagatggacacgatgactagacccagttgggtttacaagctacggcgcctaggggcaatcaggtcttttagaaatttctctgacctcttttgtctcggaaattataaaatattgcctccagtgttctacaaccaatttcacaactttcgtagtgtccatgaacagcgtcacgattttgcagtgtctcacagctaattacacgtgacggagcgtgggggctcctcaccgggagaccgcgcaggcccccctttgccggttcggccgggggcgctaagtgaggttcttcgccctcgatctgaggaacgtcagcgagagaggaaatgcgcaagacacgggcgacgtagacaggttcgggccgctgagaagcgtaacaccctactcctgtgttctggtggatctgtgcgtgaaggaatcagagaggccgagagcgaaagagagttcaggctctagaaaccattcgccagagtcccaaacccccctcctttcctctttttttctttttttctaggcctgggcctcctttttatctggtcaggggttaccacatgggcctctagctgcctaagaagggaaacatgctttttacaatgagggctagtctacagccggaagtgacctttgacaagcagagcgcacgtctcctgccccgcttgcccgcttttccggtggacgcccatttcaaccttcatttaatggccagcgacttccttgccatacctacgctgaagcctggaatggatctgaccgggactgacataccaactccaggagttagcacgccggctccggctagggacgagagccaggaagctctcatcattccgacgggacggggcgaggcgtgtgacaggccgcctgttgccacctaacccgcgatctgaccggtctgtgaccggtcacacaccgcgaccagtcgcggaccggataagcgtgcgctgcgccgcattaaatgcggcgtggcgcgctcgtccaatcctgctataaatgcggttaggtgagccccgctgtgctcacctaacccacacgcgtggcgccaaaaccacagggggtcggggcgccccagccctcggggccgaaacgggggcgccccagccctcggggccgaaacgggagcggtccgacccctcggggagacagagggaaacccaaaactattagggaaaaaaacaaatctaaaacaacgaatttgcatccattatctttctttaaatatcctacgcctactcatataactctatatatagaatatatagtaaacccaaaattattatgcaaaaaaaaatccaaaacaaataaataaagaaaacaatcttgatttcatctatcacgaaataagatcattaatatctcctcagctaaaaaaatgattgtgtttttttgttgtatgggatatgtttaaaaaactctgaatatattaaatgattaatctttaaaaaattaaaatccacaagcaaatatatttgaaccaattaattttgatgaatctcaaaatttattttatttgtttggatttcattaaaatttatgtataaaatgacacattaaattttagtatttttgcttcacatgacatacaagttctaaattttatataacaaatatgtttttcacttctatacataataaataaatcatttatacatacatccataaatgttttttaatatatatattcatttgtcaatactaaaatagtggttcacaattttctttctataatattttatgaaaagtataaaatttcaaataagaaaagaagtatatacatattttaaattagtgagcacaccagttttatcatgtagtttatttttgagtgatatatatatatatatatatatatatatatatatatatatatatatatatatatatatatatatatatatatatatatatatattgtaactaggaagcgtgccgtatgctaaacgatcaaacaacatggcatcagtcatggaaccttgtatctcagaactcatatctatgtcactcatgaaactatcactcagatctctatcactattataaaagcaatctccttctgcactgccacaaacattatgtgccatcagacggctatagccattgatattgcaataagtgtagaattaattggctcatcaaaacggaatgatcgatcgtgatcattgcgggagtcttctccgcaagtcatcttctccaactccatctcgcgcccacaaaagttctcctactgagatgcacaattctaatgcccatataatcatagtaaagacatctgattcgtcctgtcaacacataaaaaaaattgcattaacttattgctgtacaacaacattgaaccatgtggtttaagactttttttgattgggggaggggcgtgcaagtacatgagaaattttatgctacttataaaataaattcagagagttaaaatatattatcttctggtgcttttttttaacaatggaaaaattacttttcaagtcgatagcttaccagtgcatggtgtcggcagagacaccgggcaacaaaaggatgcaccattgtcatcattatgaattttagcaaaaaaaaaaaacatggctctatcatgagtcgctagaaagttgaggtgggtgcgattattggtaatgatgaccatagagaccttcgaaacagtatgggcactcctcgttattgacaccacatattagatagagctccaagacctgtaaaaattagacaaaatacagtttggtaagcaacattagagattatcagcaaccaacaaaaaacaatgaaaaaaccttacatacccaggcaccgtctgctcgtatgcattcagcacatcattgcacgagtgcgtgtgagctctccaaaatagtaatactccctccgtcctcagaagacttagagtttgaattttgtccccacaaaaaatcaacttctaccactctacatactctcagcacataaaacaaagaagttttatcccttaaataccctttacctatctatcactatcactactttttctaataatgaggggtattttggtcatttttactctccactatttttttatgggattataggaattgatattttttaggacggagggagtagtacctagcaaaggagagtgaagggagtggctcttcacaactacgggatgatccaggacataccaacatcgcaattcactcaacatcttgcgaggagagctggttattaccgctctgcagacgtcgtgccaaatcagacgatgatccaatcatcgacttgcaggatgcgaggaagcttgcttgagcagttgggtcggggtgataggcagctgtggctgcagccaagaagccttggcggatggtggtagcggcgcaagaattgatgctggaatctgccgagagaaggtgggcatccgcttggaggatgcggcgcatggcttggtggaaatcttttttttaaaccccaacgaggtgtatttgtattaaataagggggaaacactgtacaatagccaaaaggctaggacttacaaaggaaaaaaaaaggaagagagttgggggcgggggacgggggagcgtccactagaagaacgtgtggagaggcaaaaaaaaattaactacagattatttgttgtgctaccacggtcatctggcattaaagattgaatgctctctgccccgccagctcgccagagccagatttcctcagtcgcccgatcgatgattccgcatggtgttgtctcgatgctttgaaacactcggctattcctctccttccagatttcccaggagaccaggattaggagtgatttgactctccttcttttctcgacaccgagaggacagtgacgatgagccgcgcggttccacggccacgacgagccgtctccatcactgccatcgccgtatgagtcttcaagcagcccgacgagcctgcggacgagtgcatggcggcggcgggatacggcgagccaggcgcggacgaggcggtcggcgtcggggtggccagcggtgagagctccgcactcgagcgccatgtagaggccttcgttgagggcgaagtcgtcgtcgtcgtccccgagtaatctcctcctcttcttcatgcccatgtccgccgggaccgcggtggcggcgacgaggaggtcggcgccggcgacgaacaggtagcgcacggcctaccactccctcaagtcggggaacaagcggacgaggaaggccttcatgccgtcgagcggccgcgccgcaagctcctgcgtggtcgcctggggatcgggcatcgcggaggaggagggggtgagagtgttgatgacgatgttggagaccaacccgaggaggcctaagcagaggcggcggcggcgtggtggtggctgatccgctggaacgcctttgggtagaaggcctcgatcttgcgcagcaaatgcgatttgcaagcagatttttcatcgggcgacgggtacccaccaacacagcatggctcgtatatccggagatccggcagcgagctggacgccagcgccatcgtccgccggcggcgtccagcgagaggggcggcggcggcggcgagtggaaaccggatagaagacgagtatttaccgactacgccgcgcggctctgatttttatttttactagcaaaagtgcccgtgcgttgcaccgggtgattacggagtgtgtatattgaccaaaattgttgtttggtttagcaaaagtgcccgtgcgttgcactgggaagcgcacagatcagtaaaaatatgcaaattaattaaaacacaaattcactgaaatatttggtatttttaagtaggtatgtgtataattaaataaatttacaagtaaagcaagtgcgagaaataaaatgacattgttaaatttaattttattaaactctccatgattagttacgctatttggaattttcagaacttaattgctaattttaataatacaaatattatttaataattatttaattggaaaaagaaagaaaatccttccttttaggtttgcttagaaataaacacatttaataactataattgtaaatgcttctgaaaaaattaagcactaaaaatgaacttctctgtttttttttcggcctgagggacctaatatagacttatttccggcccgagggacccaaaatagacttatttccgtcccttccggtcggcccacggccttatcaaaaccctaaccctccacacccctccccccccccccccccccaactcattctcctccctctcccaccgcgagtcggcgagcggcggcggcggcggcggtagcgaccggcgatctcgcggccgaggcgaggcggcggcatacctgccctaccgcgggcagcgactggtggcgggggaggcgggcgactggggggagggggagaggc

SEQ ID NO: 74074 - DNA, 34897 bp, Oryza sativa
aatgttgaaagtcctagcctcaagcttcaaatccatcaaacataggttctgaaacattcgaagtgcatcatcagtgagtttgtttttgcaaagtccatgaaggattatgttgtatgtgctaagtttgttggaaatttggtcataattcggcatattttaatccaaaataacaagataataaacatgatatttacaataggatttgatccagtgatagtggtgaatgtaatcaacatgagcatgcttaacgttgaataagcatcaacaatcacataatgacacaatgttgacattgcgatgaacattaacagtaaaacttctaattgaaataatgtaataaggttataccccaagaatggtcctccgctggagtttgaggcagtattgcctccgttggtgttgacgggagtctccttctccttgtctccagtgttcgacatgttggtgaagatgaagtagatgttgacgaacagtgagtagtcgcgccttgcgctccccaaaaacctgatcgcccgcccgtctgtgcaaacgtcgcagcaacgcgtggtttcggaggcctactctcccaacgcgtgtgcacacactcgtcgggatgggattaccgtagcagcaacagcttttgaaaatggatgaaagtgtgtcttcttcttctcgcgggagatcaaatccattctcattttataagaggaatggaagatgaagagtaagagtcatggaataggaagaggaatggagcaactaattgtcatcaactagccatgaaccatcctccactacacaaccatcaaccaacaatcaattaagagtaattgatgtaagttaccaatggaataggaagaggaatagagcaactaattgtcatcaactagccatgaaccatcctccactacacaaccatcaaccatccatcaattaggattaattgatataagttaccaattccttaatcaaatggattaattctcaaaactcttcatcccattgatatcccatagaagaatgaattcacatgaattcctagcataatgagccttggaatttatttgatttaattgatttaaatggattaattatccaattaaatctaacaaagttcaatctgcattccactttcggtaatcctgacatagagttcttttgcagcagcagttcttctggtttgaaataaaccttgcagaattatgttatacgtaataatatcaggactaacaccactgctctccatctccttaaaaagaactaacgcgtcttccatcctactaattttgcagtagccattaatcaaagtgctataagtaacagtattaggtttcaacccaactgagaccatgccagaaagtaacttcattgcttcatccatcttacctgccaagggtaatgatatcgggcttcacaccaattcgtaccatcaagtcaaagagttttccagattctataaccctcccttctttgcaatgactgtcaattattgaattaaagaaaatagtgctaagacagatgcctcgatccaacatttcaagaaataactcttcagccttctcccatttgtcaaagatacagagactatgaattagggagttataaacaatgctgtcaggtcttagtccttcatcgatcatctgctcaaaataaagcatagcatcttctactctacctgacttgcaaagtacatctataactgttccataggtcactgcattcggattcaatccttgctgcctcattttgctgaatacaagcattgcctcttctactttctcttgtttagcgtatgcacatactagaatgctgaaaacataatgattagggtggataccgtttcgtaccatcaaatccaagagaccatgcatctcaacaagggctcctttggtagcatacccctgaagcagggtaccataggtagtaatatcaggctttaggcccctcttggtcatagaatcaaaaatctttcttgcttccgtgcatcttccgttcttgcaaagataatccatgagcgagttataagtaacaacatctggttcgacaccatcactgcgcatctttttgagaaatacaatagcctctttcggctgccctgaagagcaaaacccatgcacaatactattatatgtcatgcaatcaggcatgacaccactcttaaccatggtggtaagtacctccatggccttgtccacagtttgagccttgcatagcgcagcaataatagagttgtaggtcacaacatttggcgaaatcctctggtcaagcattttgtccagatccccctccttgaagaagccattgatgacggtgctgtacgacaccacatcaggtgggcagtcacctccatcatcagccattatgtgcagtaactcgagagcttcttggcttctgttctcatcacacagcccgttgagaagaatattgtaggagaagacatctggtatgccacgacggagcaattcgtcgaacacgtggcgtgcgtcctccgcgccaccgccactgccccccgcgcggccccctcgcccttggatcgagccctccgagcgaagggcgccagcagcgcgggaagcggcgcggcgcgccatgcccgccctagctgacaggtgcagcagcagccagtggaggggaaggagatggcagggatggtgtaggagatcggcgacgagcagggtgatcgcgatcgatctcttgcgcagttgtgtgcggcgctcttgggaaaaaaaaccagaaatttccgttcagaatggcccacttttattttttttattgtactgaaaaattacccttgcgttgcaatggaaaaaaaactaatgttatgataatgattatatttattttatagtttcatgggagttataagagatagttataaaaataaacaatgccccttctctcccaccgtaagtgatagcagctgccatttcctcatcacggaccgtgaaataatatgatatggttagatttaatttttaattaaattaaccatgattaataaatctcttttaatttttttttgaaattttgggagctttattgctaattttcataataaaaacatcatttcagcatttatttaaataaaaatctaaataacagttagtgatgctctaaaatgaaagcacagtttaaattctatagtctgctacatccttcgtttcatattatatgtcactagcaaatatgcccgtgagttgcaatgggtgaactaaaaattaaagatttgcactggttttaggagtttgaggggacaaattaagggagctaaagcgaaattattctgtgcggagcgtacacatggcctatggggtggcccaatagtgcggccggcctgggaacaattcagaggcaacttaaaggacctaaagtgaacttatttcacgcggagcgtacatgtggcccaatagtgtgggcaacctaggagtggcacccggcccaacgcgggagaagccgtagttgtccgatctgatggacggtcctgattgatcccgatctatataaaaactcagcagcccaaaccctaactctaaaatcatttttcctcccccctatctctctcaaagccaccactccccttcccttcctcaccggcgtcgccgctcccccccgcgcgcgcgccctcaccggcggcgccgctccatatccccctcttcctcctgtctcgccggcgcggccacggggaggcggcgacggggagggcaccctactggttcccctcgaccactccctccccctttctccaccggcggcgctctccctcccggcgtggaggcggtgatacattctagtataatgaatttggatagatgtgtcacattcacctaaaatctcttatgctatgtaacgaagggagtattgcaactttgcaagtttgtaaatgtgccaaaaccggtgtgttgaatgaaacatatgttaacgtgctaaaatgatgttaacagtttaataatcggtgaattgatttttgcgtagttagtagtagtacatgctaaataatgaacgtaagggcaagctattgctcgtgcacacttgccatgtgcactgatattttgtttttgacattttggtttttagtaataccccttcttttttttaaaaaagtctttgttcctttataaaggaaaggaacatcgtatcaatatcacacgttatactgtcatatccgtatacaatcgcttgtgcgcataccatataagatcgcttgacacgcagtaactgatatgttgagctgaccatggaatctcgtcaaattcatacccagaacgcagaaacaaatgaaaaggtaaatcacatgcacgtaacacaagtgaatccaatacaaaacattattacacttaccgaatggtgtacccggacacaatcttaaagaaactaaaattaacaataaatcccttaccttactcattaatattcatagtcactaggatttgaacctagtagataacgttatgcacccacaactccttcacaataattcctttggtgcttccccaaatttgatatccttaacttaagccaagtaatcgagcgtctaatatcaaatcttaccaataaatttgtggagtatataattaccaagtttccccttttcttctatcttttggttcattttcacttcgattttcaatgaaatataactcatttgtgcacgacaaaattactttgttctactgcttaatcggcgtggcagcaccaagtgcacaaatgaaggcagaagcagtcttaccattcagtgttcgatcctagcctgccctacaccatatcttcaaacaagaacacaggattgcattgacagactcgagcacacatttttacttcacagtttaatttaatgaaacgagcaacttctcctaaattacgataagttcttaggatacgttatatatttgtattgttaaatataaaataggggctaaaataaactacatcagagtctatttttacaaatctgactaacaacggacagtcctgtatttctcctctcttcagtctgcaaaaatggacagcactcagcacctagtctgctaccagccatactagaggctcaggaacatgaagtagataaattgtggactagaagtctagaacatatataaattataaaacatggaaaaaaattcccactcaacgtgggcaagcaaattagcatgatatgcatgaaaataaggtgctaacattcaaagatagaaataaacaaaattcattatgtggtttggccatatgtgtatgcaacaaagttcttcattttaaagaaggtgctataactgtgtgaatagaactatgttcaaggcagccaccaaagagagtttggtgttttccccaaaatcatatatgattcataaaatcttgtttgtttaccaaattctgtaattgcatatatgtctacttaagaaagcagggatgagactacagccataccagctggctcctgctgtccatacgccgcaaaggaattactcctaagagatacattgcccatcaaataattcggaacataaatatacttgtcttgcttataaacttgaaacaccttcctagagttagaagggtatagatatccaaaaaactctgatggttcgcaacatagatagcagggctactattcggtggcaggttctccattccctcgacgtcaagcttgtagaacatggaaattgtcagagttgcccaaatctttgcaatgtagtgctgagctctcgaaaaaaatttgcaaatatacttattttttcaataatttatgtttatatacatgcatggagaggttttataaaaatatacgcatcccgcgaaacggaaacgcgggacagcgacggttccgcagattcaaaatacgggaccgacgatcctgcgcggaaccgtcatggtccggcagctccaaaacgcggaatcgcgacggtcccgcggttccaaaacgcggaaccgcagtggccagcgactccagcactgtgcagcgcagtttatacactgttttaaccctgtgcagcactgttcacacattgttcatggtcggtgccgcgcctccattgtgcggaactgacccgggaactgtgtaaaacagtaccagaaacagtgtcaaacagtattaaacacagtgccatgcagtaaaaaaatgttggcgccgcggttccgcacactggcgctgcgggagcgtaccggttccgcgttaccggcaagcgagactggctcggtcccgcagccccattccgcgcgaacgcctcggccgtccactccgcgccgccacgccatacttttgttgcgctcccgcataaccgatctgcggattagttatattttcgcaaattcttcatactagtgtatataaacgtaaatctttttcaaaaaatgggtattttcaaatttttttcctgaactctcctccggtatcggtcaaataggagcacaagtggatgaaccacaaccatggcgacaaacaaaaagattgctgcaactgcagccaccgcgtagaagcaaacccctctgacccttgaaatcacatcgatgtctggtaaccaaatcaacaacaaaagtaaccacataagaaatgcaattctggaattcggtatgaatcccatgagtttgtccatgtacatgattttatttgcatccgcacattacatgtaaactgtatagacatagttttttgttttgcatcatacatcttagtaagaaatatccattgctgctcaaattccatgaaacacaaatgcacaatagctagtattagctgctacaagttctttagaaagtcttaacaactgcctgttctcctcaatttatactaaacattctattgacaccttcaaggttggtgtggagctaactgttataaccaacaatatatcatggtggttaacaagaatgatgcgctggcaatgattatgtttgatttccacaccttcagttttaaaattagagatggcaattttgtcactgcaggttcaaatgatttttctcccctccacaattccacattttgtcaagcaattgccaacaacgttccaaatgtaaatgttccagcaaactacattaatggctatgaggcctgcccagcgagacgaacatcacaacacattttgcgagaaaaaaaaataaaaaagggaagagagtggaggaggctgcaaacctgagagcgcctgcggcgaatcccccatggtagcgacaccaccagcggcgaaatccgatctcaccacagtctccctccgccgccagctcgccgccaaagcctgcggaccagggcggagcagcgcggccgatacaccctgatgcggatggcactccacgcctcggccacggtcgccccccgccatcaccactgcaaaaacgccaaaatcacaaatcaaccggatgagaagatatcagctagcggcggcctcgagatgcgtgtgattaccgtgcgcggtcgacgacgtggcagcgggggcagcgacgtgggcgattacgtggtggcgacgccgacgcggcggtcaaatgcaaaagggtcatcaccaccaccactgtcggtgattacattttaagatagacggagtctttttgccatttctctggagttcccatcagaactgtgcgctcttattgaaatccatccagttgagcctctaattggatttgcattgccacgatccttttttatattcaacttcaaaccactaccattgctgtgcctctcgcctaatgaaccacttgatgccccattgcttgatataaatggagaacaattgaatgccttctgtgacagaccagcatcactaccagaagatatagtaatatgagaaacttctgattttgaagataagcaacaatgacgtgtctggttcgacaaaagtttttttttttcgagttcttgctctttccatcattaaatgaagttccccccatgacatctgctgcataacaaagcttcaagaatgtcactaattaaacttatacgaggaaccaacaagataatctgggtcaggaaacatgaaatattaaaaatatcaggtagcattttataaatatttggtgtcaggccaagttcaacatctgtagtgagacttgaatggcgaccaaactatattgagacagtgcatagaaaagccaacgagatcaactgatcaaacaaaattggtgtttgttattaccagagtaactctgttgagagactttagacgatttcggatatgtagagctggaaacaacagaagaattctgaagtattgaaagagctgcagcaaaacaaaataggcgtcagactgcaactttaacatactggatgtttaaaacattttattgtgttagcgaacacattgtattattaagaaaaatacctgataataactcaatagtattgataatgacaccaacaaaagaaagcaaggagcgtttcgggttcaattttctactcatattaagcaaatgggtctgcaagaagcaaaatgaatgtaagagttcatattgctttttcaggaagaaaagaaaattgttaagcagacatacaaagtcgcactgtttgcacattttgcacagaacaaatcaggagagaagatagtacagaagaaggaaatgggtactaaactgaaacagaacatataaggagcattaccttgttatcatcgcttagaaatatggcattttccaatattttcaaacatttcaagaggagagcagcactttgcaaagatgttccttcatttcggtccaaagctgaagtggatgtatcctttatgagattctgatacacaaggtttgccaccagaagtatattgttaatttatttattcagtttatcagcgtaatatgattgcattattagttggggaataaaaagtacacagataggaacaccaagcatttaaattaatgcgcaatttactccaaacttgcttacacatgcaagaacagcaagtatagctggaaaagtaacatccaaatgaataatgttcacttggtgtagatatgtcaagtgttattatcgtttcaagtgttattatcgtgggggatataatcatcagaggaactgtaagatactaacaccacatgcagaataaaaaagtattaaaaaactatttttgcaacataaaacaacataatttgtgttgcagccaattttccatgtcctgatgaaaatagttactacctcaagcattttccatgccccaaaatataacaacctttggctatgtatctggacaagcattactttcatgtggcttcaagcacattaaagctaaaatggcgaaaaggaacaagcctgcacaatccattagagttgaacaaaggaaatgtaaaatatgcgatgttagcgagatctcacctccaatgttgaatgaaaatccaccataacgtcaaaaatactatcaagacctcccatctcccttaatgtctctttaaaatttcctccaactctggacactgtgtcagaagtctctgtaacaatcaaatatttgataagggaaaaccttcctagtatgacaatggccataggtgcttctagtgcagtccactactccaattcaattctgcaacacagatggaagtcatcaatcaaaagcaggtgaagaaaagggctaagcaaaccacccatgaatattgcaaataggtgctatgtaacttatgacaagttgacaactgcttatttggctcatataaataaatataatggtcataaagggaaatcatgaccaagaaatttgattaaaacttaccctctactgaaacagcagacaagcatgcattttccattgtcaacaaagcaagccactttggacacagttctggccttgttgttttcttgtcatctttgtcgagcgacttgatcacttgacagcttaagagaatctcttcaacttttgaaaggatttcctctgaaatgcagtcagaatccttatttgatccattaagcatttgaactttactgattccaaaaagtttggaacctatcgatggtgctgtggaatcaacaagattcactggaggatttaataatttaagaagaaaatggacaccagattctgaatccaacaaatgattttcttgaacctgaacaacaagaagggagatattggagaataagcacaagtgaagttataccattaaagagtacgagctgctagcaataataactgaaatttacaccataaattaaagttcaacttcaaacaaaatgatgaaataaaagcatggattttctcaaataatcttctttgtaatcacatgccaaaatattcatggaaaactggtgaatacttatataactatactgtagaaataaataactttgtcatgatgtgattatctttatggactgttatataaaagaaaacaatcgatatgcgtaaaaaattggaatgaagcatgcacagaagcataaggatgggattgagaggtactcacatcacttcacaaaatgaatagaagagcagctgcaccaatagtgcagggaggatcatcaatgttcaaaaccaaaattgaatcaataatttgttgtaccaatctataggatataagaaaagaggacacttgtgagtaagaaaacaaaaggtaacgtacaataatttcattaacggaacatgtgtttgttgaatggaacgatttcagtatcttttgttcagttaaaaaacaagtcaaactattcaacacctaaacagtacacattaacgaaatttaatgaaaccctatagattgatacacacaaatgaatcctacacaatgttggatctaatgccaaaactactgcctagacaaattaagtttgaaactccagttacaaattcctttatgatccgttagtagagataacgacaaacttttgtgttttttctggcatcaaaggcagaacataattgcttgtttaccgtctaggaaccagagtaaaaataattcggagaggtgacatacatacctcgctatttacacataaagagaagatccctcctctaatacaactgtaggagaaaagaactccaacacagaatttcaaagctgcaaaaggcttcagcagctcaaagattctataaaggacttatatttttcagggagaaacctatgatattcttgatattttcccccagacaaaagatctaaaaacaaggaagcagtggatgcttcgagggagaagtgcttctcatcaatcatgaacaggtaagtgccagccctggttatatcacccctctgtaacagtttcctaacaatggaatttagcatgcgggagttggcagtacagccattctcctccattgaaagaaatagatcatccaattcttctagcaacccctgctctataagattttctgccattaaactgtaggtcctaacatctggcactaaaccgttagccgagagagctgcaaacaaatccttggcttcatcatttctgccaactttaagcaatgcaccaatcataatgttaaaagtcctagtctccagctgtaaatccgtcaaacataggttctgaaacattcgaagtgcctcgtcagtgagattgtttttgcaaagcccatgaaggattatgttgtatgtgctaagttcaagctgcgttccactttcggtaatcccgacatagagttcttttgcagcagcagttcttctggtttgaaataaaccttgcagaattatattatacgtaataatatcaggactaacaccactgctctccatctccctaaaaagaactaacgcatcttccatcctgctaattttacagtagccattaatcaaagtattatatgtaacacaatcaggtttcattccaactgagaccatgctggcaagtaacttcgttgcttcatccatcttacctgccaagcaatatccatcgatgagagtactgtacgtaatgatatcgggcttcacaccaatacgtaccatcaggtcaaagagtttttcagattctataaccctcccttctttgcaatgactgtcaattattgaattaaagaaaatagtgtccagacagatgcctcgatccaacatttcaagaattaactctttagccttgtcccatttgtcaaagatacagagactatgaattagggagttataaacaatgttgccagggcttagtctttcatcgatcatctgctcaaaataacgcatagcatcttctactctgcctgacttgcaaagtatgcctataactgttccataggtcactgtatccggattcaatccttgctgcctcattttgctgaacacaagcattgcctgatctactttcccttgtttagcgtatgcacatattagaatgctgaaaacataatgattagggtggataccgtttcgtaccatcaaatccaagagaccatgcatctcaacaagggctcctttggtagcatacccctgaagcagggtaccataggtagtaatttcaggctttaggcccctcttggtcatagaatcgaacatctttctagcttccgtgcatcttccgttcttgcaaagataatccatgagcgagttataagtaacaacatctggttcgacaccatcactgtgcatctttttgagaaatccaatagcctctttcggctgccctgaagagcaatacccatgcacgatactattatacgtcctgcaattaggcatgacaccattcttaaccatgctggtaagtacctccatggctttgtccatagcttgagccttgcataacgcagcaataatagagctgtaggtaacaacatttggtaaaatcccccggtccagcatttcatggtatgtaccgtaagctttgtccagatccccctccttgaagaagccattgatgacagtggtatacgacaccacatcaggtgggcagtcacctccatcatcaggcatcatttggagcagctcgagagcttcttggcttctgttctcatcacacagccccttgagaagaatattgtaggagaagacatttggtatgcagccaagctgggtcattctgcggagcactatgtccattgcgtcgctcgtcctcttgtcagcacagaggcccttgagcagaggagtgaaggcgatggcgtccactctaaatcccttcttaatgacattgcccaaggccgcgaaaccgaggtccaagcggcccgcgcagcagcaggaaccgatgagaatgccgtaggtgcacaagttgggagttacctcgtcggcgccggctcgggccatgcggttgtagcgggacacggcggccgcggggctgtgacgcgcgacgtcggcgagggcgcagttcaagccgtagatcgaggcgcccctgccacgccggagcaattcgtcgaacacgtggcgtgcgtcctcggcgccactgccccccgtgcggccccctcgcccttgggtcgagccctccgagcgaagggcgccaacagcgccggcgcggacgcgggaagcggcgcggcgcgccatgcccgcccgccctagcggactggtgcagcagcagcagcgccggcggaaaccaacgcgacgcagctgatacggagaggtgggcggcagcagtggaggatagaggggaggggaagggggaggtcggcgccgtgctatttggcgctgaagtatacgattttgcgctcaacaaaaagattatttttaaataagttttggtcacggttaatttataaaattaatttttggaaagtgtcaaattgtcaaaaatttgtgtgataaaagggtggccgcagtttgcaagcgcgtctaggtctagacgctgttataaacaacgtccatcctgttttgataaatcctccaaacaaattgctaataatttaattttaaaaatattaattattattaatataaaaattcggcgaaacatgtgtcatgtaaattggatatatagatctttatttgagtcagattttaaatccgtttgcttttggaaatacggaaggagtcgtataaggtatctctttaaaaattttacatgctaacttgatcgagatatctgttctgcgcgcgtggaagagaaaaaaaacataaattttttgcggtagtttaatagagggatccacctttagttttttagttttttattgaatttaggctctctcttagatggaggagtatttccacttcctattttcagtttaggaaaaaaaataaattttagggatagattattgctaacatattagtgatgctctaaaatcaaagcacggtttaaatttgttatagtctactacttcctccatttcatattataagtcgttttgattttttttagtctaacttatttaaatttgactacgtttatagaaaaatatagcagcatttttaacacagaacaaatatattatcaaaatatattccatgctaaatttaatgaaactagtgtggtgcttaaatgttgctaatttttttctataaacttagttaaactcgataaaatttgactaatataaaaatcaaagcgatttataagaaaaaaaaagtcaaaactactccctccatcccgagaggtaataacctattaccgaattatacattacatacaactataaatctagacaacctaatcgaattcgtgaatctagataatatctaatccaatactatattcttatattttggaagaaaagaagtgctccctccatctcataatatagcaacttagtaccagacgagacataccaatttgttatattatgggatggagaagtaggaaagaatttattgcaagtttgcaactgtgccaaaaccggtgtgttgaatgaaacatatattaacgtgataaaatggcgttattaaaccggtgtattgattcttgggtagttagtagtagttcatgctaaataatgaacgtaagggcaagctattgctcgttgtgctctgtgcaaattgggctcaaattgtggtgaagatgacggttcaagctaaagtttcagcagagggtaatgtgaaggagattatcttaagatcataaaatgtagcatcaatatatacctgcgaaagatctgagaaaaaaattagatgtgtaggagtaatggtagttaagaacccttcacttgacatgtgatggaagcaaaaccaggaagaagaaagggaatgaaagagagcttaacacgctggtaggtttcttactttctatggttaaacaaattgagttacataacgtggagaactagaacactggaagaggttggaaagtccccccccccccccccaccgtcgctctcgcacgggcggcttggggggcgaaaaaaccctagctgcccactccccacttcttctcccccacctcgccgccgccggagctcgccggcggcgaagccggcagcgagcaaggaaggcagcggcgaggcccttttttcttggcgtcttcctcctcgacgcgatgaggatggggcaaacgacgaagccctcactgcggtcggaggtggtgacgccgtggcggtgtggggaggcggcggatccggcgcccccaaggccggatccggccatcccgcgcctggatctggcgtggcggcggcacgaggcggctagggacggcggtggcggctcagcaaggtgcgcggtggcggctcggcagcgggcgggcgaggtgcgcggcaatggcatggggctgcctcgggcgcggaggcggagcgtggcggcgtgcggtcgtgtgcgccggtgacgtgcagccggcccgggcggcagcggcggcggctcagtggcatgctcggcccttggagctggcggttgtgctcgctggcgccggcaacagcgcgacggccgtggctcgctggtgccagcgcgagctgtcccatggcgcggccaggcctcggtagccgggcggccgtcgtggtgcccttagcggccagctgggcggcgcgacgcagccaggaggggcgcggagaccaggcaaagggggtgcaggtgggtggcgccggagccggagcgacagcgtatccggcattggcgcaggcccagatggtagtgcaaagggagctggagtcgatgggttgtcttcctcgttgccggtcggcaccctcgcccttcctagagctcatccccttcttttgcggggagtttctaggttggattgagacagcagctcgccagcgggggaagctcaggctgccgaagcaatgtcacccagtcccgggttctcctttggccaaaactggcaaggcggccggcgggtggtggaacggaggggtcctgggccagctctcagggatggtggttcgatggagtcggccgacgaaggggcgtcggtgcggtgcggtggaagctacgtgctaccttttgtctgtgtggtggttctgagtggtggacggtgatctgcgatcaaggctatagggtcctaggcggaagcctagtccggtggttcaccggaccggcagcggctacgccttcgggcgtcgtaacctccttggggcgctgtcaagggttaccctctccccttcttgatgagtttctctgggtgaaaaccacatctttttagatggacgatggcagcatcctacatgtcgtgaccaccttggtggcatcgttttcgaagtctcatctatgtgttgctgccgtaggcctagcggcgtttggtcacacttagtggcggtcgtttggtgctaggcttcaccctcagtggtttgtgcttgggggtagtgtatggtgtgtggtcatgcaccttggtgcattgtggtgttttttcttgtaacttttactccttaatacattcggatggccttgtcgatgacatgggatcaggagtatcatgactagaggtttgaggcagacacaatcgcccacgtggcctggcaccctcgggggacgtcgggcccgagggtgatgtgttcgccctcctcttagtccccccgagggggtcggaccgcacccgcctcggccccgagggccgaggcgccccgacccctcgtgggtttttgctccgcgtgtatgggttaggtgagcacagcggggctcacctaaccacatttattgcggtttggctgagcgtgtcacgcggcatgtaacgaagtgcagtgcactcgtttatccggtctgtgaccagtcacagaccggtcagatcgcgggttaggtggcgacaggcgatctgacgcacgcctcgccccatcccgtcaggacgagggcttctaggcgctcgtccccagctggagctagcgtgttacctcctagagatggcacgttagtcctggttagatatatgccaggcttcatcctaaccattacaggcaagatgttgtgtgaagaagggccaacatgtagattgctaaactgacgcgtggtggacaggaatgagcaatttgtgaccagtctgacactggtcatgtcgtcagcagacagccataatcccacgtcgcacctgctttcggcggaagtggaggtaggtatgggccgtcctatcagaaggtcattcggacggcaactatacaaatctccgtccatttatgaaaaggtagggtaagtccccacagaaaggagggagatggtgcatgtggtatccccttaagatataaaaggaggaccttgcccacttagagggggggactggactggacttttccagattcggaacccagaacaagggagaggctggctcatactttgtagctccttcatacacagatccccccaaaacacaggagtagggtattacgcttctcagcggcccgaacctgtatacatcgcccgtgtcttatgctctttcgacggtcgcgaaccttccacatacagagagcttagaatttcaccctgagtccccggccgaaccggcaaaggggggcctgcgcggtctcccggtgaggagccccacgctccgtcatctggcgcgccaggtaggggactcagtgtgtgtttttctgagctctcgtactcttccgtgtgcgccaagcttttcctgttcagcctgatggccgagcaagcaaaggcgcacgacctctctccgagtgtgagtggcgacgacggggagccgaacccacgccgtcgagctcgtactccaccgctccctccacgccaaagtcctaagcggggggaggcgctcgagagggtcgaaagatccgcgacttcaccgatcgcgggcgatggagaagaacggcgagatggggagcgtcgcctcctcgtctacggcgacggcagcacgccccagggcgcgctccaagctgcgggcgcgctcttacgtcacccgcctgtcgtccctgacccggagtctccagcccaacgatggctggacgacgtggccaaattagtcatgacggtacggcagcgcctagatgctggtgggcggtcctccgccaccaaggcctctggtgctgctaccaccggctccgcgtcgtcaagacggagggcacgacgagcggcagccgctgttcgccattcggccgccactccttcgtcgactccttcgacccagaaagatctgcgtggggggccggacgcccgcaccagcatcgagcgccggcgtaatgaccgaagtgctgcccacgcaacggagggcgcttcctcgtccagagtgtcacctcaacacggacgcgggaatcagccctccgtgcccccggttggtggtgtcggctgtagagcctttgtggcgagtcttcggaatgtccgttggcccccaaggttccggcccaccatcgccgaaaaatatgatggcagcgtcaaccccgccgagtggctagcgaacccggtggtcgttcccaaggcgaacggcaagcttcggatgtgcatcgactacaccgaccttaacaaggcatgtcctaaggatccttaccccctgcctcgcatagatcagattgtcgactccactgcggggtgcgaccttttgtgttttctagatgcatactctggttaccatcagattcgcatggctagggaggatgaggaaaaaactgcgttcattacccccataggaacctattgttatacgacaatgcccttcgggttaaagaatgcaggtcctacttttcaacgtactactcgaatttctttgggtagccaattaggacgtaatattgaagcttatgtcgatgacttggttgtaaagacgcgcaaccaggaaacgttactcatagatctagcggaaacttttgagagtctccgctccgcccgcataaaattaaaccccgataagtgtgtgttcggtgtacctgcgggcaagcttctcgggttcttggtctctgcccggggcattgaggccaaccccgagaagatacgggctatagagcggatgcgcccccccagcaaacttagggatgtgcaatacgtcaccggttgcatggccgccctaagtcggttcatatcgaggctgggagagaaggcgttacccttatttaagcttctcaaacgctccggaccgtttacctggacgaaggaagctgaaaatgccctcacccagttgaaggcgtatctaagctctcccccagttctggtcgccccggagccagacgagcccttgctactctacttagcggcgaccccgcaagtagttagtgcggcattggttgtggagcgcgatgaggacaattctcatttcgcgcttccccaccctgtgccgacttggcccgggagagagcagggaggagaggcccccgagccgaacggtggcccgaggcccccgacgaccggagttggccctctgcccgcttgtcagacggtgctaggagcccccgacccccaggaaggccctgaggccactgtgggaaggccgcacctatcgccctttgaccccgaggctaaccctgtgctgactcgacccgggaaagagcagggagaagaggcccccgagccgaacggaggcctaaggcccctgacgaccggagttggccctttgcccgcttgtccgacgacgccaggagcccctgacccccaggacggccccaaagccactgtgggaaggccgcccctgttatcctccgaccccgaggtcatcagcacagaagacaagtgcgccccgcgaggctgcttggacgaagagtgccccagggatgcggcccctagcgaagaggatcggccccaccgaaaggtgcagcggcccgtctactttgttagtgaggccctccgggacgccaaaacccgataccctcaggcccagaagatgctttacgctattctgatggcctcgaggaaactgcgccattatttccaggcgcatcgggtcactgtggttacgtcttaccccctcggtcaaatcttgcataatcgagacggtacaggacgggtggtgaaatgggcaatcgaactttctgagttcgatttgcactttgaaccacgccacgctatcaagagccaggctctcgccgattttgtggcagagtggaccccggctcccgagcccgtctcaatccccgaggccagcacggacccctcgcagctgcctcacaccgcccactgggtaatgcagttcgacggctccctgtctcttcagggcgccggtgcgggggtcacgttgacctctccgagcggagacgtcctcagatacttggtccgcctcgactttcgagcgaccaacaatatggcagagtacgagggactccttgccggactcagagtggcagctggactggggatccgccgcctcctggtgttaggcgactcccagctggtcgttaaccaagtctgtaaggagtaccggtgctctgacccgcagatggacgcctacgtgcgccaagtacggcgtatggagcgccattttgacgggattgagcttcggcatgtgcccagacgggataacatgattgccgacgaactctcacggctcgcgtccacgcgagcccagaccccaccgggcgcctttgaagaaaggcttgcccagccgtcggcgcgacccgaccccttaggggagacggacgcgcctgaccggcccccgaggcccgttgaagtccaggcctcgggacccgaggggagcgctcccagctcccttagattgattgcttggattgccgagatccaagcatacctcacagataagactttacccgaggaccgcgaagggagtgaacgcgtccatcgcatctccaaacgctacgtgctggtagaagggaccctctatcggcgcgcggctaatggaatcctcctgaagtgcattcctcgggaacaaggcgttgtgcttcttgccgatatccatgaaggcgaatgcggagcccactccgcctcgcgcaccttggttggtaaagcttttcgccagggtttctattggccgacagctctcaatgatgcggtcgacctggtccggcgatgtagagcgtgtcaattccacgccaagcaaatccatcagccggcccaggccctgcagaccataccactttcgtggccatttgctgtctgggggctcgatatcctgggaccgtttaggcgggccccgggcgggtttgagtatctgtatgtcgcgatcgacaagttcactaagtggcccgaggcttatccggtcgtcaagatcgataagcactccgcacttaaattcattaagggcatcacggcccggtttggagtgcctaaccgtattattacggataatggcacccaattcactagtgaactcttcggcgactactgcgaagacatgggcatcaagctctgcttcgcctcacctgcccaccccagaagcaatggccaagtggagcgcgccaattcagaaatcctcaaaggccttaaaaccaagaccttcaacatactcaagaagcacggcgattcatggatcgaggagttgccagcggtgctctgggcaaaccgaactacaccaagccgagcaaccggggaaacgcctttcttcctcgtctacggcgcggaagcggttctcccatccgagctcaccctgaggtctcctcgggccaccatgtactgcgaggctgatcaagatcagcttcgcagagatgacctcgactacttggaagagcgaaggcgacgcgcggccctcagagccgcgcgctaccagcagagcctgcggcgctaccatcagcgtcacgtccgggcccgatcactctgcgtcgacgacctcgtcctacgccgcgtccaaacgcgtgctggattgagcaagctctcaccaatgtgggagggtccgtatcgagtggtcggcgtcccccggccgggctccatacggctggccacgggcgacggcattgagctgcctaacccgtggaacatcgaacaccttcgtcgcttctacccctgaggggggggtcgggtgtcaggtttcgggctcgggccaaccccgcaccccctcgggcgtgcagggttggccgggggctgccacacatgcacattcttatttctcttatttcagtatttcaataaaagcagtttcaatttcctaaaggctgtatctgtgtttttttttccttttgaagaatcttgacttgaaataggtcactcgtgctcaatcctgccctcgggggctcgggtcggctaaaatcgccaaacggggcccagaaccgagccgtgccccggggcgtggtgaactccgggggggaatcggcaaaaacccacaatcgggtcacccataaccctcggtcaccacgttcccggcctggccagtctcgacatgtggatctccccaggcactagccccgacccacgccttttgaggactgggacctgggcacgagcccttaatcaagctaagacgcaaaaggaccacgtcacagatcatcctcatctcatacacacagcaagatgaaattgacacaaaaatttcttcatttttgattacagattaagttgatctatacaaaaaagaggcccgaaggccttagaagaaggaaaagaagaaaaaactgaagaatggcgggggcttgggggatcaatccgatacgcccgggtcgccggcctcatcgtcactgtcgtctgcaccaccggcattgtcctcctcgtcggagttgggggcgaacgcgagccgaggggctgagccctcgaagctgtggacgatatggtcggcggcatcccggacctgcgcgcgcgctgtcctcggtcccaggagggaactcatccagcgccatccatggagaaattggggtccctggcctggtaactcgccagtacgagctccaccgctccttgggcgaggtccctcgaggatgacttaattgtcttctcgagctcctcggggagccgttggagagccccggccatcttcgagaggcgctgggcgaggcctccatggttggcggcgtactttacggtccgccctctccagaggcccacctgccgaccggcgcgatctaggcgggagacggcgtcccaaagcatgccgggccctacctcgcctgccaagcggagggcctcgacctccccggcggacgagtttagcgtgccctgcagatcggcgatggtatgttcggcagcagcgaggcgggcggctaagtcgttttcgcccgcagccgccccgccgctgcgcgccctcgcgtccagctccttctcccgcgcctcgaggtcagcggcccgctggtttagtgcggtcctctcggcgcggacacattccagagtgcggcgcgcctgctcctcctgcgctgcctcgcggagggacaggctgtccgccagccgttgcgccgcggcctcggcctcctcgagagctcgctcccgctcggtgagcgcgtcctcgtggaggcggagtgcggactcctcttcggcacaggcggactcgtgcgccgccagtgttgcctcccggatagtgacggcggcctcgcggtccgccagatccctctccacgacgcaggcgcgctcttccagcgccatggcgcgcgcctcaagggtctcttcgcgccgtcgggacgccgcttcggtctcccccgcccgctgttctcgggcagcggcaacgtcaagcaccccctgggcggcgtcgagctttttccctagctccgcctcccagctcccgtattgaaggcggagggtgtcctgcgcctcgttcatcacgctggtggcaatgagggcagccccccgctcctcctccacttccttggcgatttccgccaacaccttcttacgggcttcaagctccgagacatgccggcggtgtgccttgcggcccacctccaccatggcctccactgagcgccgcccctcctcgacacgcgcccacgcggcgtcgagctccgcccactctgcttgcagggcctccacctgggcactaagcccgtccaacaccgcgatgtttgcggcggccaaggcctgcagaaggggctctgcgctcagcggggcgatagaaggcgtggggaagagccgccttggagaggatgccacgcggctcgggccgccgatggaagtgccggactcggggatgtccctcagacctggttggtcctgggcgtcgcctgagggagtgggcccaagcgacgcgcccgcagcctcgtcgccagctgccccggaagttgtcgcctgagcgtcgcccgaggaagcgggctcaagcgacgcgcccgcgacctcatcgcgagctgcctcggaagtcgccattgcctcgtcctggcgaaatccggctttctcccgagcggcttcctcggcctggtgggctcgggcggcctcctcccgagcggcttcctcggcctggcgggcccgggcggcctcctcccgagcggtttcctcgccctggcgagcccgggcggcctcctgggcggcctcctcggcttcccgtaggcgatccgcggcctctcgccggtcagattcccgcctccgggcctctgcggccgccggatcctcggcctcagactggccggacttggaatggcgggagggacgcgacgggatctcgctgaaacagaagaaaagaccagaagacgaacaagatgggtgagtgaaaactcgcgttgagagaatgaatacagccacgatgggtgagagacgaacctgcgagggggtcggttaaacgaccactttggaggggaaataaggtttccccgagatggttctgtctcccccatcttgcggagccgcttcttcttgcgctccccctcgggctgcgatgtcggcgcggccccctccgggcgcctgctgttggcacgcaccgccccgccccctcggggaggagatgggggaggtgttcctccctgcttcctcttcccccgggcgtcggcagggcggctgctcctcgggcctccgtcgcgagacccagaagcacgaccccctcccggggtagattgatcccccctacggctcccgcctgcgccgtcgtggccctttggagctcactcctctgaggccccgaccgccgtcataatggtcaggatggaggcgcggtctggatcgctgcagagagggaggattccttggggaatgagggacgcctccatggagttgagattcagcacccgttggaccactatcttgaaatcctcaggagcccagtcccatctgactccctggtgggtcctcatgtagtcttcggacccggtgtactcccaggcgccccgagcgcgccgctggagcggcgcaatccgacgacggaggtagtcgccgtacaccatggcccctgtgagcccctgggatcgtaggcccgccaggcggtcgaggacggcgtcatagccatcccccagatctaccggcgcccgccagctggaggcctgcgccgggggctggctcggaagtcagaggcgcgcttcgtcggcgaggggggtgtagaaccagtcgctcttccagtcgtcccacttcttgcggagggcgcaggggatgtagcgattcagcaccggcccccatggctggaagtagcagccaccaactaccgatggcggcgacaccgactgcacggtgaagaaccaccggaacagccgaagagatgggcgcaccccaatgaacatctcgcacagatgcgcgaagatggccaatgtcatcaccgcgttgggggtgaggtgcgccatctggagatcgtagaacttcagaacatccatgaagaaagaagaaaatggcggaaccagccctgccattgcaaaggggagaaagaagacggaccgccccgggtagtctggcgccgggcgtccctcacccagcgtgactatctcccggccggtggcagattccggcatgaagcggcgcggcagcccagcctgcctctcgctcacgatgcgggaaggcggcagcacgctaccatcgagcagagcggagccccgtgccatggcgccggaggaagagaagattgagagcgagcgcgtgtggcgaaagtagagcacaggaaagaaggagttagggcgcaagcggcgaagacaagggaaatgatggcgaaaggaaggaaacagatcctttcctcagtgcctttatactcttgccaacgctgtgcccggctcctcgcttctcgcgcccactatttcgccccctcgtttctcgcgcccacgcttccactaatcccattcgcccgcttgcggcgcatgaggtggatatgcggttgtggcagtcgagatagatcatatcgtgcgcgcgttaattacgctcgccgaccaaagcgacgttaccatatctccagacgaaacgaatcgccatgtccagattcgtgtgctactcgagtaatgtggcagtcttgaagagaccgctcattattgatagtagagttaccattgccgatgtgcgtgatttgtgaccgttgggtttctgcccaattgtggagaccggtcccacctgtcaccaggccttaggagtggcgtcacgcccgaccgcttcccttaaagagggcgatcgccctggcataacgccgggggctactgtcggtgacatgggatcaggagtatcatgactagaggtttgaggcagacacaatcgcccacgtggcctggcaccctcgggggacgtcgggcccgagggtgatgtgttcgccctcctcttagtccccccgagggggtcggaccgcacccgcctcggccccgagggccgaggcgccccgacccctcgtgggtttttgctccgcgtgtatgggttaggtgagcacagcggggctcacctaaccacatttattgcggtttggctgagcgtgtcacgccgcatgtaacgaagtgcagtgcactcgtttatccggtctgtgaccagtcacagaccggtcagatcgcgggttaggtggcgacaggcgatctgacgcacgcctcgccccatcccgtcaggacgagggcttctaggcgctcgtccccagctggagctagcgtgttacctcctagagatggcacgttagtcctggttagatatatgccaggcttcatcctaaccattacaggcaagatgttgtgtgaagaagggccaacatgtagattgctaaactgacgcgtggtggacaggaatgagcaatttgtgaccagtctgacactggtcatgtcgtcagcagacagccataatcccacgtcgcacctgctttcggcggaagtggaggtaggtatgggccgtcctatcagaaggtcattcggacggcaactatacaaatctccgtccatttatgaaaaggtagggtaagtccccacagaaaggagggagatggtgcatgtggtatccccttaagatataaaaggaggaccttgcccacttagagggggggactggactggacttttccagattcggaacccagaacaagggagaggctggctcatactttgtagctccttcatacacagatccccccaaaacacaggagtagggtattacgcttctcagcggcccgaacctgtatacatcgcccgtgtcttatgctctttcgacggtcgcgaaccttccacatacagagagcttagaatttcaccctgagtccccggccgaaccggcaaaggggggcctgcgcggtctcccggtgaggagccccacgctccgtcaggcctccttcggcctttccggcgaaaaaaagttacataacgtggattaatgtttgtttgcaacttatacattttctccaagagagatgcacacaacctttcagagtataaattataatttatacagtttttaataaatccaatgtagatatttggctcatttaaaagatttgtgccacccttataaaaaagaacatatagaagtatttttgtttaaagtacagagaaaaaattgccgagcacacttgccatgtgcactgatattttgtttttgtcatttttgtttttagtaatacccttcttttaaaaaaagtctttgttccttcatcaaggaaaggaacatcatttttttattaaaaaaatcaatatcacacgttatactgtcatcatatccgtatacaatcacttgtgcgcatagtatgcgtataagatcgcttgacacgcagtaattgtcaagttgagcagaccatggaaaattcaacgtttgagtttctagcccagaacgcaaaaacagatgaaaaggtaaagcacatgtttagtgcgtgcatgtaacacaagtgaatccaatacaaagcattattacagttaccgaatggcgtccgatggcacaatcttaaagaaactaaaattaacaataaatcccttaccttacccattaatattcatagtcactaggatttgaacctagcagataaatattcatagccacaaggatttgaacctagcagataacgtcacgcacccataactccttcacaataattcctttggtgcttccccaaatttgatatcgctaacttaagccaataatcgagcatctcatatcaaatttgccagaatacatacagcccggagctcacagcttccggataccatcttaccaataaaatgcactctctttatggagtaattaccaagtttccccttttcttctaacttttgattcgttttcgcttcgatttccaatgaaatataactcatttgtgcacgacaaaactactttgttctactgcttaatcggcgtggcagcactaactgcaagtagctaaaaatttagcaataacgtctgaaggcagaagcagtcttaccattcagtgttcaatcctggcctgccctacaccatatcttcaaacaagaacacaggattgcattgacagactcgagcacacatttttacttcacaatttaatttaatgaaacgagcaacttctcctaaattaagataagttcttaggatctgttatatatttgtattgttaaaaataaaataggggcaaaagtaaactacatcagagtctatttttacaaatctgactaacaatggacagtcttgtatttcttctctcttcagtctgcaaaaaaggacagcactcagcacctagtctgctatcagccatactagaggctcaggaacatgaagtacataaattgtggactagaagtctaaaacatatataaattataaaacatgaaaaaaattcccactcaacgtgggcaagcaaattagcatgatatgcatgaaaataaggtgctagtggataatgctaagtacaaactagctaatgtgaaccagctgacacggtgcctttgttgcttttgtaacgagctagagaagaatattaagattcatacatgtgtactgaattttcgtttttgaaaatatactaaaagagttgattgttttagatcatagaaatggtaactggcatttacaccaactaggatgtacatagacaactaaacaaattaatgggccatatctaaagtaacagcctcgaatacatgtttgatgctctttggtcatttttaatcgaacaagaggtgttaatgttcagtcctctcttacaggttacttgcctcttcaactatatgactgggtgaataaactcaatcctctaaaatattacttgcctcttctgtaaatttaccaagtgcagaaatgtacaatgccattacactacacaagcttatttatactgattacgaaagtaattagtaactagtatcagtacctgtaacaagcttagccttgaaagcctgtctgtgcctttgaataggttccatataataaaaaaaaacaccatctttctttagtgcactccataaccgtttagaataagagtgtcagctatcaccttccttgcttcagaacataatttctcagcatcattcccttcaattggatggtgaataatgagctttactgaacctgaattaaggatgccttccattccagaaggcatcagtttccctgtcccgagaagagtaataggtatcacaggagcaccggtctttgtagccacactgaatgcacctctctggggacatttataaccacgtcagtacaccatgagaaggttaacattatatactgaatataaaaatctcattagatgtaatgtaacctaagtttggttactgaaccttaaatgcacctagctttccatctttgcttctagtcccctctggaaagaaaaatacagatgctccttttttcaccaaatccacacaccgtttaagacagtcctgaattttaacaaaccatttgttatgctcagcatggaatacaatgttgacatactacaaatatataggaaggcgatcatgcattaaacaaaaacgatgctaacattcaaagatagaaataaacaaaattcattatgtggtttggccttatgtgtatgcaacaaagttcttcattttaaagaaggtgctataactgtgtgaacagaactatgttcaaggcagccaacaaagagagttttgtgttttccccaaaatcatatatgattcataaaatcttgtttatttaccaaatactgtaaatgtatatatgtctacttaagaaagcagggatgagactacagccataccagctggctcctgctgtccatacgccgcaaaggaattactcctaagagatacattgcccatccaataattgggaacataaatatacttgtcttgcttataaacttgaaacaccttcctagagttagaagggtatagatatccaagaaactctgatggttcgcaacatagacagcagggctactattcggtggcaggttctccattccctcgacgtcaagcttgtagaacatggaaattgtcagagttgcccaaatctttgcaatgtagtgctgagctctcctccggtatcggtcaaataggagcacaagtggatgaaccacaaccatggcgacaaacaaaaagattgctgcaactgcagtcaccgcgtagaagcaaacccctctgacccttgaaaccacatcgatgtctggtaaccaaatcaacaaacaaaagtaaccacataagaaatgcaattctggaatttggtatgaatcccattagtttgtccatgaacatgattttatttgcatccgcacattacatgtaaactgcatagacatagttttttttttttttgttttgcattatacgtcttagtaagaaatatccattgccgctcaaattccatgaaacataaatgcacaatagctagttttagctgctacaagttctgtagaaagtcttaacaactgccagttatcctcaatttatacttacattccattgacaccttccaagttggtgtggagctaactgttataagccaacaatatgtcaaggtggttaacaagaatgatgtgctggcaatgattatgtttgatttccacaccttcagttttaaaattatagatggcaattttgtcactgcaggttcaaacgatttttctcccctccacaattccacattttgtcaagcaattgccaacaacgttccgaatgtaatgttccagcaaactacattaatggctatgaggccagcccagcgagaggaacatagcaacacattttgcgagaagagagtggaggaggctgcaaacctgagagcgcctgcggcgaatcccccatggtagcggcaccaccagcggcgaaatccgatctcaccacggtctccctccgcctcctccagctcgccgtcgccaccgcaacctgcggacccgggcggcggcgcacccgatgcggctggcactccacgccacggccgcggccaccgctcaccaccaccgctgcggaaaaaaaaaaacacccaaatcacaaacccaaacccaaacaggatgagaagagagatcagcgagcggcggggggggggcctctcgagaggcgcgtggctaccgtgcgcggtcgacggcgtggcgtcgccggcgccggcggcgtgggcgagcggacgcggccggaggagggtccccataggggctcacgcctcctcctcctcctcctcctcctcctcctcctctcgacggcggcgcggcggaggctttggatcagggggcggcggcgatggatgggtggattgggtagagcggagcggtcgccgttggccgccgatggcgatggagagctttggatgtatttaagcggatgataaaattcgttggaaaccaaggcgtcggtggcgaatcgcgatgcgaacgatggatgaacaagccgtgacgtctggaaaaattcagcaaatttgatccttgtttagattccaacaaaatttggccaaaaagatcgcatcaaatatttggacatgcatggagtattaaatgttgacgaaaaaaaaaaccaattacacagtttgcatgtaaattacgagacgaatatttttgagcctaattacgctatgatttgacaatgtgatgctgcagtaaacgtttgctaatgacagattaattaggcttaataaatttgtctcgttgtttacaggcagaatatgtaatatgttttgttatttgtctatatttaatacttcaaatgtgtgtccgtatactttaaaaactttgcacccaaagaacttaaaaaactttacacccatcaaatatatctgtaaggcctcatggagttagggaaaatttttgggtttggttgtcacatcggatatacgtacacacatttgaaataataaacgtagtctaataacaaaaacaaattacagtttctgccaggaaactgttagatgaatttattaagtctaattgatgcttgtatacagaccaatcattttgaaaactaagtttttttttcaatcataaaaaataaagtacaaaaaatatttaacgtttacgataagaatagcttcttttaaaaaggaaaaagtccatatgtacccataaacttttgatagaaattcctctagcatcatgaactttaaaattggatattcaaccccctaagttttgtaatgccatttatattgtggttttcgatagtggtttacttatttggcagcttaaatgactagttttgaatatttaatatagtatattgccaataatcgatcaccaatttatactatattgtaatgtgaattagtactattgatattcctatgtaagagagaaaaagaaaagggataaaatgattgcaacttaagacgaacgtgtagattttgtgcatctcacgttgtcaaactatttcagcatgtatgcaattaaatgaaaaccacttcaggtgtaatatgaataatataaagttcaggtgtaatatgaataatataaagttcagggagggagggagggttggatgtccgatattcaaggtaagatagactcaagtcaaaatttctgaggatattcaaacttttgttatgagtgtctacgtggtggacttgattttaccaaagataatgaaaacgtaaactcaaccatttatgtgttggagggaccgttttgtcttttgtgccgaagctatttataaagcacgggccgaaaccggtgaaaccttcagaaaattacagccatcaataatttattgagtgcttagtttaaaaacaaaggagacaatatacatagactagcctcaaaaagttatgctatcatgtattatgaacttgttactccaagattttataaaattattatgatattaaaataatggttaaccaaatcttgtagtactaaacaataaacatcatgatagcatggagtgtacattctaataaaaagaaatgctgcaatcagagttgcatcaatctccgagatcatgaaaaatcggtatttcaactagggacttcttaacttccacaaaacagagcggaatacggcatttgcaacagcacaccaaccatacacttctacacagaatttgatggccaccaaagtgagagaagacgcagatgatattgcattgctaacatgtgatttattctaagcttcatcagattaagacgtgtggtcacaaggtacaaactgtatggacgtctctgaataactgaaacaccacacactacactgaacattcatccctatgctgttgctactttacacttaattagagaaaaaaaaaaggagggctactcccatcatgctaagaaaaataacatcgctagatgagaagaaaaaattacacaaaacatgagcaaaaacaacaggggaaaacataaaaaaaaaaagaatgaaaccattgttagctcccaagcccactgcaggtcagagtatcagtccatctgcagagccccaggccaagacaaacacttgtgtgtatgcttttttgctgcaaagaggttgttagttgatctgtacaggcccctcttcactctttctatgaaagtttgcatttctcgataacttctgtgacagctgagtgcgtttcctctgtgatcatattgagctgcagatggaacgactgaaagagaaacatgatggattaataaatgatggaagcagaataagctcaggcagcttcagagttaatcaaaatgaacaaaaactagcagcttagataggcatgcactcaaccagtgtgggcacacaatattctcagagtcaagtcctaaatcgcaagttaagaaagagttgtgcctggagtgctaagccaagagggtaagaggttagatacttagaaactccctttttacctctatctgttgtaagagaacatttaattacgtagccaacatgttggcttgatttggtgctgtacttcaactgggagttatcaataacttaactcggtaccagattgtgtctctcatctcaagggtagtgataaaggtattacacaaagtttcaaatgtgacagcagacaatcttacagtgggagcacactagcattttaagggttaaaagtcccagccggaatgttttctccagttgagaaataaaacatcctgttactattcaaacttgaaacaagttcaaattttccttatttatgtgaaattttgcaaacaggcttcctggatgggaagtacaattatggtgacacctcacacctcagacatg

SEQ ID NO: 74075 - DNA, 12583 bp, Oryza sativa
gtgtgaccgtgtgactagcttgcatgtttcgcaatcgaacagggagttcggatttgttgtaatactcgtgaccaaaaaaccatgagaaaacctttaaaattttatccatcagatttgctttgagatttgtgtatgtatgggatgaagaaataaaaatcaaatgcactcgtgggggattagggttcgatggcgaatttttggttgacggattagctttgagattcgtacatacattggatgggggaataaaaatcaaacgcgctcatggagtctgcggttttcagaacccaatgtggggttattatcatgtagtatgtcttcaccatactatgggtttttaaaattatagtgtaactacaagttagtgatgtttaaaagttttttaagtagacccctacaaagttacaacaattaatttgttatctccaattcaagtgaccctagtattattctgatcgggcccgacatggcagcagcagtcatggtcatggccccctttttttgcaattgccatgccctagttgttactccttgtttgctatatatacatgctatgactatccatgcaaatatatcttgcatgagtgatgagttcccgtcaggtcgtatgctacaacttcgttttactcatccactcgtacgtaaccatgtgttaggagaaagattctttgcatctgctacacaagtttcttgcaactaaaacacgtgaaacgtacaaaggaggagaaaataacatttggttcccccactgtacaagatctgtacgaatactgttatcgtcattgttctttgcgttcatgtctcccatcccacgcgacacatatactttgcctaggcctgtttatatcccacacaaaaaattttacatctatcacatcgaacgtttaaacaactgtataaagtattaaatataggctaaaaaataactaattatatatattatgactaatttgcgagacgaatcttttgaacctaattgctacatgatttgacaatgtggtgctacaataaaccgttgctaatgatgaattaatttggcttaataaattcgttaaatttgtctcccaatttatatgcggattctgtaatttgttttgttattagaatacgtttaatactttaaatatgtgtctgtatatttgatgtaatacggtaatttttacccctaaatctaaacacagccttattcaaagccatcatctagttgttctcttgccagagactgacggtacgttcgttggtatacgtactcgtttcctgcaacgaccgagatgcggattggagtaggtgagatgactcgcatattctaaaaccctcccgtttaagttaatgaatggatcgatcagagtagtactatttaaatcgtcgattagattccataaatcttttaaagaattgaaggacttttgcatcaagtcaaaccaacaggcacgcagagacagacagtaacatgagtctcttacaggtcacagtggcgttgtggacggaggattataaaaggcttggactacgtttgcaagttgctgctgctctgatcgttggatgcgtggcttagctagttggttaatcgcctcccccagatttggcagatttcataattgtttaatgctccaattcctatctgaccatcatgcatctcggctgaaaattttaattagggcgaaagtgtcctgtatcatgtggcgtttgttcctttgtgcatcttcagcgttgtgattttgactttcgtcttggcactttcctgcaagtttagcttcagttgtcaaagcatctaccgaatatagtgacatgcttcctaccaccataaatgcagtactagctctaatctctccttttctatctcgatctttacctagctagctgagataaaaatgttgcaatcgtcgcgggctaactgttaaaaatctctctcatggagtagtattatttgagcttgattgcttgtttgaactcaacatcaaaattattggctgataacagtgtggtctgtattagtatatatcaaaggacagagcactgtattcttatgtgtttcgtccagttttgggtttttctcggtacatatcgtaatcgttcatagtagtatggacgtatgtggctcaatcaaagtaatcattatgacgtctctatgaaagcgtagcatccttttggaagttgtttgcctaaaattaactgagtatgacatatattattatcctcataaacctaatgatttcaattgttaacgacaagtctaaggttattgttttttggagagataatgttactttgttagcagctttaatattgcacatgcagctagatattgcgtaaacaaaacaaaaaaaaaggagagatttcacaccagggaaaaaaaattcgcgaacgcacaccagggaaaatttcaaacgtcgttctaataaatggatctcaaatgagacaaattaatgtcactcttttgcaacaacaacttttctttcttttctttttcctttcctttttgcgagtaataagaaaggcagtgattgatgctcatggggtgtggcttttcatacgtggaacgagtcacatttttgcagctcgatcggagaggagatatataccacacgtcatgtcatactgtcatctattctgtagatgccgtggcgactataattaagagcaagttaaatagtatagccaactatgagctccaattcatctatagttaatctaatagcttattcatacaatagttacatactacattattaatacctggtcccatctgtcattcacacactatgtcttatagtccgtgctacagctggctacaaatctatagcccgttatccttctctctcctcatttatcttcttaaaatatatttgcagctggcttatagcctactattatgcctgctctgagcacctctatttatttagtccaaagtgttgatacagtagtacagtagatctcaactcccttccgtaccgaacaaggactttttttttggtttggacttaatatatttcgccctttaattcctaaggtggagtagatgctacacgcatagatatttctgattctagttatagtaaacatttgttcggtcaataaaacatccatttattttctacagaaaaactagtacgtagtgactgatgtctacgtacgtgatgtaattaaattaccggcgttagcgtggcccgatcgatcgatcgatcgatcgatcaataatgcgcgacgcgacacgatgagtttacgcgagaccagcgaccgatcgatcgatggatggagcgagcgcgtgcggggtgttacaccgaaattaaacatggcaagatcgagcgagaagtacgagtcgcgagcgagttaggaaggggtacgtcgcggttggaccccgaccagggaccgaccagcggcaggacgtcgccgtcccccggctggaccggcctttccgagacaaaaagcaggtgcgcacccaccaaaacctcccacgcacatctgccgcgcacgctaccccctctctctcgccttaaatgcttcccccgcccccgcccagccccgcgccggccgccgtccgtccgcccgcgcgcgggacacgtccctactccctaacccagatccccgattcggcacgcacgtagtacactcgtgagtcgtcgtgaccccaagccgcatgcttcccgatcgatcgatccaacacgcgcgcggctgcggattcacgtacacatcgcgcgccgcgcgcgcgcgcgccaccgcggtttcagacgcccgcgcacacgccgcgcgcggttacagcgtttcgttcgttgatacgagtagtttattgtgagaggttgtggttagctagctcgaggcgcggacgcggtgttatgggcgttgccgtgcactggcggagggcgggcgattcgcttcacatggggggcgagccgcgcgcgcgcgcggaggcggcctgggcggctgcgttgcctgccgcgttggttgcgctggtgcgcgacacggctacatacacacggtaggggtgcaccgccaccgccacggccactgtgcccgcgggtgctttttcttgaggctggcaccggtgcacgagttgtgtgtgatgacgtgttcgattggatatacattatattcacacacctcaggccgggctggctttgacctgctcagaaatccgtgacgaaagcgggcataactatccttgtacccacgcagagctcacctattttgacaaatagcagagatcagtttccttgtacggactcgctcactgttcgtgcttcgtttcgttgtttttttaggggtgtttgtggagcgggagctggacacacagcgctactacgctacgacccctcgctgaacattaaatagaatttcagggttttctccacgcgaaatccctgtcccaaaacagtggtagcacgtaccaccatgcacttcaaacacaacagcaaaaatggcctttgggcttggggtggtatgcgtatgatgcacttttgcatgattgcccacccgagctctaaatttttttgctgagagcgaggaatagtagcagaccaaacggtcttaggtctcctgtcattgtgatcccttttcatgattagatttcctgtactttctcctcctgttgcagggaaaaggaaaacgatgaagagactggagaggggaagaagaagaagagaacaccacctcccgtttcccgatgccccccctgacgcgcagaatgatgcaccgtctccgaatggaaacgccacggggccccacctgccagcttgacccctgctgctgctgctgcactgcacatgttattccccctccgcctccggtgtcacgcacgcacgcgacgcgacgcgatgccgaggcgtccgtaccaccaccgccagcatcagcggccgtcagctcgagatcggacggcacgggacagatggcagcaggcgtcacgctggcgtgtgccgcccccccgccgctaagggccccacgtgccagcgatggaggcaggcgccgtggggtggtcaaagggggcgcggggacggacacgtgtcggtcgccgcaacgtctgaatgttcgaccggtgcgcggcggtttgacccacgtgaccggctaccgccggtgcacgccgctgactcagcgcacccgtgaccgtggaccgtgttcccacacacacacccccaccgtttactgtagcggttgcaattatcagtacggccacctacaggggctaatcactgttctgacagtctcgccgagatctaagcaagggattattttgagattagaagaaggaagaaaaaccaaacaagctaagccaaggagtgggcgtctcatttggggcataaataatcaacttgttcctctcaaaaaaagctgaaatcaatttaatcgaaaagcaaaccaaaagtgtgagagaaaaaaaaatcctctcacccaaccatcctctcctccatccctctatctatctatatccatctctctcccttgcctcatcaccctagttatagctaagctaatagcctctcacacctctcgctctctcactacccctccactaccatactagtagcatccataaatcccttggctcttgcacgcttgcttcctcctctgtccatctccatctcgatcctggaagcgcgagagagagagggtgcgtgcgtgcgtgcgtgctagagccaagaaccacgagcacggccagcgtcggcgagaggcggcggtggatccggctatgtcgggcgagtaccagttccaggacgagctggcgccgctgttcgcgcggccggggggcggcgcgggggagatgcagatgctgccgtcgtcgtggttcgccgactacctgcaggcggggacgccgatgcagatggactacgacctgatgtgccgcgcgctggagctgccggtcggggaggacgtcaagagggaggtcggggtggtggacgtcgtcgcggccggcggcggcggggcgccgccgctgacgccgaacacgacgtcgtcgatgtcgacgtcgtcgagcgagggggttggtggaggaggtggaggcggcgccggcgccggcgccggggaggaggagtcgccggcaaggtgcaagaaggaggaggatgagaacaaagaggaaggcaagggagaagaagatgaaggacacaagaacaagaaagggtgagttaggtcacttcaccattaaattctctcctttttttctccttttttcccttgaaatcttgggtcattttgccaagttcttgatcttagttgctaataattcattaggatgagatcatttagagcttcttttttttgctgatccggtatcaagatttggggccggttttctgtgggctagattttgcttccttgctttgcttggtggtcattctttctttcttccattcattcattcattcattcattcttctattcctcctctttttgttcttttattcctttttaaggtagtttggcaaacgtgtgaacatatctagggtttcacactcagcttgcatgcctcacacactttcttccaaaaaatttaaaaccttgccataatgttttattaaaataagtcgtttaatgtatcagctagcccctctgatctttgttttgcttttcttgattacctgcctgctactgctagttccttcattcttcacaccttcttccaagttccaacatgaccaaagatctttgtaacttttgtctttgatccccttttaccaaagattatgcccaaaaagggtagataggaataaaagaaaagcaaagtagattgatccctagacaataagcatgccagtgttatccaccaccccattctgctacttggatcttgccagcagcttccttttcagtgcaatctccagctaccaacagtagaatccagtgtgagccgaaaaggggacgccatcacgagaaagctaggccagtgccactgtgccagacagggtgtgaaccccctaaccttgtgtacacacacgctcgcgtagtcgcgtgtgtctatccagtttgaacgggatcgatcccggccgtggccgtcgcttgccggacgacatacgaaattccgccgcttttgacgcggagaaacgtaccgatcgatcgcgagctgattggtaatatggtatggattggatgggtgcaggtcggcggcgaagggagggaaggcggggaagggggagaagcgggcgaggcagccgcggttcgcgttcatgaccaagagcgaggtcgaccacctcgaggacggctaccggtggcgcaagtacggccagaaggccgtcaagaacagcccataccccaggtacgtatgtacagttacacacacgtatagtacgtgactcgtagctgtgcgcgtgtacgtgtaccggccgcagtagttgcaccggacgcgcgcgcgcgcggcagaatgcgatgattgcaatgatctgatatatacggggttgatttttttgcaggagctactacaggtgcacgacgcagaagtgcccggtgaagaagcgggtggagcggtcgtaccaggacccggcggtggtgatcaccacgtacgagggcaagcacacgcaccccatcccggccacgctccgcggcagcacgcacctgctcgccgcgcacgcgcaggcggccgcggcggcggcggccgcgcaccagctgcaccaccaccacggccaccacggacaccacggcatggcgccgccgttgccgctgggctccggcgccgccgcgcagttcggccggtcgtccggcatcgacgtgctgagcagcttcctgccgcgcgccgccgccgcccaccacggcatgactacgatgggcggcgccgcggcgacgacgacgacgagccatggccttaacagtgcaatcagcggcggaggcggcgtctcgagcgagacgacgagcgcggtcaccgtcgccgcctcggctcagccgtcgtcaccggcggcgctccagatgcagcacttcatggcgcaagacttgggcctcctgcaggacatgctgctgccgtccttcatccacggcaccaaccagccttgacgcgacgaccaccatcaatctgaagctgaattaatcatcagactagctagacaagaggtcatttggctctcgatcgatcatgctgtttaattaattaacatctcgttacatctttttccccccaaatgatcaccttctgtttcgtttcttgattttgtttttttctttcgtgctgcgagatggtacagggttttctactgggtctcgtatcatttctatgctcttactagctagctctacctagctctagtactaagcacttcttgtacatgtaagcgcctaattaattcccaggctccagcattgcaccctgcaggttgcaggactgaccatacgagccatgataattttatgcaaactttacattgatcttctcctatatagctccattaatggaagagtacgagtacttcatatatatgcacatatgtttaattggcatgttgttaattaactctagctagctagaccaatcgagctaaggtttcttgcagggtggtcaatcatgaatgaattgaattttgaatggcgttgattagtttctctgatactggctttcgcttgtcatgacgggatgatgattaattgggggttcgttgtttcgtttggttggtaggaagagttgttaaggaagaaaagtagcgagggttgttttgctgcttgtttctttgcgagtactggtcaggtcgttccaaggctagtactagtaccactactactagcattacgactgatgcatagtgatgtaaacctgcctagctagcgaccgtgcatcgctgtgtgcatgtcattgtgcgtgtatgtgattgatatgtggaattaagagctttggggcctgattagctagcttgtgcatgtttgcttacatttatatatgggttctaagtatcagagataatcatgcattatatatattcatgggtgtcgcagtcatgcatgtttgtcagaattatggcaaagagatgatcgatgcacctaatctctaactctaaaacgtggctgctgaggcgttaggggttttggacccctctgcctcttacagtgcattgatgatgtgactcatgtactaacaaaggtagtagatctaaaagcaagtcaattaatgtgtctaactggtttgctatttcgtcggctacctgattgacaatttccagaatttggttccatgcgagatcgatcaaggggccagcgtgtgtatagactggtcatacacatccagctgcatgaaatataaaagatgtagtacagtatttgttttatttgggtgtacatgcatggagtaggtcagttagatatgatgacacatgacatttcagtggaaatggacatccttttttttaattttgtttttcctttccaatgctaagctagctatccccaatattattaactatatatacgtatattgtatatgccttcaacaaggaaaatcatatatatatttttcatgctttctatttataatttgctcaattcatgtatgtgctatgaacatgtggtgccaggctgctagctagtagctaggagtacatgctgataaccggcacatatatttgcgtgtgagccacgtgtaaattaatggaagagactagatatatagtcttgcatccttatatgtgccagctgatttaatctacatataaggatattggcacacacacacatatatatatatatatatatatgtgtgtatatatatatatatatatatatatatatatatatatatatatatatatatatatattcacacgcaattaatttacacgtgtaaaccaatttgaaatgtttgattatcaagttggtttgtacgagtaagaagtcaaacatttcaactggttacagaattacgtactgtgtccagccagattaattacacaagtacatgatctcaaacccaaggatttttggagtatctaattccctagctagataagaactggctaaaaacaattgtagcttttactttgaaacacatgtgacagaaatgtcctttctttaattaaaggctcggaaccgagagaaaaatatatactacactttgggcgagtggtgaccatatcccgttaattctggtaaggcaaaatcttcttgtactgtgcatgcgattgtactttagagacttagattcatcatctgcagaggggcatgcatacatgcaagcattatctcacttgcttgatgccatattgtttaatttactactaatagcagtttagtcaacaaggagtagccaaggacacctctggaccatatgtatatatactaatcgatccaagataactagattcatggtcatggacgcaactttgaaaggagaaaaacaaaatcttgtgcagcttttaaccaacagcagattctcacggcctcattcaattggcaggtacgtaccctcaatcttgtactaccagagggtgcccaattgcatctcttcaatttggagctatatttatatgtgagatcgtgcatgcgatatactcactattctcttcattatgatcagctgatggttgttgcgtgagtaagaaagatatcgatatatgcttggactgttacacatgtctacctagcttgtggctggtagattttgttttctttgtgccttttccagccttagcttgctgaattttcctatagtactattttacatgtgatgggcacaagtggatggatcaatcatgcagtatatgtaatttaattttgactataaccttttgtgttgggatattagaattattacgcatatatggccaaatcctgataggcatcagagaaccagacaacatactagaaggtcaaaagcattaaaggccacagcgcaaggtgtgcaccaactcaccgaacgtttatttttccccggcacaaaagacaaatacggcgtagactcgtgttcaaagtccaaccctgaatatacatgtaagtcaataaagatacagccgaaaatactactatataaaagcgtataatgctagttcactggccggagaaattaagttacaatacattttctttacggggaacacaccctttgttgtttagttcatcaaatacaaaaatccgtatataattaatacagtaacgttcattaatatgaaatatactgtggtttttacatactacttcttgataatgtttaatgtgttaactaatcgtacttacgcatgatgcattatgcatgcgcagatctctttgactgactggttaaattagcttattggagccctgggcttgcaagctgccactgcatacatcagctcaatagtgtgtttctagattaagtccaagatatttaatttatttccaggttagcttaataagatcatctgaacaaggcttaacacggatagcagcaaccgtcgcatcgataattaattgggctgcttagcaccaacaaactagatagctatcgttccatgcctttgaacacaagtgatatgatccaggtcaagcccaccgttataactccgcaatggccactcccatgcaaacgtccaaatactttggcctgctagatgccgatacacatcaaaggttagggaggactagcttgcagttgacaaagaaatttgaccggtcggtcaggctgatgaaatgaccggtctcacaatgacacaaagatagggagaaaaagattgtggctcctatcaggtggcataatcagctaaagtaaaagccaaattttaaattttcaaatttaattttaagattgatttttaaatatttttaacttaatttctttttcagcattggtttttaagtcaccaagaatacatatataaaatttttatctacaaatttatttttattttctaatagggaaaaaagccaaacgaataattagtactggtactgtaacgtgtgaagacatacatgatgtgcatatatcacttgtaagaacgttttttttcccgacggttctatatcatccctgacggcagagctttgctccgctgagagaaagtactcccggtaatttcctggtgattttcatgccctgtcaggaaaaagttgggtccactcgggtgcagtagctgcacttgctgcatagccaatccgtgcagtaccaactgtttcctcgtgcatcacttgcggctaacgttggctgtgctgcagtgcagccagtgcaaccgagcattgcagagacctctgtgctgttgccttatgctatttgtagtgataccaagtattctatccgtactaaaatataagtatttttagtatagtgacaagtcaaacatttttaactttgattattaatagaaaaaaattaaaaaagattaaccatgtaaaagtgttgttactagatttatcattaaataaactatcatagtataaaactcattttatttaaaacatttaatttttatagatattattgatcaaaatagcatctcggaaaccatgtttagagtctaaaaatgtttatatttggtactaaggaagtagtatatatgtggatcttgccatcgtatcatgtatcacaaactcacgtgaaacctctatttcgttcatgaatacttgtcgattatcgcatcttgtgacttcatatgtatacaagcatacaaaaattgggagcaaatactatgaagcatttttttttggggggggggggggg

SEQ ID NO: 74076 - DNA, 4740 bp, Oryza sativa
taataatcgtgtccaactctaaaacttcttatattctaggatagagggagtatgtggtgttatccatctcactccttgctgcctcacacaggtaaatagaaacatcattccatcagatatttcatgattagtacatgtgcataataatacgttgagataagataatcagatcggaaaccattctatacaatccaatcttgttccataaaaaatatattgtgatgatcagtactgcatttggtaaagaacaaagcttcagacatatcttttgttcagttaaaaaacaagtcaaactattcaacacctaaacagtacacatagatgaaatttaatgaaaccctataaattgttttggatctaatgtcaaaattactgcctagacacattaagtttgaaactccagtcacaaatccctttatgatccgttagtagagataacgacaaacttttatgttttttctggcatcaacagcataacataattgcttgtttacagtctaggaaccacagtaaaaataattcggagaggtggcatacatacctcgctatttacacatacagagaagatccctcctctaataggactgtaggagaaaagaattccaacacagaatttcaaagctgcaaaatgcttcagcagctcaaagattctataaaggacttgtatttttcagggagaaacctataatattcttgatattttcccccagacaaaagatctataaacaaggaagcagtggatgcttcgagggaaaagtgcttctcatcaatcatggaaaggtaagtgccagccctggttatctcacctctctgcaacagttccctaacaatgaaatttagcatgccagagtcaacagtacagccattgtcctccattgaaagaaagagttgatccaattcttctagcaacccctgtcctataatattttcagccatcaacctgtacgtccaataattcggcactaaaccgttagacgagaaagcaacaaacaaatccttggcttcatcatttctgccaactttaagcaatgcatcaatcataatgttgaaagtcctagcctcaagcttcaaatccatcaaacataggttctgaaacatctgaagtgcatcatcagtgagtttgtttttgcaaagtccatgaaggattatgttgtatgtgctaagttcaatctgcgttccactttcggtaatcctgacatagagttcttttgcagcagcagttcttctggtttgaaataaaccttgcagaattatgttatacgtaataatatcaggactaacaccactgctctccatctccttaaaaagaactaacgcgtcttccatcctactaattttgcagtagccattaatcaaagtgctataagtaacagtattaggtttcaacccaactgagaccatgccagaaagtaacttcattgcttcatccatcttacctgccaagcaatatccatcgatgagtgtactgtatgtaatgatatcaggcttcacaccaatacgtaccatcaggtcaaagagtttttcagattctataaccctcccttctttgcaatgactgtcaattattgaattaaagaaaatagtgtccagacaaatgcctcgatccaacatttcaagaaataactattatatgtcatgcaatcaggcatgacaccattcttaaccatcgtggtaagtacctccatggcttgtccatagcttgacccttgcataacgcagcaataatagagctgtaggtcacaacatcaggtaaaatcccccggtccagcatttcatggtatgtactgtaagctttgtctgaatccccctctttgaagaagccattgatgacagtggtatacgacaccacatcaggtgggctacctcctcctcgatcatcagccatcatgtgcagcaactcgagagcttcttggcttctgttctcatcacacagcccgttgagaagattattgtaggagaagacatttggtatgcaaccgagctcggtcattctgcggagcactatgtccattgcgtcgctcgtcctcttgtcggcacagaggcccttgagcagaggagtgaaggtgatggcttccactctaaatcccttcttaatgacattgcccaaggccgcgaaaccgaggtccaagcggcccgcgcggcagcagcaaccgatgagaatgccgtaggtgcacaagtcgggagttacctcgtcggcgccagctcgggccatgcggttgtagcgggacacggcggccgcggggctgtgacgcgcgacgtcggcgagggcgcggttcaagccgtagatcgaggcgcccctgccacgccggagcaattcgtcgaacacgtggcgtgcgtcctcggcgccactgccccccgcgcggctcctcgcccttggatcgagccgtccgagcgaagggcgccaacagcgcgggaagcggcgcggcgcgccatgcccgccctagctgacaggtgcagcagcagcgccggcggaaaccaacgccgcaacgcagtttgtcttatacggagaggtgggcggcaccagtggaggatagaggggaggggaaggaggagatggcagggatggtgtaggagatcggcgacgagcagggcgtggagagaatgagagatcggccggcgacgtcggggcagggagatcgcgatcgatctcttctgcgcggcgctcttggggaaaaaaaagacagaaaaaaactaatgctataataatgattatatttattttaaagttccatgggagttataaaagatagttctgaaaataaacaatgtcccttctctcccaccgtaagcgacaacagctgcgcattttcctactgcgcgccgtgaaataatatgatatggttggatttaatttttattaaattaatcatgattaataatgctctttgaatattttttaaaattttcggagcttaatttctaattttgataatataaacaccttttcaacatttatttaaataaaattcccaatttctctatgggccattttcagtccatttactatctcagcccgcaaataaattctactttacctcctccaactcctcctctgactacgtttgttcgaccctccggccttccctcggcccatcaagcatgcgcggcctgaagatggaggcgttctgagccgtctgatctgatggacagcttggatcgcctccgtgtcgctgaagatacgaatggggaaaaacctaaccctccctcacatttccttctctctccatatcctatctcccaagcagcggcggcggcgccctcccataccacgtgcgatagcagcgacatcgttccccgtgagcggcggcggcggcgctcgagcggattcggcggcatcggcagcttcccgcgggattgagataagatttgtgtgctttttattattttttctgttctttttctctattttttggattgtctagttggatttcaatcggatttacggacgaaaatttaatgtgacgaaaggaaaattatgaatattttaattagttaagataagatttaggctatctcttttggtgatgctctaaaataaaagcatagtttaaatttgctatagtctgctacatcctcagtttcatattatatgtcattttgattttttttcgtaatcaaacttctttaaatttggctacatttatagaaaaatatagtagcattttaataaaaaaacaaacatattataaaaatatattccatgctacatttaatgaaactaatgtggtgcttaaatgttgctaattttttttctataaatttagtcaaactcaataaaatttgactaagaaaaaagtcaaaacaacttataatatgaaacagagggagtacgaaataaaaactactccctccatccaaagaggtaataacctattaccgaattagacattacatacgactacaaatctagatagcctaatcaaattcgtgaatccaaataatatctaatctagtactagattcttatattttggaaggaaagaagtacttcatccgtcccgtaatatagcaatatagtatggaacgagattgttatattatggggcggagaagtagtaaaaatgttattgcaagtttgcaactgtgccaaaaccggtgtggtgttgaatgaaacatatgttaacgtgataaaatgacattattaaactgtacaaacagtttaataaccgatgtattgattattgggtagttagtagtagtgcatgctaaataatgaacgtaagggcaagctattgctcgttgtgctctgtgctaaggggctcaaattgtggtgtagatgacggttcaagctaaagtttcagcagaggataatgagaaggatatcatcttaagatcataagatgtaggatcaatatatacctactgcctagataccttaagtttgaaactccagttacaaacccctttatgatccgttagtagagataacgacaaacttttgtgttttttctggcatcaacaccagaagataatagcttgtttacagtccaggaaccacagtcaaaataattcggagaggtgacatacatacctcgctatttacacatacagagaagatccctcctctaatcggactgtaggagaaaagaattccaacacagaatttcaaagctgcaaaatgcttcagcagctcaaagattctataaaggacttgtatttttcagggagaaatatatgatattcttgatattttcccccagacaaaagatctataaacaaggaagcagtggatgcttcgag

SEQ ID NO: 74077 - DNA, 21552 bp, Oryza sativa
taaccacatttattgcggtttggctgagcgtgtcacgccgcatgtaacgcagtgcagtgcactcatttatccggtctgtgaccagtcacagaccggtcaggtcgtgggttaggtggcgacaggcgatctgacgcacgcctcgccccatcccgtcaggacgagggcttctaggcgctcgtccccagctggagctagcgtgttacctcccagagatggcacgttagtcctagtcagatatatgctaggcttcatcctaaccattacaggcaagatgttgtgtgaagaagggcgaacatgcagattgttaaactgacacgtggtggacaagaatgaccgatttgtgaccggtctgacaatggtcatgtcatcagcagacagccatcttcccacgtcgcgcctgcctccggcggaagtggaggtaggtatgggccgtcccgtcagaagatcattcggacaatggcgatgcaaatctccgtccattaataaagaaaagtcaaattggagggagagatggggcatgtggtatccccttgagatataaaaggaggaccttgcccactttgagaggggacgggacttttccagattgggaacccagaacgagggagaggctggctcatactttgtagttccttcatacacgaatccaccaaaacacaggagtagggtattacgcttctcagcggcccgaacctgtatacatcgccggcgtcttgtatggttcctgtctcgcgaaccttccacagattgggagcttagagtctcacccagggtccccggccgaaccggcaaaggggggccagcgcggtctcccggtgaggagccccacgctccgtcatctggcgcgccaggtagggggctctgcgagtgatcttctgagctcttgcactctttcgtgtgcgccaagcttttcctattcagcctcatggctgagcaagcaaaggcgcacgacctctctccgagtgtgagtggcgacgacggggagccgaacccacgccgtcgagctcgtactccaccgccccctccacgccaaagtcctaagcggggggaggcgctcgagagggccgaaggatccgcgacttcgacatccacaggaggtggaaaagagcggcgagatggggagcgtcgtctcctcgtctatggtgacggcagcacgccccagggcgcgctccaagctgcgggcgcgctcctatgtcacccgcccgtcgcccatgacccggagtctccagcccaacgttggctggacgatgtggccaaattggtcatgactgcacggcagcatctagatgctggtgggcggtcctccgccaccaaggcctctggtgctgctaccaccggctccgcgtcgtcaagacgaagggcgcggcgagcggcagccgctgttcgccattcggccaccactccttcgtcgactccttcgacccgggaagatctgcgtggggggccggacgcccgcaccagcatcgagcggcggcgtaatgaccgacgtgctacccacgcaacggagggcgcttcctcgtccagagtgtcacctcaacacggaagcgggaatcagccctccgtgcccccggttggtggtgtcggctgtagagcctttgtggcgagtcttcggaatgtccgttggcccccaaggttccggcccaccatcgccgaaaaatatgatggcagcgtcaaccccgccgagtttctccaggtctacacgaccgggattgaggccgccgggggagacgacagggtcatggcgaatttctttcccatggccctgaaggggcaggcgcggggttggctaatgaacttgccacccgcgtcagtccactcctgggaggatttgtgccaacagttcaccatgaacttccaaggcacgtatccgcgcccaggtgaggaagcggacttgcacgcagtacagcgaagggacgatgagtcacttcgctcgtacattcagcggttctgtcaagtccgcaacaccataccatgcatccctgcacacgcggtgatttacgcgttcagggggggtgtgcggcacaaccgcatgctcgaaaagatcgcctccaaggagccccagactaccgcggagctttttcagctcgcggaccgagtggctcgcaaggaggaggcctggacttggaacccctccggttccggtgtggcagcttcggccgcccccggatccgccgcttagacagggcggcgtgacaggaggaggaagaagaggtcagtccattccgacgacgagggtcatgtcctcgccgagtcgccgtcgagggcgcttcgcgggccacccaaaaggggaggcctgcgagcgacaaaaagaaaaaggccggcgctcccagcagggagcgcccaaccggcaagtggtgcaccgtccacaacacttcccttcacgacctcgcggactgccgtgcagtcaaaagtttggctgagcggacgaggaagtgggaggaggagaggaggcaggagcgccgagagggcaagtccccggcggttccttccggcaatcggcgaagtgaggccaagcagaaggcccctgccgaggacatcgatgacggcgatgatgacctaggtttccaagagcctggggccaccattgccactgtcgatgggggagcgtgtgctcacgtttctcgccggagcctcaaggccatgaagcgagagcttctggccgcggcccctactcatgaggcgacgcgccgggcgcggtggtcggaggttgccctcaccttcgaccagaccgaccacccaccgtgcgttgcccggggaggacagatcgcaatggtggtttcccccactgtttgcaacgcgaagttggggcgtgtcctcattgatggaggagcagccctcaacatcctttcccccgcagcctttgacgccatcaaggccccggggatgatgctccggccgtcccagccgatcatcggtgtgacgccggggcacacttggccgctaggtcatatcgacctcccggtcaccttcggtggacccgccaacttccgcacggagcgggtgaactttgatgtggcggacctcagtctgccctacaacgcggtcttggggaggcccgcgttggtaaagttcatggcggcggttcactacgcctacctccagatgaagatgccgggccccgatggccccatctctgtccatggcgacctcaaagtcgcgctcgcttgtatggagcagcgcgcggaccgcctcgccgtcgtgtccaagcccgagggtggcgacgagaggcttggcacatccgcccccgccgccccgaggcagcggatagtcacgtgcgatgaggtcccggtcaaggaggttgccctgggcgacggcccgtccaagaccacacggatcggtggtcttctggacggcaaataggaagacacgctcgtctctttcctgcgggcaaacgctgacgtcttcgcatggagaccggcggatatgcccggggtccccagggaggcgattgagcaccgtctcgccgtacggccgggcgcaaggccggtccggcagaaagtgcggcggcaggccccggaacgtcaagccttcatccgcgaggaggtggcgcgacttctggaggccggattcatccgcgaggtcatccatccggagtggctggcgaacccggtggtcgttcccaaggcgaacggcaagcttcggatgtgcatcgactacaccgaccttaataaggcatgtcctaaggatccttaccccctgcctcgcatagatcagattgtcgactccacagcggggtgcgaccttttgtgttttctagatgcatactctggttaccatcagattcgcatggctagggaggatgaggaaaaaactgcgttcattacccccataggaacttattgttatacaacaatgcccttcgggttaaaaaatgcaggtcctacttttcaacgtactactcgaatttctttgggtagccaaataggacgtaatgttgaggcttatgtcgatgacttggttgtaaagacgcgtaaccaagaaaccttactctcggatctagcggaaacttttgaaagtctccgctccgcccgcataaaactgaaccccgataagtgcgtgttcggtgtacctgcgggcaagcttctcgggtttttggtctctgccagaggcatcgaagccaaccccgagaagatacgagctatagagcggatgcgcccccccagcaagcttagggatgtgcaatgcgtcaccggttgcatggccgccctaagtcggttcatatcgaggctgggggagaaggcgctacccttatttaagctcctcaaacgctccgggccgtttacttggacggaggaagctgagcgtgccctcactcagttgaaggcgtatctcagctctcccccggttctggtcgccccggagccaaatgaacccttactactctacttagcggcgaccccgcaagtggttagtgcggcgttggtcgtggagcgcgatgaggacaatcctcattccgcgcacccccaccctgtgcagacttggcccgggagagagcagggaggagaggcccccgagccgaacggtggcccaaggcccccgacgaccggagttggccctctgcccgcttgtcagacggtgctaggagcccccgacccccaggaaggccctgaggccactgtgggaaggccgtacctatcgccctttgaccccgaggctaaccctgtgctgactcgacccgggaaagagcagggagaagaggcccccgagccgaacggaggtctaaggcccctgacgaccggagttggccctttgcccgcttgtccgacgatgccaggagcccccgacccccaggacggccccgaagccactgtgggaaggccgcccctgttatcctccgaccccgaggtcatcagcacagaagacaagtgcgccccgcgaggctgcttggacgaagagtgccccagggatgcggcccctagcgaagagaatcggccccaccgaaaggtgcagcggcccgtctactttgttagtgaggccctccgggacgccaaaacccgataccctcaggcccagaagatggtttacgctattctgatggcctcgaggaaactgcgccattatttccaggcgcatcgggtcactgtggttacgtcttaccccctcggtcaaatcttgcataatcgagagggtacaggacgggtggtgaaatgggcaatcgaactttctgaattcgatttgcactttgaaccacgccacgctatcaagagccagaccctcgccgattttgtggcagagtggaccccggctcccgagcccgtctcgatccctgaggccagcacggacccctcgcagctgcctcacaccgcccactgggtaatgcagttcgacggctccctgtctcttcagggcgccggtgcgggggtcacgttgacctctccgagtggagacgtcctcagatacttggtccgcctcgactttcgaacgaccaataatatggcagagtacgagggactccttgccggactcagagtggcagctggactggggatccgccgcctcctggtgttaggcgactcccagctggtcgttaaccaagtctgtaaggagtaccggtgctctgacccgtagatggacgcctacgtgcgccaagtacggcgtatggagcgccattttgacgggattgagcttcggcatgtgcccagacgggataacatgatggccgacgaactctcacggctcgcgtcctcgcgagcccagaccccaccgggcgcctttgaagaaaggcttgcccagccgtcggcgcgacccgaccccttaggggagacggatgcgcctgaccggcccccgaggcccgtcggagtccaggcctcgggacccgaggggagtgctcccagctcccttagattgattgcttggatcgccgagatccaagcatacctcacagataagactctacccgaggaccgcgaagggagtgaacgcgtccatcgcatctccaaacgctacgtgctggtagaagggaccctctatcggcgcgcggctaatggaatcctcctgaagtgcattcctcgggaacaaggcgttgtgcttcttgccgatatccatgaaggcgaatgcggagcccactccgcctcgcgcaccttggttggtaaagcttttcgccagggtttctattggccgacagctctcaatgatgcggtcgacctggtccggcgatgtagagcgtgtcaattccacgccaagcaaatccatcagccggcccaggccctgcagaccataccactttcgtggccatttgctgtctggggactcgatatcctgggaccgtttaggcgggccccgggcgggtttgagtatctgtatgtcgcgatcgacaagttcactaagtggcccgaggcttatccggtcgtcaagatcgataagcactccgcacttaagttcattaagggcatcacggcccggtttggagtgcctaaccgtattattacggataatggcacccaattcactagtgaactcttcggcgactactgcgaagacatgggcatcaagctctgcttcgcctcacctgcccaccccagaagcaatggtcaagtggagcgcgccaatgcggaaatcctcaaaggccttaaaaccaagactttcaacatactcaagaagcacggcgattcatggatcgaggagttgccagcggtgctctgggcaaaccgaactacaccaagccgagcaaccggggaaacgcctttcttcctcgtctacggcgcggaagcggttctcccatccgagctcaccctgaggtctcctcgagccaccatgtactgcgaggctgatcaagatcagcttcgcagagatgacctcgactacttggaagagcgaaggcggcgcgcggccctccgagccgcgcgctaccagcagagcctgcggcgctaccatcagcgtcacgtccgggcccgatcactctgcgtcgatgacctcgtcctacgccgcgtccaaacgcgtgctggattgagcaagctttcaccaatgtgggagggtccgtatcgagtggtcggcgttccccggccgggctccatacggctggccacgggcgacggcactgagctgcctaacccgtggaacatcgaacaccttcgttgcttctacccctgagggggggggtcgggtgtcaggtttcgggctcgggccaaccccgcaccccctcgggcgtgcagggttggccgggggctgccacacatgcacattcttatttctcttatttcagtatttcaataaaagcagtttcaatttcctaaaggctgtatctgtgctgttttttccttttgaagaatcttgacttgaaataggtcactcgtgctcaatcctgccctcgggggctcgggtcggctaaaatcgccaaacggggcccagaaccgagccgtgccccggggcgtggtgaactccgggggggggaatcggcaaaaacccacaatcgggtcacccataaccctcggtcaccacgttcccggcctggccagtctcgacatgtggatctccccaggcactagccctgacccgcgccttttgaggactgggacctgggcacgaacccttaatcaagctaagacacaaaaggaccacggcacagatcatcctcatctcatacacacagcaagatgaaattgacacaaaaatttcttcatttttgattacagattaagttgatctatacaaaaaagaggcccgaaggccttagaagaaagaaaagaagaaaaaactgaagaatggtgggggtctgggggctcaatccgatgcgcccgggtcgccggcctcgtcgtcactgtcgtctgcaccaccggcattgccctcctcgtcggagttgggggcgaacgcgagccgaggggccgagccctcgaagctgtcgacgatatggtcggcggcatcccggacctgcgcgcgcgcgcggtcctcggtcccaggagggaactcatccagcgccatccatggagagaaattggggtccctggcctggtaactcgccaggacgagctccaccgctccttgggcgaggtccctcaaggatgacttaattgtcttctcgagctcctcgggagccgttggagagccccggccatcttcgagaggcgctgggcgagacctccctggttggcggcgtactttacggtctgccctctccagaggcccacttgccgaccggcgcgatctaggcgggagacggcgtcccaaagcatgccgggccctacctcgcctgccaagcgaagggcttcgacctcctcggcggacgagtctagcgcgccctgcagatcggcgatggtgtgttcggcagccgcgaggcgggcggctaagtcgctttcgcccgcggccgccccgccgctgcgcgccctcgcgtccagctccttcgcccgcgcctcgagctcagcggcccgttggttcagtgcggccctctcggcgcgggcaccttccagattacggcgcgcctgctcctcctgcgctgcctcgcggagggacaggctgtccgccagctgttgcgccgcggcctcggccccctcgagagctcgctcccgctcggtgagcgcgtcctcgcggaggcggagcgcggactcttcttcggcgcaggcagcctcgtgcgccgccagcgttgcttcccggatggtgacggcggcctcgcggtccgccagatccctctccacgacgcaggcgctcttccagcgccatggcgcgcgcctcaagggcctcttcgcgccgccgggacgccgcttcggtctccgccgcccgctgttctcgggcagcggcagcgtcaagcacctcctgggcggcgtcgagcttcttccctagctccgcctcccagctcccgtattgaaggcggagggtgtcctgcgcctcgttcatcacggtggtggcaatgagggcagccccccgctcctcctccacttccttggcgatctccgccagcaccttcttacgggtttcaagctccgagacgtgccggcggtgagccttacggcccacctccaccatggcctccaccgagcgtcgcccctcttcgacacgcgcccacgcggcgtcgagctccgcccgctctgcctgcagggcctccacctgggcacttaacccatccaacaccgtggtgtttgcgacggccaaggcctgcagaaggggctctgcgttcagtggggcgatagaaggcgtggggaagagccgccttggagaggatgccacgcggctcgggccgccgatggaagtgccggactcggggatgttccccggacccggttggtcctgagcgtcgcccgagggagtgggcccaagcgacgtgcccgcagcctcgttgccagctgccccggaagttgtcgcctgagcgtcgcccgagggagtgggcccaagcgacgcgcccgcggcctcgtcgcgagctgcctcggaagtcgccatcgcctcgtcctggcgaaatccggctttctcccgagcggcttcctcggcctggcgggctcgggcggcctcctcccgagcggcttcctcggcctggcgggcccgggcggcctcctcccgagcggtttcctcggcctggcgagcccgggcggcctcctgggcagcctcctcggcttcccgtaggcgatccgcggcctctcgccggtcagattcccgcctccgggcctctgcggccgccggatcctcggcctcagactggccgagcttggaatggcgggagggacgcgacgggatctcgctgaaacaaaagaaaagaccagatgacgaacaagatgggtgagtgaaaactcgcgttgaaagaatgaatacagccacgatgggtgagagacgaacctgcgagggggtcggttaaacgaccactttggaggggaaatgaggtttccccgagatggttctgtctcccccatcttgcggggccgcttcttcttgcgctcccccttgggctgcgatgtcggcgcggccccctccgggcgcctgctgctggcacgcgccgccccgccccctcggggaggagatgggggaggtgatcctccctgcttcctcttcccccgggcatcggcagggcggctgctccccgggcccctgtcgcgggacccagaagcacgaccccctcccggggtagattgttcccccttgcggctcccgcctgcgccgtcgtggccctttggagctcgctcctctgaggccccgaccgctatcataatggtcaggatggaggcgcggtctggatcgctgcagagggggaggattccttggggaatgagggacgcctccacggagttgagattcagcacccgttggaccaatatcttgaagtcctcaggagcccagtcccatctcactccctggtgggtcctcatgaggtcttcggacccggtgtactcccaggcgccccgagcgcgccgctggagcggcgcaatccgacgacggaggtagtcgccgtacaccatggcccctgtgagcccctgggatcgcaggcccgccagacggtcgaggacggcgtcatagccatcccccagatctaccggcgcccgccagctggaagcctgtgccgggggctggctcggaagtcggaggcgcgcttcgtcggcgaggggggtgtagaaccagtcgctcttccagtcgtcccacttcttgcggagggcgcaggggatgtagcggttcagcaccggcccccgtggctggaagtagcagccaccaactaccgatggcggcgacaccgactgcacggtgaagaaccaccggaacagccgaagagatgggcgcaccccaatgaacatctcgcacagatgcgcgaagatggccagtatcatcaccgcgttgggggtgaggtgcgccatctagagatcgtagaactccagaacatccatgaagaaagaagaaaatggcggaaccagccctgccattgcaaaggggagaaagaagacggaccgccccgggtagtctggcgccgggcgtccctcgcccagcgtgactatctcccggccggtggcagattccggcatgaagcgacgcggcagcccagcctgcctctcgctcacgatgcgggaaggcggcagcacgctaccatcgagcagagcggagccccatgccatggcgccggaggaagaggagattaagagcgagtgcgtgtggcgaaggtagggcacaggaaagaaggagttagggcgcaagcggcgaagacaaggggaataatggcgaaaggaaggaaacagatcccttcctcagtgcctttatactcttgccaacgctgtgcccggctcctcgcttctcgcgcccactatttcgccccctcgcttctcgcgcccacgcttccactaatcccattcgcccgcttgcggcgcatgaggtggatatgcggttgtggcagtcgagatagatcatatcgtgcgcgcgttaattacgctcgccgaccgaagcgacgttaccatatctccagacgaaacgaatcgtcatgtccagattcgtgtgctactcaagtaatgtggcagtcttgaagagaccgctcattattgacagccgagttaccattgccgatgtgcgtgatttgtgaccgttgggtttctgcccaattgtggagaccggtcccacctgtcaccaggccttaggagtggcgtcacgcccgaccgcttcccttgaggagggcgatcgccctggcataacgccgggggctactgtcggtgacatgggaccgggggtatcatgactagaggcttgaggcagacacaatcgcccacgtggcctggcaccctcgggggacgtcgggcccgagggtgatgtgttcgccctcctcttagtccccccgagggggtcgggccgcacccgcctcggccccgagggccgaggcgccccgacccctcgtgggtttttgctccgcgtgtatgggttaggtgagcacagtagggctcacctaaccacatttattgcggtttggctgagcgtgtcacgccgcatgtaacgcagtgcagtgcactcatttatccggtctgtgaccagtcacagaccggtcaggtcgtgggttaggtggcgacaggcgatctgacgcacgcctcgccccatcccgtcaggacgagggcttctaggcgctcgtccccagctggagctagcgtgttacctcccagagatggcacgttagtcctggtcagatatatgccaggattcatcctaaccattacaggcaagatgttgtgtgaagaagggcgaacatgcagattgttaaactgacacgttgtcacgcccggaatttctatccaaaattccaaacgcttacatgtgtgtgaaccctcgtccaggaatcagccgaggcacacaataacaaattgataatagagtacaaatattactctaattaataagcgaataaaatgtcattacagaggtagatagttcctctcaatcaataaagttctagcagcggaaattaaataaacggcgcagacggctccactccacaggcagcttgaccaaggctacacctaatcctccacaccatcagcctcaatgtagaactcttcctctgatgaatgattgcaaggtgagtatatgacatactcagcaagccacgcagcaaatatgcaagtgcacaggataacaaaggatggcataatagggttccatttgcaaaagcagcatttagcaaacatttgagaatttgataaaacagttaagtaataattaagcaatattaatccaacgctatacaacataccctgttgtataggcccaaccattctgaacaaccaccccggctgcacagttctatctccaaaccaggaatgtaccattccaaaccaggagctaatcaaattattaccagttatagcatcttttataatgatgagaggtgtgagactaatcacgaaagacattgttagacccgcccataaccgcgggcacggctattcgaatagttttactctggccagaggtgtaccactgtacccacaagacacaaccccacatcatgtcaccatgtgcctcaataccaccacggtatctcggaaaggagttgtgacaatacccctcgcataacacaatccactgcagcgcaccttcctggatcataatcacccccttataaacaaggcatggactccccagcgacccccgtgggcttatctccgccacttctcagtctggtgccccgcaatgaaccatgctatacaaaagataaagccgttgcccatgctggcttgtggttggcacgataaatgtttcacaaccgaaactcgtgaaccggtccttaattgtcatgagcacgaccatcaaaaccatgtgctcacaacccaccattaccaggttttagttggcacattaattaattaactaatcacaattgaccatcgtgaactatcaataagccatcatgaaataatagtgagtcattagttatcccataagtgtactaatgtttctaagcagggctaagcaattatatctaatatctagttgaaccaatataaataaagctcaactagtcaaattaatataacccaaggtatcaaggaataaggtaatcaagtacgaaagggccataacaaagaataggtcaattccacccaatgacattcgaaaatagatgcaatagttgaatagaaacaatagctttaaataggatcaacatgctcaaagggttgtttgggatctgtgtgacttgccttgctggccttggaactcttcaaactcttcttccgcgaaaacggactctccggaaacgacggaatctaagcagaaaagagcaaaatcaccaaaacagcacataaacaagcatgaacagtacatgtggatatttttaatgtgtagatctcaattttagaaaaatttagagacttgaaccaactaaatcggagctaagatgaattagttatgaatttttaaagattaaatcggattaaaacacttaaatcggtttaaaattgaattatgacgcaataatgaattatttttgaaaaggaaaaggggatttattgcgtcagcggctagggtttgggtggaccgggcgcacgggcggcggttcacgcgaacggacggccgagattgatccgatccaaatcggacggccgagattgatcgggtccacggcggttcacggcggacggccttgatgacgccagcaatgacgtcaccgacggcggcggcggctcggcgaggcagacgactcgagcggcgcacgctcaccggcgaacggcggcgctacggcacgaacggaggacaccaacgggtagcggacggcacggcgaactcaccgacgaccaaagcgacggcggacgaccaacggacggcgacggcgacgaggttgaaacggcggcggtcttcggcttgacgacggcgacgatgctccggcggtctccgacggcagcgaaagagcggacgaggacggcgacgacttggcgacgacgacggcgaccttcccgagcgacggcgacggctggaacgacggcggcgcacggctggagcggcggcggcgaaggcaaagctagggcacacggcgctagggctactccggcgacgagaggcgaaggcgagggtggcggcgagaagagaagagcacggggatccttttaaaggggctcgggggcggcggcgaaggcccacggcgacggcaacggcgaaggaaactcgcggcttggagagaggaaagccgatccgattcgaactcgaatccatcgatttccaaaccgatttagccgaagtttccaaaggagaaaaggtagaggagatcccggagatcatttcccctctatcaattcagccggaaacggaaaggagcggccggattggaaagcggcggcgacggcagctcggcggcgcgaaactagggtttcggcccgagaaagacgacgggcctgacaggtgggacccacctgtcagcggctgcgagggcgcgcgcgcgcgggcggctgcggactgggccggactgggccgagaagagagagaaggcggttttgggccgactttcggcccaaagccaaaagaagactttttaaaactttttcaatttaaattatttcttaaatgcaattccatttattaaaaatacttccttagctcaaataaatcccagaaaaatctaggaattatagaattaagcaaagtatttaatgaaattttatctggcccaattttatattggaatttattaattaaacttagattttcttttcaagacttttaaaattatttctaaaaattccatttaaacaacaatttatatattttgaattttcagggtgtgacaaacctaccccccttaaacagaatctcgtcctcgagattcggaagaactgacaaacagatacggatgagctgacttcaattcatcttctcgttcccaagttgattcttcttccgagtgattactccactggactttgcaaaatcggataactcgattcctggtccttctctcacttgtttccaagatacggatcggtttctccacataggtcaaatcctcttggacttctatctgttcaagattagcttcttcggtaggtacccttaaacacttcttcaattgcgacacatggaacacattatggactcctgccaaagattgaggtaactctaactgataagcaacctctcctcttctactgacaatcttataaggtcccacaaaacgcggtgccaattttcctttggtctgaaaacgatgaactcctcgtagaggcgtgacacgaagatacacataatctccttcttcaaaactcaaatctctgcggcgattgtcggcataactcttatgacgagattgagccactcgcaatctttcctgaatgatctttaccttttcttctgcttcccttaggatatctgtcccgaaaacctgacgttctcccgtttgatcccacaaaagcggagtgcggcacttccgaccatacagtgcttcgtacggagccatctgaagactagcttgataactgttgttgtacgaaaattctgcataaggtagattcttatcccaacttccaccgaaatctaaagcacaagctctcaacatgtcttccaaaatttgattcaccctttcagtttgtccgtctgtctgcggatgataagcagtactaaagttcagcttagaacccatctcttcttgaagtttcttccaaaaatttgaagtaaactgactgcctcgatcagacactatcttcttagggacaccatgcaaacacacaatccttgccatatacaattccgccaagcgactaccggaataggttgtctttaccggaataaaatgagccactttggtaagtctgtcgactatcacccaaatagagtcatggcccgatgacgttctgggcaaaccagtgataaaatccatacctatttcttcccatttccattcaggaatcttcaaaggttgcaacaaaccggcgggtttctgatgttctgccttgactcgctgacaaacatcacatactgctacgtattctgcgatttcacgcttcatacttacccaccaaaatctttccttaagatcctggtacatcttagtactaccagggtgaatggagtataaagtatcatgagcttctttcagaattgcatcctttaaatctttgttgtcggggacacagattctctcacccaaccatacagttccgtgctcatcctccaagaaaccaatagcttttcctcttctcatattcttcttgatctcttgaatatcaggatcattaatttgggcttctctaacctgatcaattagagtgggcttcgcttctaaggctgcaatgaaacctctaccgacaattcccaaatttaatctttcaaattccttgcataattccaatggcaactgtcgtccttctgtaacattgcaatagctttttctgctaagagcgtctgctacaacattagcctttcccggatgataatgaattcccatgtcataatccttaattaattccaaccatctccgttgtctcatgttcagatccggctgagtaaagatatactttaaactcttgtgatcggtgtacacttctgtacgagtaccgaaaagataatgacgccaaatcttcaatgcatgaacgactgcagctaactcaatatcatgagtagggtagttcttctcatgcggacgtaactgtcgagatgcataggcaaccaccttcccatcttgcattagaacacaacctaacccaagtttggatgcatcacaatacacttgaaaacccttctttggatccggcaaaatcaaaattggagctgatattaagcgacttttcaactcttgaaaactccgctcacattcttccgaccacttgtacttcacatctttctgaagcagtcgtgtcatgggcttagcaatcttggaaaaattctctataaacctccgataatatcctgcaaggcctaggaaactgcgaatctctgaaactgtctttggttgcttccaattggttacggattccacgttactaggatcgacggcaactcctccggctgagatgacgtgaccaaggagtttcacttcggacaaccaaaattcacacttgctaaacttagcatacagttgatgttctcgtagcttctccaatgcaaggcgaagatgttcctcatgctcttctttggttcgagagtagataagaatatcatcaataaagaccaccacgaacttgtctaagtattccataaacaccttattcatcaagttcatgaagaaagcaggggcattggtaagtccaaaagacataacagtacattcgaacaacccatacctagtggtaaaagctgtcttaggtatatcttcctctttgattctcaactgatgataccctgatcgaagatctatcttggagaaaacagtggctcctttaagctgatcaaacaaatcatcaattctgggcagcggatacttattcttgattgtcacatcgtttagtgcacgataatccacacacattctctgggtatggtctttcttttccacaaaaataaccggagctccccatggtgatgaactcggtctgatgtatcctttctgtagcaaatcatctacttgcctcttaacttctgccaactcattggctgccattcgataaggtctcttatggatcggagttgttccaggtaccaaatctattctgaactctatatcccttttaggcggcataccaggtaaatcatctgggaacacatcaggatactcccggactataggaatctcttccaaagttatctggttcagtcttgaccttaaagactcagatgacaatgcatgaacagttacaactcgaccatcatagctgttgagagttacttttctgttggcacagtctatcacacctttatgtctggctaaccagtccatccctaggatgacatcaaggtccttggattctaacaagataagattggccagaaatggtactccttgaatttctattctgacagaggggctacgttgcaaagagagtgcttgattacttggggtactaaccatcaaaggacgtctaagatcttctacttccatcccatgatttcccgcaaaactcatagataagaatgaatgtgtagcaccagaatcgaaaagtactgttgcaggaactgagttaacaaggaacgtacccaaaatcacatctggagcatcttgagcttctgcagccgcgacatgatttacacgagccttggatgctggtacagcagagttattctgggcagggacaaccttcacgcgtcggggcttcggacacttgtcagcataatgtcctggatctccacagttgaaacacaccacgggcttgttgccttgctccctcttggcaggttgttgctgtgctggaactgcaacaggacgtggagcttgattacggatattgttgccagcattgttgttgaagaactgacgttgcggacgaacaacagacgaagaacatccctgtggcatggactggggtcctaaagtaaggcgcggcttctgattatttccctgttgtgtcttgaattgagcaatccgacgtttcttctgctccatgcgattgtacttgtcctcctgacgaatagccttatccactaatttctggaaatcaggataatctccaaccataagtgggtaagaaagctcatcattaagtcctcccaaaaacttctcctggcgttcttcatcattgcgcacatcttccggagcataacgagcaagacgattgaactcgtgcagatactccgtaacagagcgagatccctgagtaagcgacctgaactccttcttcttgagagacactactcccgatggtatatgcgtcttccgaaaagcagcggtgaattcaagccaagtgataggttcagcagtagtcctgttaaggcggaagtgatcccaccattcagaggcagggccatgcaactgatgtgatgcaaatgagaccttctcctgatcagtacactgaagtaaatccaacttcttctctatggcatgcagccaatcactagcttcaacaggattagtggtactagagaaaacaggcggcctcacacgaagaaattctgctaacttgttctgtggaggtgcatgattattcccttggttttgctgattctgaaattgctgcatcatcatgtgcattaactgagtctgttgagcaagaacttgagcaagggttggattctctccattgttgttgttattggggttgttgaggttaggaccattcccgttgctgcgagtgttcaccatctggcatggacaggataagaagagaaaacgggggaaactacttaggacagagaattactttaacttttattgatcttaactgagtttcattattacaaactgaagactctcacaccactaaactcaccaacttcctaacactcagaagcaaacaaacgcatgcacttacatcccaccactgatgtaaataacatgcaagacccacacacacaaacaaacttaaaacaagcaaactaacacaacgatctaagacaacgacttaacaagtcactctagttcttccgagcataggaggtcgattgaaggctcgttcggctcatcttcctcatctttgatagctacccactcaaacttggaattgttgcgcttgggttcttcttcttcatcactacttatgatgatgacgggaggatttgctggggcaacttctttctccaccacgcggatctttggcgccaattgataacgagggacaaacaaagctctcttccttgcggtgagacgaatcctggccttctgcggcggtgcttctcccttcaatgcggctaattccttctccaagcgatccaccttgtcttctagcttgcaaatcttaccacgattccgatcttcacgatcttgagctgctaacacagtctccgcacgactttcatccatagcccacagcatctcaaccaaatgccttgtagtagcatcattctcaattccttcagtctcaaggtaactgccacggtcacttccctgtggttgacgaggatggtagcgatactcagtgtcggccaactgatcactgtagcgatcacggagctctcctatggcgatccttgccacttcctgacatgcatggatataatttcttcctccagcttcgaacatcactgatggaatatcttcactattgctgtttaaggtgactttgacacggcacctctcttcatgacgatcatgacgaatctgggcataaaaaggggcagtcccaaatccaatgacaaaggacatcttacgcaactcctggacaaaaccctcaacaccaaacaggtactcaggcttgtaacgcggcatctaaagacaagtgaaaggagggagttaagacctttatccaattaatagcacaagtttttggattaatttgaataaagttagaaaatcagagtaaaaaggtaagtaaataaagtaaaccaagctttgcgaaataaattaaaacatttggaaacgaggtcacaaattttgtaattttgaataactggtttcaaaagaaagttataaaatcaacatactaaatttattttattgcagcaagattaaataaaacagtattgtaaaacttttgctagtaaatgagccattagtacagtaatagatgtacagtactaataacactggaataaattttgaatgagaaccattaaaggagattatgaagtgcatgtgccattagtttggtttaattaaaagagaaagggaggagaacagttctacttttccaatatttttcagagggcttctatgggtaaccatttggcataacctagggtcaaagaggctctgataccaacttgtcacgcccggaatttctatccaaaattccaaacgcttacatgtgtgtgaaccctcgtccaggaatcagccgaggcacacaataacaaattgataatagagtacaaatattactctaattaataagcgaataaaatgtcattacagaggtagatagttcctctcaatcaataaagttctagcagcggaaattaaataaacggcgcagacggctccactccacaggcagcttgaccaaggctacacctaatcctccacaccatcagcctcaatgtagaactcttcctctgatgaatgattgcaaggtgagtatatgacatactcagcaagccacgcagcaaataagccaggggcccggataaccaaggatggcataatagggtcccatttgcaaa

SEQ ID NO: 74078 - DNA, 1246 bp, Oryza sativa
aagcatgttatttccatcaatatccctcctaatcattactggagttgcctttctggctttctttattattcgtcgattattttatcagtcctccttctattcgactattacttttgttctcgccgtggctgccttgttcatagagctatggcaaataatctctggtgtgtgttctaactggactaagctggccttgctccaataccatatcaaaaggaatggccatcaccgatgttgtctcatccagaaagcactagccatggtgctgcgcttccgtgctgtgcagcggttcaacgacaaaatggggcagaactcggtgctgcagcctcgtcggttccacaatcctccaatagtgttgccaaagaagatggttcatcgtgcaagccttcacaaatccgccaatgtcccaacacaagtgaaggctgctgtcttagcggcactaaagagaagtaatggacggctcagcaatggcgtggcagccattcagcgtagcacactgcgtgatactgtcatctggtcttgccaaggagatcacatcgtcactgccaatgtcatcctcgtgtggcacatcggcacaagcctttttgagatgaagtacctgcggatcaaatcttctccacggactgctgatatgatcaccgccacccatttgtcgcagtattgcgcatacctagtggccgccgtccccgagcttcttccgaacgacgctacatggaccaaggcgcactgcaaggaggtggcgagagacatcaagaaagctctcgatggagaaggaaatgactttaatcattttgtcgatgctcttggtgcgagctgcaggcacaaagttttgcagcaagggtcaaagctggcgaaacaactggtaggagaagttggaaggctcgaagacggagaaggagagaccaaaggcgtaggcgaggcagcgttgtggaagctcctggcagagttctggtcagagatggtgctctacctcgcaccgtcagacaacgtcagaggccatgccgaggctctagctcgcggtggtgagttcatcacactcctgtgggcgctgctgctgcatgccggcatcacttcacggcccggcagtgtcgccgagccttgagcccggcaatgtcgacgaggcagccgcaggtgatatgtaccgctgcgttagttgtacgtttttcaagttctatgtattcgcagcaaacattcgctcttttgagctaactgtagctgttagtgtcattgagaagattaccatgag

SEQ ID NO: 74079 - DNA, 1091 bp, Oryza sativa
tgtagccttcatttgccctgaagatgtccatcgacccccgacttcgtccatctccatccgtgtacttttgtttataaccagactgagccacaaactaagccttacccactagacatgtggaagtacggtagtgctttgcaacagaggcccgaagaccggtccttatatggcgaaggtgctactatcaaaaccatgcaccccgagcccagcctaaaaccatttttggggattttgaatagggggggcggtgtgaatccaattccacaatactccaacaattccaaagtgtccaggtgaaatgaatatcccaaagtctagagttgtaaaaccacctaatgttacctaattaaatagcgaagcatctacctaaaatcatactagtggtaccatgagtagagtgtccactagttggggttttgtttattctagggtgaacaaggaaataataacaatagcaataataaggtcataacaaaggtaaataggcatggctagataaaacagtgataacgcgggaatttaaataaagcgataatgcaataatttaaatcaacataattttataaactgggattcaatatgttcaaggatgatgtgacttgccttgctcgctttcccaaacgtcggcttcaacttccacgaagagcggatcttccgaagctgcagcgtctacacgaccaacggaaaagaaaaaggcttttactctaataaactccatataacaagcaggaacaaagcacaaaaatgggttcttgacttcttaaggaaaaattagagacttgaacggtccaattccgagttcaaatggccaagttatggccatttgaagtttatatgctctttaaatgaatatttacgaatttcttcatttaaattttaattaaaaaaaacccatttattgcgtcagccgagggaggggacgcgcggaccgggtccacgggggtggggcccacgcgtcagcctctcggtccacagtggaccgggagcacgcggctggcggcggccggcgccgtgggtcccacgcgtcagacgcacccgcgggcgcgggcggctgacggccgggcccactttgcagccgcgagggcgcgccc

SEQ ID NO: 74080 - DNA, 17914 bp, Oryza sativa
catctagataaaatattgtggctagattaccattgtgattagcctaatgacctacttggcttagttatttatgccttgtttgatatctagcatgatagaatttatgagtttttcttgtcctatcatgtcgcaagtaggttatgcttgctgtatatgctttcaaataataatgcttggaataaaattaatggcttagtatgtattatttccaacattccagaaacctttagaaccattggtcatggctgctcatgctgttgatctgatgaggcctgagaagtttgctggtgaaaactttaagcgttggcaatccaaagttcgtcattatctggtgtcgcagaacttgtggtatgttattccacaagtgaggccgctgacccaacagcagcatgcggactttgagaccagtaatgatgtggctttaggtgtcatgctttcgctcctgtctgaccagctctacgacgtgtatggtgcttacaccagcgccgcagagctatgggaggcactggaccgtaaatattcggtttcagatgcaggacgttggatatatgtcgtggagcaatatcatgactttaagatgattgacaaccaatcagtggtgaagcaggctcatgatcttttaacgattatgggtgagatgtctcagtttggtgctattgtgaatcctaagtttgtggtggggggcattattgccaagcttcctccattttggagggattttgccactgcacttaagcacaaacgggaggacatgatggttgatgacctgattgccacctggatgtggaggagaaggcgcgtgcgaaagacacgccgactatggcacaagaagggacatcaaatgccaacctagtgcagaagtcaaatgcaaagaacaagggcaaacaagcagtgcagaaccataaggccaaaaacacaaccaattttaagaagaaaattacttgctatgtttgcggcttggaagggcacaaggccaacaaatgccgtgacaggaagggcaagaagaatgttcagcaagggcagaaaattgccaacatggttgtgagcgaggctgggtcttcagggtatgattctactcctgttgcactttcagcgtatcaatcctttgattggtgggttgatacgggagctaacattcatgtatgtgctgacattaatttattttcttcatatcaggctgcaaccggttcctccatcttgatgggcaatggttcaggtgctgctgttcttggagtagggaaggttgatctgaagctcacttcagggaaaatcatctctttgaagaatgtgcagcacgtaccatcaataaagaggaacttgattagtggctctctcctttgtcgagatggctataaattggtttttgagtccaataaagttgttatttcaaaatttggtttatttattggtaaaggctatgagtgtggaggcttgttccgcacatccttgttagactcctcaaataagtttgttagcaacattctcagtaattttaataaagatgctgttgtttggcattcaaggttatgtcatgttaattatgatagcatttcacgtatgagcagcttgaatttaattccaagcttttccatagtcagaggttcaaagtgccaaatttgtgtgtaagcaaagcaacctcgcaagccatttaaggcagtcgaggaaaggaatttggcgcctttagaactagttcattcagatctctgtgagatgaatggagtgatgactaaagcagggaaaagatactttctatcatttattgatgatgctactaggttctgttacttgtacttactaaaaactaaagatgaggcattgagctactttaaaacctaaaaggccgaggctgaaaaccaactagaaagaaaaattaaacgtctacggtcagatcgtggtggtgaatatgtgtcagatgagttctcccaattctgtgcggatcatggaataattcatgaaattacaccttcctattcaccccaatctaatggggtcgccgaaagaaagaaccgcactttgactgacttggttaacgccatgttagacagtgccggtatgtctaaggcatggtggggggaggctgtattaaccgcctgtcacatcctaaatagagtgcccactaaaaatagtgagatcactccatatgaaggatggaaagggagaaagccatcactatcatatttgcgcacttgggggtgcttggcgaaagtcaatgtaccaataacaaaaaagcgcaaacttggaccaaagactattgattgtgtctttctaggatatgcacataatagtgtggcctacaggtttttagtagtgagatccgatgtaccggatgtaccgataaacatggtaacggaatctcgtgatgcaacattttttgaggatatttttcctatgaaaggtacaggaacatcatctagtcgagcaaattcaacacctgaatttcctgtatatgtagaacaacatgaacatacacatgtggaggatgacaatgaaatggctctaacaaggagcaagagaccgaggattcaaaaatcctttggtgatgacttcattgtgtacctcgtggatgatgtgccgaaatccatttcagaggcatatgcatcacctgatgcagagtactggaggatgcagttcgtagcgaaatggattccattttagctaacgaaacttgggagatcactgatcgaccatttggttgcaagccagtggggtgtaagtggatctttaagaaaaaacttagacccgatggtactattgaaaagtacaaggtaaggcttgtggcaaaggggtacacgcaaaaggaaggcgaggatttctttgatacttattcacctgttgctagacttactactatccgtgtgcttctgtcgctggctgccttatatggtttcgttgttcatcaaatggatgtgaaaacggctttcctaaatggtgagctagatgaagaaatctatatggagcagcccgatggctttgtagcactcggacaggaaggcaaggtggttaagttattgaaatctttgtatggcctaaagcaagctcctaagcaatggcatgagaagttcgatcgaacattaacatccgctggtttcattgtaaatgaagctgataagtgtgtgtactatcggtttggtgggggagagggtgtgattttgtgtttatatgttgatgacatactcatatttgggaccaatattaatgtggtgtctgaattaaaatcatttttgtcccaaaaatttgacatgaaggatttgggagaagctgatgttatttcaaacattaaattgatcaaaggcgaggatgggattatgctttcgcaagcccattatgtggagaaagtcctaactcgtttcgggttgatggactgtaaaatagctccaacgccttatgacccaagtcttaagcttcgaaagaacaaaggactaggaaaggatcaattgagatactctcaaatcattggctctctcatgtatttggcgtgtgctaccagacccgacatctcatatgctgttagcaagctgagccggtttacttctaacccggagatgatcattggcaagcactagaacgcatattaagatacttgagaggcacaatgtcatatgggattcactataccgggtaccccgctgtgcttgaggggtatagtgactcaaattggatctcggatgccgatgagatcaaggccacgagtggatatttgtttactcttggtggtgctgcagtttcatggagatcttgcaaacaaacagttttgacaagatcaactatggaggctgaacttgtagcacttgacacacccactgttgaggcggagtggctgcgtgagctcttgatggacttaccggtaggtgaaaaacctatcccggcgatccttatgtactgtgataaccaaacagttctcataaaggttaagagcacaaaggataatatgaagtcctcaagacatgtgaaaaggcccctaaagtccgttagaagtttgagaaactccggagtgattgctgtagactatgtccaaaccgcaaaaaatctagcggatcctttcacaaagggattatcacgaaatgtgatagaaaatgcatcaagggaaatgggattgatacccatgtgagtcacacaacagtggtaacccatcctatgtgatcggagatcccgtgaagtaggtaatgggtaaaaacaaactgttgggtgacaggagagtacaaaactttcttacccgttcctgtcgaagatgcagtactctcattctgtatggtagggtgacatatgtcttaatgtgctctgaggttctcttagagacgaggtactgtcctacagggtacacttggaatagcacacctatatgagttaactgtggggtcgcagttttgagacatgggaactctctaaaaactcatgaaaagacacaggggcatgaccgataaacgccccaaccagaggcttggttcctggtggcctcgtatcagtaatgacttcaaaataaacttgtctacggaaagctagcaattcaaggtctgtccattgtctagctgtagatgggtggaacttaatgttctagacagtatgatcaacccttaatgggtctactgttgaaacgctggtatacaaacaacaaatggcagtttgtcgtaattaatcgaggactcaacatatggcattgaaattggtggggattgatggaaataacatgcttggaaacattgatcatttcatcaatttaaatgcctaatgcttagccgcacgatcagcatgtgttggatgacaagatgcttgcatacaacaacctctgctgatcgagtcaatcacctgaagacttggttctcacgtgaagagagaacgtgcgcttgtggccgtttggcggctgcgtttctcacggagccgatccggctttgacgcggaggagcaacggattgagcgtgggctgccgttcagtgttagctctatataggagtcaaggagacgtctttgaaggacacagaacacaatagccatctactctgaaattcctcaactgccgtcgtgttgcgtcgccgtcgatccaagccgaccgtggtgctcatcgtgcaacgagcattccggcgagcggtgtctccgagccttcgccgcattcgcacctgcacgggggcggtgtaaaggtttctgggcagcgtatttctacgcggccgctcgacatcatcgattgactgcactgcttcaactcgctgatctccgtcgatccattcagtgagtgaattctttcgtttacaaaggaaaggaaccagtgcatttctaatctagttttgttcgtacctgagttttgtatatgcatggtactgttcatctagattaaaatattgtggctagattaccattgtgattagcctaatgacctacttggcttggttatttatgccttgtttgatatctagcatgatagaatttatgagtttttcttgtcctatcatgtcgcaagtaggttatgcttgctgtatatgctttcaaataataatgcttggaataaaattaatggctaagtatgtattatttccaacagatataaccaaattgagtgtttcaagcgctcccccaacgaagtgccaataaggaagacaggagtagtaaaattcatttgcaaaggccagctcattaataaggatttggaacatgcggtcatggtcgttggcatcaccgagcatgccatggagcacaaaaccaagagccctttgggaaccatcctccactaagggatgtccagcaaaacgccgtctcaggctcttaaacaaggagaatgataggcaaagctccttgagtcctgactgagataccaatagaggatcaccggacaaccacatgttccaaatccggtctgttgttaacaacgtaaaggaagtagtagtgcccagggaggagaccttgatacgatagccatctggggttttctctaagtgctgcttctcttctcccatagttatgtaaggaggagggcttccattgttgtctttctcattatacacctgcgccatataccccgagatgaccttcacatttcggccaagagcaaatgagcacctcgctctctgaaaggcagccaatttgaccaaaaccttaatattgcagagcgcacatagaggcagcatgggacaaaaaagtagcaagtagggccaggtgtatgacaccagccttgttgtccatatagagtagtagtagtataacaccagccctgttgtccatatagagtaggcagaaagctccacaaaagtccgggagatgcttgtaccaccaagaagtgatcggccgtcggtagacaccgaaaggaaggccgtgtcggtattgatcttgatgatttgaatgaggacactccatcgaatgagggatcttgtgaagaaaaaaggcaagcactgcacaccatcaacaacattgtacccatgataatcaactaatcatcaacacgacaagcatcagataggtaatattggattttttttttgcctgaaatttctatatgaatgtaatttgttcagataatgtaacttgttttagttctgggttctttaattggtaagactactatctgcacgagggcagaactatactgttgagaaatctagctactatcactgaattaacggttggaaatacctgttgagattcatggttttggaaggagtagtactggggatatacatgagggcagacgacactttgagctttcaccttcgacatatagtgtgatatgattaggctgtaagcggaatgaacactacggaggcgccccactggagaaaccggagtgccggatggcggcaccggtggccgtatgtgataagcgccacctgcagcacggcgaggacgccggtggaagccattaaaagagagacgatgaggtactgaccgtggatgaatacgcttagatccatgatgatgatcagcagctacaataaatggctagttagctaagtggctttgcaagctcgaccttaagctagctcattccgcttccagatcgaacaggttggtatgtgtactgtttgaggggaggctgagcctgatattccttctgtccgttcacgcggaccacgcctttctctcgatgaacactccaaaatagtactatagtttccaggaaacttactttacaaatgtcatgatgcatctcctaatcgccagtaaataaatagagtttaggcccctttgattcaaaggaaattcataggaattttagatgatctcattcctatagaaaattttcctatatagccatttgaatcaaaggaatggatcttatagaatctgtggagattatggataccccatacctacacggcatgtatagtccgactgggtatggggtgccatgtatagatagaatatctttaagagaactcgggttaaattctaaacttgtatgtcaaggaaatatccgagatcctagtcggtcatgattgtattttatttgtaactacatattccgttagggatatggacggtattttgtaatacggaccccttcccctatataaggaggggtctgagtgcctctaggggcacgatttcctcccagatcatacgatcaataatacactcggtggatcaatccccggacaggagtagggtattacttcttgattaagaaggcctgaacctgtataaaattccttgtctctaaacccatccgcttttccagcttgatagccaccccttttagtattgccgaaatcttgtttcgacagttggcgcgccaggtaggggtagcgtcaagttcttcgccgactagtgcgatgggtttcgtttccggcatcgacgacttcatcttccctcctgggcaggcgtttcgtttcggcagcctcgacttcatcaccaacgacttcggcaagatttctctcctcaactcggattcgaaccagtcgggaagaggccagatctccgctccgttcggtatcccgaactcgcccgagatctaccccaagatcatctctaccgagttgacttcaaaccacttggacgagatccaatctacttcaaaatgacccgatcaagacaatggggcctatccgccaatcctgatgaaactccccgatgatttggctgctgtcttcaccacaagggcgtcttctccccgtaggcctaggcgggatccggcttcagccccggttcggcctagctccagggaagtcggcgtcatactccagccactcggcacggtttcgacgaaacaactggacggctacctcagctcccccggcgtcgactcgcgaccaacggagatcgtggagtacgacgacttcggctaccgctatgactaccgcaacctcaacgacttcgacgaaggctttgaagacaactacacgcctctctacttcggcatcttcatggctgacaacgagatggaagaatagcgcaaagcccgagaaacagaagagctacgcgtacaacaggaagccgaacgacaccgactagaagaggagcgccaagcacaagagcgagaacggctgcagcgtgaacaacaggaacgcgaacgggctgcaaaggaggctgaggaccgacgacaacgggccttggacgccgggcgacgagcacgagagcttatcgggcagcaagacgtcgagggaactgcggtttttcgcacccctcaacagaacgcggttgcagcgatcaccctcctcgacaccctcctcaaggaagacacactcaatcaagctaatcacgtcgtcaacatcttgaaccagaccaagaccatgatcgccgcctcggtcccggttaactctgcaagcgtctgcacgctgactggcagccgagttcctcatcttcgatctcaagactatcaccaaccgagcctcagcgtcgccggcacgggatccagtcgcaggagcaggggtcacgacgagcgatctgtccattcacctcccgaacggcacagggagcaccgagttgaacggcgacgctacccacctcgcaggcgccccgtcgatcttcacgatactatcaaccagcgtcgcgcggcacaaggctacgcaccattcaccaaatcgctacgacgacgacgtggatggagtcggtgcctttacaagtgacctgtgtcgagtggattggccagccggcttcaagccgactagaatcgagaagtatgacggcaccactaatccagagtcttggctcaccgtctacggtctcgcaattcgcgcagcaggaggagacaacaaagccatggcaaactacttgcctgtggctctagcggattctgcccagtcctggcttcatgggttaccccgtggcacaatcggatcatgggcggaacttcgtgaccacttcatcgccaacttccaaggcacctttgaacgccctggtacacattttgatctctacaacgtcattcagaagtctggagaatcccttcgagattacatccgacgcttttctgagcaacgtaacaagatctccgacattaccgacgacgtcatcatcgctgccttcaccaagggaattcgtcacgaagacctagtcagcaagttcgggcgcaagcctcccaagacggtcaagcagatgttcgaaaaagccaatgagtatgccaaagccgaagatgccattatcgcgtccaagcagtcgggcaccacttggaagtcgaagaaagatacgccgactacaggagggagtggaagtgctaatcacaaggatcgcaagcgtaagcccgaggaacttgtggcaactacaacactatcctcccgacaacgttcgcgcgtcaacacttttgacaagatcatcaactcccaatgtccgcatcatcccaattctaatcacgcggccaaagattgcttcgtctacaaacagtttgcagaacaatacaccaagaacgcacgtaaggcctccgacggagatcaaagcatgtcaaagaagaaggatgatgacgatgatgtcccgactggttttcaagaccatcgcaaggaactcaaccacatctttggcagacccctagcttatgaatctaagagaaagcaaaagctgaccgaacgggagattaacactgttcagcccgatacgccccaatatcttcggtggtcggagacaacaattaagtttgaccactcggatcatcctgaccgagtggtccacccggggcggtaccccctggtattagacccagtggttcgcaacgtcgagctttgcagatccctcatcgatggtggcagtgcactcaacatccttttcgccaaaaccctagacgacatgcagatccctcgcacggaattaatgccgagtaatgcgccctttcacggagtcattccagggctatctgccacaccactcggccagatcactcttctggttactttcggcactcgggagaacttccacacagaaaacgtctgcttcgaagttgctgatttcgagacagcgtatcatgccatactcggacgcccggcgttagccaagtttattgccgtcccgcgctatacctacatgatgatgaagttgcctggtcctcgaggagttatatccctgcggagcgacatcaagcaagccgtcacatgcgacaaggaaagctgcgagatggcccagacccgcgagatcacgctcgcccgaaaagaaattcgactggctgcgtccacagcaagcgaaggtgaagtgcctgcaaccaagatgccgaagagcggagaaagcgacgccaagaccaagaaaattcccctagatccctctgatcctactaagactgctgtaataggcgctgagttagattgtaaataggaaagcgctcatcacctttcttcaaaataataaagatatctttgcgtggaaaccatccgatatgcctggtattcctagagaggtgattgagcactttttacatgttaaggaagacgctaaaccaatcaagcaacaactccgccgttttgcgcaggataggaaggatgcgatcaaggaggaactggccaagctgttagcagcaggcttcatcaaggaagtccttcatcccgactggctggccaacccagtcctagttcagaagaagacgggacaatggcgcatgtgtgttgattacaccgacctcaacaagtcatgccccaaagatccctttgggttgcctcgcattgactaggtagttgactcaaccgccggctgcgagctactcagctttttggattgctactcaggatatcatcagatccgactaaaggaatctaactgcttaaagacttcattcatcacacccttcggggcctactgctacatcaccatgccttttggattaaagaacgcaggagcaacctatcaacgcatgatccagagatgtttttcaactcagatcggccgcaacgttgaagcttatgtggatgatgtagtagtcaagaccaagcagaaggatgatttgattatggatctagaagagacctttccgagcatccgcgctttcaggatgaaactaaaccctgaaaagtgcatcttcggagtactatcatggaagctgcttggatttatggtgtcccatagaggcatacaagccaacctggagaaaatcactgccatcctcaacatgaaactgccgagctcccagaaagacgttcaaaagctgactggttgcatggcagtgctcagccggtttgtttcgcgactcggtgagccggggatgcccttttctaagctgttgaagaaaacagacaatttccagtggggacccaaagcacaaaaagcctttgaagacttcaaaaaacttctcactactccaccagtcctagcttcaccacatccacaagagccgctgttgttatacgtgtcggcaactttacaggttgtaagcacagtcctgattgttgagcgtgaagaagaaggacatgttcaaaaagtccaacgaccaatctacttcgtttgcgaggttttggctgactccaagacaagatatcctcaggttcaaaagctattatatgatgttttaattatcgtcaggaaactatctcactacttccaaggtcactcggccacagtggtcacatcgtttccactcggggatatacttcataatcgcgaagcaaatgggcggatcgcaaagtgggccttagaattgatgtccttggatatatctttcaagccgcgaacttcgatcaagtcccaagctttagccgacttcgtcgctgagtggactgagtgccaagaagacatgcccaaggagaagatagagtattggactatgcattttgacgggtcgaagaggctcttaggcactggagcgggggttgttctaatttccctgaatggagaaagactgagctacgtattgtggatatatttttttgcatctcacaacatggcagaatacgaggcgcttcttcacggactaaggattgcgatctctttaggaatccgacgcctgatagttcgtggagattctcagttggttgttaatcaagtcatgaaagagtggtcctgccttgatgataacatgaccgcttaccggcaggaggtacgcaagttggaagacaaattcgatggacttgagctcatccatgttcttcgacataataatgaggcagacgacagactggctaattttggttcaaaatgagaaacagctccttccgacgtatttgttgaacatctttacgaaccaaccgtaccaaggaaataaacaattaaagccatggacactcaagacgtaagcatgattgaagccgactggagagagcccctcataagatttttgaccaaacaagaactccctcaagacaaggatgaagccgagcggatctccaggcgcagtagactctatgtcattcatgagaccgagttgtacaagaaaagtccatcaggaatcttgcaacgctgcatgtctttggaggagggaaggcaattgttaaaagatatacattcaggcatctgtggtaatcacgctgctgcacgaaccatcgttggcaaggcttatcggtagggttttttctagcccacagctgtgtccgacgttgacaaaattgtgcgaacatgtgaggattgtcaatttttcgcccgacaaactcatctaccagctcaggagttgcaaaccatcccgttgtcttggccgtttgcggtttgggggcttgacatggtcggcccgtttaaaaaggcagtcggtggttatactcacctctttgtggctgttgacaaattttccaagtggattgaagctaaaccggtcattacaatcacggcagacaaggctagagatttcttcatcaacattgtgcatcggttcggggtacccaatcggatcatcactgataacggcactcaattcacaggcggagtatttaaagattgagaaaatccatgaaatgccattgacaagcactctaatcccagaaatgccattgacaaacgcaacttcctcaaaatgccatcgtacaagcgtttttctccctaaaatgccatcacagccagtgctgttaactcctctccgttaagttgtatgaaaagacattcttacccctgggcaacctttgtgctaaaacaacattattttgtattgtttgctcacagaacattattttgaattgatgcatatttaaattcacagacgtgtattattttgctatcaatcaaattatttagaaattaaattcataaattttggcatcaaaattatttcagaaattttgctatcaattatcagggttgtgatatgagcaaaaataggggcatcaattatcagggcaacacacacagaaagtaccaatcatgatcaacatgaattttcacaaaataaagggttcacaatacttagcatcacaacccaatatcacagaaagtaccaatcatgatcaacatgaattttcacaaaataaagggttcacaatacttagcatcacaacccaatataaagagtacttagcatcacaacccaatataaagggttcacagtacttagcatcacaacccaatacaagagtactttgcatgcatgcttaatacatcttagttcagacaatacatgtgacagtaagaaactcaatcaattattctcctcttgcttctagtccccattgctggactactcttcttgcttctagttctcattgctggactgtcctgtggtacttcattattcttcctccttttggcaggtggagtagtaggttgtactgttggggatggttttctcttgattttcttgtctttgtcctccttttcacccttcttccccttaccctcccccttccccttcaccttctacttctccttctccttccccttccccttccccttccccttccccttggcaacaggtgcagcaacttgttgtagtggcacaatggtcatagagctgaaaaaaaagttatttagcaatcaatttaagttggcattaatcaagtgcaatgggtacagtaaaaaacataattggttaccttggtaaggatgggaaaggcacattattagactcaagtccagaatcactaattgtcccaacaacggcactttaaaatcatatattacacattagttaagttgctgcagcctaggagcaataaaaggttaacaaagtggaaagtggaagatagaaatttcaccttgataggctacccaagatttgacttgacatagcagtaggatcaatgttttcagtggcaacagtggcagcagaagtagattttggttttgatttccttttcagttttctacaggaaaatgaaaataagtgaagtttgttggcaaaggaaatcaacatgaagatatggatatagaaatcacctttgttttgccactaaagcataggcctctttggcttctggatctgcttctttgcaacttgtccatctatggccataatttttgcagataggacacttttgctgacatttggtacctgcttttctcttgcccttcttattcccctcaaccccacctttgtgccttaaagttttgggcctccctgcagatctcttcaatattggaggataaagaaagaaatcacgtgtattctttggccactgggaaatgtcagttagagctggaatgcgggctgcatatgtggctttaaatctggccacactatagcattcatcaacataatcatgcacctgcacccccctaatagatgtgatgaagcacaaggcatgagcacaaggctttccagacacttgccactctctacatgtacatgtcttctcttcaagatcaactacatgcctcttaccaccttttgtgaaaaatgcaataataagattatgtccatcaacattaataatgggaattgcaggtataaaaattcaatacgacatacaacataacattacctgggtctttatcagtaacctcggcaatgaaatcatcacttctatctaggtcaaagtttagtcctctacttttctcaagaagctccttcatgacacaaggtagaatgatattaccttccaatttggctgccaccttcttcctcacacgaaatttatccatcaccttttttctaatcttatcaaccaattcgtatggcataagacctttatgctttctgatccaattgttgaagcactccgctaaattgttggtgatgtaatcaaccttagagtgcgtggagaactcgcttcgcatccataacctacaaaataagcaaagacaaaatattacattcagcttcagttcacgtactgaaaaaacaagtattcgactaaaaaagataccttttgtggtgggttttcaagtatgctatagcttcagactttacttcacctattaaagccatatgttcatcgaattctgtaggagtccatgcatatgctgctggccataaatgttcctcaaaaactttgccatggaacttgagcttgaaattggacacaaggtgtcgcatgcattccctatgctctgcataaccaaatacctcttcaatagcatagtcaatgccttttcctgcatctgaacaaattgatagtccagctggttcaccaatagcttcatgcagtttctccatgaaccaaagccatgtctcactagtctccgagtcaataataccataggctactgggtacagccaattgtgtccatcaatagcacatgcagttgctagctgacctctatactttcctgtcaagtgtgtactgtcaattgctaagtatggcctacaacctcctaaaaaaccttgaatgcaagggtgtagtgccacaaatagccttgtgaatctcttcttgtccttgaatgtcatatggtcaatggcgactatacttcctggggacctcttctcgatctctgccttccaaccatatagcttgtcaaagctactatcccagtcaccatacaatttactcattgctaattccctcccagaatgtactctcttgtaggggatggttaccttatgtgtgtccttaatcctccttcgcagttccatggccccaacactagcatcctcacgtagccaccccataaccttatcacaaacccacgctctctttgcattcctgaccttctcgctttttctagtactaagaaaaccatggtacatctcatggaccttaatctgaaaaagaaaaaagatgcaattagataagaaaataacaaaatatgcaatgtaacacatacctgcactgctggaccaccatgaatagttgatgcatgaagcctccatccacatccttctttgatacatctagctctgaatctactaggatcagtttttttaacaaaaaactcgaattctttcttaatggaatattgagccacagccaatctaaactcacacattgaaggataaatagtctcaacagtcatgggtgggttctctttgtcatatgcaacttgtgggattactggatctgcctgagcatctcgtgcaatccactcttcatcatcactatcagtgatactcagatcatctcccccttctacctcaggcacattatcagtttcagcaatagagtcatcactctcagatgaagagtcatcactctccgatgaagagtcatcaataccaactgagtattgtttctcatcatctacacctacatgctcatagtgcgggaatggattttctaggtatgcatcacttttggatgcctgactagtgctgccttcctgagtaaaaaatgcctgagaggggactgaaagtgatggagtgcaaggcacaataacttgggacagattaatttggtttcccagagtgattaccactttaccccttttagtatgatgaaagcactcaaacattgctgtcaagtcctgatctttgcatattggaatgagttctttgctactagcatgaatataatgcaaacattcagtttcatttaaagcccatggattttttcacaaatatcacccagaaaatctttgaagttagttacgtctgcatcaataggccatttgaaagaaaaaccacccggaaattcaggcctacatgtcttgcccattattctcacgtcaagtaaataagtagaagatgggtccattctgttgatgaacacatcgtcgatgtgtgagaagaaaaatgtgaaaaatgtaactgctctgactccctaatacaagtatattactcatagggcataagatgaaagacatacccatccggaatccaagatgaatccatcccctcatgttcatgctccccttcactgtgctccaatccatctataattccaccacaatatctcattcacatcagtgtagtgcagattcttcaaatgaagccaaacaaaagaaggaaaatggacccccctgagagggatgggccacctgctgggactattatgccgctgccagtgacctcctcgccggcccctgtgaccaccgtaccggcgcatgcagcccccgcaccaccccttgtgccggccgcttgccacctcctcgcctcccgtcgcctgagagactaccgccgacgcgccgacgcctggagccgccgcgccgtcacctggaagcaccacatcgcagtcgagggccgccacaccgccgactgggagccccgcgccgcctggggccgccgcgccat

SEQ ID NO: 74081 - DNA, 12197 bp, Oryza sativa
ttttttttttggtaaattttatcagaaagactaacatatagcactgtgatgtatacttcatccgtctcaaaaaaaaaaaaaagaaaaaaaaaagaaagacaaaccctggtttccgtgtccaacgtttgaccgtccttcttatttgaaaaaattatgaaaaaattaaaaagataaatcacgcacaaagtattaatcatgttttatcatctaacaacaatggaaatactaattataaaaaaaatcatataagacggacagtcaaacgttgacacggaaacccaggatttgccttttttttggacggagggagtacttatttgaaagacaaatttggttttatagcataaaaggaaagttctcattttttgtattatagtattgcaagttcacgcttcactttaatagcacctaatttatctccgttcccgttaaaagcacttccgtcactccaccttgtcttcatgttttctttgaccgcaattggctgaatatgacacttgaattgatgctcttgctcttatgtggattaatagattgatcgctctcatggtctcatttgatcaagctgaacaacaagaaaatcaattatgtcgtcggacagtgtcgtactgtcacctcagcagttcctgctattcctactgaaggtggctggactcaccacgcccatctcctcccttgcatggcctaatcgttgggctgcaacctgcatctaggcgatgcctgcacgcctcgacactgacacctgcgaatcgtacgttggtgatcgaggcgccaaggctgctcggcttcatcaaactccatccattgtgatccttttcatgtctcccacatagaaaatacgatattaacttgcatcatttcagtagaaattcagctgtatcaatgtactgaaacataaattcattaattcacagagaacacaatcagttgcatcaatacactaagctgttggggagctgttgcatagccgagactgctgcgtagccaccgatgaaggatgaaccaactccaatagccgacctgatggacgaggagttgtcgctcttgacatattgcagccacggcaggagcgtcagttgaggggtgaacagggacatcgatctattaatccataaaaagacatgagcgtcaattcacgtgtccaattcaatcaactgcggtcaaagaaaacgggaagatgaagagaagcgacggaactgttttcaacaaaattcgaggtagagttgggtgcttttaaaatgaattgtgaactctgggtgctgtaaaactaaaaacgacaacttttgatgctataaaaccaattttgcccatttgaaatatttgacgtgaaaatataggcatgttcagtttggtatcactttcaaccttaccaaattttagcattaccaaaaatttggtaagtcaacaaactaaacatactttaaccattactacttttttactaaattttggcagttccagaagatttcggtagttctataagctttcatcttgtaccgtaatttggcgaaggcatcgaaactaaaaggaccttgatgtcgcctagaggggggggtgaataggtgttcctaaaaattatcacaactttatagtatattagagtgatgagaactttcaattcaaatcggaacttccgatatgggattggaagttccggtcttaactgaaaagttcggcggataacggaataaacactagctatgaacttgtaactcgaacaaacaaaatgtatatgaaacaaaagattacaaacaaggtatctaaacaagatataaggtcaccaacaatattaattaagcatgcaagtagatcgggtcaaaacaagctcaagcacaatatgagagatggtaagaacgagcaaaccaagagaggagacacgttgatttgtttcccaaagttcggatccacggatcctacgtctccattgaggggccacaagggccgggtctatttcaacccttacctcacgaggttgcacaaatgcactcctcggtttcactcttgatctcttcccttgcagaggcgaaatcgaagccttcacaaactttccgtggcacaccacaagcttgggtgctcaccggcgacgtctagccgtctaggagaccttagtccccaagagtaacaaacacaatagaagatttgctttctatgaactcgagtgctcaaagtatggagtgaagttcacaagctctcaacttctcaatctctcaatccaactctctccccttctcaaatccctctcacaaagatgcaccacaaaggatggagtgaagctcactagctctcaactcctcactctctcaatctaactctcttcccttctcaaatccccctcacaaagaggcaccacaaaggatgggaaatggggatggctatttggctttggatgtgtctaatgtcgcccaagaacagcagccactcaaaggaggggtggaggagtttatatacccgagccattcaaaaactagccgttggaggctgaagcatctaggcccccggtgttaattttggtaattaatgacaagcgctaattgtggactaaccgttgtctttgagctatacattttaagttaggtccacgtcatatgtgcgcatggatgattatcgatggattaaaattgacggcgcaaagcaaagggaaagaagaaggtaaaactagcgctttaatttagaattgatcgaggtgtagggcgatcaaatttgctagtttatttttagtttcgccgtactattaagatgggtaatgacctagcaaagagatgattttaattgccacattaggtcattatgcatttagacatgtgctcacatttcacacacacacacacacacacacacacacacacttcactgggttcggcctgaccaggagcggtcagaccggccacatagtggcggtctgaccggcgtgccctgaccgacggcacatgcgcggtcagaccggtcccctggaggccgggatggtgctgctcgggatggctgatacagagccgacggagctgtattcggtcagaccgagccgatggcggtctgaccgagccgagaccggtctgaccggccaccccatgtcggtctgaccggccaggccgatggggccctctgatagggctacaacggctagttttctagccgttgcagagtagcacggtctgaccggccacatacctccggtcagaccggcagagcacagagttgggggatttcgcccccaacagctagttttggtgggtgggagtataaatactcccccaccagcagcaagggggctctcttggcacccaattcaattgcatacaccccttgcacctctctcacactcacttgagctttgtgttcatccatctagtgtgttagagggttgtttagccaagagtcaagtgcatttgcttccattgtagagctagtgtggcacttgatcatctccacatcgggtcattgcttgttactctcggaggttgccgcctcctagacggcttgtggaggagttgcccggtgacctctctgagaagattgtggaggaggcccggcgccggtttgtgagtggtttggagttcaccaccttcggagtgaaggaagaactaccccgagtgatcgaggcttgggtagtcctctccgtgggccggctcccgccttgcccaccccttgacgaagggggcgtgcggtggcttcgtggttgagcggtggagttgggctcgcctcaacggggagtaggaaaccggcgagtttccgaacctcggtgaaaaatctcttgtctcattgtctcatttgattgtcgcatttacatttgtgcaatttacatttctagagacatacttgagatcatatcactctaggattgcaaaacattgacataggagtgtgatttactttcatagagatataattgagccactatcaccctaggtttgcaaaacataacttagttgattagttagagttcacccttaccaagcctagcaacttaggttagatttgattaggtgttatttagttttaaatcgcctattcaccccctctagtcgacatctcgatctacaagtggtatcagagcttggtctctcttgattgggcttcaccgcctagagagaagatgtcgaacgaggtgaaccaagtagggaaggctcccatgtttaatggcacaaactactccacttggaaaattaaaatgtctactcacctcaaagctatgagcttccatatttggagtattgtggatgtaggctttactatcaccggcacacccttgacggagattgatcaccgcaacctccaactcaatgcccaagccatgaatgccttgttcaactctttgagccaagaggagttcgatagagtgagcaaccttgagaccgcatatgagatttggaacaagttggcggagatccatgagggtacaagtaagtacaaggatgccaagcttcatttcctcaagatccaatatgagacattctccatgttgcctcatgagagtgtgaatgacatgtatgggaggctcaatgtcattgtgaatgatctcaaggggcttggggcaaactacaccgatcttgaggttgcccaaaagatgcttagagccctaccggagaagtatgagacccttgtcactatgcttatcaactccgacatgtcaagaatgacacccgcaagcctcttggggaagatcaacaccaatgacatgtacaagttgaagaagaaggagatggaggaagcctcaccttccaagaagtgtattgctctccaagccgaagttgaagacaagagcaagagcaaggtgaatgaagtcaataaggacttggaggaagagatggtccttcttgctagaaggttcaatgatctcttgggaaggagaaaggagagaggaaggggctccaactccaataggagaagaaatagaagacccaacaagactctctccaacttgaggtgttttgagtgtggtgagaagggacactttgcttccaagtgcccttccaaggatgatgatggagacaagtcatccaagaagaagagtggaggctacaagctcatgaagaagcttaagaaggaagggaagaagattgaggccttcattggggaatgagactcaaatgaggagagtgattgatgattgtgatgatgtttcctatgatgagcttgtgagtatgtttgaggagctccatgcttatagtgagaaggagattgtcaagttcaaggccctaaagaaggatcatgcttctttggaggtcttgtatgagaagctaaagacctctcatgagagactcaccattcctcatgagaagcttaagtaagctcatgacaacctcctttccactactcaacatggagctcacattgatgttggcatatcttgtgatttgcttgatgatagtgctacttgccatattgctcatgttgcatcatctaacatttctacctcttgtgatgatcttatggatatgcctagccctagctctagctctagctcttgtgtttctatttgtgatgcctcacttgttgttgagaacaatgagcttaaggagcaagtggctaagctcaacaagagtttggagagatgcttcaagggtaagaacactcttgacaagattttgagtgagcaacggtgcatccttaacaaggagggacttggattcattccaaagaagggtaagaaaccttctcacagtgccactcgttttgtcaagagtaatggtaagtattgctccaagtgtcgtgaagttgggcatttggtaagtgattgccccggtgataagcctcctaagacatgcatgttcgattctcattatatgcttaggaaggctcataatggtagtattgttgctagatatgtgggttcccctatactcggtggtaaaaagaatgccatttgggtgcccaaagctttggtctctaacctccaaggaccaaaacaagtttgggtacctaaaagagcttgatcttcttttgtaggtgaactaccgcaccggtgggagccattgggtgcttgatagtggatgcactcaacacatgaccggtgatagggctatgttcaccacatttgaagtaggagggaatgaacaagagaaagtgacatttggagacaatagcaaaggaaaggtaattgggttaggtaaaattgctatctccaatgatttgtcaattgataatgtctctcttgttaaatctctaaatttcaatttgctttcggttgctcaaatttgtgatcttggcttgtcatgtgccttcttcccacaagaagttattgtttctagccttcttgacaagtcttgtgtgttcaaaggttttagatatggaaatctttatttggttgattttaattctagtgaagcaaatttgaaaacttgtttagttgcaaaaacttctttgggttggctttggcatagaaggctagcccatgttggcatgaatcaattgagcaaactttcaaaacgtgatctagttgtgggcttgaaagatgtgaagtttgagaaagataagctttgtagtgcttatcaagccggcaagcaagttgcatgttctcatcctactaagagtatcatgtccacatctagaccattggagctcttgcatatggatttgtttggcccaacaacctataagagcattggtggtaatagtcattgtcttgtgattgttgatgattattctcgctatacttgggtgttctttttgcatgataagtctattgttgccgagcttttcaaaaagtttgcaaaaagggcccaaaatgaatttagttgcactcttgtgaaaattagaagtgacaatggttccgagtttaagaataccaatatcgaggactattgtgatgatcttggtattaaacacgaactttccgctacctactcacctcaacaaaatggtgtagtggagaggaaaaatcgtacattgattgagatggcaaggactatgctagatgaatatggtgtttctgattccttttgggcggaagccgtaaacaccgcttgctatgcaaccaataggctttatttgcatcgtctcttgaaaaagacttcctatgagctaattgttgggaggaagccaaatgttgcctattttcgagtttttggttgcaagtgttatatttaccgaaagggtgttagactaaccaaatttgaaagttggtgtgatgaagggtttcttctaggttatgcctcaaatagtaaggcataccgggtctacaacaagaacaaaggtattgtggaagaaaccgccaatgttcaatttgatgagactaacggctcccaagaggggcacgagaatttggatgatgtaggtgatgaaggcttgatgagagctatgaagcacatgtctattggagatgtcaagcttattgaagtggaagacaagccatccacctccactcaaaatgagccatctacttccgcttcaccaagtcaagctcaagttgaagtggaggaggagaaggcacaagatccacctatgcctccaaggatacacaccgctctttccaaggatcacccaattgaccaagtgttgggtgacattagtaagggtgttcaaactcgatctcgtgtcgcttcgatttgtgaacattactcatttgtttcttgtcttgagccaaaacatgtagatgaagctctttgtgatccggattggatgaatgctatgcatgaagagctcaacaactttgcaagaaacaaggtgtggactttggttgaaagacctagagaccacaatgtcatagggacaaagtgggtctttaggaacaaacaagatgagaacggattggtggtgagaaacaaggcaaggttggtggcgcaaggtttcacacaagttgaaggtttggactttggtgaaacttttgcccccgtgacaagacttgaggctattcgcatctttcttgcatttgcatcatgctttgatataaaactatttcaaatggatgtgaaaagtgcttttctaaatggtgaaattgccgaacttgtctttgttgaacaacctcccggttttgaagatcctaaatatcctaaccatgtttacaaactctcaaaagctttttatggtttaaaacaagctcctagggcttggtatgaaagattgaaagattttcttttgtcaaaggatttcaaaattggaaaagttgacaccacccttttcacaaaaatcattggtgatgatttctttgtgtgtcaaatttatgttgatgacatcatattcggttctactaatgaggtattttgcaaggaatttggtgatatgatgtctagggaatttgagatgtccatgattggagagttgagcttcttccttggacttcaaatcaagcaactcaaggatgggacgttcgtgagccaaaccaaatacatcaaggatctactcaagaggtttggcttggaggatgcgaagcccaccaagacacctatggcaaccaacaggcatctcgaccttgatgagggaggtaaaccggtagatttaaagctttattgttccatgattggtagcttgctttaccttaccgcatctaggccggatatcatgtttagtgtttacatgtgtgcacggtttcaagccactcctaaggagtgtcacttagtggccgtgaaaaggattccaagatatttaaagcattcctctactattggcttgtggtacccaaaatgtgctaaatttaagcttgttggctatttcgattcggattatgccggttgcaaagtggatagaaagagcacatccgatagttgccaaatgcttggtagatcccttgtgtcatggtcatccaagaaacaaaattccgtagccctctctaccgccgaggcggaatatgtttcagcgggtagttgttgtgcccaattgctttggatgaaacaaaccttgttggactatggcatatccttcaccaaaaccccactcctatgtgacaatgatagtgccataaaaatagccaataacccggtccaacattctagaaccaagcatattgacattcgccatcacttcctaagagaccatgttgacaagtgtgacatagtcattagccacataagaaccgagaaccaactagccgacatctttaccaagcctcttgatgaaacccgcttttgcaagttgaggaatgagttaaatgtcatagatttctctaatgtggcttgagatggtgcatcatggttgcttctttttgcatattgtatatttgctcttatttgctcttatgctttggattttttgccatttggttcttcattgtgaaaatggagcatgtcacattaagggggagttttgcactcttgcatgtgctctacctccctttatatgtgagcaaatcaactagtggtgctagtagtattttcgaatgtccaagtcaacataagtcaaaacttttgcaaaatcaatgaaatttgaaaactatctcttggaaaaagtttcaaaagggtccctatatgttttccaagcctcttattgcaagaaaaatgtattttagatgaaaatggctttttggccctcttttgaagaaactagaatcttatttttggccaaaatgagattcaacctcaaaatgagtttgagaaggaatttgagaaaagtttcaaaacaaagttggtagagaggaggatttgaaatgtttttggtattcaaatcatattcaaaaaccaaatatttcaaaagttgtttgaaaatcaaattcgtccaaaaactcctatagaccataaaaggtcacctcctagcactcaagtgagttttgttgcaaatcttcataaatttcaaatattatgaatggttggcaatatttcaactcacacatttcaaaattgctccaaaaatcaaatttttgttggattttattgtgtgggggttgccggcttatgcaagggctgtgcacagccggcagggcgctgcccggtctgaccgcccatatagggccggtctaaccggtgtggacgaggcggtttaaccggccgcatagggctggtctgaccggccgagctggtgggcccagggtttttatcctcttcttctctatcccgcacctacctcttctcttctcatccccattcatccccaattcgaaaaaactcctcctctctcctctcccaaaccctagccacctccctccaccaaatccatccggttcaaccgtcaaaatcactctagttacaccgtaagtgaatctcctcctcttcctctctctatcccatggatttgtttgagtttttattgagtttgtgatccatggcatggaaccctaggtgaaggaagaggtgttcttcgatttgcaccaatagagggtagtttcttggtgtgattcgactccttcaaccggtaaatcactctccctcttgtgcattctctcaaatcggtctatttcaatttctagggttaaggatactttccccattgcttcaatcttgatgaaatagacctacaccttgatgttcatgttccaatcttgtgcaactttgtcctagcaatttttgttagaatcatttgtgtggattgtggaaggattcggttgtgctactgtcaatggcggtctgaccggccgaggaccgtcggtctgaccggccgtgagccgccggtctgaccggcctatggccgtcggtctgaccgacttggggcttgcggtctgaccggccttggctctcggtctgaccgcccctgacagacagcactcccccttctcccacttcactatgtggcttctaaaattgttgcttatccatcctttgctccttgtttttcagctatgcctccccgcactcgccatggttgtcgtgagcccacgcccgatcccgtcagtgagaatgaggaatcaagcgaagatgagtatgttcatagtgatgatgaaaatatggaaaatgttcagggtgatgagatggaagtaagtgatgatggtgatgacaatgggagtggcaatggtgaagatgatgaggcaagtgatgatgggagtcctctcgattccaccatccaatttgtgcttaatttgaggaatgctcatcaatacactatcctccgtcaccatgatcaattccggaggcctaacgattgtaatgatccaagatttcatatacggttccaaaagtccgtgtatgaacaagtgtatgccaacaaagccttcgcctaacacaagtggatttcttggaggcacattggtgagacaccggagtttgaagatttgcaagagatgttccggaccgttgggattgatagaattgtcaccatgaagcaaccttttgatgaagatctcatccggcaattctatgccaccgtatgggtgtccagcgattgtgatgcaatgaagtggatgtcggggacccttcgatgctctatcaaccgccgtgaattcaagaagctcttgcacattcgcttcaacaacggggatgaccttcatgatgagcacacccacaaccccttctccattgatcacttttctcagttttatgaagaagggggaaggcacacatatggaaaggtggtggatttgagggctctcccaagtgtgatcaaccgcatagtaagggccaccatcctcccaagatgcggcaacaatgatgacatacgcggagttgcttggcatgtcattgatgccattttggatggtcgtcggtttgatgttatcaaccttatgatgaagaagattgccatctcaaaggggactattggacaaggaatctattatgctccctgcataatgaggttgattcaaagcaagttgggacaaattggtcacaatttaaaagaacataaggagtacaagcctcgtctccaactctccactcctagagctcctcgtgtgcgccaaccaacttttgattaaggtgcaagctcaagtgcagcccctcctcctcctcatgggtatgatccaagtgtttttttccatccacaatatgcttactttggaatgcaacccaacgagtacttcaacccggtacttggggctattaataccctaagtgaaagcattcaacgcttgtctaccgggcatgaagctttgcatgaggatgttcgtggcttgcgcaccgatgttggcaacttgaatacttcggtgggaagattgcatactagggtgggtgtcttggattctcgagtccaaactttgagagtatccaagcatttgtgtatcatcgtcgtcgtgatgctcattatccttccacttcggcgcgtcctccttctccaccacaagaatgaagacctttttggtacttgatgccaaaagggggagaaaagtgtgtttctatgtcttg

SEQ ID NO: 74082 - DNA, 11234 bp, Oryza sativa
  unsure (1)..(11234): unsure at all n locations
acgtccaactatacattatttattaaggggtattatagtcttcttctcttaaccatattacatgctaaacaatctagaatgacatgtattttgggatggaggtagtatgtaatatatcactttacgattgtgtaagtttaaatttaatttctataagttataataaaaataataaattaacgtatattcatattcaaaattattatttttaaaaaattgtagaagttaaatttgagcttatgtgtttgtggagagatatattatgtacattattagatttttttttcagattgttttaactattcattaataaacgagttcaaacgagtgaacgtctattttccagtgattaaaagagctttccaacaatttacatgtgtttttttatagatcgtgggggcatcgtggtacttgctgtcgatcgagagggtgagcgattgctggaagaaggcgtgcaacgagttcccgggatgcaacaagatctacatgtactgcggcaacgaccaccaaaaagggttcctcgagtggcgaaccatcacgcggcagtacatcaacgagacgtgcgagcctagggacggcgtcatgcccttcaactacggcatctacacgccggccgtcaggtccgacgtcatcaagtccaacgacttcacctccaagctcctctactgcctctggtggggccttgccaacctcaggttcgacaattttttatttttgccgcaaatactatcgaaattgaaattaaaagtgtaaattgcttcgcacagaatagattgtatcatatttcacttacaccgggttttagtacttatgttcactttgcattagggtatatccaaatgttttttattttgtatactagattgcgtcatatgaatgaaggaaaattttataaatcacgagtaaatgatttttttagtcgtcaaaaatgaatactccctccttccctaaatatttgacaccgttgacttttttaaacatgtttgaccattcgtcttattcaaaaacttttatgaaatgtgtaaaactatatgaatacatgaaagtatatttaacaataaatcaaatgatacgaaaagaattaataattacttaaattttttgaataagacgaacggtcaaacattcttaaaaaagtcaacggcgtcaaacattttgggatggagggagtatatcgcagtaggagtctctcctgctatttttaatcgtaagaaaaattaatttagaccacgtttcacaaagtcatccatattttataaattttaatgaaatttctaaaaatttgatgatgtatatcctggtgctaagtgaaatttgtttgaaggcaacaacctgatgtagactgaaaatatgtgctaaatctgatgtaaagtgaaagtagaagtgccgctttatcaagtgcaaagtgcaatttactcaaattagaaacgattcctatgagaatgttgagaaatttggtgtgagaataattaatttgaggatggatgcagcacgctggggcaagggctgcagacgagcatatacacgggggaggcgctgttctcgatattcctggcgacgttcgggctgatcctgatggcgatgctgatcggcaacatccagacgtacctgcagtcgatgacggtgaggctggaggagatgcgggtgaagcggcgcgactcggagcagtggatgcaccaccgcctcctcccccaggagctccgggagcgcgtccgccgctacgacgcctacaagtgggtcaacacccggggcgtcgacgaggaggtcctcgtcgccaacctccccaaggacctccgccgcgacatcaagcgccacctctgcctcggcctcgtccgccgcgtcccgctcttcgccaacatggacgagcgcctcctcgacgccatctgcgagcgcctccgccccgccctctacaccgagcgcaccttcatcatccgcgagggcgaccccgtcgaccagatgctcttcatcatccgcggctgcctcgagagcatcaccaccgacggcggccgctccggcttcttcaaccgcagcctcctcgaggagagcgacttctgcggcgaggagctcctcacctgggcgctcgaccccaaggccggcctctccctcccctcctccacccgcaccgtcagggccctctccgaggtcgaggccttcgccctccactccgacgagctcaagttcgtggcggggcagttccgccggatgcacagcaagcaggtgcagcacaccttccggttctactcccagcagtggcggacgtgggcggccacctacatccaggccgcctggaggcgccacctcaagcggagggcggcggagctgcggcggagggaggaggaggaggaggaggccgccgcgatccgctcgtcgacggggctcaagaccaccatgctggtgtcgcgcttcgccgccaacgccatgcgcggcgtccaccggcagcgatccaggcgggccgacgaggtcctcatgatgcccatgcccaagccctccgagcctgatttcggcgccgattactgatcagccggcaaatgcatgtgaattagcgcttatgaaatgggtgtaaattgtgagtaaatgttgtcggatttagctgtgcagtgcagtactccctccatttgatagtcatatttcatcttggcacacagactaaggataagtaattctacttatcatctatttaaatgtgctactagtcattcctcgtaaacaagtgattcattaatatttacatttctcaatgcccatgtagccaatcatgtgtggaagaatgaagagtcatgtattaaatccaagaaagtcattaagatgataagttgttggattgaaatatacctatcaaaaataaaattttcagatttggaaatatgactatcaaaaatagatggagggagtactacagtgtgacagtgttgatcggctttgcgtaaaccggtacttgatcaaagctagaaatattatacccaatcttgctttacataaacaggtgtttctatcttgttagttaggggatgttagacacacaattgagcaaagtttatcaagctcatagtaaagtttcttagtatttctctacatcagtacgactgtcaaggcaaagtttatcaagctcatatatagtacaggctgtgaatcaccaaactccaaatctgcttgaggcaaatgtaatactccctccgtccctaaatatttaacaccattgacttttttaaacatgtttgaccgttcgtcttattcaaaaacttttgttaaatatgtaaaactatatgtatacataaaagtatatttaacaatgaatcaaatgatatgaaaagaattaataattacttaaatttttttgaataagacgaacggtcaaacatgttttaaaaagtcaacggcataaaatatttagggacggaaggagcagtaactattaacagctcaggacttgagcaaagggttctctggactgaaggctgggaaccaccaagctccaaagctgcttgaggcaaatgtaatagtaaccctttaacattgtatcttaagttaagacggccatttgaaaaaacaaataaaatggtactaacttaaaacaagagattactttgtaagctgcttgaggcaaatgtagtaactctttaacattgaatcataatacatcgatttgaaaaaaaaacaaataaaatgacaacttaaaacgagagattactttgtttgccctcatgtatggtccaactatctttaaggtcaccaataggcaattgggtgccaacaccataactgatggctgccgctcccgtcggatggcctaaacaaccaaagaataagccaaaatttaaattttcaaacttaattttgagatattttcaatgtaggttctttttcagcattggattttaagttaccaagaatacatatataaaagttttacctacaaattcatttttattcgttttggcttattaggaaaaaagccaaatgatgggggcctaggtatggtgaccatggccgtggaaggagccaatccatctaaaggtaccagcacccatgttacaccaccagccttggcattgagcatgacagccatcttcatagcgaatccatgaagtcaccatgatagggacctcctttggtatttctctgtattcctaattcccgtaggaatcatggggaattccatccaattcctatgatactcaaatgtcctattacagtgttttctttccatttctacatcccaaagaataagaccaactataaatttgaacaaatgcattaaaaccaactccatttcattatctaaaaaaaactccatttcattatttatttgattgaaaggatcactgtaaactttggtatgaggcttttgccaaaccatggcttaaccaatctacatcctcgaggtctctttctaatgcaacagcgatgcccttgcatattccttccataaatcatattacctggttctattgattggatcggaatacatccgagtgaatcggaatatagtgaatggtactggtaaactgtacaagtgtgtgcatcaattctcttttgggtgtgcatcttgcatctagtgatacttacatctgatctcttttaggacatatgttgtaaacttacatctgatctagagccttttcttccgagcagttggggcatgagatgcaacagcagtagcctgtgctgagcatgagcagaaaccacgcagaactgcagttacagcagccagagcgaatggaacgtacagctgaatcagcttcggtgttgttcttcctgagcccagcatctctccgaagattgcagactgaagaaaatgcagccaatattagaaacaaatcaagaagactcatggtataataagacgctatcaattatatcacacaaagattggttgactaatgaaacaattctgaatgtagtagaatccaatagatctactccagcaagcaattagggaaacaagtagcatgaaagtggagtttccccccaataactagccaaatccatctctcctatgccgtgctcgatcagatcacaatcatcctgtccgatctaagaaggcgagaaacaatcgagagagttcgttaccatgtaggtgagcacgtagacgcccgccatgatgtaggtggcgccggaccagggccggcgcgcgaggatgccgtagaggttggcgacgcagaccggccagaggaaggcgaggtcgagccaaacgaggccgcgaaagaaggacggcgggtcggcgacgaggtagtggccgaactcggcggcgaaccaccggtggatgccgacgagcggcgccgggtagaggccgcgagggaggacgacctgggcgtcgaacagcggcgccgccaccgccatggtcaaggagagcagcgccaccaccgcgtcggccgccgccgtgacgaagcccatttttggtcgctcctgcccctctggagccaaatgagtactattaaggggctgtttggtttccagtgacttattccaagtacatgtcacatcgaatgtttggacactaatttagtgtattaaacatatactaattaaaaaactcatttcataatattagactaattcgtgagacgaatcttttgagtctaattacgccataattttgataatgtgatgctacagtaaacttttgataattatggattaattaggcttaaaaagatcatctcgtggattagctctcatttatataattagttttttgttagtctatgtttaatactctaaattagcgtctaaacatccgatgtgacatgggctaaaaaattttagccctatctataacaccccctaatttcgatgagaaattatttgttttaataatctacagagtcaaccctttttcactagtttatggtaaaaataattttaatatctgcagtactaatagtatatttgcgtgaatatgctttagtatacaaatatttttttatcaatgtatgccgtttactaattgtttttaatcaatatattctaaaagtatttgtttattaaatttgtactaacaatcgtctcaaccgcttgatttaggtagttagaagttatataaaatctagatgcactcatgacataacacagtgagtattaacaagaatttagtaagaaaaagttagtacgtatatatatatatatagccctttccattttaaaactatactccctccgctcaaaaacctaaacatatcatgattcgttgtactaaattaaatggcatctaattttatgtttgtttttttctaacggaaagactataggagtatgccttataaaaattggtgtaggcttacatgtattttttttccttgcgtaaaatataatattttttaccttcaaacactcaacgaagtctatttttcatcttgaactataaaaccaattattcttcactttgataatggtttcagaggtgttctttttgttaccttactaaccatcgtgctattatatgtcatcatggttgctaataagacattggctatggctccacatttgaagctgttttctttttcaccgtttcttctcgcagtaaagtgattagagggggagatgtgaggagacggaggaaagcaaatgtatgatatgtaggctccatgcaaatgttagtacttataatggcattaaatagtgttgtgactttcaacatggcaaagaccactgctaaaatatatcttgaggtgaacttgtctagttttaaagatttacggtgaaaataaacatttttatatttcagggtggaaaacattttttttctctgatacgatggagaacatctaccattctttaaaatgttcccccactaaattacaaccatatctttgtagtaaagcatcctttgaaatatagtaattctaaagaatcttagttcgaaattgtctttaatacctattatcggatactttgagagatctgagatctcccacattaaccagaagatctaagttactgattacgtgaatcttattatcgtgatagtagatggtactgatagtttcgagaatgttgtaaattgggttaccgatggatcaaaccccctgtcattgtcgcatgcatgcaatgtaggtagctagntatttcttctccttcattcttcctctnttaaaatattttttctaaaatatttatccgatctacgatccaatcacaccattgtatccgttgcaattaaaactttacaacaagataacatattattatattatattaaaagaaaagcatacgtttcaaactgttaaaactcaatgttttatatgtgatagtgatatattttaatgtgcgtcttcaacgtgtttcaaaaattcccgaagctacttgttactaccctctctcctctttcttcacctcattcatgcatgcattagtgagcttcaaaacgatttttatgctaaactacttatccaatttatgatctgatcacaccgttgtatttgttataattaatctttataacaagatatcacatgattatattttgatgaaagaaaaacacatgtttcaatccatcaacacttattgtttcatatgtgatagcgatatgtttcatcgtgtatcttcaccatgtttcacaaaatttttaaatgtttcagttactggtttttttgtttcaccatatatataacttggtgtttcaatcgttggtgaactggaacattttaccgaccgattttttggtgaactggaatattttactgaccggttttttggggcattggacacccaatgagaagattcttcctgatagttcgtgttagacaaacactatctggccctagtttctcaaaaataacttttgaaaaatggaaaacatgaagttctacattcatcttggactcgtaattcagtgttttaattagcaagctgtagttaatatggactcttattttaatgtaacactgtaatttaaaaaataaccaacatgtttagcatataattaaaattttaatactatcaatgcaataaaaggatcgatagctagttggtctaatctatcaatatgttatatcataacgatatctttaaaagaagctatcatattcactacaaagactagaaatcatgacattaatcagaggggaaagcaaaaaaatgtaaacgttagattatcatgggtctagaatgttattgtaaacaaaatgcatgccaataatgacaaaaattaagagttttatattaaatccaattatactttccatccaaataacagctatgtagatagtaagatacaaagagttgtatataaaaaataattaatttttccaattcatatagaaatcataattctatttatagaaatagaagatagagttatgtaccaaatctgattatacttctattcagcttttttgtaaaattgcgatggataatctgttagctcttgtgaaaatggtataaaaactctagagtttaaaaggagtattacacatatatatttttttacaaacacagtgtaaatatggacgctcacatgcacacacacttacttctataaacatacatgcacattctatctttatgagcgattgaacatcccgagagatttagcaaatatattaagattggttgagtcatttttttataccacaaaggatatatattctacttgtgctgttgtactgagtgtatatgggcgctagtatatcaattgcaaagtcaataatatagggcttgttcacttttgttgcccaaatcaactataccagattttggtaatgctaacttttgatacattttggcattatcaaatttcggtagtgttagatttgtttgtttctgaaagttcaagtgccattaatttggttttggtgattaatgacaaatccaattccatgagactaatattgttgtaagcatttctttgtctagtctcatatggatatgaaagtggagtgtgtgagaggtgattcctggacttcatatgagttgagatagaaatgttcattgatggtggacctaaatcacaaggatgaaatacatggagatcaagctatatgtatcactctttctctccatgtacatattgatattttcatatataatatttccacatgattgacatgtgcatgtgagactaatgttttgtttgagtcttatctcttatttagtctatttacattgagaacgtggagatgatgaatgtatgtttttattttaatgactatatttgagaaatgccttctattcttgtataggataagctctcaatgtgtcatatcttgttatgcatactcttgcttcacacaaatattccatatgcatacatttagggggagcaaatcctacaccttagttatgcatgtatttgatccaagttattcactttcatttaattgggatctttacatttgagcatatatttgagtatatgacacttgtggtgttgattaatactcatcatttattcatatccttttatacatgtgattggttagtcaacatgtggaggttgacaactggatcattgagactaataatttcactaagttaattgagaaaaataggttccaaggattgaaaaggtgttgacgctcaagtgatatgattacacctaaaataccaagaataacaaagcgaagatattgaatatgtgggatacgaagtggctactatggcaagacggtgaagggcaagcgatgctcggtcgcgatggaccatgcggaggtgaagggcaagcaaggggcttggcgccgaagaaccaaatccagtggtgaagggcgagtgacggctttgtcatgatggaccgtgtgagaccatttgaagctacaaataaccgcatcaatcatttgaaaaatatatggtgaaacggttttggcgttggcgtcccttaagataaaggaaggaaatggaaacaaggcattcctattggtataattctcttcctatttatatttgagtataggaatgatgtactatttagagggatgcaacgtcgatgcgtttgtgtatgtctcggtgctcaaagtgacctatcatactactaccttgagagaaacccaagctttaacctatcctttgagtggttttagaccttgttcttggttgagttgggtagtcctctaagtgagctttccatagagtccaagatcataaaaaacggactcccaagcaaaaagttatgattgttttactctgtgcttttcggaagttccgaaaaattatcggaagttccgaaaatcatcagaagttccgaaaatggctgcgaaactgagttttgcttttgtaaattttcggaagttccaaaaactcctatctttgcctctgtaggatcgagatgtcgactagaggggcgggtgaataggcgatttaaaactaaataacacctaatcaaatctaacctaagttgctaggcttggtaagggtgaactctaactaatcaactaagttatgttttgcaaacctagggtgatagtggctcaattatatctctaagaaagtaaatcacactcctatgtcaatgttttgcaatcctagggtgatatgatctcaagtatgtctctagaaatgtaaattgcacaaatgtaaatgcgacaatcaaatgagacaatgagacaagagattattcaccgaggttcggaaactcgccggtttcctactccccgttgaggcgagcccaactccaccgctcaaccacgaagccaccgcacgcccccttcgtcaaggggtgggcaaggcgggagccggcacacagagaggactacccaagcctcgatcactcggggtagttcttccttcactccgaaggtggtgaactccaaaccactcacaaaccggtgccgggcctcctccacaatcttctcggagagatcaccgggcaacttctccacaagccgtctaggaggcggcaacctccgagagtaacaagcaatgacccggtgtggagatgatcaagtgccacactagctctacaatggaagcaaatgcacttgactcttggctaaacaaccctctaacacactagatggatgaacacaaagctcaagtgagtgtgagagaggtgcaaggggtgttgtagcgcccgttccgtcgtggcgcctagcgggaaaattatctcttaaaaaccctaattgcgaaatttgtttctttgcttgttgtctagtgtccgtgccatctcaaggtctcaatccgcgatcgatcgtcgagatcaattccgaatccaattccttccaaatcgaatccctccgcaaaagtctagtttgcctcccccgggttcgatgggccgaattccgctcggcccatctcttccccgg

SEQ ID NO: 74083 - DNA, 3461 bp, Oryza sativa
ggctttgtatgacaagtgggtcccactttttttaaaaaaaaaagaaaatgctgactggattgctacgtgtacgccacgtaggacaaaaccgctctggattggatcgagggggtaattcgtccggtattgaaagtttgggatgaaaaatgtctggttttcgggttcgggggtgtaattcggtcgaccgcaaaagttcagggggtaattcatactttttccttttttctttcctttccttcgccgcaaagcactccaacgccgccgccccgatctcttccctccggcggccgccatgtcatcggcggcgaacgaattacttgttcagaccgaagagatgctgcagaaggaggcgaaatggatggcttaagtcaagctaattttagatatttattattttgtgtatttgagaggagcaatacctgtactttattatagcatagcaagggacggcttgttcttagatgatattgtggatgcatgttgattaatttttttctaataactctatcgctcttttcctaactatctgttctatgtaccattgatgaagcatatattgtgtcgctgtcatttggttgtttcatttgtaatattagttgtcaccgtagcgttagcacgggcatactcctagtgaggaggaagaggatttgcttcgccgcgtcaccgggggaggtgtcacgttgagattcctgctggggctggggttgggttgagattccccaggcgcccgcggcggcctcgatctgggcggcgcagatcagaggacggcgcggatcggcgagcttcgcactgggcacgtgtgcctgtgtgtgggagtcaggcctcgcagccgccgctgctgctgctgctgctgctgcacctgtcagctagggcgggcatggcgcgccgcgccgcttcccgcgctgttggctcggagggctcgatccaagggcgagggggccgcgcggggggcaatggcgccgaggacgcacgccacgtgttcgacgaattgcttcggcgtggcaagggcgccacgatctacggcttgaaccgcgccctcgacgacgtcgcgcgtcacagccccgcggccgccgtgtcccgctacaaccgcatggcccgagccggcgccgacgaggtaactcccaacttgtacacctacagcgttctcatcggttgctgctgccgggcgggccgcttggacctcggtttcgcggccttgggcaatgtcattaagaagggatttagagtggaagccatcaccttcactcctctgctcaagggcctctgtgccgacaagaggacgagcgacgcaatggacatagtgctctgcagaatgaccgagctcggctgcataccagatgtcttctcctacaataatcttctcaagggtctgtgtgatgagaacagaagccaagaagctctcgagctgctgcacatgatggctgatgatcgaggaggaggtagcccacctgatgtggtgtcgtataacactgtcctcaatggcttcttcaaagagggggattcagacaaagcttacagtacataccatgaaatgctggaccgggggattttaccagatgttgtgacctacagctctattattgctgcgttatgcaaggctcaagctatggacaaagccatggaggtacttaacaccatggttaagaatggtgtcatgcctgattgcatgacatataatagtattctgcatggatattgctcttcagggcagttgacagaggctattggatttctcaaaatgatgtgcagtgatggtgtcgaaccagatgttgttacttgtaacttgctgatggattatctttgcaagaacagaagatgcacggaagctagaaagattttcaattctatgaccaagtgtggcctaaagcctgatattactacctattgtaccctgcttcaggggtatgctaccaaaggagcccttgttgagatgcatgatctcctggatttgatggtatggaacggtatccaacctaatcatcatgtattcaacattctaatatgtgcatacgctaaacaagaaaaagtagatgaggcgatgcttgtattcagcaaaatgaggcagcaaggattgagtccgaatgcagtgaactacagaacagtcatagatgtactctgcaagctaggcagagtatacgatgcagtgcttaccttaaagcagatgatcaatgaaggactaacccctgacatcattgtatatacccccctaattcatggtttttgtacctgtgacaaatgggagaaggctgaggagttaattttttaaatgttggatcaaggcatctgtccagacaccattttctttagtagaataatttataatttttgcaaagaagggagagttatagaatctgaaaaactctttgacttgatggcacatactggtgttaagcctgatgtcattacatacaatgcactcatcagtggatattgcctagccggtgttgacgtaaaacacgaggcctgggagatctgcttaactccagtgcaggtccaaaactcgccttcgggtatgcttagcgtgccaattgatttgatcctgcaatcaacaagaaacaaagacaaagaaaccgcggttaaatccataaacgatagacgatcggctaggtgccgatgacatatcatttatctttgagccgatgtcatatgtgcatcgatcggcagtcattaataaataagaagggactaaatctattcgatcggctgtagatattaacaatatatagtccttatatcgatatatacttaaatcaagtgattgggatagatcggactccatgccgagacagtatgaatcacttagatcgaaatatatattaataatgagattatatacgttcatagcatagccgatcagatggatctagcatgtatcggttgatactccgatactactctatattaagatattaaagcaagtagaatatactaaacaaaagcctaatatacttaaatgcagcaatatcttaatataaagggcagatttaacatgtcaatcgagcatataggataaaagtagttaaatcaggtaagatcggctgaaaccccgatactaccctaatcggcaaccaaagacagactagagattgagattctaattacgactcataagatcaaactcaactgatgcagctataagtatgaaaagaaggataatatctagacaatcaagccgttggatatgtcatagagtggtggatatcctatataatctaagtcaacgtcggtatttaacctaatcggctgccttctagtaacagacgttagccgattagaggttagataacgatattgccaaagattatgtaagatatatgataactcgacgaattacataaacaagattagagtgtcataaagatggaagcactaatcccgagaacgcaagccgccataacaagttttacctcttgttaaagatcgaaaccgatgcagctcaacccgaaagcaagaactcgtcg

SEQ ID NO: 74084 - DNA, 46470 bp, Oryza sativa
aaccctaaccctaccaagcaagaaaactcagaacaagaaaacaaacacaagttggtaaatcataattcagaacaagttcttgtgcctaagatgaaggcaatagctacggattgcaacaccaagcatgctgttcgaaggtcaaatgccctaaaggtggttcatttcccacagaaatgccgattacggagccataatcgtacaaaatcccactgtttccgccaagattacgcagaagaaacaagaactggctgcccaatttcataaccctaacaagattcctcaccaagattgcccgcgaagcaagagcaagaacgcgaattgttattctttacttacagcgcagacaagtaagaaaaaaaaaaggagggttctttggtgtaccgacccctgggcccggaggacgcggcggcgcggcgcggaggcgcagatcccgagcagcgcgaggaagctggcccggcgcacccgcctcggcgcggtggcgcgcagcccgtcgagcgcgaagttcgcctcgtccacgctctccatcatctcgccgtactcctccgcctccatgagcgaggtggccgccgccgccgccgccgccgccgtggcgggctccgcgtagtccccacccccacccctcccccgccgccgccggggcggcggcggcgggtcctcgtcgaagtcccacatcgacgacgactcctgcgacggcgcgggcgggtgcgacgactgcgacgacgaccccagcaggacgaggtcgtcctcctcctccccgtcgaattcgaacgcgtcttgcgacgacgagaacccaccgccgccgccgcgctcccctcctcccccgtcggagaaggagcgggatctgcggccgtaggtgcgcacgatcatctcagctgctgctgctgctgctgctccgcctcctagctgctgctgctgcggcggcggcggcggcgcgcataggagagaggagagagagatttgggagtcgtctcgtctcgtctcgcgggggtggggatgtgggtgacgtcgtcgtgggggggatgggtttggatttggatttcgaaattttttgctgctgcggctgcggctgatccggatttgggaattgggaatcgggaaaaatggaggcggaggggagaggcgtgcggatttgggggaaatcggaggaggaaaccgggaatgggacgaggaggagggggagctgaggcgctgagctcggcttggctccggatgtgctcggctcggctcgtggcgttgggccaagctagctagctagccaagaaagggaaggggatttgtaaaaagaaaaaaaaaaggaaggaaggggtgggacccacttgcataggaaggcggttaggcggtgggtgggatggggcgcttcctagccgttggattgttggtgttccatcttggcatctcatgtgggaggatgacgagccattcggtgattttcgatttagttggtgtttgtatcgatcagtgttacgtcggatgtatactaattaaaagtattaaacgtaaactaacaataaaattaattgtataaatgagagctaattcgtaagataaattttttaagcttaattaatccgtaattagtacatgtttactacagcatcacataggctaatcatggattaattatgctcaatatattcgtctcgcgaattagtccagggttatggaatgggtttcatcattaatctatgtttaatacttctaattagtgtcaaatatccgatgtgatagggattaaaatttagtccttggatccaaacaccaccttagatgaagatgaagatattttagtccacgtaaaatgaaacaagttagtaatgattaattgagttttacttttataaaccctaaaagtaaattttatttgatattttagagtaagtttatatacaaaattaaaaaacagtttgaaaaacatgctaatgtatcatgtatcttgatgagaaaagaacataacctaaatgaagatgaagatattttagtccacgtaaaataaaataagtcaataatatatatgattaattgagttttttaaaactccaaaaatagattttatttgatattttaagtattttttatatagaaaattaaaaaacagtttgaaaaacgtgtaaataaaaattaagatagaacttttatcataatggacaaaaggatgtactagtagttgttgagccacagggaattcgtgagtagtgagaaccaacccgttgttgctgggaaattcgtgggaactatagtaccccgttgattgcatcttcttcaacctctcggtcaggttagtggtgctactgttcacgccatggttgacgctggtcaaacgctcgttttcttcaccctcgtcaacgtcccgtcttccatttcatcgttttgctccacagaccacagctgcatagagagttagagacccacctagttgtatcctcctgaaaaacctctacaatttctttctttttgccttttcaggcttttgctgcacggttctcactttataaaatggaggccagtttagggcaaagaagtgccaaaacctcactttaattacaaaaccgagtagtttctttatttactgctggcaaattttttaattgaaatgctttttttttccaaatctcactcaccttcttcccaaatcaaaattatatttcacaccaaatactctatttaaaagggtgtttagattcagggatgtaaagttttggcgtgtcacatcgagtattatatagcttatcgtataggatcaataattagtatttttattagtgcccaaacaccctgtgcgacactatatataatacccgatgtgacacgcccaaacttcacatctttggatctaaagcacccctcagtgttctaaacccccaaataaaccattagaaattcagaataagtcagccccgtacaactggtcgacgagcagcggcggtcagtgtagcacacacggtggtagctgcgtccagtggactcattctatgtaggcacccgatggccagtattttggctgtacgccggaccacgaaaaactgctatcgcctgcgcccactggtttctgccgtctgctggtttcaggatgcttcaggttcaggactttgcttgattgctttctgtttccgggagctgctactactcctgtgcccaaggagaaagaagttcactgtttgtgcagggaggtggagagggataactattctaatatcttgaaagaatattagggcctatttagttccaaataaaaattttcacgttgtcacattgaatatttgggcacatacataaagtattaaacgtagaaaaaataataattacacggttcgtcaggaaactgcgagacgaatcttttaagcctaattgcgtcatgagttgacaatgtggtgctatagtaaacatttgctaatgatgtattaattaggcttaatagattcgtctcgtagttttctggcggaatctgtaatttgttttgttattagagtgcatttaatacttcaaatgtgtgtccgtatattcgatgtgagatgaaactaaatatgcccttgattccttcgttgtttacatgtcatggttcaatattacggaaatcggcatgtattggggaatgattgaattgaaatttccgggaatttcgatagagaaattgaagtttgaatagatcttagctgaatttgaacaagcttttagcaaatttatcatttaaaaaaaatctaattagctgaaagaatatccaggcggagggaaccaaccgacttgaaaattttcagtcagaaatatgggacatatatactagagatggacatatagagttggagagctcagaggcagctagagatgatctttgatagggtacaaaactacaaattactcaaaaactctacagagatcatacaacttaaaagaaaaaccatctgtagttttcgatcacccaagctcttattaccaaaagtaatcccaaaaaagaaaacacttgagttacatcttacaacaatcccatattcccatcccatgatccaccagtgaacaacacaactttcactctgcaccatcatatcgtacacatcaagctgatcattaacagctaagtaattcgtgagaaacgcgtcctacaaattctcctccatcgatctttcttggtagagaggagaagaagaagaagagcacagcaaaatcctagacgaaaatcaatagcacatcactctcactcactgatcgtgatcggccaagccgacgagcttctcgctgagctcccagaccttcttggccttctccggatcggaggcctcctcggagagctggttctcgaacgaggccgagttgttgttccagctccagtacaccccggacttggtgaggctggggtcactgacgacctgggccagccgcttgccggcctcctcctcggagacgtagcccttggtgatgtacttctggaagggcgggaagaggaggcggaacagcgggacgtgctcccggaagaggcccgtggtggcgatgcacccggggtagagcgacgcgaacgtcaccccggtctcgccgtggtaccggcggtggaactcctgcatcgtcagcatgttgcacaccttgctgtccttgtaggccttggcgccgtcgaactcgccgccgtcgatcatggcggagctcgacacgccgtcgaggcccgaggcgagcccccggaggtcccccaggttcgccttcggcggcacgttccccgccagcgtgttcgtgttccctgcattcatcgtatcgaaattagaacgatgttcttatagtaacatgttacaatagaatgttgccgatatgctttcaaatgatatgatattttttttaaaaaaaagttacaactgcacttataaagtttttttttaaaaaaaaatcagcttatcgactttgtaatacttgattcattcgtttatactatcaaataattatcatacccattttagaaagcagtataaggttgtgccctccatgcacagaaaaataatccattaattaagtattatctaagaagaagttttcacttttagaggtttgtgcttgtgtggttagctcgtggttcttgaacgcacacgctggtgcgcatcatcctcgacaacttcctattatgtttttcttgtaactttttctcattcttaatacattcagaaggtctctttcaatcttcccgatgaaaaagaaaaacttaaaaattggattaatcacaacaacttcctataattttttttataaaacatgcaatttttagcagttcagtaattgtagtaattgtgtacgtggagaactacaaaatagtagaagttggaagctttgacattagaacacaacagcctaattctggtgaggaagaaaggttgtcattaccggtgatggagccgacgatgatgaggcgcttggaggggtagtcggaggaggtgaggtcggcgaggagctcgcgggcgaggaggaagtgcccgaggtggttgacgccgacgctcatctcgaagccgtcggcggtgaagctcggctgcttggcggtgggctggtacacggcggcgttgcacaccaccacgtcgacgggcatctccagccgccggacgttggcgacgaactgcctgacgctgtcgagcgacgccaggtcgaggtggacgatggtgtagctgcccttctccatgccggcggccttggcggcgcgcgacgccttgaggaagtcgcggcaccccatgacgacgtgccacctgcccgtctccgccagcgccttcgccgtcgcgaggccaagcccggacgacgcgccggtgatgaccgccgtgcccttgcgcagcgtctgcttgcccgacggcgacgccggcgtcaccgtcggggacgacaccgccgccgacgcctgcgcgcggatggccaccgacgacgtgctcaccctctgcaggagagtttcagttttcgtggcaacaatgtcaagatatatgaacaaactaggcctttgtttttatataaaaaattttttggccaaaaacatcacatcaaatgtttgaacatgcaagaatattaaatgtggggaaaaaaataattgcacagtttatatgtaaattgtgagacaaatcttttgaatctaattatgctatgatttaataatgtgatgctacaataaatatttactaatgatggattaattaggcttaataaattcgtctagtttacatgcggaaccaagtttatgaaattacagggagcaaacttgacagtcttgcagtaaaatcaagtttatgaaatcgatccacatcaatatgaacttgaaatgccaaagctaattaagtagtagtacaattttttgggggtgtggcgatgtcagagttttgagcaactatttctaagtacagcaagtaaaccttgcaatcttgcactaaaagttacccaaattcgcatcactttgcaatgctatatatactcaaactaacactgacataaaatccagatcaataggaagtcaaaatgccaggctaatcaagtataatacaatttttgtggcgctgtcagagttgtgagcaactaccatttctaagtacatcaagcaaaccttgcaatcttgcactaaaagttcgtcaaaattcacatcagtttgcaatgctagatacactcactcagcaagtccaaatgtcaacctgaagttgcaaattaaccagacacaaaggctacttggttgcactaacaatggcggcacacactgatgttactagcaattagcaaagctgcacacctgtgaaaacaaaacaagcccctgacattgtcatagctaaaacgatgagagaatcatcatgatataatctcattagccagttgattaatgccaaacacaggcataaccatttgcaacgccacgggtgctcctaatctgacagagcaaaccacagagccacagtggtaagctcctccaacataactgaaagtctgaaactaataatcgtgaagtctagaaacgaaaacctggcaattcactgaacgaactagccaattacttgtactactcgccagttagtagtaagtactaatattagcactaacaaacagagcatcagcacagagcaagcagagtgctgtaacaacattattacagttactaccttggtgcgaaggccgagagcactggtctccagcttgagcccgtcgccgagacgaacgcccaagaacgccgagtccttcaccgctccctacacccccaaaaaccaacccaaaaacaaaaaaaaaaccatttaaccaatcgccgccatgaacacgaagcaaaactctgaactagtctgaactctgaaatgcctccatggctgaatccccgagcttagagctctcacctccttgcgggcggagagcgcggaggggaggaaggaggtggtggtggccgcctggagagccatcggagatttttctctcttttttttcctctgcagcgaagtgagtgaggctttggggggttggggttctaagctagaagaagaagagagcgaaggagattaggcgggcgttttataccaggtggcgataaggcgatagggggaggagtgccacgtggcgccgagctggcgatggcccggccaatggggtttcgcgggctggatttcccctcaacgggatatttattttttattattattgtttctcgtcgtttttatctcctctatgtgcgctgatttttttttttgggtgtatgttggtcgctgtttcggttggggtcgatcgagatggttcgagtgagttgtgcgtggatggatgggccggttttgtttggtctcgccgtggatcgcggttgaaggaccagtatctgggaacggatgagatatgggcctgttcagctgcttgatacagcccctgcaaggaataagttcacttcatgacccttaaaagtgatcgaaatctaattcgtatccctaaaccataaaaaccataaaaccggatatctcgactcccaaactcttaaaaccggtgcaatttgactccctggacgattttgaagagtggtttcgctgacgtgacgcctacgtgacagtattgactcggtcttctttccacgtggcgttaacgtggcattagaaataaaaaaagggactgcctatacatcatgcgatagattttctagccccctatcatgcaaatttttcaagccataggataaatttaatctcatctatttaaatttagggagtaactattaaaaaaaaagttggcatgtatttacattgtaagttcctaaaattacatatgtaattacatatgtaattttagtgtatttatgatgtaagtcataaaattacatatgtaattttagtatatttacgatgtaagtcacaaaattacatatgtaattataatgtaagcacgatgtaattagtaagcgtggatcataagcaaagtagcagtagaaaacactgctcaaatgcaaggaaaaaaagcaggcgtgtgtttcgaaattgaacggtaaatatgtgagacccacagaacgcaacaacaaagtccacataatgcaacaacaaaagctcggtccatctcaaagtccacagccgtgtatgactttgctcaatccaaatgcagcactaattgtaaacagagatgaatggtcaaaaaagtgaaagatttagcaccctatttttttttttgtcaacagagcactagcgattccgataaaaaaatgtgcgagagcactagcgattccgataaaaaaatgtgcgtgacccattactcattcacacaaaaagaaatgtggacccattgacatgtgaggcccacatgtcagtcctctctttcaccttccttctttctcctccctctctcccttccctctctttctctcccctttcttcttccacttccttcccggcaccggcggccggtgccttctccaaccccatcccggcgagagcgcgggcacaagtcgagcagcaggtcgtcacccacggcgctgtcggcgacgccctccacgtcggcgcggcgcgcggccacggcgggctcgacttcttcgtgtcgcgctcgcacgccgcccgcctcatcgacctcgtcacctcgctgtcgtctgcccgtgtcgtcacgtccaagcagctcgtctcgcacgtgaagctctgcctggtgtgccgcgacgacctcatcttcctcccatctgcacattgctgcaatcaagcaaagaaagtagcaggacaagcagtagcagagtaaaagagaggacgaggcttcattgaagtcacataggctagattctaagggcattagcaattcgtccgccctcaacaaggagccaaagcctccacgtaggcaaaaagcaaaacgaggctttcatctccacaatgcgcgtgtagctttggataggccgcatcggcatcgctccatctccaatctacgcgccgccgctagcttcttccccagcttcccgcttcttccgggctccggccggcgcccctcatctcctcccccgaccagcgcccctcccgtggccggcgagcggacaagctctgtggcgtggaccgcggagactacgcaagagaggcggcggaagcctggcggagaggcgacggcgcccgggcggagaggcgactgaaccggcgacagcgccggccggagcggaggcccagcccggggctcgctagatctagcctcgggccctctccggcgcggatgcggcttctctggcgacctcagggtggatatggctcggacgcccctcctatcccgtctccggcgagcttctccggcgcagatgtggctccctatcccccctctctctctccggttttctccaaatgggcggatgcgattttcctggcaaaaagttgatttctctgacgaggtcctcggagccaatgttggtcacacgaacctggagaaggagcggtccccactcccctctctcctccatgcatacactttatctaggtagacaaacattgccacacgccacgtgtgtgcactgtgaatggcctaaaaagtccccggccattgtgcttcttcaaagttgaacctcgactaggagtaatgttcaacttctgagcgtaagatataagatattaggcctgagtaattagttgggccagatgttaggtctagcccatttagcgcctagggtttagggagcaatatatttatgggtgttttcgggtgcctctttttctacccctcgttttccgcgcgcacatttttcaaattattttttgcaaataatttctatatgaaagttgcttaaaaaaattaaattaatccatttttttaaaaaaaatagttaatacttaattaattatatactaatggagcgctactttttccctgtgcggagggttcagtttgggaagtagggacagcgaacacatatcttctcctcttcctcgcaccggccgccggcgcaacacatgagttagggtttcgacatttttgagagggagggttcagggcgacggcgcgggcgcgatgccgttagagatcgaggggcaggcgatggcgaggtcttccgtctggaagaagaagaagcgcgccaagccgatgcctgacaagggttggaagaggaaggggaagggatcgaagaagaagaaggcgaagctgcacgacgtcgacgacgaggtcgtggtggcggcggacgccgccggatccaagtacgaggaggctgccacccatccgcctgggacggagacgacggtgacgatggagctggatctcatcgaccactatctggtgggcgagctcgtcgcctacatgacgggcgcgttgctatgcccgatccttcacctcaagtccatgaactgccccttcgtcgaccccaggcacctcgctcctgtcgagaaggatgtagaattctccgccaacatcctcaagcaacaccgcctcaccaacggccccgtcgagctccagatggaccccatcaccacctccgatgaccatgaccaccacgacgacgacgagctcatcgatatgaggggctggataaactggaggacaccggaggagatgaggaagaggatggtcgaggaggaacaggaggaactggaggaccaagcttaaggaggaagcttaatttatttaacaatctgcttgctgtggctttgtaatttgcaagtttctgctcatcattatactagttatatattatactagttctgctcatcattatgatgtaatcttgcaccttatatcttgctaccggtgattcagatatatcaagttaaaaatggatgtagccactctctgctacttaaatttgttgtcttgttgctactacctccgtttcataatgtaagactttctagtattttccccattcatatagatgctaatgaatacgagaaatactagaaagtcttacattataaaatggtggaagtatctattaatttatcgtcttgcattaacaatttttttgggtgcaaattgagccgttttttttgacaaattgacccttttcaaaaacttatttcgaaactaacccctgccaaaaacttcaaccaaaactaggccgtcggctcagcgccaagcgcattggcgctgaggttggccgtgtcagcgccaacgggactggcgctgacattgtgccaccgtggcggccgggccgatcccctagctgacgtggcagctacctcagcgccaaccgcttcggcgctgaggtgcccaacctcagcgccaagtaagttggcgctgaccttggctacttagagcccggccgaggccgccccagccagttcttcctccgttttttccccagccgcccgcctagggttcggtcgccaccgcgttctcctcgcccaatctcccccaaaaacctctctaatcgaaggtgatttgtgcggcattgagtttgggatcggaagagaaggtaaacccttctataaaccctaagttccccaaagttttattggatattttgcattgttttggttgtagacgtggtttgataatagttggctaaggatggattattagatggataatatgggtggggatgaagtgtggaggtggcatatctttatccatttggttgttattgatacatttgacaaaatatatttgggatggatgtttggtgatgcgctagggtttgatgggagatggatgtgtggtgatggcctaggatgtgggatggatttgtggtgattgagagggtttgaaaggggttgatgtgtggtgaagggtaggtaatttgtaggagtagagtttttttttatcaataatgtgtagtatttgagtaatgtacttatttattggaaaaattagacatgttgttagcttttgaagtattggtattgcaatggtaattacatattattttcaagtaattaatgtttatgcatgggttaaaaattgtagatggatagattggtccggcttcattatggtggttgtgtggtagatgaaagtacacatggaagccaatttgagggaatgacagttagacaattagtgttttttgcgaagcctacctttgaggagttaatgtctcgcatcaagcatgaattggattggaatgatgagtcggttggtatgcaagggagatacgatgtgggcggcggtgtcatgtcacataaatttatgttagacttgaatggagagatcgaatggcaaacatatatagatatagtattggggtcacatttcaaatctcttgaggtgtttgcatggaagaaagatgttaggatagggaagaaagaacttatagaccttaatgaaagtccactcatagaatcacccattagctgtcacgaactgtcagagaggtgtagtaggaaggaagaattgattgaggaagacgtggaggggggcgagggagtaaatgatatggcggatgtggaggtcagggaagagaatgacccggtaagggaggaagtcatgcagaggagaatgtgccgttaagggaagaagtacatgcagaggacaatgtgccgttaagggaggaagttaatgtggaggagaatgtgccggtaagagaggaaggagatgttgaggatggtcgggaggtaggagatgatgtggagttgcctgaggaagaagcgaatgctaagaatgtaagtatgggcctaagggagttggctaggctgaaattctatacccgagaggagtgtgaggaggctatgatacgcagtggattgaacccaggctggttggagtatgatacagaggatgaattggatgagtccgcttccgactccgatgatgatcgtccagtgcgtaagatgtcagagcatgaaaggattgtgtttgcgaaactggtgggtagaaacccggaaataacacaattcgaggatcttaccagatctgggctagcaattgctgatggggatccacaatatgacggtgccttcgaaccaatgtgtgatgaaccaaggaaggggttggagtttcgatcgatggatgatctgaaaatatggctacagagttattctatccgtgtccaccggccgtaccatgtgaaggaatctaacgcgtcagtaaagtatactatggcttgtctcgatcgccattgcaaatggcagattaatgcaaggaagagtggaggagataggtggcgggtgactagggtgggcgaagaccacacatgctgtagtgcggaagtaaccggcaagcatttgcaacttacttcaaggtttattggaaacaggttacaggcatttgtgcgagctgaaccaactttatctccagcagcgattgtcgaggcagttgagcaaatatggcactatcggcctacgtatggcaaagcatggcgtgctaagcaagttgctatgaaggtcatttggggatattgggacgaggcgtatgttcgcttgcctacactgatgcgtgccatcaaagcaaagaaccctaccatgcatttccgtgttgaggctcatcccgagaagtccaggatggtggatggagtacagaagcgagtatttggacgtgcatattggatatttggccagtccatagaagcattcaagcacttgaggccggtgctagcaattgatggcactttcttaaccggtaaataccaaggtacattgctcatggcaataggggtcgacgccgggttacatcttgttcccttggcgtttgctctggtagagaaggagaatacatccaactgggagtggttcatcaacatgttgagaaacaagttgatcggtcctaatagagaagtgtgtataatttctgatagacaccctggcattttgaactccatcatccacatcatgcctcatcacctaaccattcaccacaggtggtgcatgaggcacttctgtgctaacttctacacagctggagctacgactgatcagatgaaagatcttgagcgcatatgtcaaataaatgagaaagcattgttcctagatgagataaaacgcctcatgggtgtggtcggagagaggccaaagaagtggctagaagaccatatgccacttaaggtcaaatgggcaagagcatttgataccaacgggcgctgagtgtcccacggtcagcgccattatggctggcgctgaggtcccagcccgcaagccatccagaaggcttgctgggctgggccgtttcggctgggctgggccatggccgaaacggccaagtcccacctcagcgccaggtgggctggcgctgagtgtcccacggtcagcgccattatggctggcgctgaggtcccagcccgcaagccatccagaaggcttgctggtctgggccttggggttgcggccaagtcccacctcagcgccagtccggttggcgctgaggtagctgccacgtcagctggggatcggcccggccgccacggtggcacaatatcagcgccagtctcgttggcgctgacacggccaacgtcagcgccaatgtgtttggcgctgaggcgacggcctatttttggttgaagtttttggcaggggttagtttcgaaataagttttctaaaagggtcaatttgtcaaaaaaaaacggcaaattgagtgcttgctggggacttgagaatgactggtgtttatatatatgtatatatatttaacccagcatgctgctatggccaactggaatcggtatagctcattactcaagacttgtatttgattaatttactcttcttccatactgtaccttgtgctgcttgcagatttatattgaggttcagtcagtggtcttaaagtgacgccaagtcatttaaggactcgtataatctttactgtcttattgccacgcttttaatttccctcgtgtgtcatactcaacattatgtacatggttcatgccataacatatttcatctttttgttttggcatggtcctttaagagcacaaggcttcagaagcacaaggaagggcaacaccgaaggcaaggagagcttgatcacaccccgcaccacctattcatgtcacaggcagcagatttcaggttggctagcctttttccctttgtttttgcatgatgatattttagcaaatcaaagtgcccgattaatattccgattctaccacatcgcacacatcggaaacagaaagaaagaagtttctcattccgtgcttcatttttacttcctccgtttcgttgtattgtagggcgttttgatttttttttcctgtagtcaaacttttttaaatttaatcaagtttatagaaaaatttagcaacatctaaaacacgaaattagttttattaaacttaacattgaatatattttgataatatgtttgttttgtattgaaaatgctactatgtttctctataaactcggtcaaacttataaaaaattagtatgaaacagatggagtattatgtttccttctgtcttggattttcatgttatgaattgaagttggttggtcagtgtcaggaagagaaacttgaggtttttgttgaaatgtaaaggggtttattgatgttttcttttaggtaccccttaattaaattaacttttactcttattagctgacatggtgttataagtacagggtggcacatgctgaggaaccaaagatggcaactggtaaagaaatgtcaggatctatgaggtcagtatggtctttttgcctctatatctttctatttagggtacccggtaccaactgatgtcaggctatatctggtaaatgaaagtgggatctgttttgcattgtcatgggaagaaagtagtgaggttctaagattggtgcatatccttattgtcagtggcggatcttgatactttttaaagcccgggcaaatacatatgtgaagaattatatacactgttaatcactgaaaatttaaggtattgtaatggtgtgatccgccggtgagtccaggcagctgcccggagttgccggaccttggatccgccactgcttgttgtccagatatattgtcataattgctaggtgaagctgaaaaaaccaaaatgttttcttttatggatctgtggtagtctgccgtcatgtggtttatcttatctacacggtttcatataactggtttctgctctgctatgtataattcttctatttaaatgcatcatactgatagtgtttagtggtatgacacgtgagaataatcagatttgtgagttaatatagaactgtgggctgcaaaattagtcgttgagcatttagatgtttctacgcctcgcaatggcacgtgccctatcaggtaacaataagcatgttgtagcagacaaaaggatttatattttcacttgttgacaaattagaatgaactatagaaaaaaatagtcgttggttacatggagcattgtactcgatgcagaacaaccttaatgagagcgaatgccattggggggcagaagaacatgttggtggtgttcttttcttctaaaaatgaagatgaagatgatgattaagttttttacgcaaaatgaggtagtattaacgtatgattgattgagttttaattattacaaacttgaaaaatagatttgtatgatattttagagcaactctcttgtagaaagttttcgcatgaaacgcactgtttagcagtttaaaaaatatgtcacgaaaatcttaatcttcatccaactttattggaggaaagaacatgaccaagttgtgtgattgggggcattgagagcgaatgcacgagatgattgcgctgttatttcagtatgacatcccgtgcagaccagaacgtcctacgaatgtgctgcctatggtggacctggtggatggaatggtaagaatttgatatgaatgtgttctgctcaaccatctgagagtttcaaactgatcaacagatgctgttgaacatcaattgctttcttcagagctcacacaatttctgtcaattgtgcagcactcgtcgttcgcagctcagggtcagcattggtggtgcctcatgactgcaagcgtcttgacaccaaactaatcatagagagcagtacagattagtacgtgtctgcgaatacagcctaaatttatcaggattcaggaagaaaatgtttggaatttgcaaaggatttgtagagctggaaatgggatgccatttggttatatgcagaaataagctgcaagcctataagcgtatatgtaaggtgccatcaaatgcggtgtatatcagaagtttgtaacgaaagttgcagcaataaaacggtactcctgccactatcttatatatgtgttagtatgattattagtcaagagttatcgagtttgattttcctcaaaagagagagggtgccatgtaattcgggacggagggagtatggctttgtttagattctaactttttattcttcaaactttcaactttttcgtcacatcgaacttttctacatacgcaaactttcattttttctatcacatcgttccaatttctttaaactttcaattttagcgtggaactaaacacaccctatgtcacattgttgctagctctgctctagctgacttccttcgcttgaagcggaaagcgcaccaatgagacattgtcactagctctgctctagctaacttccttcgcttgaagcggaaagcgcaccgatgcactcatcgatgatcgctcgcatcctggagggctcgaacttcttcccggtggtagagcacggctcaaacatacacatcggcgaacaggtccagcgcgaagcacgtgctcaagttctgtgagttcgatggcaaagaggacacctcacgtagagaaccctgatggggccaatgcgacatagatggtgttgtccgaaacgatggcggcctgccaccagtcgcctttgcccctccctcaccagcgatcgggaacggatgagagagagggaagatgggagtggaataggagatgggaagaggggaggctagaggaataagaaatagacctgacacgtggggcccactcaccacatcggctaaaatcaggctctatactgcttggaatatcgggtacaccggttttgcaagtggagggcctcgttatatgtacaattattacggtttgaggacgaaattagttactccctccgtcccataatataaaggattttgactttttacttgcactgtttgaccactcatcttattcagaaaatttgtacaaatataaaaaagaaatattgtgcttaaagtactttggataataaagtgagtcacaaataaaagaaataataattccaattttttttaataagacaaatggtgagttaaaattgcttatattatgagacagggagtatttcaacgtcaagacgagagatctaaagtgaacttatccctatatgtaattagttggacctgtgtggtaaaggtccagcccatttagcgcctagggttaccctctcctctctacctcgcagtggccgccgccgcaacgcatactcccttgtcctaaaaaaaaaaaagacaaacactggatttccgtgtcaaacgtttgactgtccgtcttatatgatttttttttataattagtattttcattgtattagatgataaaacatgattaatactttatgcatgacttgtcttttaattttttttaaataagacggacggtcaaacgttggacatagaaaccagggtttgtctttttttttttgatggagggagtacgtgagtgaagggtttcgatagggagagattagggcgacggcgggcggggcgcgatggagagggatgagatcgagggaatcggcaagctcaactcccctgagaagaagaaggagaaggagaagaggaggcgcaagcacaagcccgacgaggcgaaggaggagatggtggtggacgccatacccaaggaggaggagaatctcaagtcccccgaaaagggatcaccgaagaagaaggagaagaggaggcacaagcacaagcacaagcccaagcccgacgggacacaagccgtactcaaggaggaggaggagagcaacagcaagtccaaggccccggcggagggcgagaagaagaggaagaagaagaagctggtgacggtgaagctgagcgacgagctgatgggatacctgcggaccaaggaggtgatggcctacctcgcgcgcgagacgcctcgcccgctcccgatcgatccgggcgtcgcgcagcacatgttcgtcgaccaagaactcaggcaggaaatcgccgcccaggttcacgagaacagggaattcgacgccttcgtcctctaccagtaccgcaccaagggctacgccgagatccagcaggaggtcaccgacgacgacgacgacgacgacgaggtgtagctagaatcttgcagggaatcaataatggttggtggtaaggagcaatgatctgtgatccagctaaatatactagagtgcttctgctcattaatcattattaggatattactatgtctaatggtgttattattattgcccgtatctttgctacttgtaactaaacgtgtgggaatcacaagtaactgctttcgtagttaaaccgagtgaattgctaacgtattggaatgaatgggattgcaactgtgatttgattctgattggcatagtacttgtcatagtagttgtgatcctaaatgtgaatgatcttggctagctaacccgaacgcttcatgttactctctgtttgtgctaaaagcgattcggatttctactatttatgacttgttaccttcctgatctcgttaattctctttttgtgtgatcctattcgaattatgtttgaaaaacatttcaattatatcgcctcatgtggccgtatctcattcagagcagcttcttctataatgctgtttttctctgcgcttttgccattcatctattcattttgattaatcttcaaatacctcagaagtgtgaatcttctgcggtattgttcttttcttcatgtgccaacgcagtgtggtttggtgctttttttcatattgtagtagatatcactctcccttggttatacaatcaaggactttttagtggaggaaagagtaaagattccattcttttgtacatttgtttatagaagcaatacgtgtgctgcaaaactttgtgagccttatgcatcgtactgctggctaaatgttttcatgtctaatgaatagtacactagaatgagaaatgccatgaagacctacagtaatattatgttgtcactctgtaaatgtttggcttgctgtaaaatcattggctgggtcgaaggaacaacgaagcattgttgattccctagggccccatgccttttctgtacaggggataagaaaatcttgctacatggttaacaagccggagaacaactgatgacatcactgacaactggggcaggttctgctcatcttctctgtagtatcatttacataatacttgagtttttcagtactccctcgtttcacaatgtaagtcattctaacatttctcatatttatattgatattaataaatctaaacatatatatctatctagattcactaacactaatataaatgtggaaaatgttagaatgacttatattgtgaaaaggaggtagtactgatcatgattgcgctgttatttcagtatgacatcttgtgcagacgaaaacgacaaatgggctgcctgcctatgctggacctggtggatggaacggtaagaatttgagatgaatgtgttctgctcaaccatttgagagcttcgaaccgatcaacagatgctgttgaacatcaattgcagatcctggcatgcttgaagtgggcgatggggagatgtcttaatcggagtaccgctcacagttcagtatctgtgggcacaatcataggtaccatagcatgttttgtgtactaacagttttgctgcaatgttgaatattttcttttgttgcatttcctcacagcaagctttgcttcaactgttcaggctcctcttttgattggatgtgatgtgcgctcaatgtggccccgtttagtttcccaaaaacatcacatcgaatctttggacatatgcatgaagcattaaatatagataaatgaaaaaactaattgcacagttagagagaaaatcgcgagacgaatcttttcagcctaattagtctatgattagccataagtgctacagtaatccacatgtgctaatgacggattaattaggctcaaaagattcgtctcgcggtttccaggcgagttatgaaattatttttttcattcgtgtccgaaaaacccttccgacattcggtcaaacatcctatgtgacacaaaaaaattttctttttggaaactaaacaggcccgagccagcagatgaaagacatactcagcaactgggaggtcatcgttgtgaaccaaggcaagccttctctttcacatgcttagatctagccatattctttgatatttcaccatactcatataacaactttgtgcagacagactaggtgtccaaggaaagaaaatgcaagctgacaatggattggaggtaatccctgttcatctgcatcagtggttttcaagtttcagccttgtctttgttccatgctctgaagctggcaatactgtgttaatttgtcgataggtttgggccaggtcactcagcaacaacaggaaggatgtggtactctggaacaggccatcactgcgcattggtcgagcattggactcactgggtcagtggctgtcactgctcgtgatctatgggcggtaaacttgctttcttcagagctcaaagtacaacatcactcttcagaattcagagttcataacatttctctcttgcgatttgcaaggattggtagagatggaaatggatgccatttggttatatatatgcagaaataagctgtaagcctgtgcatgtaaggtgccgtcaaatgcggtgtattgctgaagtttgttgtgaaagttgcagcaacaaagcggcattcctgccactatcttataaagaaatatactcgcctgaagacaaatctgtggcaaaagccttcacagtaaagagttgagacattgcaagacatcacaactagacagaatgcaaaacacattgtggatcaaaacaatatcagctacaactaaggattgggtttgcaccagccaaatcacctgcatctgttgcttcaacaaaacaattaatatccacgaggctgccgtctccgcctccccgcccaccggcgtcggaaggatccagtccgttggtcagtacggccgtgattcaaggggcccatatctgtcgggccggaacgggactctgacttagatgtgcccatgttatttggtctggaagagattttgatttggaataaatccacttcgactccattagctagtgagcgaatctgattggaaaaagtatacccaaggtccctcaacttgtcatcgaattgcaaaatcgtcctccaaccgtaaaaccggatacaacttataaaaccggtgcaaattagactcctaggcggttttgactccggttttatccaacgtggcagctgactcagcatgggacccacgtgggtcccatatgccagccccttcttcccctccctctcttcctctctccttcttcccctccccatgcagggcagccggccggtgggggagcgcgggagaccggcaacgggcgatgggcgacgaggcggcagcagcgccgcacggcctcctgcgcccgccctcctagccaggggagccgggggaggagctgggtgcggccgtcgggggcggagcggggctcggctggcggggcggagctgggcgcgggcggcagccggtaggggaggagctgggcggctgcggggggggagggcgggcgcccgacggcctcgatgacgtcctctggccggcgacatgcccatcggcgccaccctcacgaagatggtggccttcgtcgacgacgacttcgaagtctacaccgtgcccaggcccacttcgacctctcgctgcaagatgccccgaatgaaactcagcagctagcctataaatagtcctgacaaattatgggccaacacttcttgacaaaaaggccattaaaaccatcaggactaggaggcctggcaatggacaattttttcacataaaaagtgcaccgaaggtccctcaacttgtcatcgagttacaaaatcgtcccccaaccacaaaaccagatatatgacatctctcaagttacaaaaccgttcaatttaggtccttcggtgattttgatcccggtattgtccgacgtggcagctgagtccgcatgggacccgcgtgttagattgaccacgtcaccacttcttaccctccccatcaactcacttcctctctccttccctctccatgggcggtggccggcgaagagcagccagggcggcgcgacaggacggttcggcgggcgcggtcaccggtgcagaggagcacgccacggtcgggcgtcgccatggcctctcttgtccccgtcaaagtcaccccgctcgacgaggtcggcggcggcgagcatggtgtcgcgtcgcggcgtgccccgttgaagtcaccccggtcgacgaggtcggcgcacgcgagcggggaggagcgtcggtggtgggaccacaggggtagagcgaagggggagctggaggggaacggtggtggcgaggtggaggaggaggatgccgctccgacgaaactcccattcagggcgagggaggagcggaagacggagacggcgacagcgggagggaagtggggatggaggcggcgaggagggagttggccggccgacgcgttgtcgccgccgccgccgccgttgtccttccggccgttgctcatccgcgaggccgtccccaacaagccgccgctccggccgtcctcccccgttccagcgccatggcagccagagttcttcggcgagggtatcaccgtcaacggcaaggcctggccgttcctcatcgtctaccgccgccgctaccgcctccgcatcctaaacgccatcaacgcccgctacttcaacgtctccctctctaacagcttccccatccacgtcttcggctccgacgcgtcgtacctctcggccctggacaccgtcaccaacctcctctccctggccgagatctttgacgtcatcatcgacttctcctagtcgccgacggccgagatcgagttgctcaactcggcgccctacccgttccctaccaacgccgcccccggctcgctcaatggcagggtgatgaagttcgtgaatccgcccgcacgcggctcctcccaccgccgtccgccgcacgcgcatgcttccacctttgcgcccatccccgcggcgccggcctgcgcccggcccgccgccgcagcgtcgccacgccaccccgccgcctgtttcctacctcgccctgccggccggcccgcacgaggtgagcggggaggccggcgaactcgcgcgcgccgctgtgggtggcagccctagggccgtccccgtgtgagagcaaagagagagcgagaggaaggagagaaacgaaagagaagaggggaaaggtgagtaggtgttgacgtgtggggcccacgtgggtcccacgctgagtcagctgccacgtcggacaaaattggagtcaaaaccgccgagggatctagtttgtactggttttgtaagttaagggatgcgttgtatccggttttgtggttgagggacgattttgtaactcgatgagaagttgagggaccttcggtgtactttttccaatttttcacaatattatcctagcgtgggccgtgggcgtgtggcccatcactgggccttttccaaaccgacttttggcagctaaaacctgtcggtgatcgatccgagccgcgtcgtgtcgccttgcctcgcctcgcctcgcctggacttcgacttcgccaccgtcgagggcaccggagatggccaaccaccgccgccaatgggcgtcgtggcagacgttccaccccgtccacccgatggaggatctcatgcccggcggcgtccgcctccccgaccccgacgagcagccaccggaccccatctacgccttcctcgaggtgttcgaggagctctacggcgaccagttccctccccacgtacgccgtccgccgatcaaaactcgatcgatcgattgattttggcctttgatttgctcatctgcttcaattccacaccctgcaggttctcctctacgactcgggggatcccaacggcggcgacgacatggaggagtctgatgacgacgtcgacggcggcggcgagagtctctccgccatcgtctatggcggggggagactgcacccgtcccggcgcccgtccgtgccgccgccggaggagaggccgagggggtggatgccgtgcccggttcttcctcgggcgggaggcggccatggcgatgccgacgccgcggccgccgaacaaggggtggagggagaagggccggccggacgcgtggcagcggttctacctcgaccgcggcgccggcaggcacgcggcgtcggaggcggaggccaaccgggagctctggatcgcgttcctgctcgaccgcggcgccgcgaagagcacctcgtggtggaggtcgttcgagcggcggttcgaacggtgcgccgccgccgatccctactacgccgccggcgacacgccctgcgccatggtgacctctttcacgttctgcttccagtaataggccttggtaccctatgtacgtctttcaatgggagagtgattaatttcagctatagaatcataagcagcattggcacaatagaactcgtagcgttttgtaagtagcatactttgcaaactttgcgtttgtttagttcgcgaaaagaaaatttttgggtgtcacatcggatatttgaccggattcgggggtttttgaacacgaataaaaaaactaattttataactcgtatggaaaaccgcgagacgaatttattaagcataattattccgtcattagcatatgtggattactgtagcctttttctagaaaatgcatacattgcgacatggtgtcctgaactcctaatacaatttatttctgttttcgtgggccaatcagtagtaaactagtaatctattttggaatttgaagatgcaattgatagtgtagtggtaagggtatgtgttgaaaccacgctcataattctttctcaaatgaatgtttggaggaacttctttgtctccaaatattaatcctgttcttttttctattattaaggaattccgaattttctgccaatctcatgtctcttttctgctgacattgtctggtgtcataaaaaagtatgtgttcaactgttcatggcttcaaatgctttccaaaccttttcttcagagtatgtatgtgatcttttgattggctaacatatgactggtaattttggagcacggcaaatgtaagagagcaagatcggggtacttgagcattggtatctcctcgtagtgcaagagtgttgactgcacgtcaattgacgataattaactttgcagatgttgcctggtgtcagcctgtcaggtgactgcccctctttcttttctttctttcttttttttttgtgatggaagtttctactctagttttgctccatggagtatgctttaatcttaaagcagtttgtctacaaattccagtctccaaattaaatgtttagagtaataatttgggggaaataacctccatttagcaaaagggaaaaattataaagtccatggtcctaacttgtccttgtggaatgctttgatgcatgccagtgtagacattgttttgcatacggccgagtgaaccaaattaattgaacagcttatataactatatgtctgttttgttatttctatatcctatctctgttttttttaatagatggcggcgttaaattttaaagtaaaatgctatacgtactaactttttattattaaaatattactaacattgatatgctataagtacatttagatattttttataacttccatctacctaaatcaaacagttgagatggttgttagtaaaaatttagtaagaaaaaattaatacgtgtatcagtgccgaccattcgtagattttcaaaaggttagtgtaaatatgataaaatacaagtcgattatacttaaattttctttaataataaaacatgccgcaagaaaataaatgatatttatattttttttataatataataaatggtcagatattatgtaaaatctattaaaaatatggaaagagtacattattaaaagcgtgttgatgaaaaaaatacatactgacttgggagatctgcttaactccaatgcagatcctaaatcttgctttcgaggacttgggatatctgcttaactccaatgcagatcctaaatcttgctttcgagcttaaatgcatgccagttgatttgatcctgcaatcaacaagaaaggaaaacaagaaaataaggttaaatccgtaaacgatagccgatcggctaagggccgatgacatatcgttaatcactaagctgatgtattagcattagatcggtaatgaagaataaagccgatcaatgtggctcctaattaataagatacaactgcccctctgtgggctcatcccaattgcggcaatacttgtgcagcacgtcaatcgatcccgaagatcaatattaacttctaatttggtacatgatctaccaatttagtcgtcaacaattatacaccaaagataccagcaataaaacaatcgacacttgaatctaacgattaaattagcggatttacaagtttttttttgagttgtgatacaaattcatttgcacttaataaaggccagcttctgccgtagtggagcggaggcctgtcgccgggaggcttgggccggatcgtcatcctttttagggttccaccatatatatacctcttgtaagccgttgtgcggcgttgtaaccccaccctagatatagtgaagatattttgctggctggcgcccgtggttttttctctcctactttgggagggttttccacgttaaaatctcgtgtcttctgtgattgatctattattctttatcatttgtttgcctatcgtttcctaacactttttgcccccaaaacttttatatttgtgaccatcggatcgcctcgagatttgagcatgaagagaaaaaaatgctagaaagaaatttttatacatgtcatgcataagatcctagtgttatctaatcaaaccattgttgaatgcaagttttaataagttatatataaaagttatagtgcagttacagtgcaattacacttcagttatggtatagttatatctgaatgtttttgacccaaaaaatttatttgtgacagttttttagatactctcaaaaattagatttgtctcccaggaattgagactgcaggtcaagcatatgatctcctggcccatttccgaaccattttgcgaagctggtccgaaattaagctctgggtggctacgtttctcttctcttttccatgccagaatcgatcgatcaaaaggcatatgcatctcctgtttctgcatgcgccgatcaagacggacgcgtggtgacttcactgtaggtatatagtggaagacttgagacggcgacggcggcggcgggaggcgacaaaaacgcttgttgttttcagtcctactcactcggcgggcgatcactcgtggagcagagcacggaactgatcgagagagagaaaaaaggggccgggagagtgccttttgcgcgccgaccatgtcctcctcgccggttcctgtcgccgtcgccggccaccacgcgactaaactaccaatatacaccacgcccatatacctacgtggtgggggccgaccaatcgggctagctttgctagtcttccagcgcaagaaaactctgcacttgtatctgtccgtagtggcggagccagtactgccgcaacgcataagaagatcgcacgtcaatatattagaagcggaggtgaatagtaacgttttccgatgaccgactaatttttatacgtgtggacggttaacgataatggagacagacatatcgttttaggctgcccgacatgccggggagctataactccgccgctgtgtgtctccggctctgatcacggtagcggcggcgaccgttgttcaggaaccgctggaattgataattggcggttagcgggtggtcaacagtggttgctcaactattgaagcacaggaacatttttttttactttttaattatataagagaaaattaatgtagtatttcttttgtcccagaattataacaaattttagttataaaccttaacgagtatgtctaaatttgtactgcaactgctgcagccagccgctggacttttttttttcttgattcactgttcgtataggctacagtagctagcgctgcagcccttgcctgcagcggaacacacccattgtaacactttttggatttacatcgattcatccattgatcatatatatatatatatatatatatatatgtatgtatgtatgtatgttttgtatatgtgtctagatctattaacatctatatgaatttgggtaatgctataaagttttatgttgttgaaacggataaagtacttaaatattgttatagttgtaaaaggagatagtagtatattttctcgagagtgctttcttttttttttaagaaatcaagagtgcaattttgttcaagaaaatgcaactactactgctatatcactggctaaccaacttttgacccgtctacggcgatcaagagagtgcagcactcagtggtatatatcttaattgcgctatctcctcacagattttaagttatcttatcagtccgtgttgcaaattgttcaaataataaatcacactttttttcttctttccaaagtgcaaatcatgtcgattatacacatgtcatgcatgcagaagtcttctcttcctcatatgtctgaattttgattctcgatagttcggtccgatgatatcgttaacacaaattggttttatatgtaagtttcacgttttgaacgaaaaccaaccagaaaccacgaaatgtataggtgttttgacacgggatgagagcagattttcgagtgaaatttgaatggtttctgataattcaaatattgtgaaaacttgaccaaaatcttatcaaaatttgattaaaatggcgaaaaccgtcatattaccatcagaagtccgtatctgttgctcaaccgaaaaggtgaaccaatccttgtgtgctcgctctacagctcagggtttttgcaccgtccatcactggtaccaaacttgggaacttgtcttgatgctattctacacctgtttgattaatgcaatacagtactagtagtagctacccgccgatcaccaggcatgtgtaacttttttttaaacgagaagatatagaagtgtcaatttaaaagaatataggaagaaaagggcattattcatatatatatatatatatataagagataaaaactaagaaaatagttagattgtacaaggaactagctagcagcctaaagtaacatctctgttagatacttggcttttgccgccgtttaagttcttgcctgttcctctatcctcgctatactacctgtcgtagggacggatctaacatgagagcggcgggctctctgagcccccactactggcgtgatgactatgaaagcccccacgaagaccctactaaaattttttaccatatatagatgggagggggattgtaactctatctagtttgctcagaccccactgctattttttttgatctgccactgatctatcgtggttagctcttacttctctttggtctataaaagctaacctaggtgggaatggaatataacctcctctgttcagatttgggttttttttttacggagaaaatatgtcggaaaaccattcattactagaaaaaacatttttctaggcgggcaaaagtagtttttccaggcgggggaaaggagcgcatgtacgtaaaggcttgcgaacgcccaacggcacctacaaaaatcattttcgtaggcggttgatccacccgcttgtaaaaatatttttagcgaaaataaaaaaaatgccactggtggcctcccccttcggcttctccccattcgggagacggctcctcctccatccgccggcgctgcccgaggggcggccgccgttggttcctcctccgtcaccgccgcatccaccacccccgccctcccccgtcggcccctcccttcggccgccaactctcctccccctcccccagtcagatatgggaggaggaaggagggagcgttgcctccgtcgctgatggccggctcccctcatctggccggatttgggagggagggacggaggaaggggagcggtgccgccgactctcctcctagttgtcgtgcgccgccgtgcctctggtggccgccaccttcgccctcatgccgcctccactgctactgccgccgccggccggttcccctcttccggctggatctagaagggagggaggagagcgccgctggccaccgccctccccccttcctcctcgggccagatctgggagggagggaggggagccatagccaggagcagcagccgccaccgccactgccctcccccctccctccggccaccgcgccagggtgcgccaccactgccaccggtgggaggggagaggggaggagaggtgggaggggaggggagaggagagaagaggtgggaggggacttagaaaactttggctgcgagggaagaggggagagaggtttttaaagatgcttattttcgtagatggacaactatctcgtctcacggtttttattttcgtaggcggcaatttagtttcgagagacctacccgcttgaaaagaaaataacgcccacgtctcgaaaaatgatttttctagtagtgattttgtatatctccctacttagacacgtgtaatgtgatggaccaaaaagtgtggtcctccactttccacacctgcaccgctgctgcagcacacaccgcagcaggagggtcgggtggctgcatgcacgcatacattgttcagtccacgtttgcttcggttcgcttttccgtcgcgcgagctgatcatcgatcgccgccctcgtctccactatgaccttagtcattaagcaaaagaaattaagccccctcttcttccacacacacctaacctcagtgctccctcggtaattgtaaaggaagttgttttgtacagcgacacgttctttaaaatataactttaacctttttatttctataaaaatatttattaagaaagtgatatatatgtatacttttataaaattatttttcaagacaaatctatttatatattttttacgttttcaaacttaacaacttgagaattattcatgatttatattcccaaggtttgacttaggtggtgtttggttggagggactaaagtggggctaaacttttagtctctaatttccaaacaccctcttaaacattgtcctaaacaacttcctttacgagcaatggagggagtatacctcccctctcgcctagctatataatcaaccccgacaccttcactgaaacacctccatggctttccaccttcgcttcctcctcctccttgccctctagctactagctcacactgtcacagtcaccacacagctactagaagtaagatttagctagattattcattaatctgtactaattgatattgctaagcagctgcagcagcagcagctggttggggggaggaagaagaaggagagtgttcgatcggcggcggcggcggctcaccggtccgacatgcgcaggggttcaccgtggtacgactactactactcctcgtcgtcgtcgtcgtcgtcgtccccggcgcggagcaagcgcgcgcaggcgcagctcgtcgtcgtcgtctccgccgccggcaagaagctaccctggccctcgccgcggcgtcgcgggagccatgtcgtcgccgttcctgggctcttcttcctcttccgcttcgtcgcccctctcttacctgaccccgcctaggcctcctcctcctcctcctccccttctcatggtacgtcacggattagctcgatggttgactgatcttgacgatgagctgatggtgttcgacgacgatcttggcgtgcaggggcagggatacgccgctgctgccaatggcggaattggcggcggcggcgtcgaggcggtgaacgcggcggcggcgccgaggcagggtggcaggcacgccgggcacccgccgctgccgaggccgccgccgaggcagtgcccgcggtgcggctcggcgaacaccaagttctgctactacaacaactacagccgcacgcagccgcggtacctctgcaaggcgtgccgccgccactggacggagggcggcacgctccgcgacgtccccgtcggcggcggccgcaagaacagcaagcgcgccgccggcggaggcaaggccggcgccacagcctcgacggcggcttctgcccatgtcgtcgcgccggcggcggcgccgccgacgtcgtcgtcgttccccgatctcctgaggcagatgctgatggcgccggctaccgccggtggcggaggcggctacagcatcgacctgaccgcgtggcagcaaatggcggcgttcgcggctccacctcaggccgccaccggcgatgtcggcggcgcggtcggagcggcgtcgacggcggcgccggacgcgaactgcggcggcggcggcgtgcagtactggaacgggtggctgcaagatgacatgcccggtctagatggttcatgttaagtaacccgtgcttgtattgatacgtatacgtatacggagctacggatatatataccgaatacgtatacgtatatatatgtgtgtgtatatgcatgtatagcctatgtatgcatacatgcatacacatgcgctatgaaagtatatacgtatgtcgtatgcgcatactaaattagcgtaacaagagcctatgactgtactagtgtagtttggattcaggttattaactcgtgggtatatgttgacctactgtagttaaatttgtgtatttgtgcgactctgcccatttctagtttgtacgtgcatctatgtgttatgctttttttttcccttttttaagtactactcccaccgttaaatattactccgtataaacttagttaaactttgttaactaagtttataaaagaatttaatgacatccaaaacactaaattagtttcattagatctaatattaaatatattttgataatgtgtttgttttgcgttgaaaatataactatattttttataaacttgattaaacttaaataattttaactagagaaaaaactaaaatgacttataatatgaaagggagggagtacaaagcaaattgtcagacagaaaaacaaaagtgaaagactgctatgtgcttgcttacatacataaaagcactagttatggttcaatgtaagtcaaggatcatatcttgataagtctcaagccagtgggtatattccattctgctagatgctctgatattaaccccatcaatttgtgaagcgatttcatagcactttgctataatcatctacagtatatagctctgaaaatgagcaacgagacacgagagcagaagcaccggtagcagggaacccacaggcaagcagaacaactggcaaaaatcctctgcaccaacagaccaacaacactttgtgtgcaaaagacctaacaaaataaatttaaatcacatggttaccaaaactgtcacagtattacacagtgatttctctctctctgaatatgcattgtaataacagactaattaagcacaaatagcagagacaagatcaagtgaagtgatggttcagggtttcagctgtacgggctcatgccgatggtggcttcccggcgggcgtaggagacccgcgacttggagaagtagaagtagtaggctccggtgagcacgcaggtgatcagggagaaggcggcgccggcgccgaacgtgccccgccgcaccgtctcgcagtccggcgggttctcgaagaagaccttgcggtagcgggtgtggtaggcggactgcaccagcccggccagcaggcacgactccgcgatgaggaatgtcaacctgagtagaagaacatcaggcagaatgttcagtaccccagtgtgcaaaaactggatggtttggatgaaatttgtatagattcgctggctgcttaactgggtaattcaactgtttgatatatagagatcattggatgaataaattgaagcatttgaagatgtcatgctatgattcttatgccttatgctgcttgcaatttttatgcttttgttttgggggcaaaagtgagaattcaataaattcatgcgttcatatagcagtctaattagtacagaatcatggcagtaaaagtatttttcagatgctgtaatacatactaggtgctacaatgaacaggtaacacagtacccatgtcaccagcaggtgtatgaaagaacacaagtagaaacatatcaatgccaatcgtatctgaggaatcatagataaacccctgttttctctagataaaaaggacagttaaagggggcgttcggtaaagattgtgtgccaggggaattatcaaagttagggccaggtcttccaaaatagaaaatttgcataatatttctggaaataagataagtgataacccatgaacacgcctagttctacaacaaactgagtaactgcctggagacaaaacaaaaatattttattttgataagtaaaacaaattgactatggttgttcgggtgcagtcatgagaaaacgcatgcctgacttgttagttcggtaaaatgtttaaacttaattctgcagcaattaagcaattatctatattattactttaaatgatgctagtggtggtgtcagcgtctgcctccaacgtcacaagctaacatgtggggccataagatccatacacatgaatgtttttgctttatatatggcattttatgcctaatcaactaactatgctaaatttaagtttttcttttgcttttatctcttataatatccgttgcaacgcatggggcctttagctagtcagtgtagaaacaaatggttcataaacaattcatacaggtagtctgaatttcagagctcatacatataccactgtcataattgtttacaatgtgttgtgcaagaagtttgggggaaaatggtcatataactagactgtatcactggactcacagattaccaatagaaagtaccgactccaaacccaacaaatcagaacagtttagtactagtattaactgaaagctactcgttgattagttgatgaagcttgcccttaatcaatgtgggacttggtccagccggccgtccaacaatttctacaaccactaaagcactaaactcaacggttgagccttgatcagttaacactgtgaaggacatagcaagcaaatggcaacctttacattttgaccaattcagcataagaactccaagatgaccaaagctaattgctaactgtacaaaattcaagaccaaactcccaaccagtcaatttatttattcttaaaaaccatcaacatcatagtttgtattctaccatagcctgctatatgctaacattcctacaattttgccccgtgtgcacccctaaataaattagcatacaatatcagcaatccaataatccgaatgcgcaagcaaaatttaacaaattacatgacattctagggaaaatatcaaataatttgcatatttcctcttcttgagaaaatcttagagctagatgattgatgattcacggatatagaacaactaatttgtatatttcagcacgaatcgcatcaatccgcagggatttcgtgtaaattttaccctcaccaatcaacaccccaattttcccaatccccaagtttggctgagtcgttgatccaacgcgctttcccctgcaccgatctctagtttctttctgacttttcggcaaccccaaacatggacagctagagattcccaagctaataatccctgaattcgcgctgctttgcttgattaaacaacgcgagaaacgaagcgcacgactcgcggggcccgcgcgtcagcctcacgcggggaggtcaatgcggcggcggcggcgagagccgaatcgtggagaggatggggaaggggaaggggggatcggagttggtaccaggaggagaggaagaggatgagagcgcaggcgcgcgcgccgccggggcggagcgcggcgccgcagcagaagcagcggctggagacggcggccaccgcctggccgatgagcagcagcgccagcgcggcggcgcccagcccggtcgccgcgtcggggcggtacacgcagtaggtccactcctgcctcgcgtccgtctccaccctcgccttgccgccggagagagagagagagagagcacaggagcatcatcagcatcagcattagcatcagcacagaaagtcagttcgtcggaggagggggagagaggggggcgcgcaccgatgggcggctctgctcggcggcgatggcgaggccgaaggcgacgacgtcgacgaccaggatgacggccagcaccctggtggagtcggccatgatgggggcgcgccgcgaaacccgaaaccggcggcggcggccggagatctcagatcacctcgtcgtcgtctcgctctcgccgcgggctcgaatgaattggccgccgtttcgtattgtactgcctgccgtttttaaaacaaagcgaggttgaactgttcgggtcgctttttttatacactccgcgtgcttgtttcgaagacgcaaagcttaaaaaagaagtttggaatttgacgatattccacttcaaatttaaaaaatcgacgcaactatttatgtggtgtttggatttagaaactaaaataaaccctgtttaacactaagtcgttctagcatttcccatattcatattgatgtaagtcattctaacatcaatataaatatagaaacgacttacattgttaaacggagggagtaataaaactaattacgtaaatggaaactaatttgcgagaaaagttttttaaacctaattaatccataattagcatatgtttattggcattacataggctaatggctcaatagattcatctcgtgaattagtccagaattatgaaatgtattttgttattagtttatgtttaatatttttaattagtgtccaaatatttaatgtgacgttaactaaaattttagtccctgatcctaataccaccttagtacaagcactgctgacgttcgtgaaaaatacatgccgatgtctcaagattcgcactagtgctgttgatggaatagcaatacatgccgatgtctgaagattcgcgctagtgctgttgatggaatagcgacgatttgatgataatttgataagagtttgaattggaagtttgacgagctagcggagtatcgtcaagtcaaacattctgctcatggcaagttgctcgtatactgttcaccggtttgattttttaagaaatattcacataaaaattccttgtacgaaacgtatttgtatatcagtttagtataaagctcacctaaacagctcataagaacggaaccttagtaacgtgcattagtacttcatcatccaagcagacctgctttcgatccattcatcgcttattcatttcggcctttgggtcattttgtattacgaaaattcttaaaatcaataacatatgatatatacaaaaaaaaaaaactgttcagcaaaatggtggcacttaggtactgtacttaaccataaaaaatatataaatatgtaaagaatgatacaccataaatataacgaatgaactattttttatctgtaaaaggccgcgacatgtctaaccattgccattcaacttaacgtttagaacagcacgcaatatcattttagacttaacacttacattttatctacacgtaaaatagtttgctgtctatatatagctaagtcacatctctctcctattgttctcctctattttcatattttcacatagttttttttgacaataactttcatgtctttttttaaaatgaaataattttgatcccagattagcaataactctataattaacacagtataaagcctcatgaagataactcgaaatctcgcgggacaagcgcaaatattagacgcttgggtaaaagttgaatggtttttctccgagcaaaaaccattgaaccacctgtgctattctgtacgttggattcgaaagaacctcaatgaacggtccgatctaccccccctctctccccacttgttggcccaccatcggcccatggaccaaaaagcccatttcctctcgaaggccttaaacccctcgcctctcctcctccctctcccctcctcctcactagggttttaccccccaccttcccgccgaaacgcgacgccgccaccgccgctcgccgccgccgtcgccgtcggcggcgctctccctccctccccctctcccccccgcacgcgcggccatggcggccgggaagagctcgtcggcctccaaggaggaccagtacgcggcgctgcgggagctgtaccggccgcacatcgactcgttcgactacttcatcgacgaggggctcgacaagatgcttcagtccatccgccccgtggagatcaccgtccccaactcccccaccaccctcagaaatatccttcctgcttttttttttttttaccttttgctcgtcgcttacagttcagtggaccagttttttgtgtgctagtacgaatttaccagtttttccccacccagcatccaaaattcaattcttatgtgctacgaatttaccttaagacagctctcgtgctttccgaacttagctgacaagttgttaataaagccaacacccagtagttccaacatagagttactaaggcgcaggtttgaattcgttttcactctcttacgaggacaccaatagatgaggtttggaaggactgctatatttgtggatgctaattgtttgtgtacggaatgaactatggaagtaacttggttatcatctcattttcccttaaccgtcgtctatactatccttggagaaaggtcatctgttcccaccaaagagggatggtcggttggatgcaccgctctacccccagcaggttttgctatatggacttatcaaatccctttacatatcattttcattttaaacacaagacatttgtttaatctattgaaaactttggacgttctttcctgtttggatgagcagtgcaggcaggcacggacgacgtatcatggggaatttaaagtggatactttcatccaatgtaatgacggaccagctgtcaggcaaaccttcaattttggttacttgcctattatgttaatggttgttaccccttctttgttgtacttcttatcacatttttttcgtaagaacttctctaggtggattttggaacttgaatgagcggctgacagcttagttgagtagtagcatccacatatgagtgcagcttgttatctgcttttaggatctagcttgtgtttctacaattttacattagtctggcaccccaataagtcttggttaagttcacctgtctctttggtacaaaagctacttctgcttcttcaagtcaaaaaatgaaaactaagctatctaatatgatatagttacctggaaaaaaaagagacttttctctatcagttgggtggaaagaatcaaacattatgcactttattagtgtcatgatgttttgtcagtttatagctttataataggccaaaaatctaaattaataagcatgattatgcagtttttgcggttcagtgctgctttacaattctgacactaaaatgataaataatagctgctttgaataatttataatcagttgttcgtgaaagctgatctgcaattctgcatgcatcatactatgctgcaattctgtagagttaggaacacccaaagcatcgatattaaaaaaagtgcagatacatcacattttggtggtagccatagacaactattattgtttcttccttctggaagctatgcaggattcatttcacgttccacttctctctacaccaccttatttgttcttatttgaccgatggttttgatttaattagtgtgaattgtattctattcttgtttatgattttatgctcatgcaattccagtcaaagctttgccatctaagaggtgcagattctgaaaaattgattttccatggtgaagaggcaacagaaatgggcgggtgagtatgttatgaacttgtttatttgtttacattctcttaattatgtcatcttcttccctttctatcatttcttagtacaccgatcatttagtctagtcattcaacttgttaagactacctgtggatcttattgatcgattcattgtgttatgattatatcacattcactcttgattcttctactgttactgaacaaattttttgacactgtttcctatgttagtgtattcattctgatgcattttgtaaaattttctttcaggtacttcatatgtggtgggatggagagacttgtacggattcttattttacaaaaacgtaactatgtaagattactcagcttttcttttagatttatgttgcaaggctaatattagaaaaaaaaaacccagagaacattatggcaatgaatggtttggtgtgaattttttcagcctatgggcctgatccgtggctctttcgttaatcgtggtgctgggtacactgacaaagcagtgatcataaggtgccatatacttgtctatagctgcttatgttactgagtttttttgctgttgcaagtatacttgtctgtgtatctagttgtaccttttttatgttataatccatatctagttttttttgacagatgtgtccaagatgatcagtccagtgtgacaataaagctgtattacctcctaaatggcagtgcaaggcttgggttctggtaagttctgcactggcaaattgtgagtggaaatgcttgagtttctttttagtttttggaacttgattcttgaatttgtgcaaaattcaggttgggaggcagagaatttctccttcctgttgggattgttctcaaggtatatatttccttcatggggcttattgttttctaactggaaattgagttaataagctttctttgtgcatgatcaagttttacaaatcattgctactatatattgttggatgatgatgcaatctacagtgacgacctcaagccctttcttgaaatattccatatttttcatttattgagtaattaagctgtattttacaaactttttttttgttctaagcgtttcattaatctttcctctttctgtagtttattctgttaccttaccagataatttgatttatactctcactattttatttaaaaagtaatattttgattgtgcttctattctttgatatttagtgtaggttggcagtattcttaatgtaactttaacagtacattgacctgattgtgaatttacaaatgataggccctaattgatactagtgaccgggaaatatttacaagcttgacatgctgctacagtgatcattatgaaagaggaaagggagttgtcagcactcaacttattggtgaaagggcacaaataattcttgacgaagtcagagacctgtctctttttactcgcacagaatgcttgttgcatcttggtatctgagagtttaatttgttctatttgcacaaatttttgaatccttcttagtcactgacatcgataattatctttgaaatgcaggaaagtacttccgatctgtgatggaaggatttgagaaagatgattttgaaactgtaatattggatgtttaatctgcatttgtctttgcatgttgttgaaatttggatcgcttcactttggtcattccacattgtgtaggttgctgaggcagttcttaaggactatatttttgttcacctgcaaaacaaccatgacaaatttaatttattgatgtaagttgaagttttattgctcttttctgtgaatttctatccttttgaacctctttaatgatgtgtatctcttattacttttcacttcttagatttatgctgcagaaactttatgcgattgtagatcaaactgcgtcacctgataaagctgatgctctacagtaccaggaagttctcttgcctggccacctgataacagtttttctaaaggtcactaaaccctctgccgtcaagctcatgaccttttttttttcctttttgaaaatcaactccatagtactacaaaaatggcattcaatgttatgtgcttagtaaaaacaatactataacataaaatagcataagttttttgtcttaacctttctacccttgttcaattctctgcctctaccttctctgttacatatttgcatggactgctggaccatgaccaattgaccagtgttagttacaagatggatgtttttaaactgcttggagctggtgctgatgtgttccttcaagcataggtgctaaggtagaacaggtcatccagcacatactatgttgatagcttgagctagtagtcctttgcgttcatattgactactacctccgtcccaaaatataagggattttggaatcccttatactttggaacggaggtagtacttatttcacgctcctagtatggtacagaagatctaggttattaacagtgtaggcatggtagtggttacaggtagtacgaagatgtttttcacccaattttgctaaggtagtgagttaagtcatattttgcttcgcacttttgctgtgcctttgagcttatttttttattctatttgtttcatctttgttccctgtgagcatcgcttgacgctggttctttgatgtcctattttatggctgagattttgttggtgttgcttttgatttcttttctgacatccagttctgttttcctaactcttgtttttctttcctatcatctccaggatagacttcaagattggttgagaaagtccaaacggttaattgttgaagaggctacaaaaaataaaagctttgatctcaatgactgtatgtttactctatccatgtttttatacaggaaccctttttagttgacctgtgtttctgaagtatactacatcgatactagaatccactaatgatccatcagcgagtgaatgctagtgatctttgcattcatatgatccaacaagtcttcatatggccagagacccagagttgtttatgggttccaacatctggtgtactctttataggagtggacgaggggtagcctactatcaccactgttgttattgtcttaggaaccaaggtctagacatgcttgttgggactaatttccataggaataagatcagtttggttagtatcacctatttccataatattagttactccctttgtcccaaaatatagcaacctagtactggattagtcaccacctagtattatgaatctggacagagaggggttggacagagggctctgtccatattcgtagtgctaggtggtgtctaatccaatactaggctgctatatttttggatggagggagtagtatatatgttaattagtatcctatattttatagaattttttggtttagatagcaagttaaatatttgatttgtttggaagttagagattttattctggagggtcaagttaaagggacatcaagagttattgagacatctagtggaaagccttgctggctgatgaggattgggggtagggttctcatagcgaggactgggtgtaggtcatctaactgctgttttgagtcttcaacttttgattctcttggctgaactataatgggtgcgtagtgtcctgtttttaggaagcctggcttgatccttaagaatataatttctaccatcctaacaaaccaaatctctaactttctatctgaacagattacattttaacattatagaaattgctggtactgaccaatctaatcttatttgcaatgaaactaatcacttataaactactaacttgttgctgcagtcatcacgcctagaccttggacccctaaacaggcttttgtctaataaatcgtgttgcatgaacactgcattctctgcatttatggctagtattggtagttgtacaagtatgctaaactcttgaactagtaatcattaacatgacggatcagaaactacagaccacaagattaatcctaacagcagatcccataaaaataccagctacaacttttataacagttacgactatttttcttttgtgcagcacaggaggtcaggaaatttctcagtaaaacttcagcatatgttggcaaagctattcagagtatgataaaggtcggaaaagtaaattcacaatcagggctagatctgccacaggtgcatctcttacaaatgcttactgcatctggtattttaaataacatttggcgataatatactggcaaagtcatatagcataaaaacacatcgtgatgcactaattgtaaaaacaacaaagaactaaatcaatttgcagtgaagtgatttatagtttactcaccttttcgtgaggtatatattttttctcgtgagtgaatttgtcgatggttttccttgtttgctctggtttattgcatcacactctcccttgcatgtctaagtaacttccctagtaactattatctcttctttcaaaggtatttgagcagggatatcatgtccaccctcctatttttcgaccttaattctttttcacactcaattacacctattaatttctgagggaatattaaaaattacgtaatgctgtgtatatgtcaacccttcaagtaagttttcaagatgaaagataacaatatgcaaaatgaattacgtcaaaaactgaaaacgatctgttcaaaagtatcactgctcactacacattatattgagttacagcagaaggtatcatgctgcggcagcacagtgctggagatggccatggggtaccggccactaacccaccgcttcaatgctggctataggctgttttgaaataatgaaggcatcacttacccacaatttacattttagtttttcagacaatatatcccaagtaatttgttggtaactgattccttctcttctgattaagagatgcttgacacgagtcacagattatgatatatgttcgtagtaaaatctcttggcaagaacgttcattttcagttaagttcaatgttgtttgtgttcacagtcctctcagatcatttttatatgtgataagcaccttttaaaatttgcagcgagatgggatgaccattcatgctgaac
